United States Patent 10,724,096 (METHODS AND COMPOSITIONS FOR INHIBITING AND TREATING NEUROLOGICAL CONDITIONS) - sequence listing, part 38

SEQ ID NO: 765 - DNA, 730450 bp, Homo sapiens
aggcagggggcggcaacatggcggagtgagcggcggcgtcggggcttcacaacaacagtggtggccgtagcagcggcggcagcagcgtcaatagcatcggccacagcctgagcttcagcaccggccagcgtcgtggccagctgctcgcgtcctcgggcttctcggagcggctgcagcatctccgcggggggcgggccgggccggacagaccgggagagggagagagcagaggcagcggcggcggcagcggcagcggcagcggcacacctgctgggcgggcacagccgcttgcccggcagcggttagcggtaccgccaccgccgagaataagcctgcggatcccccgccgcctccgcgggggagagcgccggagcgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctggtaaggaaaaggcgtgctctcaatctgcttccccagtccccacatacaccgtccccagcgcctttccctcccacccttcacccccagggtcacacgcgccgcgcgtccctgggagcgcagagcgttcagccggtattgcccagcgggtgacctgcctgcgcgctgctagagccacgccacctccctcctctcctctttctggtcctctcctgccacctgagcgcagtgcccaacttaacaccgcttcttctcactttttaggaccgcgagtaacccagtacccgcggtgaaggttttgggtcgactttagagtttagttaggaggtgaggaggcctcctgttctctggggttctttttctcacacttaattgtccttggtgtcgctctccgaggatgacagccttgcccctggagcctaaattcccccgtgctgctgaaatgtgagaagcgcattagcttccaacttgagcagctggggtgtgatgttttcgaaggagacagaaaatgatgcagttttgcatctgtctttaaatattccaaggccatgatggagagtgttgtgtctgtatccatccccctccatctcagaagcagccgtcccttctttgtaatattgccctgaatatactgatctcttagtcattttttgtgcacacaaggtgtgtgaggacaccaaatcacacaggttgatttctgtggttactttcagtagtgtggcatgtgggtaaagactaaaggaaaggttttaaacgcagccctaggttttggttcctttcatggtaagaaagagttactgcagaagtgtgtatgacttaatgttttgcgctatctacagagaggctcagaagcgtttaagatgtcagggaaagaaatggaaagaaggagaggagaatcatacattgaggataattaacagtagttcatatttagtgctttgtaaatggaggttttgttttgttttgttttgtttttaaatgcagccaagctttttaaacagttttctctgcaatagatctagtctttgacatactgtaaggttgggctttgggaggcaagacataaatcgagagcaatcagttgagtattgtatttggtgtggggtcacaggaatataacaatatgcttacaggggtactttgtaacacccatgcagtcatttttcagctaagcaattatttttacttactctattggaaaactgagagaaagctgcagctacatcagtggtgtcctgagacatgcattagataatgtctacggtttatgaacctcgtaaatgcacagaaaagttgaagctgtttttttccttttgctagtgtgtcaggtcaaaggagattatctgtctttgttatattcattgctgtttaaaacaaaacacctctttttacttttttgtacctttcaaataaatcatcatgaaaagtcagtgtaagtttgagggaatgtcactaagttgatataaccaagttcttttcagaacactactagaaatacagttttcttgagttttaattttaactagctgcaaataagaggtcagtacttgccatttctttttaaaagaagataaatctcaaactgttagtatgttagcaggtaactgtatttctgtaatttaaaggaacacatttttagttgcagttttgatctaaccaatatcatttttaagttagattatattaggctattttagtaagtattcctatgcttacttaatacattttaacctggtaagaggcagtagagctttcacaacctggaaactgatttgaatgtataaccagtttggactctgcagcagtagcaatgtgtgctgaatcagttcttaacagatggggttttttagatatacggtagactaagaaaggaagtgaaatgtttctcttgagataaaaaagaaatttaactcttcagagcaatgaaaatctgacatgaagtttcagtatgcagacgttattttagagaactttaccattaagcttagagtcactagaaataaagtaatactgagatagtatatccccaaatctacctaagattttgtaactgcaatgatatttggaatttaaagagttaggtttaaaatttctttgtatgtatttaaagaatgcaatagatttttaaatagaaacttttggagaaaagaataaatgacaaaaggagctgtttattactaagttgttaattatattaattgtggagtataaattagtcatttgaagtgtaattttcttgaactgtagatttagggctttattgtccaatacactcatgaaaatgtcatatgaaaatttaagtggattctcaaaaatatgtggaagtcatgggcatttaaaaaactgattatcaaacttaattctatttatttagtaagtaaaccaataaaattcatataggacactcagtgactcgttagagtttggaaacctttaatattaaatctaaaatgattttttaaaattttcagttttagtttaacacattaaataaaaatgtaaggtgaaatagtgaaatacctattactgtgccctgaatgacagaaaagaaaggagaactaatgaaacttcaaaaaaaagaggagtttctaccttaaacaatacctttgtctcagtcgcctttgtcagtatatttttctttctttttcctgtttattttttcttcctatgtaaggatactcataaatacttggtttttaggtgctgtttctcacatgccttggccaaagaattaaaagctgggcagagtgaagttttaagcatgcactaaagtgtaggacttcttcaacagagcggtggctgtaatttttctgctttgtttcccaaaggtctagagacctatttttactactaggtggattgtgggagtttggtgaggaatcaccaatgtgatatgatataaaattagtcatttttattagagatgtatgtattttgtataatgatgttatagttgacttaaaacagtgaaatatggaatggataatgttaggaaggtaggtaaattagtttgtgaataaagttacagtcagagtgcattgtcaaggattttgcattgtagctctactaatgaaagaaactgatcgttaacaaagtttggcttctggaggaattatttaaagtggcaatataagagaatttaactacagagaagagattttgttgattgttttcagttgtaaaactggcgtactacctaatctattacttcttttgtaaacacacttaacatatgtttatataagctttatccatatttgaagtaaaagctatgtaagtatcgtgttattgttgcttataacatggaagtttcttttataaacataaatttctagaaaaatatgtttataatagaggattaatatttacttagtgaaagaattcataatttttttggaatggctttcttatgtgtatagtataattctatgattataattatggaatttaattatagacaaattttttatgaataactgaattcatgaaattttttcatgaaattttttcatggatttgtagttttttttcatgagttacagtgagttatatcagtgtgtccagttgtagaaaatgatatttcctctgatttttttttttttttacattctaagtggcatgctgttggctgaactggaagcctaataagatgctttgaagggatttgtggtttaccaaatttctctcatcttggcttatggatcatggtatttttgttaaaagggtaactttaaggttttttttttttttgtacttgaatatggcagtaactcttcttccttagagtttttttaaatttgcagcttgatagtcataattttcattttaaagatatttagaattttacaaacaaggtgtcttctgcatttgaattatatttatttaaaaaatatacagttgcatcttagaatcatggaggtccttaatactaataaaaccacatttatattaaaataatttcctgcattttaatttatgttgatatataagccttttcatattaatttgagttgtattttattctcatgattgggtatggaaaataaaattcaggattcatatgtaaatgctcgaggtttcaatatcttaaggagttttgagattttccttagaaatattaatttagtcacataatgacactaaggcagcaaatattctgtggtcagtcaacgatcaagttatattaattttaaataaatgttttgtgtattgctagctgctttttggtaaatactatgctgctaattaaaaatatctcaaggttctttattcttttgctatacttttcccaaacagtgtgaaataatttattgggtctaacagacccagtgcccgttttgtgtcactggtatagctgtattataaaattcagtcacctgcattttttttttaactatatactgaacatattgttatgcattagttccaggttttccatttcttgtctttatacaatgtcagcatatctctttggcatcacatatcaccctgtagcattgcagttatttatgtgtgtttcccttcctaggctgtgaactccatgagggcaggaattgattttatgtatatttattttttgtatttctaggccttggataagttaagtgcgtttgtagtgtgcaggacactgtattaggcagtaatgattatggtcagtttctgaagttatgttcaacattacggtccagacttaggatcctgaaataaactcatatataaagtcaactcatataaactttatgtatttcttattcctcaaactagaaatatgtgttcaatgtgtatgatattacctgactgtgtaggcattactgcatatgtagatgttattttgaactggcatctgttagtaagttcgaatctggtaaaaacttttcagtaaacttttatgtataatcaaatataatcacataacaaggtcatgttgttaacaaagaaaatacgtaatgcattgaagagaaattgtagaaaatattgttagcatttgtcatattgccaagaatagtggacatctcttgtttttgtgtgtctggcgtacatgtcacctctttgtagtggtacctcagttttcctttgatgactcacttattccccatttgtagttcagctggtttaggtgggtctaccccactgcctgccttgagggtcagacatctaacctaggtgtggcaagaattgtggtgattggttcagggacaaacatttaacccaagggtagcgagccagagtaggttccaggaattgtgctggaaggctttctgatggggatgctgaatgtgtaaattcttaagagttgtaggtccctgtcttagaatttgatcaggtgtaaagcaaacaacctcatgattctgttggagaacctagagttctttatgtctgtggtgattatcttctaaccattaaattatctcctttaaaatttactattgttatttatttcaaatcagtgtaagttgggttttttgtcacttgtaaatagaaggaatccccagtaacatagacattagtatctggaaatgacacattgtaggaaacagaccttagattttgaaatggagtggaaggcagtgagaactttgtggtcctctagcagttccgttttacagagcagctgtttaaattgtcacctgtgttatctttgtcaatggaactactgaggttggaattttagggatgttggaatgttttggtcactttttggggtctttgatacaatgtcttttaagagagcagttaacttcggtccaagttagcatgcttgaaagcaaagcagaaagaaaatgtagcctttccaaggcagagaggctctttctgcctgtagctgccatccaagatagcagagaattagaatattaaagctttgtaggtcataaaggcctaagtttttaccccgtgctaaagttggcaagaggaaagccaagagtttaaatgagaaccaaataaagttctgtctgataagcttctcccaagcctcgcatgcagtatacgccagccttctgaccaaagtaacagtaatccagttgtgaagagctttaaaataggatgcaaccagggagcaagtgatagaatagctgtgcctcctcacccagtttattgtttcacattgcttcaaggaagatcattaagctgacggttaaggggataagagtactgggaaggcctattgctatgagactgaaacttaaaagctgacaagatcctgacaggatctcctgttttggttgcgaattcaactccttttacttaagtaaattgacgaaaaacttaccaaagtttaaggaagccatacttctagagaaacctcaagcctggtaaacaaaggcctgcattcttttacttctaaggcaattctaagctccagcagtgtagctgctagaaggaaaatctgcgttatggaggctaataagtgagatcttctgagatatagtggtagtgaatgtgttcattttggccgacccaaggaattccattagcaaggacagggaattcttgttactctgaccaatgatatatggtttatgctttgaaattagttatcatggtgtttctttaaccttctccagtcttctaagtgcagttattgtttcttaatgttcttttaccattgtatattaattagaagttatagttaaattcattatatagctatataattggtcaggtttgaggtaccaccaagaagaatattgtcataacacaaaaatttcagacttgaggttagatgcagtaatttgtctttgtcttttttcaccctctggtaaggtggtaagtacactttctattgtgtctaagatagccatgttaaacatggatatttaagtagttatatgtatgaaaagaagtgagtgtctgagatgggtgggtagccaaggactctaatgttatagatttctgacggttttggctgcctagcatccattctttctgctgttaacattctcgattttttgatactcttttagggagtcattcttgatttttatggtctggggcttcactggactttatcctgctttcctggaccagacagagaaactgacgtctggcccaacagtaactggtattggttataaaatttagctgcatttctgagacagcttgataacttctttctgaagaaagaaaaaggtgctttcgctggggttgctgaaaatgttagaatgtaagtctagaattgattgcagtctgcaccatgaagtcagattctacttgagaacagagctgttaaagaggcacctaaaaccaagccatacattgctgatggcagctttggatcccctcaagtcagttttatctccagatgtttcagtgcatcattttgccttaagccagtttgagttgggtttctatccatttgtgccccaatattctaaattaaaaaatatttaaatactaatgtttaaattaaatattctaatattctaaattaaaaaatttagaatattctaattttctaaattaaatatttagaaatatttaatttctaatattctaaattaaaaaaattttaaatactttaggtattaaatattacaggacgaagcataagaaaaatgtttacttgtcaaagaacttgatatatttcaagaaagaagaaatatacatgtttaattaatataaaaatactcactttggctaaataagaacataaggcaacagataacatgaaaaggaagtgattaaaaagaaatgaccagctggtcatggtggctcatgcctgtaattccagcactttgggagtctgaggtgggaggattgcttgagccagggagttcaagaccaacctaagcaacaaccctggaggttgagtctgcagtgagctgtgatcacgtcactgcattccagcctgggtgatggagtaagatcctgtctcacaaaaaaagaaatgatgattgtttgctagggcaagttaaaataatcttaaatgctctttctgggctcgtaaactgttacagctattccgagtgacattttaccaatatgtatcaaggattttaaagaggttcctataatttattcttagttctttaggctaaggaaaaaaatacctgtggacaggtatgaaaattaagtgtatttttatgatataacatgtggcaacaacttaaatgttcaacaataggaaaacattaaatatattatttttacatccatgttatgaaataacatacagctattaaaacattctgtgcctcagtttctttgtgtgtaaaatgggatttcaaccttataagatagatatacaggttgtacagattaaatgggttaatatatgtaaagtgcttggtatatagtaaactttagttagtacttactattgttgttttagttattaccttggtcctgagaatcacctgaccatagaaagaagtaatgacctaactgaaagtgatctgtcctattttagcttggagtacctgagcctagtgacctgtcagggaggggactcttaggtacacacagatcatgatctcctgctgaagcacaggacatctgttgtcttgaatcctgcatagtctttatcagtgcctgaggtagtttttctgatttcttactttgcatgaggagggtgagaaactggggatggaagaggcaagaggtaacaccagttcctttgtgtggagtctcttccatctcttctctcacagggctgactttcacatgttgatgtagtaagacatgaatggtgatccaaggcaaatagtaactccctctgggagtatttgcttaaatatttagaagactacttgggtaacaagtctaaggggcaagttaaaggattaaaaactaatttatgactattttagaaactaacattagcctatagtttaatagctcttaactatttacagtacacttgcggaattgaacacagcagtgtcctctaaccctcagaataatttccttttatagataccattcctgctttacatatgtagaaactaaggctgtagaaaatgtgaagtaattagacaaggttatctaggtactaagtagcacagctgggactcagaccttcaggttccaaagctagagttctttcccattactaagcaaatgtagctagtacttagaaattatcccaaaaacagcatgtatgaagagatgatgttggaaggggagggaccagccagcctcagtgagttgattctctggtagggaatgtgtcccatagacaacttaggacaggctattcagaggaaattaaaaatgaatgcaggtcaattgaatggatttgtacactaaagtgacttagcaagaactgtaccatgagttattaatatttgagttttaggaaataattggttatgtggtaaatggctttgaattttatacattttcactgggtataatgtggatacttgagggattactctgaaccagaatagtagtatgcattaatatattatacagaaaaagtaaattcgtgattttcttgttatatattggaggtaattatttgaaccactgtatataccatatttgcttgaataaaacaaatgagttatagaaggaattatactagcatctgggtaatataatttctaataattgtgatttctctttcagtttatgaagatagagcaaacattggttaatagcaaattttatgggagtaaaaatatctagatatatttctctttagcaaatactttcattttctgagaaaaataacgcagcagattaaaagatggtatataaatatttttatgttatttaatttttttacatttgggaagggaattggcatttatagattgggtttgggttcatatcttatgtttttaatgtcctcttccaactcctttgaaataataactaatctataactgaggttaaggagcttgtccaagatggcaaaattgcttagtagcagaatgagatccaaagttggatcttccatttccaagttttgctatttaaatacaccattacctttgataatgatgatgatgacagtgatagaatctttacatgtcaggcactgtgttaagcatatgacctatgttatcttatttaatcatcttgacctatattgtgaaatattcagtgaaataaagtaattgtctttttaagctaagcaagtctgctgtcttaaaagacaagtgttttcaactctgaatatataaacgatacttgattataaaatgtcatagaattatttcacttaatttatactaattctttataacttgatccccctttcaaagtccttgactttaaatgaagtatttaaatttttttaaccttaggagatatgagttatcagtacaagaatgttccttttattataatatattgactgttacttgatagttgttacatttctcaagtcatcatattcttccatcttttgtctaaagaacagctcatctttcaagatttagctcttacccctatttaagtgacgtcttccctgatattcccctaaaagctattcctcccaacatgtactttcccatagaattttatacatatttcagatttagtacccacacattctattttaaattacagttggccctctgtatccatgggttccatatccgtgaattcagtttggatagaaaatatatgagaaaaaaatggatggttgcatccatactaaacatgtatagactttttaatcttgtcattattctctaaaccaggggttcccaacccctgggccacggacctgttaggaactgggccgcacagcagaaagtgggccatgggtgagcgagcattaccacctgagctctgcctcctgtcagatcagcagtgccgttagattctcaaaggagagcaaaccctatcatgaactgcgcaagcaagggatctaggttgtgcgctccttatgaaaatctaatgcctgatgatctgaggtggaacagtttcatcccaaaaccattccccctgaacccccctattcatggaaaaattgtcttccatgaaactggctcctggtgccaaaaaggttggggatcgctgccctaaagaatatagtatagaactatttacatagcatttacattgtattaggtattatctggagaggagttaaagtatacaggagggtgtgcataggttatgtgcaaatactataccattgtataccaggaacttgggaatctatggattttggtaaccacagggggccctggaaccaatcccccagagatatcaagggacaactgtgtttgtttacttatcagactgcactagaggctctgaatcttttgaggatcagcacattatcttaccttgctattatgagtatttaacatagtatctggcattttgtggtgtttagtgaactttactgtggatattttctctcatctttggtatagttagtttgcttgtttcagtcatattcagcttcggcacaaatcttatctttgcaggctattctgattcttttaatttctacattttcctcttgctttaacatttcagtttttatttttgagtgggggatgattggtgtacctacatgtatgcagttgtcccttggtatccatggaagattggtttcaggacccctcaggataccaaaatccatggatgctcaagtcgtttgtataaaatggcatagtatttgcatataaccaatgaatatcttctcatatacttcaaatcatctccagattacttataatacctaatgcagtgtaaatgctaggtaaatagttgttctgttgcagtgttgagggaagtgacaagaaaaaatgtacatgttcaatacagatgcaaccatctattttttaaaagaaatattttcgatcccctattggttgaatctatggatgtagaactcatggatacagagggtccactgtaaatacatggtttatattttaaaaaaagttttctggatatttgagactggtaaggagtcagagtgtttttggatctggtcaatggcctgactctttcacttgcatagatgaggaaactgagaaccaggtaggttaagattctatggtccttcacagactaggaattaacacccagattccctgacccttcgtccagttcttttttcattttatcttgatgactgtagttctactttgcttaagctcagtttctgctttataactttcatatggaaacttccgtttttactccagcaggctcagaatacttaaaatgatagttaaataaattactgattaatcctaatctagtgtgctattgctagagtcaagatacttcttgggtacataaaagagtaacataattcataccttcaaataacttgaaattcagaacagggaatggaagaataaacagataaattataatggatgaaagtgatattgtagagatagaaacaaagtgctgtgggaacattaatggagctcctaactttccttggaggagttgggaaggcttcatgggtagacgtcttgtgaaagggatctcgaaggacaagtaactgttccaggattaaaagagcaggaaaagaacagctttccacaaagggatagcttgcacagtgacaagagccacgaaagagtgttttcatggttttttgccttaatgctaactatagactacagtaaattaaatcaactttatttctttttgtagaaatcatttttttttaaaattctagtagtacagttgaccattcatatctttcagttaggaggagttaattaccccttcttgtaggagggtcagccttttgttctgtttaggccttcaactgattggttgaatgaggcccatccacattagggagggcaatctgtttatacagtatactaatgcaaatgctaatctcattcaaaaacaccctcacagacattcagaataatatttaatgaaatacatgggcattctctggcccagttaagttgacacctaaaattaaccatcataagaggtatgtattttttctatcaactctcccttttatttgactgttgaaagatatattgttatacccattgcagaaaaattataaacctgtgcacatggtaggcatttaataaatatcaaatgaatgaagtacaaaaatgaatgagactcactggcaaagaaaaaagacgactttaattttgagtatattgtaattctgaagagaatgtaaagatgaatagatgaaaattaacattttaacatttggcatttacgtttattttcagtagtctttgaggtgaatgatgattaactttttaaggaaattagtgttttccatttataaaaaatgaaatttatatacaaataatcaattttttataagagcaaaaaaacaatggttttgaaagtcagtgaaagttgtttttttttttttttttggtcattaggtttattcccaggctggcctgatatgttcaaattcttgatatctttatctttttatagaggtaaaatatacataacatataatttatttcaaccctttttaaaattttgttttcaattgacacataattgtatgtatttctggggtctaatgtgatgttttgatacatgtatacattgtgtaaaaatcaaattggggtagttagcatgtccatcacctcaactatttataatttctttgtgataagaacactcaaaatcttctggttattttgaagtacacagtacaatattgttaatcatagtcactgtatattttaaccattttaaagtttacagtttggtggcattaagtgatttcacgttgttgttcaaccatcatcaccatccttgtccagaattttttcatcttcccaaactgaaatcctgtgcccattaaatagtaacttccatttctcctctcccaacctcgggtgatccgcccacctcggcctcccaaagtgttgggcttacaggtgtgagccactgcacccagccaaaagtaatttctacaggactcagattctttagttctgtttctttaatatcatgtggaatatatatatatatacacacacacacacatatatatacacacacacatatatacatacatatgtataaacacaaacacatacacacacacatatatatacccaccatagtgatatttatttaaaaattcattttttcccttgcatttgttttgttctcatagtagagctactcttgattctcttatcttgaaacttctatgtattgctccacacctagccctaaccctgtattttcatagtattccatttccttcatctttattacaaagcttaaaataattaaactgggaagacagtcttaaaaggtgagggaggtgaagagactcagcaggccaagccagaattctggcacaggaaaagaaagaccacgaacactcacacatgtataatttttgttttgtcacctaaaaatcgatttgtggacaacaaaactaatttgttatgtatgattaagcctgatgatttcacttccttactgaatattcagcagtgattttatcccaagtcctcctttatctaaagcaaaatacctgtaattcatcttttccttaagagattgtaaacatgttacattaaacaatctgaattttaacattaaaaaaaggtaaagcaaaaacttctatttatctttcatactacctgtctatttataggcttctagagagcatgaccaatatctatttgaacttattttatataacatataacttctgaagatacgtgttttcgctacaacccctttgtttttgtatttttaagaaacaacataaatttattacctttattatagtcctagctaatcttaaataacttacgcaagacttatcagccatggatatatttataactcttttgagtctatttatagctttatttgtctctttgtttgcttctttttgtttgtgtacagctatactatccagtgtggaagcccatttcttgtggcggtgagcgcttataatgtggcttttgagaattgagtgttctttaagtgtaaaatacacaatgaatttcaaagacttagttaaaaaatatatcttattaataatgttttatattagttacatgttgtagatatattgcctttaggttattttattataaataaagcatacttattaaaattcattttacctgtttatatttcttttaatgtgactacttaaattttaaaaattatatatgtacctcacattatatttcttttagatagcattgttctaactgaggtaagtcagttgttaggtcttatattggagactttgggagacaaattcatattttacatgattttatgaactataatagtcacttgtcctttatctttggagcaaaaacgattcatttttatttataatgaaattagaggatattcatcagtaagaaggggaggacagattcagattaagttttgactgggggaagtgacaatgggaggagaccctctaatgcctggtaaagtcaggcctgttatatagtaaacatttgatacatattaattttttaaaaattgggtcaggatttgaagaaatagtaataataggatatttcacaccatgaatagagttatagtttaaatgcataggtgtaagtttaggccctggggagactggaggtgcttttggtttttactgcctgcccttgagagtaggagctagaactccgggcatttgtgaaaaatgaataagagaaaaggtggaggaagggatgagagtaagtaaactgagagtgtttggaacttatttctaatttttgcagtctcataaaatttgatttccaagaattgcaatagtttatcaaagtagagttaaatggcttgctaaaactgagaagaaaattcaagttggtctgatacagttcagtattctaagatcaggatcaccatgaatatggatttttccttaactgttttggtagcagcactattatgtcaaacctttctttttctgtaaggatatcctgtcccctcaccacctcctaaaggaattgtttttttccttcctgcaaattgagttacagttttccattaatctgcaataaaaattgaaagtatgttacagaaaaaataccttagaagccaggtcaaatagtattatatgtaataatacagtaactaattatgaagtgctatgtttatttgtcgtgttttttaagagttgaggtttaatgattcttttttttaccaaaatgttacttttcatattgtaagtttctttagagtatctattgctatgaataaaatattctaaggtgtgaattttatgtttttttcgtaggtgttaatctgttcacatgcttgtttcattgctgttgttgttggaagtcgtccacctggcagacaggaagctctgcttgggtgggattggaggtgcagtctttcaatactggactatactaagtatagattccaatggcaatgtaattccatttccttggcctcattaatactacatagcagttcaagattcctggaatggtcataaaattcttttgaactattaacagtttctcatccaggccttaggataaaaaaaaatgttcatttttagggtgactgacatacttattttaggagtctgttgagtagctgtgaagaagcattttttctttttaaaagtactcatttccataagtgtcatagggagtatgttgagcgaataggttttggtcagatttgctgatgctgcataatgacattttggtctacaatggaccacatatacaatggtggtcccataagattatgatggagctgaaaaattcttatctcctagtgaagtcagagatatcataatgtcatagcacaatgcatcattcactgtggtgatggtggtgtaaacaaacctattgcactgctagttgtataaaggtatagcacatacagttatgtacagtacataatacttgataataagcagctatgttactggtttatgtatttgctatactgtactttttatcattattttagcaagaactcaagcttaaaaaaaaagttaactgtaaaacagcctcaggcaggtcttgcaggaggtattccagaagaaggcattgttatgataagagatgacagctccatgggtgttgttgcccctgaagacttttcagtgggacatgatgtggcggtggaagacagtgttcttgaagatcctgacacttcgtaggtttaggctaatgtgtgtgtttgtgtcttagtttttaacacaaaagtttaaaaagttaaaaagtaaacatagaaaaaggttatagaataagatacaaagaaaatatttttgtatagtcatataatgtgtttgtgttttaagctaattattataaaagtcaaaaagttaaaaaaatgaaagtttataaagtaaaaaagtttatagtaagctaagtttactttaatattaaagaaataaacttttttttgtaaattaagtgtagctcaagtatatacattttataaagtctgtggtagttattgtaatgtcctaggccttcacattcactcaccacacaaccactgactcacccagagcaacttccagtcttggaagctccattcatgttaagtgttctctacaggtgtaccatgttttatcttttatagtatatttttactgtatcttttctgtgtctagatatgtttggatatattaatactattgaattataattgtttatgcaatacagtaacatgctgtgcaggtttgcagcctaggaacaatgggccataccatagagcctatgtatgtgggctgttccatctaagtttgtctaagtacactctgatatttgtacaacaacaaaatcaactaatgacacatttctcaaaatgtatctctgttgttaagtgatgaatgactgtattttatcctagaaataatgtttaaccttattagtgatgtgcactctgaaagataaactaatatattttagttactgtatgacaaactgtcactcagtgtgacagctgaacccaattacattgaaaaattatgctgccaaactctgaaataaattgaagatgacctggctggaaaatataggatatagacatttacaacagagatttgaattccaacgaaagaatggttgtagttttggatcggtatgcattttatattttagaaccttaatttattatctgtgtatgtaaaaagattagagcggtattagtgggaagattgtttatgggaataaaatttaataattagatgtgtcacacttgtggcatgttattagttgttaaagagggactctattaatgtagcttattcctgagaaaaaaccacaagtctaataaaagttttgctttatattattatcaggatatgatcagatattaatgtttaacatacactcataagttattaaattatatcattgtccagttttgactcagttattcagtgtgggttactatatttagctcacagatgatctattcttttgctcctagctatttctctgtggcttcccctcctcctgcacgcacccccatataaataccagtctattggatctaaatatgtatattcattttcaatctaacttcatatctggtcacatatccattttatcccacaaacttttattgattacttaccgtatgtaaagctaggcacttcggatacaatgatcaagataaggtctctgccctggagtttatagagttgtagagggtgacaaatatgggcaatgagatgtgtaaattctatcatagaaatcaattagggtattgtgggctacactgaaaaaagaaatctaccaagtaagtcaaggtaagtctttataaaggtgatgaagcttgagttgagttttgaaagatggctagaagctagatctggctacagctgtgtggtccagcatggcggccactagccacacatgtggctagtgagcatttaaaatgtccttagaatataaaatgcacacttaattttgagggctaggtgtaaaaaaaatgtaaaatatctcaataatttcataatatttactacattttgaaatgatattttggatatttgggtatatgtactgagttaatacaagttaatttcacctgttttattttacatttttcttttcatgtggctaatagaaagtttgaagttatgtatatggcttgtatctgtgacttgcgctgtatttttattggctatcagtggtctggagatttctgaaatttttaagatttttaaattagatgaaccattagaagtatagaaagaaactaaaatatattctagcatgccctctttttctctctatgtgtgcatatgtgtgtacatatgtgtctatatatacacacacataacctttatattgttcaagtcattcatactttgggttttctggttatatgtcagtaaacctcatcctaacagatacattgaattaatagcaacaatttaaaaaccacagaccactggggaaaaacttgttctccctactctggcaaaaattgcttaaataattcatggaaatcaatatggcaacaaatttaaaatacattttattgtcagcaaatactttgaaaggaaaattgaaaacgttacagagttgaggaaacaattattagaatcaaatgttggagtttgttttaagtacaatgagagtactcttattcccaacatgtttttatatattatttgctatattgtgtttcttaatgaaataaacaactgctttttgtgagctctataaaaatatatataagtgaatgtacactttcgacagaaattcctgtattccctgcttattgaaaccagaaatcaagaaggaattctacctttacctggaaagcagaagatgtgttttgtgaagatttacttgacttatcagaacaagtctctcttccggtatttagattgctactttgtatattaactgtcaggggcaccatattttaaacaggactctgaattgaatactagaactccagaatgctggtgcttgataagattttaaagattatttagtttttcagatgtggaaacctaggcacagagaaattactgatttaatgtgggatactccgattttaagttgccatactgtggaactggatttcaggtgtttgattttctagtctagcaatgatctctttggttatattaacgtgagtctcttgggtttggctggtgtattagtttactggaggtgtcatgacacatactgcagactgggtggcttaaaaaattgtaatttattttctcacagttctagtggccgcaggactggtttcttctgaacctttctccttggcttgcagatggccgtcttttccctttgtcttcatatgtgctttcctttgtgtgtctatgtcctaatctcctgttcttatgtgaacatcagttatattagattagggcctatccatatgatttcattttatctgacttatctctttaaaggttctatctccaaatgcaatgccattaggctgtactgtgttccccccaaaattcataatgttgaagtcctcacctttagcatatgaatttttggggggatacagtgcagcccataacagctggtcttaactaagcgaaaataagggtaaaatgagtgatagtgataaaaatgtaaggtcttttattagtaatgctttacttaaattcctgtaaaaatgacagttttctatttgtaaacccattgcttttttactttgaattatttcatccttttccatgcttctactcttttcttcccccccccgatatatttttattctcacatgccttcatctgtgcatccaaaggcactgttgattcagtagtatcagcggaaaagcccaaatagttttgactccagctaattaaaagaaaacacctttaaaaaatatatgctgcaatgtttgtagaaaatctaggtcttacttttctttattaatatcaataataataaaaataataataaacctctgttaagtgcatattaggtaccagggattttgctaaatgctttaccctatgactttggtagttttatagatgagggaactaaaggttaaagaaagtgaaataatttttccaagatttcagagcaaataattgttaaattaagcttcagacacaggcagtacttgctatgcttactgcctgttttttagaattcttaggaatttaacttgcaactgtctcgaatccaagctatactctgattgaaattaagatatggaaataacatcatatgttgatagcttttgtggtaactatcgtgtttactatggcaagcattcagcacactgagctttggatgtttaaatatattgaagctttgattcttgaagtcctcaagaatctgtttgcttacccaggcacaaaatcactcagcatcttcacttggcacataaatgctaattcagtagcatgatatacatggcatgtcataatttgcccctgcctgtctttctagtgacattttattttttctcatagctctacactctttagtcataataaactactacacttattttctggaatttaattattcttatggctccttggggttgctcatgttccttagttccatttaggaaatattttattgattacttactaacgcacaattcaaggtttgtttgtttctgtctgcactattgagagtgatgttggggcccaaaagaccaaaaaggagttgtttacaggtggacttggactgttctgaagagaatctgcagatacctatttgtgttttgctaagtggagcttaaatgacaatgggccacaaggagcagggctacaaagggaagagcagggggagaacgttatctatgtctctgggtccattagtaggtacgtgcttgatcccagctggatcaggttaacactggagcagaattaggaacagagggcaatagaaacagtgagtggggaaaggattattgtggtgactatcactttggtgctccatagcggtgcctagagtagaggacccatcacagaagtgttctagcaatgacttatctaggaaactagctactgtaaacttggttatttgtttatttcttcagacttggtgatacatattatggtcttccattaacattatatggtatatgtcagcagcattcttgtatggttttaaaccctgacagaactataaagaccttttggtgaggagaagcagattagtttaaacatacttgtatttctaggtagttgatgggagcatagcatagggatggtatgcccaactctgaggacagaacaggattgggaagatgattcttatctttaaggatttcaagatctaataagagagactaatgtgtaaattaaaaaatactaaataatgtgttcaggccttagtggtaggactagtcagaattcaaatcctggctcttccctttctttgcttgtgactgagtgaaagtgtgtattagataccacagtatcacagagaagaaagcaatgaactatttgaagcagttgggaaagacattaaggtggaggattcccctgagattggctcgaaagggtcagctgcagtttgcacagtagactggtggagtgagggcattccagataaagaaatctgaattggcacagtgtattctaaatagtgttttcttcctagaaatgtttttctttcccagaaaattcatacatattctttagatttagcttctatatttttttatggatccttgtttaactcacatctatctctcaacctcaggagtcacatggttggcaaatgcacttggttagcaaaactgcagttgccatgatcaaggtctcctggatgacaaggggtgggaggaggagaaattaaggtaatgcattaaatgtgtatatttatttataaacacataactaaaagttctggaaaacagttgtttccaaaaccagaattatctgttgttgtttgtttgtaccgaatgtaataaaatgataatgtagttacaagtttttgtaaggtatgttgctaggctgttgactgttttgatttaatattagtaggagctcttcatgagaagaaacactattacattaaaggtatacatcaattatgagttacatgtttatttcagaaatgttaaatatgaaaaaatgtttattggaaaaaggaaatatggtattctgaattaataactttatgacataggcatttgtattcccatttgtatataagaaaaatgaagtttggtggaatttgaagctaagaactttgggcaatatggagcaagaggcttttataagagagtggcatgagtgaagtagtgtgcccattgcatgtagattcatctgattggatagagtagtgtcctcttatcctttcagtgtttcttatatttcttttcctgaaacgggacttgtcagagagcacagcctcttctgtagcgaagtatgtataagttgggaggtgcttctttctagccccaagttgtgcttgtttctcttaggtcttttataactgtaagctgatgtacttgactctctacatttatatttgtaggattaatgaataaatactattagaatccaatcagtttttgtgtcctggttttctgtaaataacttggcctttgtggtatgactaatctgaatccaaatcctggtctgtcttttcgtggctttgtgaccttcaactatgttacatatctctgagcctgtgttttttttttttttctctctctctctctctgtgtatgtgtgtgtacctgtatattctcacatatatgaaaatgaggtaaatgatgttatttttccttttatttccctcataagtggaaactgtatatatgagagaattctatatataacagatcattatattattgtttctgctactatactgcatgttcatttagcacatttattagtcaaaatgtggtccacagatgaggtttgcatattcatgaaatatttgctgttctaagaggagataaggaacttgtgccagaatgcaaatcatctgtgctaagtacactatttctttcaactaacctttcttttttttttttttttctcataacaagactttcttgatgaaggaagcagaatgtcgattcatattttacttctatctcctcattggctggcactctgagtagcctgaatgtagagtgctttgggaagatattttgaagaaagcttaattttatttatattacttttcatttttggtgttagaaaggtttgttattattagtgaaaaggttattaaatttgaacttggattctaatcgtgtctttgctactgattagttgggcaactgaattaaatcttctaggccttattttcctgacggaaaatgaaggttgggttagatatctgtggtttttgtaggctttaacatgttaataattatgttttttaagtactatttttttcttttacctttttttttttaaaaaagcaaaactgagacctcgtcaaagtagtagataagaagcactgcaatagaaacatactttaagaagcctctttttggaatagatgttttattaagctgtagtcaaccatatggcaaggatttgatgctaaggctataatgattgagactgtttttgtcttcaagtagtaatatcctgggaaagatagacaagtaaatacatacaaatgtaaatacataaatcggtagtgtgttagagatatggaccaaaaatgtgtgaaacaggaggctgtgaaagactctctagaacaaaggtaagcaaacattttctataaggatccaaatattttagcctttgtgggccacatggtgtctattacaactactcaccctgcagttgtagtggaaaggcagccatgtaaataaaaatacatcatttttcaacaccaattctctggcactaattaagtgtcctaaaattcaatcctgatactacatagagttagtgcaaacctcttaaattagaggcagaatccttcaattctgacactaattgaaagttagtacagactccacaagttaaggagccagtcccacaagactgcttccatttcagataccagcctgaaataggctacctgcacttctgctcaactgaccacaaattcagaggttcccacaacttccctcaggttctgtaatcactagaatgactcagagttcaggaaagtgctacacttacaattacagttttattataaaggaaacagcttaggaacagccaaatggaagaaatgtataaggaaggcactgagagggagtgggctatagagcttccatgcccttactgggcacaccaccctcccagcagattgatatgtttgccaacctggaagcatcctggacctcgttgtttgagttcttatcaaggcttcaattatgtggcctgatttatgggccacgtaattgaactcaagtaccagccttatattcacttgcttagttttttttgacttggccagcccttcccttgaaactatctaagggccccaacatgagttagcttgttagcatgagctcagctatggtcaaaagggtcttgttatgaatagcaaaggacactcttatcacccaggacattctaaagatttttgaagttctgtgccaagaattgggggcaaagaccaaatatattttaaattatacgataggcagccattactgatatgtaaatgaatggccaatggccgtataataaaactttatttacaataagacattgagctagaactgacctataggtagtagtttgcagacccttgctttagaaaaatgtgaaaaactgctgaaagaatgtgacatttgaactgtttcttctatttattttaaactttttgctgatatgatactattttatagaatttttaaaatttattttcagtagcactaatagatttttttaaggtgctatgagagtgagtaaggaactttttttaaacacatatgctgtgattaatgtgttttaatatcaattattaatatcaattgattgttaatatcaattgattattaatgtgttttaatatcaattgagaaggacttcagttaagtcctctttgtgcctcttactccagtaggtgggcttgaaaactacctactggatcacaactggtaggctttattctcctgagtgatcatgacttttatcacattccttgattagtgatgtttctgttgagaatgctgtttaccttctgtcgtttatgttttgcatttatattttgcatcccactcttgttttcaacatagtgaaaggaattagagccttgggttggagttttattcctctgacttaatgggcctgtgactaggcaggttccacattctgagagctgtccagtgagggattagaaattcgacacttactgctgtgtaataagttaaagcatgaacatttaaaattttttggtttttaaaaaaaaaaaactaaaattttttggtttccgttttttctttttttctggcttgatagttttattttttattttttaacttttattttaagttcaggggtacatgtacaggtagagtgcttttgggagatattttttacataggtaaatatgtgtcatgggggtttgttgtgcagtttatttcatcacctaggtattagcctagtagacattagttattctttttgatcctcccacccttgaccctccgataggcccagtgtgtgttgttcccctctatgtgtcagtgtattcttaccatttagctcccacttacaagtgagaacatacagtattttgttttctgtgttagtttgctgaggataatggcctccagctccatctatgtgtctgcaaaggacattatctcattcttttttatggctgcatagtattccatgctgtatatataccacgtttttttttttatccagtctatcattgatatgtattgaagttaatttcatgtctttgctattttgaatagtgctgcagtgaacatatgcatgcatgtgcctctgtaatggaatgatgtatattcctttgggtatatacccagtaatgggattgctgggtcaagtggcatttctgtctttaggtctttgagaaatcattgcactattttctacaatggttgagctaatctgcactaccaccaacagtgtataagcatttctttttctccacaaccttgccagcatctgttggtttttgactttttagtcatagccattctgcctggtgtgagattgtatctcattgtggtttagtttgcatttctctcatgatcagtgatgctgagctttgtttcatatgattgttgggcacatgtatgtcttcttttgagaagtgtctgttcatgtcctttgcccattttttaatggcattgtttgttttttttccttgtaaatttgtttaagtggcttatagatgctggatatgagacctttgtaagatgcatggtttgtaaaattttctcccattccgtaggttgtctgtttaccctgttgatagtttcttttgctctgcagaagctcttatttgtcaatttttgcttttgttgcagttgcttttggtgtcttcatcatgaaatctttgcccatgcctatgtcctgaatggtattgcctaggttgtctttcacagtttttataattttgtgttttatatttaagtttttaatacatcttgagtttatttttgtatatggtaaaaggaaggagtccagtttccatcttctgcatatggctagctagttatcttagcaccatttattgaatagggaatcctttccccattgcttgtttttgtcaggtttgttgaagatcagatagtggtaggtgtgcatcatatttctgggttcttttttctgttgatctgtgtgtctgttcttgtgccaacaccatgctgttttggttaatgtagctctgtattatagttaagttgggtagcgtgatgcctctagctttgttctttttgcttaggattgctctggctattcaggctcttttttggttccatacgaatttaaaagtagtttttttctggttctgtgaagaatgtcaatggtagtttaatgcgaatagcattgaatctgtaaattactttgggcagtatggtcattttaatgatattgatttttcctatctatgagtgtggaatgtttttctatttgtttgtgtcatctcttgatttctttgagcagtggtttgtagttgtcactgtagagatctttcacctccctagttagctgtattcccaggtaatttattctttttgtggcaattgtgagtgggagtttgtttgtggtttggctctcagtgggactgctgttggtgtataggaacgctagcaatttttgtacatttattttgtatcctaagatttccctgtagttgtttatcagcataagaagcttttgggctaagatgatggggttttctagatacaggatcatgtcattggcaaacagggttagtttgactcctctcttcctatctgaatgccctttatttatctctcttgcctgattccctgctgaataggaggggtgaaagagggcatccttgtcttgtgccagttttcaaggggaatacttccagcttttgcccattcagtatgatgttggctgtgggtttgtcatagatggctcttattattttgagatatatttcttcaatacctaggttattgagaatttttaacctgaagggatgttgaattttattgaaagcgttttctgcatctattgagacaatcatgtggtttttgtctttagttctgtttatatgatgagtcacatttattgatttttttatgttgagccaaccttgtatcctggggatgaagcctacttgattgtggtgaataagtttgttgatgtgctgctggattcagtttggcagtattttgttgaggatttttgcatcgatattcatcaaggatatcagcttcaatttttcttttctttttttttttttgtatcaggatgatgctggcctcatagaatgacttagggaggagtccctccttttcaaattttttggaatagtttcaataggaatggtactagctcttctttgcacgtctggtagaattcagctgtgaatctgtctggccctgggctttttttggttggtaggctattactgcctcaatttcagaactcattattggtcagttcagggattcagtttcttcttggttcagtcttggcagggtatatgtgttcaggaatttatccattttttttctacatttttaagtttatatgcatagaggtgtttataatattctccgatggttgtttgtgtttctgtggagtattccccttaccatttcttattttatttgaatcttctctcatttcttctttactagtctagctaacagtttatgtattttattatttttttcaaaaaatcagctctgggatttgttgatccaatgaatcgtttttcatgtctctgcctccttcagttcagctctgattttggtatttcctgtcttctgatagctttgggatttgtttgctcttggttctctagttcttttagttgtgatgttaggttgttaacttgagatctctctaattttttaatataggcatttagtgttataaatttctctcttaacactgccttagctatgtcccagagattctggtaccttgtatctttgttctcattgtttcaaagaacgtcttgatttcagctttaattttattatttacccaaaagtcatttaggaccagggtattcaatttccatgtaattgtatggttttgagtgaatttcttagtcttgagttctaatttgattgcgctgtggtctgagagactgttatgatttcaattcttttgcatttcctaaagagtgctttacttctgattatgtgatcgattgtagagtaagtgctgggattacaggcgtgagccaccacaccggcctggtttttgttcatattctgaattctacttctgccctttcagccatctcagcctcagcccagttccgaacccttgctgcagaagtgatgtgatcatttggaggaaagagagcactgtggttttttgagttttcaatgttctcgtgctgattctttctcatctttgtggactttgctaccttaaatctttgaggttgctcacctttggattttttttttcttttaatagtctggctgcttttccacaggactgttgcggtttgctgggggtccactgcagtccttagtcatttcgggttttccagtacctacctgaaggtatcaccagtgaaggctatgaaacagcaaagatggcagcctaccccttcctctgggtgctccatcccagggaggtacagacttgttcctggcccaaacatacctgtaggaggtggctggagatcctgactggcaggtcttgcccagtcaggaggaacaggattggagacctgctaaggaagcagcctggccacactttcatagagcagctgtgctgtgctggggtaccacttctgcctctagttggcttgggctctctaaaacctagaggctagaatggctaagttgcccaaatagcaaagatggcagcctgcccctccctctgggagctctgtcccaggaagttttcaaatctttgttggccagagaacattcgccagggtgtctggaggtcccccttgcgaggtcatgcccagtgatgaaaaacggatcagtctggtcatgttttggtagaggagctgtgctgtgctgggggattccttctggcctaggttggtttggactctccagggcctgcaggctggaacagctgagtcatccaaacagcaaagatggtggcctctactccccacaggaactctgtcccaggtaggggtgacactgttgcccctggttagctggaattccaagccagtgggtcttatcctctgtggtgccatggaagtggggtccgcagaccgttactgcctgcttccctggattcagcccccttcccaggggtatgtacggaagtccaacctcctgcgttgctggagttgcagtcacttttgccaggatacccagagccagagtctgtaaaactcctgggcccctctgcatgtctgagtggctgctctgctgagactccacacagctctttgtgtcagactgaaggccctgctggagtgggttcatgaagggatctctcctgacctgagggttgcaaagatccgtgggagaagcatggcatggtttcctggggttgcacattcactcacgacttcacttggtgggggaggttcctccggctttgtgtcactctcaggtgggccgtcatcctatctgcttttcattgttctttatgggttgagttgctttcctgattagtcccaatgcaagtacctggatgtttcagttgaaggtactgtatttacttgcccctttcattcctctctgtgagagccatgcaccattgctgcttcttgttggccatcttggcccaaatcctctgttttctttttgccagagtagaagtggtttcctcttcttacctggacgtttcacaatggaatgaataagcaagctgatatcaatttatcagcttatcttgttagtttcatttcttagtatatgtgaggtttcaaatggtcacaaagatgaacatttaaaaggcctccaaacaaggaaaactggcagtgggccagaactgactattttaatagggatagagagtttgagtttgttactatcctgttgcttaggtaatgttactgtaagcagaggatagagaataaagagaattgcccgtatgagtacatacaaaaatgatgatgaaatgagggtaatgggaaaataatattttagggatagaataaatgcaaaattcagaaaaaccaaagtggagtttattctttttgtcagtagccacagatgagttgctagtatcatttttaaacacaaatggcaagtacttaaatgtgtttatatgtgtggactacagcaatattctaccagttagcagcacatgaaatagcttgttcacttgctggttcaattgaaatgtttttacttaaatacctattaaacattgttgatactgaattaggcttgtcaggagaaaaaatagaacactagttttcacaatttttacccggtagtagctcatgcatgaggctaagcatgtagtcctcatactatcaccttgaggtaaagtcctgttatccacaatttacatatggggaaaggagattaagtaacttccctaggtcaagcaggtagaaatggctgcacaagactcaagccttttactggttttcttcctaacagacataatttcttaagttctgtgagaaaattacaaagaaatctggaagcatcacattatccaacttcaaactatattataaggccttagtcaccaaaatagcatggtactggtataaaaatagacacatagaccaatggaacagaatagagaacccagaaataaagccacatacagccagctgatcttcgacaaagcaaacaaaagcataaagtggcaaaaggacaccctattcaacagatggtgctgggataattgacaagccacatgtagaagaatgaaactggatccttatctttcaccttatacttgaaactaagacctgaaaccataaagaatctagaagataacattggaaaaacccttctagacattggcttaggcaaagacttcatgaccaggaacccagaagcaaacgtaacaaaaaccaagacaaatagatgggacttaattaaactaaaaagcttcagtacagcaaaagaaataatcaccagttaacagaaaacccacagagtgggagaaaatcttcacaatctatacatccaacaaaggactaatatccagaatctacaaagaactcaaatcagcaagaaaaaaaaaatcccatcaaaaagtgagctaaggacatgaataggtaattctcaaaagaagatatacagatggtcaacaagcatatggaaaaatgctcaacatcacttattatcagggaaatgcaaatcaaaccacaatgtgataccacctcactcctgcaagaatggccatatcaaaaaatcaaaaactaatagatgttggtttggatgtggtgaaaagggaacacttttacactgctggtgggaatgtaaactactacaaccattgtggaaaacagtgtcgagattccttagagaacttaaaagtagatctaccctttgatccagcaatcccactactacgtatctacccagaggaaaataagtcattatatgaaaaagatacttgcacatgtatgtttatagcagcgcaatttgcaattgcaaaaatatggaatcctcccaagtgcccatcaaccaatgagtggatgaaaaaaatgtggtgcataaataccatggtatactactcagccataaaaaggaatgaaataatggcattctcagcaacctggatggacttgcagactattattctaagtgaagtaactcaggaatggtacccaaacctcatatgttctcactcatatgtgagagctaacctacgaggacacaaaggcctaagaatgatacattggagtttggggacttggggcaaagaatggggggtggcaaaggataaaagactgcacatggggtacagtgtacactggtctggtgatgggtgcaccaaaaactcagaaatcaccagtaaagaacttatttatgtaactcaacatcacctggtctctgaaaacctattgaaataaaaaatttaaaataaattacaaagaattatgactttctaaggattggatagatatctttttcttttttctttgttttttgtttttttttttttttcatggagcagagactcagacaaaacttcataaaggagagatatataagatgaagtgaaaatctaaggtgaggcctaagcatggagggcattgaatgttaggtgacaacttgaggagttacttgagtcatagagctgttttatttcttttgttcattttacctctcgtaaaccattctgtgctacttttttctccaggaagattgttcaaatttttgaggctttgtagttaaatgctattttgcttctagagaacttttctttttctctctatttttttttttttttttgagacagagttttgctcttgttgcccaggctagagtgcagtggtgcaatcttggctcaccgtaacgtctgcctcccaggttcaagtgattctcctgcctcagcctcccaagtagctggaattacaggcgtgcaccatcacggccagcaaattttgtatttttagtagagatgatatttcttcttgttggtcaggctggtctcgaactcctaacctcaggtgatccgcctgccttggcctcccaacttgctgcaattataggtgtgagccactgcgcccagctagacctattacctttgcttatatacttatgtgtaaatactgaatataaatggatatgaattgtacataattatctttttttttttttgagatggagtctgtctctgtcgcccaggctggagtgcaagggtgtgatcttggctcactgcaacccctgtctcccggattcaagcgattcttctgcctcagcgtcttgagtagctgggactacagtcatgtgccactgcacccagctaatttttgtatttttagtagatactgggtttcaccatgttggccaggctgatctcgaactcctgacctcaggtgatcctcccacctcggcctcccaaaatgctgggattgcaggtgtgagccaccacgcttggctggattgtacataactatcttaaacagaatagatgctaacattaatctgtattgagaagtaatctaattcattttgatagttggagtcattttcccctccagatgaaggctaatgaggttcaggattttgtttcacatttcttgcacctgccatacactaggcattcaatcactatttgtagaaggacagaaggatacacttttaatttaaagttcttttttttttgagacaggtttttgctctgtagttcaggatggagtacagtggtatgatcacagtttactgtagcctcaaactcctggactcaagcagtccacctgcctcagcctcctgaatagctcccattatgcctgactaattgattaaaaaaattttttttttagagaatgggtctcactgtgtggcccaggctggactcaaactcttagtctcaagtgatcctcctgccttggcctcccaaagtgctaggattacaggcatgggccactacatcctgcctaaagttattctttaatcaatcttcaaaccttgggatgggcatattctaagcagtgctgatcaaaaagtaagtatcaatgatttcagggaaattctggaagactcttaagtcagctataattattaatggcaagatttggttctggcacacagacttcagataactaatatttactgataggaagaattgaaaaaattttatagtgaacacccatatatgtaccacctagagtctacaatttacattttactaaaataactttatcacatatctgtatttttatgcatccatcgatctgtctattttttctggatccgtttaaaccaggttgacgccatgcatattttttaactgaaattcaatgtttggctacctccccaccataaaattacatacagtgaaaacatctaatattctgtgagttgtgacaaatgcatgtacctgagtaacccaaacctagaacattatagtcatcccagagagttcctcgtactcctttccagttaatccctacctccatactcccagagatggtcagaggtttttttttcccaccatagattagtattggctgttgtagaatcttgtataaatggagtcttaacagtgtcaatgaacccttttgagtaaaacttcttttatttaacagaatgcttttgcaatttgttcatgttgtgcttatcagcatttgttacttttactgatgagttgtggaccattgtataaatataccagagtaagctaatccattcttctactcatggaactctaggttgcttccagtttttggccattatgaataaaacttccttgaatattcacccatgagtcattttaagattcatgtttttattccttttgggtaaatacctaagaatgtaattatcaggtagagagatggcatatgcttggttttagaaacctgacagaccattttattaagtgattaaaacattttgtattttcaacaatgtataacagatctcttttccccagcatttcatatggtcagctcttttagacattctgatggctgtgtattgataccccactgtggttttaatttgaatttctgggatggccagtgatgtcgagccctttttcatgcctttatgcaccatttaaaaattttcccctggttgctgggcacagtggttcacacctgacttcgggaggccaaggcaggcagatcatctgaggccaggagttcgagaccagtctggccaacatggtgaaaccccacttctactaaaaagacaaaaattagctgggcatggtggcgtgcacctgtaatcccagttgcttgggaggctgaagcaggagaatcactcgaacctaggaggcagaggttgcagtgagccaagattgagccactgcactccatcctgggtgacagagcaagactctgtctcaaagaaaaaaaaaagaaaaacaattttcccctgggaagtacctattcaaatcttttgccaatttgtaaattttttaaaatgtaagagttcattatcctagatacagatttttaagtcagatgtatgttttttggaaattttttaaaagtctgtatattttctttttacttaaagctatattttcaggagcacttttaaatattgatagaatttaattcatcaactatttcttttatggttattactttgtatccttaagaaaacattgctttccctgtagatcatacagatattcttctgtgttttcttctagaggctttatagttttaattctcatgtctgttatctatatgaaattaatttttgtgtctggtgagataagggttcagatttcttttttcatattaatatccatttgtttcatcaccacttgtggaagagactttgctttttctattggattgctgtagtacctttgaagaaagttgaatgatgtgtaagtatgagtctttcttgttccattgatccatttgttggtctttatgtcagtactgtggtgtactgtggtgtctcaattactgtagttttatgtaaattttgaaatcaggtagtttaagttttccaatttgttgttgttgttttgccctaggattgccttagagtctagctgttttttttgttgttgttgttatttatataaatattttataatcaattgtcagtttctagcaacaatcctgggtatgttgaatacatagtttaatgagggggaagaggagattgacttgttacatgctactgtcttcaaatcattagtatcatgtatctctctaatttactagatcttttaaaaatttcttccagcaatgttttctggtttctagtttagaagtataacttttttttattacattttattacatttttattacatttatttatttatttatttatttatttatttaaatgctatttgctatggttggaatgatggtgttcctccaatgtatgttgaaacttaatcctaatgcaacattctgaagaggtgtgtcctttgggaggtgattaagtaatgagggctctgccttgttgaatgggtacccttatatttaatacagtgttgaatgtcggtgatgaaaatgagcatccttaggttgttaaggatattaggaggaaattggttactatttgatcatttagtagattacaattaagatgttagctataggagtttgtagatactatttatctagttgaaaaagtttttcctcttcctagtttgctaagagtttataccatctgaattttgtcggatgatttttctacattgattgaagtgcccctatgtatttctccttttattagtatgataatagttatatgtattttcttaaaatagcttcattgaggtataatttatatatcataaaattcacgtgtttttagcatacaattcaatgaattttagtgaatttacagttatttaactgtaatcaaaatgtacttttataacatttccgttactctccaaataaataatatgctaatttgtagttatttccaattcccacccccagcctaaggcaactaccgatttaccctctccatgtttgccttttcttgacattttgtatccatggagtcacacaatgtgtggtcttttgtgcctggcttctgtgacttagtataacatttttgaggctcatctattttcctttttattgccaagtaatattatgtggatataccacagtttgattatccatttaccagtttacgaccatttgaattgtttctaatttttggcttttatgaataatgctgatatgaacatttgcatctaagtcttcatatggatatatattttcatagatacctagaagtgaaattctgggtcatatggtaaatccttgctttaagaaactgccagactatttccaaagtgattataccactttacattgccactgacaattgatttttgaatgttataaacaatcttgcattcttaggataaccccatgatgtattttccatcttgcgtattgctggatttggtttgttaacaatttaaggatttgtgtgtctgtgttcatcagagattttggtctgcaattttatttccttataatgtccttgtcaggttttgtctatgaatgatttttatagaattcaccaataaaacattggcctgcacttttctttgtgggaaggttttttttttttataatggggttttctttttaatctagattgtttgcattttccttcatcttgtgtcagtaaattgtgttttgcaagggatttatttgtgtcatctaagtagttgaatttgttagcacactgttcataaacatttctctgatattcttttaatgtctgtaggatctatactgataatcctttccagatattgataatttatgttctctcttctctctctctctctctctgtctcttaagcttatggtttatcaacattattaatattattaatttcaaagaaagaaatttggctatgttaattctattatttgttttttattttattaatttatgttcttattattactttgtcctacttgctgctatgagttttctttgttctttgattagctttatgaggtgaaactgtgggtcaataagagctttttcttttctaacactgtataacttcctctaggcactgctttagctcattttacagaatttaatagaattttgatcagattagttaggagtgttgtttttgaaggcatttctaaagattttgttgttattgatttttttttttgagatgaagtctctctctgttgcccaggctggggtgcactggtgcgacctacctcagctcactgcaacccctgcctcctgggttcaattgaatctcctgcctcagcctccctagtagctggaattacaggcatctgccaccatgcccagctaattttttatatttttagtaaagacagaatttcaccatgttggccaggctggtcttgaactcctggcctcaggtaatcctcctgcctcggcctcccaaagtgctgggagtacaggtgtgagccaccatgcctcacctgatttcgaatttaaatccattgtggtacaaagacaggatctgtggacttcagtacttttaaatttattgagactcgtcttatggctcatcatatatttcctgttttggtgaaaacaccatgaacacttgtaaagaatggtgttttatgattattggttgtaatgtttctaagctctcaattaagtcaagttaattatagtgttgttcatatattttatggtttcacctatgggttttttttgcttaattttatcagttattgagaaagggtcttaagagtctcaactatgattgtggaattttctttctccttttaattacttaatatttcagttttgctttatgtattttgaaattcttagcaattgtgtgcacatttgattgttatctgttcctcaggaattgacctttgggttattattattattattattttatactttaagttctagggtacatgtgcacaacgtgcaggtttgttacataggtatacatgtgccatgttggtttgctgcacccattaactcatcatttacattaggtatttctcctaatgctatacctccccctgacccccaccccacaccaggccccagggtgtgatgttccccgccctgtgtccaagtgttctcacactgttcaattcccacctatgagtgagaacatgcggtgtttggttttctgtccttgcgatagtttgctcagaatggtggtttccagctgcatccatgtccctgcaaaggacatgaactcatccttttttatggctgcatagtatcccatggtgtatatgtgccatattttcttaatccagtctatcattgatggacatttgggttggttctaagtctttgctattgtgaatagtgccacaataaacatgtgtgcatgtgtctttatagtagtatgatttataatcttttgggtatatacccagtagtgggatcgctgggtcaaatgatatttctaattctagatccttgaggaattgccacactgtcttccacaatggttgaactagtttacactctcaccaacagtgtaaaattattcctatttctccacatcctctccagcatctgttgtttcctgactttctaatgatcgccattctaactggtgtgagatggtatctcattgtggttttgatttgcatttctctggtgaccagtgatgatgagcactttttcatgtgtctgttggctgcataaatgtcttcttttgagaagtgtctgttcatatcctttgcccactttttgatggggttgtttttttcttgtaaatttgtttaagttctttgtagattgtggatataaggcctttgtcagatgggtagattgcaaaaattttctcccattctgtaggtagcctgttcactctgatggtagtttcttttgctgtgcagaagctctttagtttaattaatttagtttaattgacaaatcccatttgtcaattttggcttttgttgccattgcttttggtgttttagtcatgaagtccttgcccatgcctctttcctgaatggtattgcctaggttttcttctagggtttttatggttttaggtctaacatttaagtctttaatccatcttgaattaattttagtataaggtgtaaggaagggatccagtttcagctttctacatatggctagccagttattaaatagggaatccttttgtttattaaatagggaatcctttccccattgcttgtttttgacaactttctcaaagatcagatggttgtagatgtgtggtgttatttctgaggcctctgatctgttccattgttctatatatctgttttggtaccagtaccatgctgttttggttactgtgccatgtagtatagtttgaagtcacttagtgtgatgcctccagctttgttctttttgcttagcattgtattggcaatgcgggctcttttttggttgcatatgaactttaaagtagttttttccaattctgtgaagaaagtcactgatagcttgatggggatggcattgaatctataaattatcttgggcagtatggccattttcacgatattgattcttcatgagcatggaatgttcttccatttgtttgtgttctcttttatttcgttgagcagtggtttgtagttctctttgaagaggtccttcacatcccttgtaagttggattcctaggtattttattctcattgtagcaattgtgaatgggagttcactcatgatttggctctctgtttgtctgttattggtgtataggaatgcttgtgatttttgcagattgattttgtatcctgagactttgctgaagttgcttatcagcttaaggagattttgggctgagatgatggggttttctaaatatacaatcatgtcatctgcaaacagggacaatttgacttcttcttttcctaattgaatatgctttatttctttctcttgcctgattgccctggccagaacttacaacactatgttgaataggagtggtgagagagggcatccttgtcttgtgccagttttcaaaaggaatgcttcaagtttttgcccattcagtatgatattggctgtgtgtttgtcataaatagctcttattattttgagatacgttccattaatacctattttattgagagtttttagcatcaaaggctgttgcattttgttgaaggccttttctacgtctgttgagataatcatgtggtttttgtcgttggttctgtttatgtgatggattatgtttattgatttgcatatgttgaaccagcctggtatcccagggatgaagccgacttgattgtgctgaataagctttttcatgtgttgctggatttggtttgccagtattttattgaggatttttgcatcgatgttcatcagggatattggtctaaaattctcttttttgttgagtctctgaacaggctttggtatcaggatgatgctggcctcataaaataagttagggaggattccctctttttctattaattggaatagtttcagaaggagtgctaccagctcctttttgtacctctggtagaatttggttgtgaatccgtctggtcctggactttttttggttggtaggctattaattattgcctgaatttcagaggctgttattggtcccttcagagattcaccttcctggtttagtcttgggagggtgtattgttcaggaatttatccatttcttctagattttctagtttatttgcattgaggtgtttatattattatctgatggtagtttgtatttctgtgggatcagtggtgatatcccctttactattttttattgcatttatttgattctcctctcttttcttctttattagtcttgctagcagtctatcaattttgttgatcttttaaaaaaaccagctcctggattcatggttttttgaagggtttttttgtgtctctatctctttcagttctgctctgatcttagttatttcttccttctgctagcttttgaatgtgtttgctcttgcttctctagttcttttaattgtgatgttagggtgtcgattttagatgtttcctgctttctcttgtgggcatttagtgctataaatttccctctacacactgctttaaatgtgccactgagattttggtacattgtgtctttgttctcgttggtttcaaagaacgtctttatttctgccttcatttcattttgtatccagtagtcattcaggagcaggtttttcagtttccatgtagttgtgcggttttgagtgagtttcttaatcctgagttctagtttgattgcactgtggtctgagagacagtttgttgtgatttctgttcttttacatttgctgaggagtgctttacttccaaccatgtggtcaattttggaataagtgcgacgtgttgctgagaagaatgtatattctgttgatttggggtggagagttctgtagatgtctattaggtctgcttggtgcagagctgagttcaagttctggatatccttgttaacctttggtctcattgatctgtctaatattgacagtagggtgttaaagtctcccattattattgtgtgggagtctaagtctctttgtaggtctctaaggacttgctttatgagtctgggtgctcctgtattgggtgcatatatatttaggatagttagctcttcttgttgaattgatccctttatcattatgtaatggccattggtttaatgtctgttttatcagagactaggattgcaacccctgcttttttttgttttccatttgcttggtagctcttcctccatccctttattttgagcctctgtgtgtctctgcacatgggatgggtctcctgaatacagcacactgatgggtcttgactctttatatttgccagtctgtgtcttttaactggggcatttagtccatttacatttaaggttaatatttttatgtgaatctgatcctgtcattatgctgttagccggttattttgcccattagttgatgcagtttcttcctagcattgatggtctttaagtttggcatgtttttgcagtggctggtactggttgctgctttccatgtttagtggagctcttgtaaggcaggcctggtggtgacaaaatctgtcagcctttgcttgtctgtaaaggattttatttctccttcacttatgaagcctagtttggctggatatgaaattctgggttgaaaattcttttaagaatattgaatattggtctccagtctcttctggcttgtagagtttctgccgagagatctgctgttagtctgatgggcttccctttgtgggtaacccgacctttctctctggctgcccttaacattttttccttcttttcaaccttgctaaatctgacaattatgtgtcttggggttgctcttctggaggagtatctttgtggtgttctttgtgtttcctgaatttgaatgttggcctgtcttgctgggttggggaagttctcctggataagatcctgaagagtattttccaacttggttccattatccccatcacttttaggtacaccaatcaaacgtagatttggtcttttcacatagtcctatatttcttggaggctttgttcatttatttttactcttttttctctaacttctcttctcgctttatttcattaatttgatcttcaatcactgatattcttttttccacttgatcaaataggctattgaagcttgtgcatgcatcacatagttctcatgccatgcttttcagctccatcaggtcatttaaattcttctatgcactgtttattctagttagccattcatctaatcttttttcaaggtttttagcttccttgcaatgggtttgaacatcctcctttagctcggagatgtttgttattactgaccttctgaagcctacttctgtcagctcgtcaaagtcattctccatgcagctttgttctttgctggtggggagatgctatcctttggaggagaagaggcactctggtttttagaattttcagcgtttctactctggtttctgcaaatattgcagaacagcaaatattgctgcctaatctttcctctggaaggttcgtcccagagggttacccgcctgtttgaggtgtcagtcggcccctactgggaggtgtctcccagttagccagttaggctacacgggggtcagggaggaggtagtctgtctgttctctgagctcaaacaccatgctgggagaaccactgctctcttcagagctgtcagatagggacgtttaagtctgcagatgtttctgctgccttttgttcagctatgccctgcccccagaggtggagactatagaggtagccggccttgctgagctgtggtggggtccacccagttcgagcttttccggctgctttgtttacctactcaagcctcagcaatggcagacccccctgcccctgccaggctgctgcctcacaggtcgatatcagactgctgtgctagcagtgagcaagtctctgtgggcgtgggatccgccgagccagacatgggatataatctcctgttgtgccatttgctgcggaccagagctgttcctattcggccatcttggactgacctttgtattgttatgaaatgttctttgtatttggtgatacttcttgtctcgacgtttactttatctaatagttatattgttgcacaatctgtcttgtttatttgcatggtatatctttttctgttcttttactattaatttctgaattttttattttcttatttttctgtaaacagcatgtagctgagtctttataaaaattaaaaatccattgtgacattcagtcttttaataggaaaatttgtgttccagtagtatttaatgtaattactgatactggatttaggccttctatcttactactatttgttgtttctttgtcccatttgttttttcttcctgtgtacctccttttctgccttctttggattagttgattagaatttcattattttatatatttgttttttaggcgtatctccctgcattattattttaatgattcttctacatctctagcttttcagtctagagttgttaccatactgtttcacttaaaaaatagaaatgttcatccttacaataattaaaagtcatttatcttcctcttctgctgtagttgtcatgtgtattatatctacacatatatacccaataaatgtattagtctgttctcacattactataagtaactacaagagactgggtaatttatgaagaaaagagatttaatcgattcacattttcacagggtgtacaggaagcctggctggggaggtttcaggaaacttacaatcatggcagaaggtgaaggggaaacagacacatcttcacatggtggagcaggatagagggtgaagggggaagtgctacatattcttaaacaaccaaatcttatgggaactcactgtcatgagaaccgcaaaggggaagtctgcctccgtggtccagtcgtctcccactaggtgccccctccaacactgaggattacagtttgacatgaggtttgggtggggacacagagccaaactatatcattccacacctagccctcccaaatctcatgtccttgtcacctttcaaagcacagtcatggcttccaaacagacccccaatgtcttaactcattctagcattaactcaaaagtcgaagtccaaagtttcatctgggacaaggcacgtctatttgcctatgagcctgtaaaaccataaacaagttagttacctccaagatacaatggggctacaggcattgggcaaatgttcccattccaaaagggagaaatcggccaaaacaaaggggttacagaccccatgcaagtccaaagcccagaaaggcagtcatcaaattttaaagctccaaaataattttctttgactccatgtctcacatgcaagcacactgatgcaaggggtaggctcccaagacgttgggcatttatgctcctttagcttggcatggtatagcctccttggctggtttcatgggccagtgttgaatgcctgtggcttttctaggcacatggtgcaagccgtcagtgggtctaccattctgagttctggaggatggtggcttttttctcacaactccactaggcagtgccccagtggggactctttgtgggggctgtaaccccacatttccccttcacactgcttagtagattctccatgagggctctgcccctgtagcagacttctgccaggatatccagacatttctattctctgatagctatttggaggctcccaagccttaactcttgccctctatgcccccacaggcttagaaacacatagaagtcaccaaagtttgcagcttgcaccatctggagcagtgacctgagatgtatctggggcccttttagccacagccacagctggagctggagaagctaggatgcagggagcagtgttctgaggttgtgtagggtagcagggccctgggctttgctctcaaaaccattcttcccttaggcctctgggcctttgattggaggggctgcgggaaagccttcaaggcattttccccattgtcttggctattaacattcagctcctctttacttatgcaaatttctacatccagcttgaattcctccccagaaaatgggcttttcttttctccctcatggtcaggctgcaaattttcttaacttttatgctgtttcctttttaagtataagttccagtttcagatcatctctttgcttatgcatgtgaccatatgctgttagaagcaaccaggccacatcttgaagaacactttgctacttagaaatttcttctgccagatatcttaaatcatctctcaagttcaaagttccacagatctctagggcaggtgcagaatgccttcagcctctttgttaatggttaacaaaagtgatctttgccccagttcccaataagttcctcatctgagactacttcagcctggacttcattggccatatcactgtcagcattttggtaacaacagtttaacaagtctttagaaagttccaaaccttccttggtcttcctgtcttatgagctctccaaactgttccaacctctgcccattacccagttacaaagctgcttccacattttcagggatctttatagcaataccccactctccagtgccaattttctgtattaacccattcttgcactgctgtgaggaactacctgagactgggtaatttgtgaagaaaagaggtttaattgattcagttccacagactgtacaggaagcatggctggagaggcctcaggaaactgacaatcatggcagaaggtgaaggggaaacaggcacatcttcacatggcagagcaggagagagggagtgaaaggggaagtgctacacaattttaaacaaccacatcttgtgagaactcacccattatcacaagaacagccaaggggaagtccactcctatgacccagtcacctcccaccaggcccctcctccaacaccgaggattacaattcaacatgagatttaggtggggacacagagacagatcatatcaatatacactacacagtactataattttcacttcaagcagtcatatgtattttaaagatgtactaaggacatatattattctatgtttaccaatatgcatgccatttcttttactttttgttccttccagaataagtttccgtcttgtatcatttccctacagcctgaagaaccttataaaagcacttttaaaaaacatgctggcaaccaattcttttaagtttcttcttttaaatttaaaaatgtgtttatttgactgttcttttaaaggatatattttgggtgtaggaattggaattgacagcatttaaaaaatgtaccactgtcttatggttgtttttttttttttcctgatgagaagaaagtagtcattcagtcattgtttttctatatgtaatatgacttttattctctgccttttttttaagctttcctctacccttgatttacaggtatttggctgctgaaccttgtctttttgacaagttttttgaatttttaaatttatatatttcaccaagtgtttgaaaaatgtgtgtgtatatgtgtgtgtatatatatgtgtgtgtgtgtgtgtgtgtatatgtgtgtgtgtgtgtgtatatatatatatatatatatatatttttttttttagacagagtctagctctgtcacccaggctggagtgcagtggcatgatctcggctcattgaaacctctgctttctggattcaagctgttctcctgcctcagcctcccgagaaactgggaatacaggcacatgccaccatgcctggctacttttttgtatttttaggagagatggcatttcaccatgttggacaggctggtcttgaactcctgaccaccacgcccggccaagaagcaaataattttggaatctgtagtcccttaatggggagaaaaggagctaggatgaaatacataaataagagttaaacatttgacttggtaacgaggtatttgaggggaatagtgcccttcagtgtttattcttgctttttttaaggtaaaggctagaaatacttattttatttatttatttttttgagacggagtcttgctctgttgcccaggctggagtgcagtggcatgatctcagctcactgcaagctccgactcccagattcacaccattctcctgcctcagcctcctgagtagctgggactacaggcccccgccaccacacccggctaattttttttttttttttgtattttttagtagagacagggtttcaccgtattagccaggatggtctcggtctcttgaccttgtgatccacccgctttggcctcccaaagtgctgggattacaggcatgagccaccacgcccagccaaggctggaaattcttaatgtgacttctgagcccttgcatgatctccaatgagtctcatctcctgctactgttgcattcattactcgctcctctctccactttgctatctatactgcaaacacactagccatcttatatcgtatcttattagagcttattcatttggtgaccctgttatttctgctttaatttctcctcttcatttctcgttcatcttcctctggatactttcttttcatcctaatgatctcagccgaaatattattttttcagttatttcatggcctctcctgataagattatatgcaccaatagcatcctcgttttctcttttgtagaatttctcattgttgcaaatagttgtttacttatgaatatctgtttaaccttgctacaatgtaagatgtataatgcagtatttttgtattcactggtatattttctgcatctattacagacctttgcatatagtagatgctcaataaatgctggaaggaataaatccagagatgaattgcttattcaggatttcattcagctaattttcagtaaggaataaactgccaaagattagtgtggagactatccctaccagttcctatttctgactcagagtgaggaagttagtctccaaaactaaataaccaagataaatgatgactgtttttcgtggtttgagtatgacccctggttacaacatagagtagtgccgacaggctataatgtctatccctgaaatgagctatagtgcggaacattatgtccaatatgcacttagtctgttacaaaaattttcatttgtaagaaatactgtatttctaccctgtacatttttttccctattttagctcaattttgattatggttcttttgaaaagatatgtagaaacagtaaaagattacctaaaactataaaaaatggcttcataaggggctgggcatggtggctcatgcccgtaatcccagcactttgggaggctgaggcaggtggatcacttgaggtcaagagctcaagaccagactagccaacatggtgaaaccccgtctctactaaaaatacaagaattagccaggtgtgatggtgggtgcctgaaatccctgctacttgggaggctgaggcaggataattgcttgaacctgggtggcagaggttgcagtgagccgaggtcatgccactgtactctagcctgggtgacagagcaaggctctgtctccaaaaaaaaaaaaaaaaaaaaaaaaaaaagttctataagaaaaaagtaaataaatggagtttagtggtttatatgaaataattcaattcaaagggatgccttacattaattttaattatgtggaacgagtttatactaatcagttgttttaataaatgggaaaattaaaatatagctttaaataggggagatttatttcaaatgaaaggaaaaacatattgacagttaagagtgagacagacataggaatattccagcaattgagagtgttgatgatgcatccttggtgaccttttaagaaaataggaaaatatctatttattgatatttcctcctatgtatgtaactacttttaatggttatttttcagatacaatttaccatatttttatcattaattttttaaatctcctgaatatggagaaaatcctacctttactgttgtgtatgagcaataaaactcattataactagtcctgtaaactgtgaccaccaggtaacttgttgataagttggcataggaagggacctcatacaacagggaattcagctaaaatattaaagttgctaattctgaatcttggcagatggctggaagtccaagtcatcttttttctgagactcttgtgcatatggatggtttttggttgggtctgctatctgaagtatctgacatggtaggtattatgggcaaatgataatgttcgtatttgaatagttgatagcttaatgatttcaaagaattattatacattgaaacacaaggtcagtcagtggctggaaatgaatgcacacatttgaagtgagaggactgctgagagcttgttgggtggttgggacctcagtcctaggttctctctgccccgaccttctggcaaggggaatagagttagctcaggaaacaaaggtaaaagcccattttccacaactaggtaaaccaagtaagcattaaggatattaaaaaggaaaaactggctgggtgtggtggctcatgcctgtaatcccagcactttgggaggccaaggcaggaggatcacttgaggtcaggagtttgagaccagcctgcccaacatggtgaaaccccatctgtatgaataatacaaaagaaaatgagcctggcatggtggcatgcacctgtagtcccagctactgaggaggctgaggcaggagctgagattgtgccactgcactccagcctgggtgacagagagagaccctgtctcaagaaaaaaaaaaaaagaaaaactttaagcatgtttaactttatcagaggttgcctgagcaaaaaacaaacaaacaaaccaaaaaacccaataacaatgatttgcgattaggcagccctcagaactagaacaggttccaagaactatctgctacctgttcacctagcatttatggacagaaaacagagtgggacaaaaaaaaacaacttaattggttacagctaggtgttgtgtctcactttaatcagctgactgtcaacagttgactgaagctcagatgctgtaactaataaactcagctttttgttacatgagtacacgctcaagtttcattcagcatgaatgacttcatattagtttggtctgttgggctcagtacaggagcctagtccaaatcaatggcctcctgcaaattttatttaacaggttaaaagtttagtcccagaatatctgaattagagcataaggcagaaagatgaattctcagtcctacctgctaatgggacgtgagcctttagatattctgctgggcttgaccagaattagctcagagcctgagcatttgttaacttgtagctgttgaagcttggaaaagcaaggattccaccttagtgaaattaaatgacttacccaagatcacaatactaatttgaaattgtgtcagaattgggatctaggcctatgtccattcctaatctagtagatttgctatataataccatcttgaatgtgcaaattacaaccttgttacttcacaaagtgtgattattactgtaaagcttaaaaagttgcttgctacttggaaaagcaatcctgaataattaaataaatcttgttatataaatataaaattgcataaaatttttagaaaactgttgatagagtctttattatttattttacattcatatttattttacatcccatgatagatacttgccaccttatatagaacttttgccaatattagggtttaataaatattgattgaatgctaatatctgaaatggtagtcagaggagttgggcttttcacctctgcgtttgtgtgtgtgtgtgtgtatatatataattgtcaacatgatagaatttatactataatcaaaattaccttggtttttagaagtgatttatagtatatttacttttacatctatctattgagtggtcccagcaataattagtgaaacgtaatgtaagaaccatccattatcttctttttataaatgaggaaacatactccaagatcatgtgaatggaaaaggaaacatgggaaaatcatatttctgaacatgagttgtacattaccagattttgttttaggaagactcactattaaatgtgtgtgtgcgtgtgtgtgtatgttttgattaatgtatgtattatgtgttaagtaaatagtatacatgctcattgcaaatcatttaaaaatatatgtgacgaagaaatgaaaaattgccagtaatctcattgctccatggtcactattgtaaacatctgacatttgttaaatctattatttatgtcctgtattcaaagtagtgtggaggtaggcaagatcactggattagtcaggaaatttgaatattctacctgtctgttagcttagtttttgaccttggtgtagggattccgtgattgccaacatttaatttttaaaattatttcttaccttaccttcttctccagtttatactgttatttctattaaataaatatgactttgttttccagtgagataactagattaacaacattacctttattgtcagtgaagaataaaagatgatgtttcacctagctcatgtagttctagttctcaagaatatgatatgtgatactttttgaaatatttaaagtagtttaaacagtatccatttgactctataaaagcctagctgggctctccatgagggaacaattcgaatagatggtttgtaacgtctttttcagttttaaaatgcagatactttgattccattgcacattgatatatgaactcattcttccttattattatttcccaaaatggtaattattttgcttctagaccagcaagctaatatatcaaaaactcttacatgtaaatgtagttgtttaaaaatatttatgctgtgtaatgtcagtaatttatgagttacagacatgatatcccttatatttttgcataataattcatttttaggaaaaactaagaataaagttattctttgtatttttaccagtcttttcccaaccaagtgttactgaaactgtcataccaaaatctttttaccttttaagattctcacttttgaggctgagaactatgaagctagtattccaatttgcattcattgttgtaatttcaggcagcatgtccaatttacttctactgttaggtgcttgtttgttgtacttatgaagaactaagaaggattttctcgtagcccagagttatgttattttttgcttagtgacaatttttacaagagaccttattataatcaaaccaatgaaatgcatcatagtacctttttcagagtgccagtggcttaggaggtattttttttatgtaaacttgttaaaggcatgtaactaactattgggcaaaattcacccccgatatttcacataggttcttttctattttctgtaagtgttggccggtctgagaaataaagggacagagtacaaaagggagaaattttaaagctgggtatccgggggagatatcacatgttggcaggttccatgatgtgcccccaagccacaaaaccagcaagtttttagtgattttcaaaaggggagggagtgtacaaatagggtgtgggtgacagagatcacctgcttcacaaggtaataagatatcacagggtaaatggaggcagggtgagatcacaggaccacaggactggggcaaaattaaaattgctaatgaagtttcaggcaggcattgtcattgataacatcttatcaggaaacagggtttgaaagcagacaactggtctgaccaaaattttttaggtgggaatttcctcatcctaataagcctgggagtgctgcaggagacgggggcttatttcatcccacagctaagaccgtaagagacagctgcccccaaagcggccattttagaggcctcccctcagggacgcattctctttctcagggatgttccttgctgagaaaaagaattcagtgatatttctcccatttgcttttgaaagaagagaaatatggctctgttctgcccagctcaccggcagtcagagtttaaggttatctctcttttttccctgaacattgctgttatcctgttctttttttcaagatgctcagatttcatattgttcaaacacacatgctgtacaatttgtgcagttaacgcaatcatcacagggtcctgaggcgacatacatcctcctcagcttacgaagatgacgggattaagagattaaagacaggcataggaaatcacaagggtattgattggggaagtgataagtgtccatgaaatcttcacaatttatgttcagagattgcagtaaagacaggcgtaagaaattataaaaatattaatttggggaactactaagtgtccatgaaatcttcacaatttatgttcttctgccatggcttcagctggtccctccgtttggggtccctgacttccctcaacaactaaccaagcttatatccttatggtagaaatagagacatactataaatatttataacaaacaaaattggggtaagaatccttcttttgttctattgtttggtcagtcaataaatatatttttaaaaatttttgtgggtatataatatggggaatatatgtgtggagtactttagatattttgatacaggtgtacagtgtgtagtaatcacatcagggtaaatagggtatccatcacctcaaacatttatcctttggctccttttcaataaaaaaattttgttttctcacagctctcccccaatactctctttacccccttacctgaaatctaagtgctttttgttctcacaagtcctctgtaccttatgatgagtgaagagcttgacattctccaggtattttgcttctagaccacttttttaaaaatcaccttctttcagcagagtgttctcactttgaaatctgtgtaatacctgctttgccatgattgttcttatgcttactgtcattagtgattttttttaaaaaaataagctttataaaagtggaagcctgtgtgtgaatttttctgtgattttttttctttttttgactcagccttatgggtttgaattcatttgtttgagtatctccctttaacaacaacaaccttatgaggtagacactattattatccacacttaacagatgtgggactgaacacagttatatgtttaggtaacttgataaggttatatatccagtaagtacagtgtctggattttaacacaggcattctatttcaaagcccagactcttaaccagtatacagtacttacattcactggtaatcagaacaatggaaactaaactgtgatgcccatcatccgtcggtatgtctgtatctatcttccttctgtctgtctacatacctttatatgtatttagattatcaacagattatctgcagcaaaattgggtacagtaatatctttaagggtcaggggaagataattttgaatttagtaatgtcctatccagacattaacattttagaataagatagacataaggacaatttcaggcatacagggactcagaaactttttcatagatcattgctgaaagaattattaatggatatactctagcaagaagggcaatgaaccaggagaaaataatgggatacaggatgtaatgatgcacaaagaaagcagtaaaacatgctgttaaattcaaatatagttgaaaaatttacatgggaattgggagaggaagtatagaggacagtaaaatagtaagctatggttctggtcctgtttcggagaagatagatatgcttgcttgctaatgttaaacttggttaggaaaagaataaatctacatgtaaactgctataataataccacctacaatttactaagcatttatatgtgccagatactttgttaacattttacatggattataagagatacacacacattcactctatatatgttatatagattatatatttataatatatataacacacacacacacacacacgttttaaaagcatacacaaatgcagggatactgatcgagcaagcatttaatagctgtatcctttaggaaatagaggggaaggggttgagatggggaggtgtgaaggtcaagtggaaaattttgctttatctttatagataaatgcttttacattaaaaatgccatcacatattattgtttttttaaaaacctaaagaagtttaagcagatataccaaaaatatcaatagcaattaaatttgtttttttactttccttttttgtttttgttttttagtgtaattttgaatttcaaaaaagaaaaagccttgagaaacacttggcagcaatgataacatagttggtttttttttgttgttgttgttgttgttaagagaggaggtcttagtatgtttctgaggttgaacttgaactcctggactcaggtgatcctctcatctcagcctcctgagtagttgggactataggtgcttgtcaatgtgtctgatttgtggcgtagttcttaaatcttttcaaacttctattaaaaataataactagggtaactgaaggaagaaacaaatgctgggtaggatacagagaaaagggaactcttatacatggttggtaggaatgtacattaatacaaccattatggacaacagtatggaagtttctcaaataactgaaaatagaactaccatatgatccagcagtcccactacataggatatatccaaatgaaagaaaatcaacatatgaaagagatacttgcactcccatgtttattgcagcgctattcacagtactcaaaaggtggaatcaacctaagtgtccatcagcagatgaatggataaagaaaatatggtatatgtgcacaatggaatactattcggctataaaaacaagtggaatcctgtcatttgtagcaacatggatggaatggaggtcattatgttaagtgaaatgagctaggtacagaaagataaataccacatgttctcactcatatgtggaagataaaaaaagttgatctcatggtagtagagagtagaatagcagttcctggaggctgggaaagggaggaaggataggaagagattggtaaaaggctattgtaattttgtaattacaaaattacatttagataggaggagcactgtagggtgactattgttaacaatttattgtatattttgaaatagctagaagagaggattttgaatatttccaacacaaagacgtgaaaaatgttgaaagtgatagatgtgctaattgtgctgatttcatcattatacattgtatgcattgaaatatcactctttaccccatgtgcacaattattatgttaattaaaaattaaaataggtgacagtatatccccgtatcactgaatatgagtaaaacaatggatagcagcaagaattatgggggaatagccagtgaccaggaatggttaaaggaaagataaactatggtgtattctaagatctgaggaaaccagaaaccacaagcaagtgttcacctccaaaaaaggtaccctcagaatgggagctcaggggtcccatctgagaccagcagttgcagttggtagggagctaacaggttacatacagtttgtgggtacaaggagactgtggaaaggtctgagagaataggggttccctgggccttcagtgttctctgacatactcaataaggtttggtcctacaatggggaaaaatttatagaaatagaacacaatttcatcagggcaggaactctgtgagtaaaggagggaaatcttccaaatactaataggtgaatgaccaggaaagatgcatcttagaaagtactggagatgaggctatgcttgagaggctcttacttttttatatttcttggtaacaacagtaaagctaggagctctattctgtccccatgtcccctcttctaatagttaaagagaaatgatctcatttaaacatatgcattagaaaatgactgtattaaaactccacaaaaatatattgtatcaggtcggtgcaaaagtaattgcagtttcagatagtgaattttaaatcattataactaggctcaaacacatacttattaatcaaaataggaaccattacaatcaacacatcttttgccaatgagaaataagtttgtttattcctgtagtatacaaatctgtttcgggatgccatgaactcttggagtgcattttttgcatcctgctggttgtagaagcactttccccacaaaaagttgccgagatgcttgaagaagtggtagtcagttggcgagaggtcaggtgaatatggcggatgaggcaaaactttgtagcccagttccttcaacgtttgaagtgttggttgtgcaaggtacataccgtaagccaacaaataaaacctcagtaaatttcatagaacagggataataagagagcgttctccagccacagtacaatgaacgaagaatgcacacactcaatccaaagatggcaagaaagaagaaaattatgcatagaaaaacttgaatcaacagaaaacataaagatggtaaaaagttggatatattaataatcaaaacaaatagtatgagcctgggcaatatggtgaaacctcatctctacaaaacaaaaaccaaaaataaaaattagcctgtgtgctggtgtgtgcctgtaggcccagctacttcaggggggctgaggtaagagaattgattatgcggtgcagcaagccatgatcatgccactgcactagcctgggcaacagaatgagacctcatcttaaaaaaagaaagaaagggtatgcagtatgtgactgaggttataatgtgggaaaaagaaaatgcaggtatatgctttttacaagaaatgcccaagtagtaaaaggatgaaacatgaactagacaaatagctgcccagcctgtctccccaaagatactaggtgacttttaatgtgcacacatttgattttaggaaggataaagagatctctaaataaaaattccatttcagttcatagatatggaaataatttaaatggttttaattgcatcaagtttgtgattgtttatatgttcccatgtagtttgggaacattacactctgaatttgtcatccatatacattttatttcttaactttaatttttatctcatttagatttggtgggatgctttgtcgtctttttttaagaaaatttaattttattttaagttccaggatatatgtgctggatgtgcaggtttgttacataggtaaatgtgtgccatggtggtttgctgcatgtaacaacccatctcctaggtattaagccctgcacgcattagccatttatcctgatgctctccctcctcccaccctaccctgacagggtgtgttgttcccctccctgtgtccatgtgttctcattgttcagctcccacttattagtgagaacatgcagtgtttggttttatgttcctgtgttagtttgctgaggataatggcttccagtttcatccatgtccctgcaaaggacatgatcttgtttctttttatggttgcattagtattccatggtatatgtgtaccccattttctttatccagtatattattgatgggcatttgggttgattccatgtctttgctattgtgaatagtgctgcagtgcacacacgtgtgcatgtatttttgtaatagaatgatttatattccttgggtgtatacccaggaatgggattgctgggtcaaatggtatttctggctctaggtctttgaggaattgccacggtgttatattggatgctttgtcttctaatgtagatcattcatatggtcttcaagtcttttgtaaattgctgaatgtttgaaatagtttgctgtgattgaaaaggaagttaaagggggaaaaaagcactggacaactagactctggtatgctgctaccactgacaaactttgttactgcctcttgactagtttcttttttcatttatgccctttgaggctctaatatcccattttggaagcagttcttgtggattggggatatcgctgtatttttctctctgtagaaaataccagtgcatttattcgatctgtgcattagcttatatatttcagcaagtccactacttaataaaatgatcatagtaatcccacttggtatatgacatgatgaagatgaaggtgctatctggttaaagatccaaaagaagaggatttataacaaataatgtttgtctggacatttgaatttaagcatcgaaaaggatattaatagaacagtgtgaatttccaaagtagacataatgcagctatgcacatgatagaataaaaatagagcttttgtcttattttttaaaagcttaggagaattaagacatgatttaatgttttatgatgacagtattttgccagttttttattaccttatttattatatattataatgcattaagttgatactgattatcaactatgtgccaagcattatactgttacatgtgaaatggtaaactgtatttgggcagacgatttcccatggcatttttgcatgtcttgtattagcatttgttctggactatcttttcagggattttggtgcaggaaacagccttgagaaacagacatacgtttggcacagggcagatttttttttttttttctgaccatgataataaagatgtttccctctgaggcaaaggttggacaggttttctggcagctcctttaaaagactggagttttcaaagcttgtggttccttctctgtgatgcaaactcactgtgtgtgtgcagcatccacctgtcttgcttctgctttaaccctgtgagactttggaggagagaggggaccaatacaaacatgaaggtcatgatgtctgttgtgcaatgaataatgaaacctttaatctctgaccctgtaaacttagatattttgctgtctatggaactatcaggctaatttgttagcttgcaagtagggtaaaatatcagaccctttgtagttcttgacccaatggagattgattccttggtattagagcatttcttctctagtggagaagacagaaagtgaaacagttacttacagtatccttgataattgttatgatggtatggaagcacctagctggagcacttaattcagttaactagttaaggaagagtcaaggatagcttaccagaggaagtgacatatttagacctgaaaaatgagaataagttaggcaaaagacagagattagaaaagagtttatacttccagatatgtgtatgcataattattttaggcttcccttttttgttttgtgtttatgaattactttgcacattttaaactcttggaagagacaggaaccatttcatagcctccatgggttacattctgtagttttccttaggtataaggtgtatttcttcatttcttataagctgcatgtggttgatcttttgtttaaaaaaagtatatgtatttaaaaatgtatatatctatctgtccagtttgccaattcttgtctttaaattggagggtctagtctctttacgtgtaattattgacgtgtttgaatttaaacataccatattaccaagtagctttttatttgtcatgtcggttcagtacatttttctttttttttcccactacttttggatgtacatgtcttttatttttattcagcatccccctttattaaccttaaaaaattattattttgctattcttttagtggtaaccctagatattataacatgcatgtttgatttattaaagggtaaaataaatttatacttttatcattttctggacaattcatggatcttcaaacactaatttcatttatccttctcccaaattcagtgctattgtttttgatatattttaatcttttccatcttttaaagctcttctggacatcattgttattgataaacatagtaaatatgtatttagatttatccatgtgtttttcctttttctagcctttatttcttcctgcatgtctaagcttccatctgggctcatttactttctgcctgaaacatagattttagtattttctttgttggaaatctactttttacagtctctttttctttctctgcaatttttaaatttttccttcacgtttaaaggatatattcctagatatagaataacagttggcagttattttctttcctaggtttttaaagtttttgaaagagtctcactctgttgcccaggccaggctggagtgcagtggcacgatcttggcttactgcaacctccacctcctggattcaagggattctcctgcctcagcctctcgaatagctgggattacaggcatgcaccaccacgcctggctgatttttgtatttgtggtagaggacttgtgttgtcatctgacttctgttatttcagttttcgaacaatatgttgctgcttctttgaaggtaatacatctttttctcgtcactttttaaaacaattctgatttttagcacttttcctctgatgtgtgtagatgtgattttttttttgtactagtgaaatggatgatagatcagaaatgattctggtatctatagcttaatttatttaactggccttgaaaatttgtttgtaattctgtgttcaaacactgcttctttatttctttctcctatccttcatgaagtgtaattataggtatgatagccctattcattgtatttcacatccttttttcccccctctgtttttatccttatgtccttactatgtccatatgactgaattttttttgatgtgtattctagttcactcattacttcttcaactgtatgtaatgtgctgttaaacctaccattgaattatcaaattcacttatttttcagttgtggaaagtatgttttatactcttctatggttttttgttttctgctgaaatcttcaatctttttttgtttgttagtttttgaactgggtctcattctgttacccatgctggagtgcagtggcgtgatctcacctcactgtaggcttgacctcccaggctcaagtgatcctcctgcagcggcctcctgaatagctgggactacaggtgcatgctactgtgccacagctaattttttttgtattggtggagatggggctttaccctgttgcccaggctggtctggaactgctgagttcaagcaatttgcccgcattggcctctcaaagtgctggaattactggtctgtgccaccgtgcccagccctcaatcttgtttttcacattagtaattattgttttatgttctggttctgataacttcattatctagtcatttgtgtatctgcttcattatctaggaccctatatgtctgttgctttccttagcttttattcacttctaatcatttagtatggctggctattttttattgatgtctgaataaagtatataaaaattgtaaacgcaatttgaggctttggatactgttatcttccttgagagaagattacttttgatttacgctggtgctggtgtgtaggcttgggaccctggcagtcacagattgttacaatccaactaagaatagggatgatttgaagttgtgcctggtctctgcaaggacttacctatatcggtttttgttttaattgaaatgaaattcacaatagctatagttcaccattttaactatttaaaagtatacagtttagtggttttagtatacaattttcccttcgtatccttgggagattagtttcaggacctcccatggataccaaaatctacggatgctctaatcccttaaggaaaatggcttaatatttacatataacctatgcatatcctcccatatcctttaaataatctctagattacttataatggcctatacaatgtaaatgctgtgtaaatagttgttatactgtgttgtttacgaaatagtgactagaaaaatgtttgtgtatgttcattacagacactgtcatccatttattccccaaatatttttgatccatagttgtttgaatccatacacagagactctatgcatacagagggcataatgcagctctgtatttacaatgttgtataatcatcatctacttaattctagaatacttccattacattaaaaagaaacccctcatctcccaatttcctcatctcatcaacccctggcagtccagtaatctacagatttacatattttaaatggaatcatacaatatggtctgttgctactgccttctttctacttaatatatttggcctttttttgtaacccttacttttggggtatacttacttgcaacaattcttggaagtctgtgaaccctagctttgtctcactgttttcatgggcatattaaaatctttgttcaggttctcagccctccaactgttgtttttacagtgggcatttatcttgagagggaaagtagcctaaagtctgggcttacatctctgggtttcctttctctcttgatctgcctttgcagtcctagttttcttggtagctctctgatgtcttcaagtattgtttttatgttttatccatctttctgattcccagctcattggaattagactatgtaaatatttgctgaatgactaaattcatttattgaaacattatttattgaatggaaaatatgtgccaagtactggaggtatagtagtgtacaaagcaacaaaactctctactctcccacaggttacattttagggacagttgataggaaataaagcatacacctgaaatacatagtatgtcaaaaggtggaaatttctgtggagagcataatgcagggaaagatagaatgagttctagggtgttgagagctgtttcaagtaaggtaagttagggaaaacctctttgataagatgacatgggaagagttaactgaagggagagagccatatggatatcagtcagagggaacagaaagtataaagaccccgagtcaaaaatgagctgtcccactgtccaagcaagagtatggctggagcagaaatgaggtggtagattagctcctagctctgggggttggacagatcatgtagagtgctgtacaagtttggattttattagaacagagttgggaagctgctggagtgtcttgagtagaggagagacatgatctgcttagcactcacattgatcctgttaaaactggtatttcggaataaaccagatcctgggtggtgagggtggatgcagagacaccacctggagattttttcagtaacacagacaagggaggaatactcttttagatcagggtgctagcagtgcaagtagaaagaactgaccagaatttagatatattttgaaggtacagacaacccagtttgctagacatttgaatgtgggggcatgagaaagtcaggagttaagttcttggcctaactgatcagaaggatggaagtgccattgagtgaaactagaaagctcgctagaggatctaatttgcaggtgggataggcagaagatcaagagtttgttcttggccctgttcagttttatatgcctgttgtgcagctaagaggagatgacaagaagtaagttaaatatatgaggctgcaaaatggtctgaggttaatatatacatttgtgagttattagtatcttgttgatactaaaaaagctttgagattgaatgaggtcatttaggggtgaatgtgaatagagaagagatgcaagtactgaaaacagagacaattcaaattttataagtccagggctgaggaggactcaataaagaaggtagatggggctcatgcttataatcccagtactttgggaggccaaggcaggaggatcacatgaggctaggagtttgaagaccagcctgggtaacatagtaagacctcatttctacaaaaagcgaaacaaatattagccaggtgtggtggtgctcacctgtagtcccagctacttgggaggctgaggtgggaggatcatttgagcctgggagatcaaggctgcagtgagccgagattgtgccactgcattccagcctgggcgatggagaccctgtctcaaaaaaaaaaaaaaaaaatagatgggccaggcatggtggctcgtgcctgtaatcccagcagcttggggaatctaaggcagaaggataagttgagtccgggaatgggaattcaagaccagcctggacaacatagcaagactgggtctctacaaaaaaaaaaaaaaaatatatatatatatatatatatatatatatatatatataagctgggtgtggtggtgcacacctgtagtcctagctacttggaaggctgagttaggaagatgactggagccaaaaagtttgaggctgcagtgagccatgtttgcctgggtgacagagcaagaccccatttctttaaaaaaagggctagtagctcaaggatgaagtggagccaatgattttttttttttaagttgggatagattttactgtgtttgcatgctgaagcgaatgatctagcaggtcaaaggtcaggaacgagtcttgtagcagttttcttgaggaggggaacaggtatggaatgtagagggcagaggacataggtggaaggtgggctctgtatagtcctgagggtagttcatccacaagagaagggaaggcagattattttggtaaccctacagggttaatagatagaacatatcaaagttgcctttcatcaataagagtaagaatggtggaggaggtcctgtaagtttaagcagggaagagaagcagcaaaatagtaaatggaaaaggaaatagatctgggaaatggattgtagaggagcactgagataatttcaccttctcatctataaattgagaaagtttaattagatccatctcaagacttttaaatgaataagtaattgactaaccacaccttgaatactataatatacaaattcttgctattacttgctgtgacttcgttgtcaaacagtaaaaacaagtgtttgatatggatataatattgatataaacagaattattaatgttagtgcatataaatatgacattcaaatgcaaatcttattgctagcaaaaattttttgatattaatttctatatatagtttaagctatagattatggaaaacagaagcaatgcccatagttggtagttcacatttgaactacataatgatctcgtactactcctaagaatttctaaaacatatttatggaagctaagtttaggtatgtatgttcatttcagggaatattcattttaggctacttgatattttacttaagcttaattactcacaggtgtgctattgcagttgtatgataaaggaaataactaaattttatgactatccaaaacattctttgtgattttttactatctataatttttttaatttttaatacagtattgctctgatatttagcagtattaatcacttgtcatttatatctgtttatcagtgcatagtgccagtgaagttgaagtcatagatactattcccagtaagttttcctccgtatttagttctggctgcccatgtcatactggaaaaataaggcaacttaaatttattgagtacttttaaagttcattttatgccactataatagaatagtacagactgggtaattggtaatgaacagaaatttattggctcacagttttggaagctgggaagtccaatatcaaggtgctggtatctcatcagggccttcttgctgtgtcatcccatggcagaagagcaaagagagggtgggagagagagcaagagggggcctaagtcatccttttatagggaacccattcttctgataaggagccctctcacatgatagtggcattaatcaactcgctccaccctcatggcctaatcacctctctttaggacccatctcccaacaatgttgtattggggattaagtttccagtatatgtcttttgtgggaacacattcaagccataccaagtaaatagcctaagtgagtcacttttgagtactttacatgtggtagagtctttagtcctgcagctatcctgtgagataggcggtgttattctgaaaagttccatgccaaattatggatttagtaagtgacagggttgggatttatttccaagttattccaaatctaaagactgtgccactattaatgatcaattatagttcagtaaagtatattttgtataacatttgaaaataaaacaatggttatatagtcttgtgcctgtgaattgttcttttttacctggctgtatatcatctttaattagtgccttcctggactcagtcaccttcttttaattagcctttattttatgttcttattagaaacttgataatttctacattattgaaaaaagaaattttgtaagtaagagactgcttaggatattatggagtggaactagagttcgagaattgaatggcattaggttggctcctgattgtgtactttagggataggttatttttgtggaagagttagtaagaattcttttatcaaatagatagttaatagactataaggggtagatggttgaaaactaaatatttaaatgttattttaaagctacttacaaatatactgacatcacacaaatgatatgaaatacttgcttaatagatatataatagtttcaaatatttcagtgcatactatttaggtgcttctcatagaatggtcaacaagaccaatgtggaacttatcattagaagtttatagtccagtgtttgtatataacccaaccctgagagatatatctagcccccacccctagaaacttactgttttccctctgattgtaaaatattcattttacaaaatttgtggaataggaaaaaatataaagataaatggaaaagatttataagcccacagctcagagatacacttcggacatatttcactttagtttctttttcctttatacacatttattagcatgaattaaacatgtatcttttttttttttttgagacagagtctcactctgttgcccaggctggagtgcagtggtacaatcttggctcactgcaacctctgcctcccaggttcaggcgattctcctgcctctgcctcccgagtagctgggtacaggtgtgtgccaccatgcctggctaagttttctatttttagcagagacggaatttcaccatgttggccaggctggtcttgaactcctgagctcaagtaatccacctgccttgccctcccaaagtgctgggattacaggcgtgagccactgtgccctgcctaaacatgtattttataagaaaaatctgtttgctacattttgcttttagtttttaattttcagttcttttttttccttttgtctcagggtcatatatgtcattcttttttctcctgtgactcacttaatctttgtattttctgatccattaaattctgctttaacatgtataatttctttttatttactcagttttgctttttagaaattctcaactgcatgagttaaatgcctgacccgtttattgttattatttgctgcttttaatttttgttgaaagctttttaaaatagaaatttttgtaaacaccttctcattaggatataaacacagttatttgggaagttacattcctttcctgttattagcaaaaaaactttttttttatctcaagcaggttctgtgaattgtagggaccagagaacattattttgttgttctagtcacgtattttttatttctctcaaacaagttttgaacaagtgaatcttctctttttcctttacctcatctggtaatttttgcaatctatttgtgccatacttgcagtcttaaaacattttttttgtttgatttttaccacttttaggccttcagattctaaattcattatgtactctgatgccaaagttgttgcatacttcacagttgtcttcttagtagattattgtactactttggcatcatagaaccagaaggccttagaggtcatataattttgatgaatattattttttaaagatctggaaactggggcttggagaagaagtaaactgatgtacctagctcactaaactaatgtacttctgctaaaaggttttagcagaatctctacttaaaagcaggggtctactgggaccagggcaagcctcagtccttactgtgagatgaaagccaggccatctgccagccccactctgcaaggtgcctactccctgcaaacacagaagcttcttggtgggagcagacaccagacaaacaggccaatgtggggacaggggcggggccctacctgttggtgccactgggctcagtgaggttgcccaggccttggctgcagcagtcccgctgccagcactgggagaggttgaagagcacgagacaggccaccagggccactgtcagcagcatgacctttggcttcaggctcatctgcaagaagatggagcaggcaatgaagcccaggacacagctgcaggtgtagtactggggaggggttggtgtcactcaggacagggccgcatcatcacctcctcttgcctctgatccagcactgaccccagagccccactctccagtgcttcagcatcgtgctcttgccttgccgcctcccttctcaacaaaaagcaacgagatctgaaaaaaaaaaaacaaacaaaaaaaaaaaaccacacacaaagcaggggcctagatctctttccatttaaccccattgaatctgatttgaatctggttagtagttctgtgagaagctattacaggatttcagataataagataattgaaataatgtagctattcagatcataaaactcatttaataatgagttattgagaaactaagtattgtgatctaagtggtgttttaggaaggtgaatttggcagtggtattgagtggtgacataggaagatgggaggaggcaaaaaagagggattttgaaactgcctggcatggttctgtgttccatcccagatatctttaacaaaagctaacaaacagtatatacaactactttccatttttttttaatattgtcagttttcttttatgtggactaaagcattacattactctaacaagtaagataatattgcatgatacaataatgaaatattatttaattcaagtcatatagtcattatttttgaaaaacaaaaataatgagaaaattagccttcagaaaaacattatgaagattaggaataattacaaaaatattttagtatatatttaaattctgcattttaaaacgtctagaaacaataactttttatattatgagttatattcataatataaaaatactctcttcagtgtgctctatttgagaacttacataataacctcatttaacattatgtataacagtgattcaggtgggcagattttatttcacaaagtgcagttataattatggctgaattttgagattcggataaaaaaggaatatagatattagtttttctcatataatctttatcttttattcattcatttgaaagtcattcattacacagttgcattagaattgaagcaaataactagaataaagttatgttttatatcaaagcacttaattcttaaaaccccagatattcaagtattgtttacaattaggatataaaaggttagaaatgatgtgcatgttaactctcatgtaacttttgtgagttacactttgatgtgattgagtttatttctttgtaattatattctataatttttttgccatatgtgtatgtgtgtgtatgtagatatatgtatacatagtgtgtgtatacatatatacacatacatgttaaaatgaggataacttgtaaagcgacttaagttttatggtaaaaatggagtttattattttgttagaatctgagtattacatctaactgggatgtatacattgtagtaattaattcatcagcaactaggatatcttggacatttgacaactcatttgttgagtcccgttttggaggggacattttcttgcatgacagttgcaaactgttatctatcaggcactgaggcaggtactagggtatataatggagtgcagagctacaatacaagctccaccgtccttcagcttgtatgtgtatacacacacacacacacacacacacacacacacatttatttattttaatttgagacagattgtatacacacaaatcaagtatagattatgtagtgctaggaatgaaataatgtatttttatccagaataatggagacatacggtattttaggtagtgtagtcagtgaatgcctctttgaagaggcagcaactcaaactgagaagtataagaaagagtcagtcctgctaagagccagttaagagcatgttagaaagaaggaacagtgagcaaaaggcctgggagttgggagaaagtgtgcctatttagaaaccaactaaaatctgagtgattggatcctttaatgagcaaaggggagagtaacatgattacattggtgaggtagacatgagtaagatttattcaggttttgtcgactgtgagaaacagtttggattctgttacaagagcagtgggaagccattgaaagactttaggctaggggagtgacataatttcttttatgttctaaaaagatcatctgccgcagtgggaagggagcaaaggcaaaaaagtggtgatctagtgtagtgcttcatttatagtggtgacacagttatttttttttattaaataaagtgaagaaactagaattaagcaggaatctgttgtttctagttgtttccagtagggatgtttccatctgtacactatttttagtaaaaatgcataaacctatgttttcatttccgttgggtactgagagtgctgagacctacctgtgggtaaatgtgtgtttagtgcctgttataagaaatttgccaaattgttttctaaagtggctgtgtcactttgtgttcatataagaaatgtgtgaaaggtccagttgttttacatcctcttccatacttggtgttgtcagtctttttgatttgaatctggtagatggatagtggtagcttactgtggtttcagtttgtgttttctgaatgccttatgatattaagtatttttccatgtgcttacagaacatttttatatctttttttgaaatatctgttaagatcatttgtcaatttaaaaatggcttatatttttaattaagatgtgagagttctttatatattctgggtacaagtcttatcagatatataatttgcaaatatttttcttcaggctccggtttgtctttccattttcttaatagcatattaattctgtacaagtctaatttattgatgttttttcttgtccttttgtggcttacttaaaaaatatttgcataatccaagacaagaaaagatttttttcttagaggttttgcagatttaacccttatatttgcatatgatataaagtaaggataaaagttcatgtggctgtgtggttgtttctgttgttgtaaatactgttctttctccattatttatcttgtcacctttgtctcacatcaattgatcatctattgatttgttttataatttatgtgggtttatttgtgggtttatttttggactttctattatgttctgttaatgtgtatgtctattcttatggtaatgacatattgccttgatttttgtggcttccttgtaagtcataaaatctggtagtttagggcctctcaagtttgttcttcagtctcaaatttgttttggctattgtaggctttttgaatttccatatacgttttgtaatcaatttgtgatttttctaacaaaaaaccaggcacaattttgattaggatggtgaaagatgaatttggaagaccaagacatcttctcatacttaaatatggtaaatgtctgtatctacttaggtttttcttttctcttgttattattttttaatcttagcaatgttttgtagttttgagtatacactttacaaatatttagatgtacttactactttgtatctcatctttttgtattataaatgatattctttttagttttaatttattgtttcaattgttctttgccagtataaataaatgtaatatgtttgtgtatattgatcttaaatcctgagaatttggtaaaattctttattaaattagaacttttgggtagattccttaggattttgcgtgtagatgattatgaggtttgtgaacagagatagttttacatcttcctttccaatctttatgcctttaatttattcatttttcttcctgttttgcatttggttgagcatccatgataacactgaatagaagtagtcagagagaacatctttgctttatttatgaccttagtgtggaaaccatgcagtcattcaccattaagtatgatgttagctataggttttttatagatgccttttatgaatatctggttgaggaaattctatttctagtttgttgagagcttttataatgaatatttttgaattttgcaaatgctttttctgtatcttttgacatcatcatgtggcttttcatttttagtcagctgatatggggaattatgtcatttgagttttttttttttattgatgagcaaatcttgcactcctgggataaaaccaacttggtcatgatgtcttttttgttttttaatatgttgctggatttaatttggtatatattaagtgtttttgtgtctacgttcacgatggttatttggctgtagttttcttttctttgaaatggttttctgattttgttaccatgatattgttgactcatgggttttgaaatgttcctttcattaaatttttttttgttttttgtttttttttttgagacagagtctcactgtgtcacccaggctggagtgcagtggtgcagccttggctcactgcaacctctgcctcctgggttcaagcgattcttgtgcctcaggctcccgagtagctgggattataggcggacaccaccacacctggctaattttttgtatttttagtagatacagggtctcaccatgttggccaggctggtctcgaactcctgacctcaagtgatccacctgcctcgattaaaattctgagaaagattgtgtagaattgatagtaattctctcacgagtgattgatagaattcatctgtgaaatcatccagatctggggttttgtttgcaggaaggcttgtaactacaaatttaatttttataatagatataggactatttagattggctatttattcttaagctttggtagtttatgtcactcaatgaatttgtctttttaatataagttgtcaaattcataggtataaagttgttcacaagaataacttatctcttcatagtgtctgcagatctatagtcatgacttttatttgtattagtggtaatttatattggttctctttgcctccctccagccgctccagctgtcccacacctctttgcttcatcgggctagataaattacagaactaaccaacatttgatttcaccagtattgttttattgggttttgtatctttgtttttttccctcttgttctagttatattttttctttgacttattttgagtataacatgctcttcttttatagtttcttaatgtggaacctaaggtcattgaattgaaagcttctatagtaatataagtcttttaatgttatacatttctctaaagcactgttttagctatatctaataaattttgatatgttacatttttatttagctcaaaaattttctaattttcttggtgacttctttgatctataggttatttggaataagtttccacatacttaggtattattattctgatgtatagttttatttatttttaattctaccgtgatcagatatcatactttgtataatttgtcctttaaatttattgagatttcttttgcaatctcagatactcttagcttgatgactgtttcttgtacgcttttagaaggctatattttctgctgttggatggtatgtatgccccaataacaatttagtaaagttgtttgatagtgttgctgaaatcttctatattcttttgtaagacagagtctcactctgtcacccaagctggagggcggtggcacgatcttgctttactgcaacgtctgcctactggtttcaagcaattctcgtgcctcagcctccgagtagcttggactacagctgcgtgccaccacacccagctaattttcttgtatttttagtagagacagggttttgccatgttggccaggctggtctcaaactcctgacctcagtgatctgccttcctcagcctcccaaagtgctatgattacaggtatgagccactgtgcctggcaaatcttctatattcttattggtggattttttttatatggggggaggtgtctttttaatctactgagacaggtgtgttgaaatttcaacaaaaattgtagatttgtctatttctctttcatttgtataggctttgcttcttgctttacaaagctattattagatgcattcacatgtaggattgctgtgccttcttgatgaattgattttttttcttcatatgagaagcatcccttcttccggttactgttctttttataaagtctaatttgtctgatattaatttagctctcatttttttggagtttttttttctgcatagggttatttttgtgtcatgggctggcaaactattgcctatctgctggctgcctgactttatagttttatcggaatggtggcacaccttgtctttacacattccctgtgtctgctttcaagttacaggtgaagaattgagtagttatcatggagaccaaatggcttacaagtctaaaattttcagtatgtggccttgcaagaaaaagtttgctgaccctctgcatttttttgtagacagattgtaatggagtcttgctatatttcgtacattcttgtaatctctgccttttgagtcatagttttagattatttacatttaatgtaattattaatattgccacaattctggcagttatcattgctgtttattccgtatttattacatctgtttttctttctccttttcctattttatgtctggttttggattaattgaatatttgttatgacttaattttacacatactcttgatttattaactacacttttttttttacatgtttaatggtttttctagagtttatcatatgcatcattaacttagtgctctctaacttaaaagtaatatgctacttcaagtttagggttaagaaccttataaaagtacacatatatttctcccgccatgtcctttgtgctgttgttgttactgtttttatttctacgtgcattatcttaagcccatagtacattgttgttatttttactttagatagttatgttttaaagagatttcaaactgtggaattttttctaaacaagatacttaacattctggtgctcttcagttttttgtgtggatttaaaatttctgtatgttttcttctgtctgatgaagttacttacatttctcatagtaaaagtctatgagcaacaaattctgtcttgtagttggctgcagaagtctttttttgctttcatttatgaaatagattaggatttttacttgttagactaagagaatttaaaagtgtatagtcgtttggccattaacacttcatttttaactcattttacttgtcacttgactactggcagtcaggtatccttactatatctattgttatagacatataaagccattataaaggtggttatacagcttttgaaaaattgcgtgttgctttaaatatatttgaaagatgtattttcaagtaggcactttatgatagtcactccctttgttttcccttccctagagtttttatagactgtatttgtagcagcatttgatatactcttgggtacagttatttctataacacaggaaattgccaatatgaattacttgagagaggaccagtgtaaaagaaataggaagcaaataagtaattttctattttacttgcctttgtttcttagctggggtacagggtcattaatgtttattatgttcatgtgtaaattataagtatttttctgttatttactaaacaattatctaaaattcatttattatacatgttgatgggggcagatcttaaaggttaaatgcttggtggagataaatatatatgtcttgggcatggtttctctggtattcatatatttatttatggtattgagaagacatggatttaaattctgatgctaacactagctttgggatcttgggctggttatttaatgtatgccaacctcagtttcctcatttgagacacccattgcacagaattttgagaattaaatgaggctatacacataaattactcagcatgtgataaatgttcacaaaatggtgattcttaattatgtttctgcttacatttttatctctgtataatttcatatagctttatctagaagaagatttatgttttagaaattaataactcaagagctttataatatagattgtgcctactttgaaaaataatttgaattggcttacagtgaaagatagcagtatactaaaggaaggaaagcaaaaactagtcaggaagacagaataaagaaaggagataatgaagacaaatatagttatcaaaatttgatccttaatttttaatttcctggaaaccaaggctaaaaggataatatggtggcttacactattcttattgtatattaaaagaaagcatactagttcattaaggtgcttaacattttcccccagattttatgataagaaaaatgtatttctttataaagggacactgtcagtgtaactgatgggagaagtcacctacaggtcagatgcctaaggagatgagaaattatactactgatctcatactatattcttaacttgtttatattttaaagggctttcatacttttttcaatttttatctttgtgtcctgtataagttatattaaatataatttatagtagagctatagtagatcctataaaagtatgcgatcatagaggagggtagtattaattttgaaaagaaatgtttcagatgatctcatcaaggaggtggaagttaagttgggccttgaagacattactaaggtttagagagacaaaagtacgtacatctgtgtgtgtatgtaaatatagttacctatacaaaagaaaaagtgtgagtaaaaacaaggaaatatagaataatgcagtggtcacaaagtagaacatggcagaagtgagcttaggaagactgggcaggtcagatcttgaaggatcatgaatgctattaagaaatttggtctttctttagaaaatcgcaaggctctttttcttccaccttttattttaggtttgggggtgcatgcgcaggtttgttacgtgggtaaattgtgtgtctttgggggttggtgtacaagtgattttattacccatgtggtgagcatagcacccactaggtagtttttcaacccttgtgcacctcccatgctccactctcaggtaggccctggtgtctgttgttccccttttatgtccacatgcactccatgtttagctcccacttacaggttacttccattttctgatggacttaaaagtgggagcttatttgtgttcatgtgataatttgcttaggataatagcctctagctgcaaccatgttgttgcaaaggatgtgatttttttttgttatggctgcatagtattccatggtgtatatgcaccacatttctttatccagcccactgttgatgagcactgcattgattgcatgcctttgctattgtgaatagtgctgcgatgaacatacaagtgcgtgttgctttttggtaaaacaatttttattccttttgatgtatacccagtaatgggattgctgggtcagagggtaattttgggcccggcgtggtggctcatgcctgtaatctcagcaccttggaaggccaaggcagatggatcacccgaagtcaagagttcaagaccagccagaccaacctggcgaaactttgtctccactgaaaaaaaaacaaaacaaaaattagccaggtgtggtggtacacacctgtagtcccagttacttgggaggctggggctggagaattatttgaacctgataggcggagtttgcagtgagctgagattgtaccactgcactccagcctgagtgacagagcaaaactctgtctcaaaataaataaaataaaataacataaaataaaataaaagtagttttgttttaagtcctttgggaaatctccaaactgctttccacagtagctgaactaatttacatcccaccagcagtgtataaacatttccttttctccacaactttgctaacatctattatttgctgatttttgtttttagtagccattctgactggtgtgagatcttacctcattgtgattttgacttgcatttctctgatgattagttatgctgagcaaatatacttgttggcctcatgtatgtcttcttttgagaggtgtctgttcgtgtcctttgcccatttcttaatggggttatttgttttttagttgttgatttgttcatatttcttatagattctagatattagactttttgtaggatgcatagtttgcaaatattttctcccattctttaggttgtctgcttattttgttgatagtttcttttgctgtgcagaagctctttagtttaattaagtcccacttgtttatttttgtttttgttgcaattgcttttggagacatcatcttgaaatctttaccaagacctatgtctagaaggctatttcttagatttttcttctagggcttttatagttttaggccttacatttaagtcttgagttgattttttgtgtatggtgaaaagaaggggtccagtttcaatcttctgtatatgtttagccagttaccccagcaccatttattgagttagggagtcctttcctcattgcttgttaatgttgactttgttgaagatcagatggttgtagatgtgtggctttatttctgggttgtctaacctgttccattggtctgtgtgtctgtttttgtatgagtacctggttactgttgccttgtagtacggtttgaagttgagtagtgtaatgcctctggttttcttctttttttaatgcctgtgacgtctttgttttagactgagagctctagtgggagagtgatgaattgaataaaagagatgtctcatccttttatctctcactagtctcacttgtctctcttactagtctcacttgtctctcactagtttattttgctatcgcttacattttcttctccatcttcattttgttttttacagactcaggttattatattaggttattctaatgatcagtgagaggttcttttctgttttaatctgttttacatactactgacatgctgagttgtttggaaaaaattttaattagctccttattcctattctaagtgaacaaattcttttgcattttgattttttttttcttgaagtctgatataatttggctctgtgtcccaacccaagtctcaccttgaattgtaataatctccacatgtcaaggacaggaccaggtggagataattgaatcatggggacagtttcctccatgctgttctcatgatagtgagtgagtcttatgagatctgatggtttcataagcatctggcatttcccctgcttgccctcattctgtctcctgctgccctgtgaagagatgccttctgccataagtgtaagtttcctgaggcctccccagccatgtggaactgtgagtcaattaaacctcttttctttataaattgcccagtctcaggtatttcttcatagcagtgtgagaacagactaatatagagcctccttgtaatctcactgtatttctctgctttctgtttgctgactgttccctgctttgtttagctagtgtgttcactgctctttatgttttatatctcagttttttctctagtatggggcactttctgttttcaaatgcatggcaatatctttcatagttatccatacccattgcaaatctcatcttttcatgaagatgtattttattggactgctattgtactatcctcttttgtttctgaactgttggttaatacattttagcaaatgattgttccataattgttttatatattctttcaattggccagctagattgttagcttctaaagcagcactaccaatagaaatataaaatgagccagacatagttttaaattttctagtagccacatttaaaaatcaaaagaaacacataaaattaacattaataatatattatattaaactcagtatatctgctactttggtggttagctgatattttgacagttacctacctaaaatgccaagatagagaagtattctattactacaaatatagtcacacccatcctcttaccctcataaccctaactcttggtaactactactctcttttctgtctttattatgttgtcatttagagaatgttccataaatagaatcgtattttatgtgatctttggagactgcttttcttcactcaacataatgtctgtgatatttatccaggttgttgtgtgtattgacagttggttcctttttattgctgagtagtattccatggtatggactttccacagttcatttagccatgtactttttgggagggcatctagttgtttctactttatggctattacaaataaagctgctattaacaattatgtacaggttttgttgtagctatgtttccgtttccctaggataaattcccagtagtgaaattacttgataatatgctaactgtatgtttagttttgtaatatactgccaaactattttcagagtgattgtaccattttatatccttacaagcaatttatgacagatccacttttttttttttgcatccacaccagcacttgctgttactactgttttctgttttaactgttctgatatatatgcagggataactctttgtgccatccatagatcctctttgatcaaatgcgtgttcatgttttctgcccattttctgattcaatggccagcttctttactgttgatttctgttacattctagatgagtcctttatcagatatgtggtttacaaatactttcttccagtctgtagcttatattttcaactttttaacatgatctttctcagagcaaaagtttttatttttatgaagtccaatttattaatgttatcttgaatggatcctgcttttggggtcatgtctaaaaacttttagccaggctctaggtcctgaatattttctgctatgttatcttctaaaagttttatattttacatttaaactatgattaattatgagttaatttttataaaagatatgaaatatcttataggtggaggttcatgttttttggcctgttgataaccagttgctctgacattgtttgctaaaaaggttgttcatcctccatttaattgcttttgtatcttttttgagaataacttgttgataatcatttagggctgtttctgggttctcgcttatgcttcatgatctatgtgtctatcaactcaccagtgctacagggtcttgaattattatagcaagtcttaaaattagagagtgattcctcccactttatttttgtttgttcaagaaaaaatttaaggtattgtaattcctttgcctttcatataaagttcagaattatcttgtttacatctactaaaaatatttccgggatttatagaaaatgcattaaacttatatgttaatttgaggagagttgatatctttattatgttgaatattccatgaacatagtatgtttctatatttatttaggtctttgatttctttcatcagtgatttgttgttaagaatgatagtcttgtacatagtttgttaaatttacatagacaattaattttttagtgacagtaaatggtattttaaagtttctgtttccacatgttccctgatagtatatagaaatagaattgacttttgtatgttgatcctgttacctagctaaactcactgaatggttacagagatgttttcctagattccttggtgatttctttaggccggttcatgtcatatgcagatggaacagttttatttcttccttttagatctctgtatcttttatttcctttgtttgccttattactctgcatagaaattccagtactgtgttgaatagcagtggttgtacaactgtcaacactgtctgcattcaaaactttttcatcaccccctacagaacctttatattcattaggcaatacccccacatttcccccttcctcatctttggtaactctaatatactttctttctctatgaacttggcctgttttagatatttcatgtaattgcagtcatatatttgcctttttgtgtctggttcatttcacttagcataatgtttcaagattaatccatgctgtagcatgtatcagaacttcattcatttttatggctgaataatattccattgtatggactatattattaaaagttattataaatttttaataattaagactgtagtattgggcttctttctttttgtttctgcttattcatattcctttgttcagttacagcaatggtgagaggacaattttctcagaaacttttcttgtctatttgactgttgagggcacaaacaattagtctataacattatgtgttatatatgatatataacacatatatatgtgtttatataatgatatataaacatttagtctataacaccatagtctataacaccactgctgtggtgtggatggctgtaatgggagtccaagaaaaaccatctttgtgggtactgggaggagtttctggattaagtggtatctaaattgatatttgtagatttaatggaagttaacaaatccagagtttgagagggaaccctgtatcatgcatagggagtaacacatacaaaggattttctatgaagtgagggatggtattgtagaaactttccttatggcagtagctgggaattagaaaaaactgaggctgggagttaatttgggctttctgaaaagtgttaccattttagagtttatccaaaataacaaattgcaaagaaatccagcagtttaacaattgttcactttgatttaaataatgaacattgaattattgcgtatgatcctaataatctaagatttcaaatcaagatatttaaagactcactctatacctaaaacatacacaaaaggtacttaaattgctagtatttataaacctcagtgctcttagaagacaacatgtttccaagtcagcattttgtatttcaaaatttttattcagtaaagtttatttactttatgtaaataaaagttactgcagtttaaaaagctcagctgtgatatttattttacacaaattcacttaagactgattcttgagtagcaagcatcattgtggaccacttctctaacagcggtagtaccttttagaattttttgaaggcctggaggaaaagaacaccgttaactgtgcaaatagagtatcacaaagatgcattcagatttgtaggatgtctcaactggtttatccttctcttttatatatggtcacagtgatttgacacatcttttcgaagaacagatttttagtatttagctttgttttttatttagctttttcagctttgctacatcatttcctttgctttttaagatgttttcttacgtgtttttaaagtatttttatttgattttcttatatttgaaccttcaaaatcttctttcttgcttttaactttaacaaattcttttaaattatggtctactacatgtagatgtttcatttcttacccataaaaatcattgtttcctcattttactcttcatagagctttataaatatcccctctctttctttctttcttaaatctacacctctgacttcatagcaagtgattaagtgcattttgtagtctatattaggatcctggatctaccgcttacttatgtgtgaccttagtcttgttgcttaacctcacttatcttcagtttctttctatgaggataatgaagcctcactgtagttcttcataggatcgttagagaattgtttaaataatgaaggtcaactctttttacttattatatgctttagttgctaataagcaactcattacaagcaaataaatattttcctaatcttgggatgatattttcattcagcagttagcctctttaacacgaatgtattaaaagttaacaataaaggttataaaaccatctcactgtagaaagcataggcccattacaacatctgtagtaaatatttttactgcttccggcaattaaatcagagagctaaatgatacatagaaaggggcaatgtgtttttggctgcgaaagatgtacactcaggcttcacataacagagcctgattgttagaattacatatattaattgttaattcctttcacagccgactccaccagcacccctgcaatgagcccatctctgctatttacatatgtaattatttggctctaccagactctgctaaagcagttacaactggtttaggagattcatctaaaaaaattctccaatactctacaattcaagtgtataccctttattctacaaatttatacagaggcccataggcataaacctcattatcggcttctattggttcaatcaataagtgtccgtattgttgattttccaaccttttgtttttatatagtttatttctcgagaaccttttctgagttaccaatcactagtgtacaagattcacagtagtgacagactgaagtcagttgggctcataataatgaacaaaaaggagttttatagtaagacaatggtatggtaaaaaagtgatgtttgagttggtttcagtaaatgtccaagtgatatctaatagagtgtatgatccataataaatttgattttgctggaaacataagacttaagcttgctgaatttcatgatacttcagaggtattcgattggtgactactttttttctttttttttaatagctggaagctggggtggttagagaactgataattgctaactttaactgaatgctaactgtatgtctcccattgtgcctaagtacttaactcaattatctcatttcatgctcccaacaattttattagacaggaactttttttttcaggtttgtaggcacatgtgaaggtttgttacataggtaaactcatgtcatgggggtgtgctgtacagattatttaatcactcggttatgtattaagcccagtacccaatagttatcttttttgcttctctccctcctcccaccctccaccttcaaatagaacccagtgtctgttgtttccttctttatgttagtaagttttcattatttagctcccacttataagtgagaatgtgtggtatttggttttctgttcctgcattagtttgctaacgataattagcctccagctccatccatatccccataagagacatggtattgttcctttttatggctgcatagtattccatctggtatatgtaccacattttctttatccattctgtcattgatgggcatttaggttgattccatgccattactattgttaatagtactacagtgaacatttacatgcatgtgttttcatagtagaataatttgtattcctctggatatatacccagtaatgggattgctgggtcgaaaagtagttttgcttttagctgtttgaggaatcgccatactgctttccacaatggtaaaactaatttacactcccaccaacagcacataagtgttcccctttctttacaacttcaccagcacctgttatttttgactttttaataatagccattcttcttggtatgatatggtatctcactgttgttttgatttgtatttctctaatgatcagttttattgagctttttattcataagcttgttggccacacttatgtcttcttttgaaaagtgtctgttcatgtcctttgcccattttttagtggggttttttttctcttgtaaatttaagttccttatagattatggatgttagacctttgtcagatgcatagtttgaaaatattttcttatattctgtaggttgtctctttactccattgatagtgtactcatagtgtacaagtgttcccttttcttcacatttttgccagtgtttattatgcttgtcttttgaatataagacatttttaactggggtgagatgatatctcattgtagttttgatttgaatttccctgatgatcagtgatgttgagtatctttcatatgcccatttgccatttgtatatcttcttttgagaaattgctatttaaatcttttgctcatcttggtttggattattagatattttcctatagagttgcttgagctccatatgtattctggttattaatccgttgtcagatgggtagtttgcaaatattttctcccattctctggattgtctcttcactttgttgattgtttcttttgctgcacagaagctttttaacttaatgtgattccatttgttcatgtttgctttggttgcctgtgcttgtggggtattgctggtgaaatttttgctcagaccagtgccctggaaattttcttcaatgtgtttttatagtagtttcatggtttaaggtctgagatttaagtctttaatccactttgatttgatttttgtatatcatgagagataggggtttagtttcattcttctgcatacagatatccagttttctcagcatcatttattgaagagattgtcttttccctagtgtatgttctaggcacctttgcgaaaaatgagttcactgtaggcatgtggatttgtttctgggttctctattttgttacattggtctctgtgtctgtttttatgccagtaccatgctgttttggttactatagctctgtaatataatttgaagtcaggtaatgtgatttctccagttttgttctttttgcttaggatagctttggctattctaggtcttttgtgattccatataaatttgagcattgttttatctatttctgtgaaggatgtcattggtattttgatagggattgcattgaatctatagattgctttggatagtgtggatattttaacaatactgattctttcaatccatgaacatggaatatttttctattttgggtgtcctcttcaatttatttcatcagtgttttatagttttcattatagagatctttcacttcttggagtacattaactcctaggtatttaattttatgtgtggctattgtaaatgggattatttttaaatttctttttcacattgttcactgttggcatataggaatgctactgatttttgtatgttgattttgtatcctgtaactttactgaatttgtttattattctaatagttttcttgtgaaatctttaggtttttttcaggtataagattctatcatccgcaaacaaggataatttgacttcttcctttcccatttggatacctttttctagctttctcttgtataattatgctaactgggacttccaggactatgttgaataacagtgttaaccgtgggtatccatatcatgttccagatcttagagaaatgacttttagtttttcgtttttccccattcagtatgatactagctgtgggtctgtagtatatgctttttgttgtgttgaggtatgttccctctgtccttagttttttgagagtttttatcatgaagggatgttgaattttatcaaatgcttctttaacatcagttgaaatgatcttgtggtttttcttcattctgctgatatgatgtatcagattgattgatttgtatatgttgaaccgtccttgtatcccagggataaatcccatttgatcatgatgggtgatctttctaatgtattgttgaatttggtgtgctatgttttttgttgaggatttttgcatcaatattcatcagaggtattggcctgtagttttctttattttattttattttttatgtgtctgtgactggttttggtatccgggtaatacgggcctcatggaatgagtttggaagtattccttcctcctccatttggaagtatgcccttctcctctatttttcagaatagtttgagtaggattaatattagttctttaaatgtttggttagaattcagcagtgaagtgcttttctttactgggagacttttattacaacttcagtcttgtagcttgttattaatctgttcaggttttggatttcttcctggttcaatcttggtacttgtatgtgtggagcaattcatccatttcttctagattttccaaataatttgcgtgtggttgctcacagtagccactaatgatcctttgaatttttgtagtatcagttgtaatgtctccttttttatttctgattttatttatttggatcctctctcttagtctggctaaagatttgtcaattttgtttagcttttcaaaaaatgaactttttgtttcattgatctgttgtattgttttcttcatttcagttttatttatttctgctctgatctttattatttcttttcttctactaattttggatttggtgtgctcttgatcatttagttctttaaggtgcagcatttgattgtctgtttgatattttttctcttttttgatattggcacttataaacatccctcttagtactgcttttgttgtatcccataggttttggtatgttgtgtttctgttattattagtttgaagaaaattttcaatttccttcttaatttcttcattgacccgcttgtcattcaggagcatattgtttaatttccatgtatttgtatagtttctgaaatttctcttgatgtttctagttttattccgttgttgtcagagaagagctttatattatttcatttttttggaatgtctcaagatttgttttgtgacctaacatatggtctgtcttttcagttgatccatgtgctgaggaaaagaatgtgtattctgcagctcctggatgaaatcttctgtaaatatctattagctcaatttggtctgtagtgcagatgaattctgatgtttctttgtttattttctttctgaaagatgtgtccagtgctgaaagtgaggttttgaagtctccagatattatggtattggaacctatatttgtctttagctgtaataatatttcctttatatgtctgggtgctccagtgttgggtgcatatatattgaaattgttatatcctctcacttaattgacacccttatctttatatagtgaccttctttgtctctttttatagtttttgtcttgaaatctcttttgtctgatacaagtatagtgacttctgctctttttttggttttctttggcatgggatatctttttccatctgtttattttcagtctttgtgtgtctttataggtgaagtgtgtttcttttaggcaacagaccaataggtcttgctctttcatccatttagttagtctgtgtcttttgattggtgagtttagtgtatttacattcaatgttattattaagtaaggatgtactcttgccattttgtttttggttttctggttgttttgtggtcttctttcttgcatttctgtcctctagtgaagatgattttctctggtgatttagtttcttgatttttattttttgtgtgtccattgtataatttttggtttgaggttaccatgagccttgcaaatactatcttatcattcattattttaacctgataacataacactatttgcataagcaaacaaacaagcaaaaagaaaactagtaaaaacttgccttaacttcatttccttgctttttaactttttgtctgtttatatctcattatactgcctatgtcttgaaaagtagttgtagttattatttttgcttggttcatcatttagtctttctacttaggataaaagtagtttgcaaaccacagtaacagtgttataatattctgtgtttttctgtgtacttatattaccagtaaggtttgtattttcaggtgatcatttattgcttattaatgcccttttctttctgattgaagtaccccctttagcatttcttgtaggacaggtctggtgttgatgaaatcccttagcttttatttgtttggtaaagtctttatttcctcttcatgtttgaaggatattttcactggatatactattctagggtaaaaggatttttccttcagcaatttaaatatgtcatgccactgtctcctggcatatatggttttcactgaaaagtctgctgccagatgtattggagctcctttgtatgttcttgtttcttttctcttgcagcttttaggattcttactttattcttgacctttgggcgcttgattactaaatgtcttgaggtagtcttctttgggttaaatcttcttggtgttctataaccttcttgtacttggatgttttctctaggtttggttagttctctgttatttgaaggtttactcagaataaactttctacacctatctgtttctttacctccttttaaaggccagtacctcttagatttgcccttttgaggctattctctagatcatgtaggcatgtgtcattggtttttattcttttttctcctctgtgtgttttctaatagcctttcttcaagctcattaattctttcctctggttgttccagtctgctcttaaaggacttgatgcattcttaagtatgccaattgcatttttgaactgcagaatttctgcttgatttttaaaaattatttaaatatctttgttcaatttatctgatagaattctgaatgccttctctgtgttatcttgaatttctttgagtttcctcaacacagctattttgaattctctgtgaaaggtcacacacatatctttgtttctccaggattgattcttggtgccttatttagttcatttggtgaggtcatgtttttctggatagtgttaatgctagtagatgttcctcggtgcctgggcattgaagagttaggtatttattgtactcttcattgcctgagcttatttatagccacccttcttgggaaggctttccagtgacactgtgattcttgcagacttgtagaggtactgccttgatggttttgggcaagatctgggataattctctagattaccaggcagaatctcttgttctctttccttactttctcccaagcacacagagtctctctctctttctgttctgagacacctaaagctggggctggtatgacgtatggcacaagcactcctatgaccaccaccaccatggctgtgctgggtcacacctgaagcaagcacagtgctgggtcttgcccaaggcctgccttaatcgctccttggctatagcctatgttcactcaaggccctagggctctacaattagcaagtaacaaagccagctgggcctgtgtccttctcttcagggtggcaaagtccccctggccactagtgggtccagagatgccatataggagtctgggactagagtcttagaaatcttagaaaccttagaaatctacctggcattctgttgtattgtggctgagctggcactccaaccacaagacacagtccttccccttttccacttttccccttttcccctttccaaaggctgaggagcctcaccccttagccactgccactcctggccatgaggagtactgccagagtaccaccgacattcccttaaggaccaagggctcttctatcagcttgtggtgaatgctgcctggcctggactcaaccatcagggcagtaggttcccctttggctcagggcaggtctagaaatgctgtccaatagtcaagtcctagaattggggaccccaagagcccacttggtgctctaccctactgtagtgttgttggtacctaagatacaagacaaagtcccctttactcttctgtttttatcaagcggaaggggttttgccccatagccaccacagctggtaatgtgcatagtctcacctgaagccaacaagtctcagaaactcaccaaggccctcagcgtagtaccttggtatcactgctggttattcaggacccaagggctcttcagttagcacatgatgaatgctgcctagactgggtcctttccttcaaggcagtgggtttccttctggcccagggtgtatctagaaatgtcatcccagagctagagcctggaacaagggcctcatgacctcagggtgccctattcttctgtggcagaactggtaaacaagatgcaagacaaactcctccccactcttccctctcctcttctcaagtagaaggaaggggtttcttttgtatccacaagctgtgcagtctggggttaggggaggggtgatgccagcattcccttagctgccccagctggtatctcagtgtgtccatgccactttagtccactgtgtttgggcctagttcagcactaggacttacctatgaggtacagtccttatggcctagactgcctttcaagtttacttaaacaccaagagcactctggcctttggtactgaggttttcaggcactcaggtttggactgctggtatcagtgattcccctctggctagggctggttgagatgccttcttgtgggtggacatcagcttagtttggtcaggttttcctttatgctatagcaagatggccccaggttcagtgcctcacaattgctctgttctcccttcaccagcacccagagatgctcttggcaccaagccatgctgctggagtcagggaggggtggcgtcagagactcagaactgttttctatcttttcagtgtctctttcagtgatacgaggttaaaaccaggttctgtgggtgctcacatgatttttagctcttatgaagaagcttttttctgtgtagttgtttgttaacttagtgtccttgcggtagggttagagggacgatctgtggagttttctgttctgccatcttgcctcacctccctcctaaaaaatattcttatatgagattgtaatgtttatatgaacttgcatgaagacagaattcttgtgtttggatcctgagtctcttacccattttgtaacattcttcaacatacttttaactctgtgcctatgattccttatctgtaaaatgaagataataatagtgtcataatagatgtaaaacatgtaaaacaatactaaatgccatgtaaggttaagtggtggtattattactatttatcctatttacatcatattctgtggtcatctgtcagtatttgtgaatacctttcagtgacaggaaattaattttacttcttgatcctaattctactccctgtctgttcctaatcttgttttgcctttgcttcctcttttctcatctactcatattttatgtcttccttcatgctttatataacttttagccaccttcaatgttttttggaataaagtaatgtatgcatacatacatatacatctttgttcctagaatttagcactgttagtgcatggtttttatcttggacattcatatattctagttccagaacagtaacttctagaacttaataatttattaaggaatcaatgacttcaaatttgtcagacgttgtatatgattattattttattcctaaatcttatcgttctttagaccaaaaggatatccagtttgacagtgttcttttttaagaatgatgcttttaactgaatataatagttcctatgggattcgatcaacagagagtaaagagtgttattatgttattttattctatgtgtatttgtctattactgtacttaaaataccaaatgggaggggcagtatgactttggactcatttgccataatgctgaagttaaatgtgttgctgttaaatcagctttcttttacccaattcacatttgtgctttaaaaaaaaaagcattacaagaccttgcatacttctgttcaacttattttttaacattcatttcattatttcaatatttcttataagttgtatgagtttcatatttctttatcttctatatattgagattatgccccagttatatctctttgtctgtaagactagtaatgtcaaaaaaaatgaatttcatgtcttaaaatttatccttagtaaattctgtattttctgttgattatcccttttaaaggccaaaccctctttttaggaatttttcctgaatctcactcaggaatcacatgctgtagtttgctctattttactagatttgaaatcacccttttccatttatgtgaaaattagatttctgtttgctagtttcgatgctcacaatgcctttcacttatttgtagctcttatacttttgatcaaaattaattttataccagaatccttgaaattttttagagtagtagctttgaattcttgttattatttcattctactgtcatcgataacctcccatgttaacactattgtttctttctgtttactttcagctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcaggtatggggttgtctgacaggaaagtataacttaaatgtttataaagtttcacatacttctctttatattctataggtaatgtagatttgttgacattactttgatttaaaataaatggaaatgtgtggaaattttactttttatattaatggaaaacctgaagagtgcaagaagaaaaacatacttactatagtagacaaacataattactaatgttgttttctaaattttagaaaatctcagtaccatggagtgctatgaaatctatcagaaaaataaacattatttttatgtagtatttcattaagcttttacataattaaaataccacaataggtattacagttctgtataatgagcattttaccaaattcttctagttctgtgcccctcaatctggcatatatgcaactatgacaggaggtactaaaagccttatataagcatggtgtatcttttggatatgtccattttggaagaaacttttgtattaaaataaactaatatattatgggctagaacataaaattcaccaagaatttcaagataaaaatactaatgttttgcttgtttgggtgatttcaaacaataactttgaaatctataattttttcaccaccaaccgtttactaccttgcatgctcattctcctgtgtggctagatgcatttcagaaaagtgttttgaatattattccagagcaaatatcattccagaaaataagtttaaagtttaaaatgtttattttttgtaagccacgaatcttcagcctaagtatcttctgacataaaagcattttcataattataaaagtgctgatattaccctccacagtattatacctgatcctggaaagtagttcagataccagagaatactcttttaacattttggcttatgcatttcattatttttaaaatttatggaacaaaacattaaacaagaatggaatgaaaaatggcttaaaaaagaatgcagaattgcaaaaagcatgctttgaatttaaatatttcaaaaaatttgattttctgagaaaatatattaaaaatcatatctaattaccttcagggtggcatatatcttttttttagaatgatttagcagtccctgtattgggtactgatggctaacttgatgaaaaatgagattcagacatctatttcttaaaatacctttttaatattaatagtagcatttctataaattctagaggtacttaatagaaatttattaatatagacttacatgtacacatgttttatagaatatcatatgatcttttaattcttacatctgagcttaagctcttaattttttttttgtaaattggctgctactctatggagtgcagtttagagaatgagccaaaattacatgcatagtagtttactggtacataattcatcagcactgaaatgtgaaagtgacagtgaagatgattgtaccatagaagttcatatcttgacattgctgttacataaagctccttaattcttttatctttttctcagtaataatattaataacaaaatttttcactttttgtaatttctagcatttcccttcaaaagagcttgatgatggaaggatatgagaaaagagaataaatgtcagaaaaatacctctgtcttactttttaatagagaaattaaactttacatattatactaaggaagaaccagtagccactaaaacacgactaacagttcatatctgaatgtattgtagtatgttaaattcaatggggtactttttatttaataatgtagtaaaagtgtcactaaaaggtggctaaattaaacattttataacaaattgatgagaaaatttcttggtcttagtattttttcttttaaaaaaaatcatttctaattactttcaatcttgttctccagcaaagaagaccgtctataataaaattaaactgagctgcttggttgtgttacatatacaatatataagtaattcgtattttttctcttttaaaaatgatttctgattacttttaatcttgttctccagaaaagaccttctgtaatagaattaaactgagctgcttggttgtgttacatatacaatatgcaaggaatttttaaaaatttctaattaaatacaaatttaatagattactttttgtgacatacatgggagataagataaagatgaagtcttgtataacctgaaaaaatttaaacgttgcaaatattttttaaagtttttttaaaagtattttatgtaaacctttaagaaatcttctgtaaaggttgccattgcagctaattgcttaaaaatacttcatattatagcaacattaaatggactaagaaaaaaatacttcatattagcttaggatttttatagtacttaaatttttttgtagaaacacactttttgacctatatgtactaatattttaatacatttttgttgcttcagtgatgacatgttttatttcattaaaatatcactctgaaagtggcatatccactgtcacaattttgtcatagagattattgtgtgttaaataaaattatttaattattaattgattattaattgatgaagataagcatactaagtttccattttgaaatatacaaatgacaaatattttttaaagtctcaaattccagttattaatctgtgatatgatattgaataatatacattatatatcagtactaagtatttcagcttaccctaacctaacctttttattaattgattataagcttttagaatatatatgtgtattgctttgtaataacctttgtagtatgtttcattcttaagaagtgctttagaaattgagaaaacgaagtataaatgtttagatgttcaatttcttgcaaagaacaatgacagaaaaagtattaatcacaatatgtagagaaagcaatcagagacaagagattaaatgtataatttttctcattattaggtgtgctggtgtgtctgttatatgcacataaacactcacactagcatgatggataccactattaatgtgtttaaattacacttctacttatagactagtgtgtaagagtgagggttctgaagctatactgtctgggtttgaatcctgattctaccacttgctaggtctatgttcttgggcaatgggaataaattatctgtgccacaatttgctcattttaaaaggggataataatggtacttacctcataggcttgttaggaggatttgtgaggttagtatctgtaaaccacttggaataatgtttcacttggagtaagtggtaaaaattgctaatgggccaaggaatataccaagaatatattaagaatagataattctgaaagacaatatagtcagctgttactttttcatttgacaataaccagtttgcaattttaaatctttgtacatttgcatattttacctacctttccctgcacacagcaggctgtgttgtggtgtgtgtgtgtgtgtgtgtgtgtgtgtgtgtgtgtgtgtgttctgggaatatgtaaaatctattttacatttctgctaagacagcttaattgcggtggtaatttaatgggggaaaatcatgtaattcaaataaattcttttggttatttaatgagttaaaaattgttaattggaatggctattcatgaggacatttagctgtattagatacatatatatatatatagagagagagagagagagagagataacaatgataacttttttctttcaaaaagtatattaccttgacagatggcagctcatgactagagttcagaataactttattttcctttgaagatcttctagttgatatgttgggggttcttgccagctacagcatcactgtcaaggagttgaagcttttgttcagcatgcttcgaggagaaagtggaatctgggtaagctgtggtcggagggaaaggtattcagtatcagtccattaatacttaatgttcaaaagtttgtctctagagagctatatacttgaatttataatggaaattgctttcttcttaaatgatttagtaaatgttttgtaaatgatttaaaattaatttttctctctagttagaaaacagtccaatgggtaacatggtatattaagtatgattgctaaatttgtacaatgacatttctttcttttattgtttccccagccaagacatgcagtaaaattattatcagttcttaatcagatgccacagagacacggtcctgatacttttttcaatttccctggttgtagcgctgcggtaagttttaaatacatgtgctgatttttatttatttatttttaggtcacctttagtaaggtttaacttacatataataaaatttaccagtttagaaagcacaacttgatgagtttggaagtcatacaaccactactatataatgatttgaacaatttcatcactccccaaaattcccttgtgcctgttggaagatattcccctctacccatccccactccttactacttctgatttactttgtattcctatagttttgccttttctagattgtcatataaataaaatcatacagtatacagtgttttttgttttgttttgttttgttttgttttgttttgtgtttttgacggaggcttgctgtcacccaggctggagttcagtggcgtgatcttggctcactgcaacctctgcctcccgggttcaagcaattctcctgcctcagcctcccaagtagctggtattacagacacccgccaccatgcccagctaatttttgtatttttagtagagacaggtttcaccatgttggccaggctgctctcaaactcctaacctcctgtttgcccgcctaggcctcccaaagtgctggggttacaggtgtgagccactgcacccggcctggtatatagtcttttgtgtcaggcttctttcacttcccgtgatgcttttgagatttttccatgttgtagttttaattactgttttattctgttctctctttttttgagtagtatggcattttatggatataccacagtttatctatcctatccattcactagttgatggacttctgggtttctagtttttggctgttataaataaaattgctgtgaacatttgagcacaggtctttctatggacatatgttttcttatctttcgattaaatacctgagtgagattgctggattttatggtaactgcctgtttactttcatgagaaactgtctactcgttttctgtattagaacattgtacattcctataagcagtgtatgagagtcccacttgatctgcatcctgaacattttcagtcttttaaatttgaggcatttaaatggttatgtacagtagtcccgccttatccatggggtatatatgttctaagactgtctcagtggatacctgaaactgcggatggtactgaaccatctatataatacatactatggttttttcctctacatacatacctgtgataaggtttaaattactaactgcacacagtaagagattaacaacaataataaaatataacaattatagcaatatattatagtaaaacttttgtgagtgttgtgtctccctgcctcccctccttctttgtctctctctcaaaatatcttaatgtactgtactcacctgtttttggactgtggttgaccatgggtaactgaaactatgaaaccacagataagaggggatctactgtagtggtacctcatcatagttttaattttgcattttattcatgactgatgatgatgagcattttttcatgtgtttattggccattcttatgtcttcatttgtgatgtttctgttcacatcttccgttcatttaaaaaattcggttgtttttcttattatcgtaagagttcattatatatttggaatgtaagttcatctattagatcaaggtaaaatattccctgttttaaaaagtcaataaaagttatatattatttgataataaaatgttatttatattgtatgataataaaactgcctgaactaattgcttaaatactaaaatccgaaaggttagtatagggtttaactcttcatttgaaattgtgtgtgtgtgtgtgtgtgtgtgtgtattttttttaacagcaagcacttagaaatctttgactactttgagattatttattagccacctgcatcttcagtcattatgcttggagtagattacattccttactcttgaagaactctgatggctagatatgcaaatacagcttgctacaataagagttataaatgatactgtagatttaggtatgggaacaaaactatgggaacacaattgaaaagagaaaccatgctaggttgaagtccagaaaagcttcacagatgaggaaacatattagtctgctattaaagaataaatgagattttgttagaaggaagaatgatttggatagaagcaacatgatgtataggaagaggaactgtaaaagaactagtggaatagctggtatatttagatgtactttggaatgtggggttgggtagtagaggaggataaaatcagaagggtttgttggagccatagcacgtgggaagtcctgtataacatgaagaaatttaaattttattctgaatgcagaagatttttgacatggaaggtccgtgttgtatttgagaaaggccattatcagcaacatgaaagatctatttgaggatatcttttatgtagaattttgataaagtctaggaaaataaataaatacattcacacatttcttgaagtcaggtgaaataatcagctactttcttatttattccttagaatggctacattttatttgattgctattttcaagggagtcctatattactccttttctgcttatgaatggatctgaatcctttttggttataaatatcagtagttaagtttctgagtaataaatgtcatactttgcctttcttagtttcaatgttgttagcattatgaacattatctcttaatgcttgcatttcttcaatattgattccattaacattttctagctcagtcatttttggctttaaatattcaatctcctttaaccaaatgggttactactgaaaacctagtgtaaaccacagaaaactgaaattgggaggcttatgtgtaagagactgtatactgatgaaactagatggcgacttcttggagtatagtctgaaacccgctatgtaatctagagataaaatctaattcactgagcatttgaaaattgaatgtttctataatcaacaaatactatttaggtgtactgagattgttttaataaaatactagctcttattttatggatttgtttgtgattttctggtatttatactttgattgttatttaatctgcaaaagccatatttgaccttagctactatcacatttctttaactgatactttcgtaccttttctcattgccttgtaggcaattgccttgcctcctattgcaaagtggccttatcagaatggcttcaccttaaacacttggtttcgtatggatccattaaataatattaatgttgataaggataaaccttatctttattggtaagtaatatgtttaattttagtacttttttctttaagtacttgaattctataaatgtatagtctcaaggcaacttagatagaatatatgtatatatgtgcgtataatatatgctagaactgtgaagacactgtaaatcagttttatttatgtatgtatatatgcatttattttgctattgattctaggtcatctgcttcatgattatcattcttttccaattacagtttaaaagtcaaaggtacagactttctgtcccagtctccttcaatgtatatcagttgtgggatttttagtgaggattgctggtccctgaaaaaaattccaaacttttaccagatttcattcatttttgccttttcacttactttgttctatgagcataactgacatatgctttaaaattgttgataataactatgtaagaaattataagataagattatttggtgtagacaactagaatgagttgatcaacctaacaatgtgttgatctgtaagggttgaaagcttgataattttagtatgccagtaatacacagtacagcatacttaacaataagtacatcaaacattcattgattgccatactgtatgctaggcattgtaagtgtttatatatatgatttcatttaatacttgcaatactctgtaataagacggcctgtgttcaagttctggctttaccacctactattcaccttgtacttttggtgtcttcaactataccaatgaggatagtaatagtgtctatcccataggatttaatgagagaatcatatttaaagctctttgtataatggctgggtcagaaatgtgaacacagaaatatgtgagctattactatcttctaagctctattataaaatatatatggataaaatgagaccaagttttaaataagcatctgaacttccaaacataaatggggttggacttcaaagtggtcattttgggagatcatacattaatttcagtggtatctgcatttttcagtgattaaacatttttctacatcgtgataaatttacagctaagggaaatgctcttgtagaagaaaacaactatatttcatagttacatctttttaattttttaaactaaaaatgtactgctttgcttgatcaactgtatcatttatcaaacttgactctgaccaagtttttttttctttttctttttaatttctaagctattttcaaaggtataccagaattagagagcaggttgttatttaaaatgtgaactttgtgtaaatgtgttctgtatttgctgattgcaaatggtccttaaagtctacttggtggtaggcttttgttggcaattaatttgtttttaagtatttctgagattttagattgaaatactaaaagctgtcatagtcttttatttcctagtttaaatttcttatatttacttataactaaccttttatatttttgtttagtttttatttgacacatattaaactgcttctactgtacagggaaataagttttatttttataagaatgtttaatagccattaggtgtttagttctttttatcagaggatattatactattctcagttgtctttgcagttttcgtactagcaaaggagttggttactctgctcattttgttggcaactgtttaatagtcacatcattgaagtccaaaggaaaaggttttcagcattgtgtgaaatatgattttcaaccacgcaaggtaggtaaaagtaaatatttttataactcacctgttatgacagaattcttaactctccttttatgagctctgtagtattctctttcacgggttttcctatgcttttaattgttttctcttatccttgtctgcatttcctttttacttttatgtctaatttttgtcttctgtaagatcagtgttttgatatcttgtggtgtatttctcttacactctctcattatctcagtctgatctgttttatggcattctttcaatagatacttattatctactgagtattggataccattgtaggcactagggattaataaatatttgcctttttttaaaaaagttaaatgttaaacccccagattaagcaatgcacagacacattttttttgtgggagattaacctaatcctagtagttctgaatattgtttcctgagattgaaggttttgttaatttgtgatgctttaataatgctggcttcaaggagaggaatgttgctgtactgttagttttggctcatgaaatgtatctttacttaatatctcaaataatagcagagacaaggccaaaacacattttaaaaactgctctaaagagaaaatgcagagaactgtgcaactgtatgattagaattataagagataattcattcataatcaggtggcattttctagagggattttcctgcctgagtaccagactccatctttgtgtcagaataacaaaccatctgaaaatccagatgaaagaaaaccaggacagagtgcataggggtacccgtcacacatgtttaaggctttgttccccttccaggttcagggttctttcttgggtatatgacagtgagattatcaacgttttttagggcacactgcctcctcctaacagaaatattgccttaccctttgtgattaatggtacaatcataacagatatgatgaacccaaatgtggtgagggggagatctttatttctttttcgtatcttttttgtttgttgttgcttatgatctgatgtgtgtcttcccatatacggaaaaatatattattttgggtggtatttccaaaatttgtttagattttacatgattctaataaaaatatttgctttatatttaatgtcagttattgtcatttctgttaaagaatatcaatttaacagtaattcattaacatatacttagaaaatgatttaaaaagcaatgattctgaataaatatattcattcattataatggtgtattctttcttttttaatacaaattgattattttaataccaatcacattgcctttgctctggaaattctgttttattagaattaaggtgagaccaagatagtttgctaaaagtgccaaattattttgaatttcagtggaatagattagaagtacagttgttggtattataatttttcatgttaggattgtgtgtttttaacaaatattctaggtaacttttctcttcagacaattttaggaaatggtggtttaaagaatgtacaggcaaacaattagagtgaagttataaccaaatgaaattgtcattaaccaataaaaagcactttaacccatttgttctcactttttctattttgtgtcttcttcactgttcacttttggaaaacacattctcctttgtaaagctctcaatatgcagtgaatctaaggggtctagttaggagcagggccagagagtgatgtggattttaaaaagtcttttgtgaagattctcacaaaccttgaaaagtcataaatatttgcttttactgtgtttcattattcaaaataaattcattctcttgtttattcctctctttaattttccatagattccctagctaagttgttgttatccttcctaataagagatttactggcctttcaaaaagaaatctttacattaaagcttttgctttcccagctgtaccacttaaccagctgttagaacttgtgaaaatggatataaaccattagcatgttacctaatggtaatatgtgctctagacatattagctactattgatatcatgctgtacttttaattttcaatttattttcatatcttcaatttataatacatatcttgtggattcttaatatggatctttttattccttattactggttgtgtctttcttttataaatttctttttgagtctcaaactaaatgcagacttcagtatatatacataatatcactatgcacacatagtttccaagtttatttttattttctttagtcaaagtatatcagatcaaaagttaggcttttttttttaaccattgaaaaactcatttgtgtctgttatctgtagagtacagtttggtgtaccaaggaaagagaaaagttacttttcttgtaaataagtactatggtctttactgagatcagctcattaatcagtgcatttgtttattcattcatttaattttatcatatattattgttacaaccaaaagcaaaccttgataaactccaaatctgattaatttttctgtattaattatcttaagttaatggtacccttacccatctaagtgaaaattggaagccatcttagactcccatcttagactccccttttatatgttaacacttcctatcagttctgttagttaattcccatcctcattttaaaattatgagtgcctttgtcttagttccgcagcttatggtgtcttacctaaatctttgcagtggcttttcaattttatctttatccacacttgcctgcctatctcacctccacattgctgccagttattttctttaactatggagcagatcgtttcactttcctgctcagaattatttagttataccacattatgcaaaaaacaaaggcctaaaggtctgtttacaatctggtctttgcctgtttttgtttttgtgtttttcctgctaaacctacacactgaggaaagttttgtcaagcatctgtgctgtattgtattaagattctgcctggaatgtttttttaaccactgtctactgaacagttccttttcatccttcaagcttagtcttacagttcattttattcttttagtgaatatttctatgatagtctttcttctctatttgtctttccttcccagttacttatagtatttacttttattactcccaaatctgtattttagatactctctattctcataactgtttctctagtgaaacttccttgagtgtgtatatgttgtccgtctttatatacccatgatccaaggttgggatagggtacttggcataaagtaggctcagtacattttttgaatgaatgaatgcctttgaaaggtaaataataatcaattttagcataaacaaacctcatcatgggacatagtagataaaaacaaaatagcagtttagtcaatggtatgttatgtatgggtgccaaatacattaggaacttttcctcatagttttcatacattatctatttataatattcacaaggaatccacaaagtaggcattattattcccctttttcagagatgaaaataggttcagagatactaagtaatttgccaaaagccatagagctagtaacttgggaatccaattcatgtctttatgaagtaaaattcttcctgcccagtacattatctggagtagtaagaactcagtaagtattgtttgaatgagtactttttttaatagtaagtacaccaataagtataataatacatctagtatttatcttaaaactgtctttgggcaggaaatcttttcctatatgtaggcatttattcgtgtctcttctctttagaaatgcaaagtttacacattttattccacaatataaagtttgtgtcttctgtgttatttagatagcattctgattgaatattttcaaattcagtgaaggtaatatatgcaaactttaattcttatacttgtaaaattctataagattttccttaaatttatttgacactctttttacggttttttcttgataattttgtaatatttagaaacaattgttaaatgaatactttaaagattttctcttctgattttaatcagggctaacatatatgttggtttcaaatcaagtgaaagacttagtttccaataaattaatgattacctggaatgaaaaaacttaaaaaaggatgtgcattttagacagttaaatgtcttgacctgaccttgcttttatagaagcacactgttgttttgtattactgacttttttgagttaatacactgttttttttttctttttctgttttcttttcttttttttttttttttttgagacaaagtcttgccctgtcgcccaggctggagtgcagtggtgtgatcttggctcactgcaacctctgcctcccaggttcaagtgattcttgtgcctcagcctccctggtagctgggattacaggcacatgccaccaggcctggctaatttttgtatttttagtagacacggggtttcaccatgttggccagcctggtctcgaacttctgacgtcagttgatctgcccaccttggcctcccaaagtgctgggattacaggtatgagccaccgtgcccagcctatttttattttctaagttgaaatgaacaaaattgaattttgctcaaagtattttagataccttgaaataactaatattttagtgattaaggattattgtaactttttatttctgaaaatatatatgaaataattgaatagtgcatttaaataatctgtagaacaaagtttgtattttatattttggtgggagggagaaaccagttaattttccccccttaacttcagaaagcatacttgttcaaatgtttacaaatcatttgtatttttctatactttagaaaaaattatttctatattctcgattttaggctattaactctcaggagactaaaggttgctacagaaatcaaaccatccatattaaaatagatacttaaaatgctttttgataccagtaactataaaatgggcacttaatatgaactctttcatttattcttaataaatattcccacattgttattaaatatataattatcctggatttactaaatctaaatggtgaaattgaagctacctaaatcttattataaatgctaaaatgttgtttctttgacagatccttcctgaccatgcaatccaaagtagaatccttgtttattctttttcagtttatactgttctttttctcttcactgtaatcaccatgatttataattctacatttgtttaattgtgtcatatatatttcttttactagctcataaattctaggagaactggtcagccttgggtatctgcagtgcttggcacaatgtaaattttaaatgaatgaacacaaataaattgtatttctacaatttcgaatcttggtatagtggaaggaacgtcacgctggaggtcaaggggttgtagttcttgtcttctccaggagtattctttatgtgccacttctaccatctgtgaaatgagaaatgagagggggaacttgatcaagtggtattagatgatccttaatagtcctgtcagcatattcttgtagggttttatgaatgttacaattgcattttagactgtaacaaccaaacattacatattgatatatttaatttttttatttaagtggtacatgatcagcattgtccacatttacaatcgatggaggaacagtgaaattcggtgttatgttaatggacaactggtatcttatggtgatatggcttggcatgttaacacaaatgatgtaagtctttatttttctgtctgtgttttaatttgtttgggagtatgatctatcattacaatatgaattaaataataaaatagtttggtagaagcttaaaactttgaaagtttattctttttattaaataaatctttcattgttaaatttagtataagaaaatttctaaaagacatgattagtgattaaaaaaacagaaacatttagccaaagttttaagttttttagatcaaaaaccatgaatcctgtattctgtttttttccagcatcaagcactaaaaaatgtggtttaccccttatttagatatggaaagaagaccctaaacagaagtataacagatagtcactattattaattacatagtgataaatgctatggagaaaataaattggggatacaggaagtaggtgtagggaagggagaagcaagatggtccagagatgattttagtaggaagagttgagcaagcaagatatgtggggaacttcttctattcagtgggaacagtgagtgcaaaggctttgaggcagaataggaaagttcaaggaaaaggcaatttgtctggagcagagggaggaagaggcaaaataatattaagagatgaggttaggcagaaatcattttggccttcataagcaaacaaggcctgggttttcgcatcttactcagcttaaaaatccttggaaggttttcagcagacaagtgatgtgtgcttctattttaaaaccatcagtctgcctgcagtattgagaatattttgaagggaaattacagaagcgggaagatcacttaaatcgcttattataataaaacaaagagactttattagtgtctaccagtatattagcaggggaagaattgacacagttggattctaggtagagaataactagaatcaaaacctcaagggtccttacggtttctctactttgggctttccattgtctacattccggcctgtcagagccaaagtgaaaggtttgttttaatgctgaaagtacctccaagctcaataatatacaacccttcaagcatacctggttttataagaacttacctcttaaacacaattcatttctcagttttgtttgcatctctctaggctttcatctcccgaagggcagggatttgcttatcctgtcttgtattcttttaactagcactgtgcatatggtccacagtttgtcccctagattggggctgggcagactacaccctatgagccaaatctgaccctccccctgtttctggttttgtgtaagctgggggctaagaatcttggcttttaatttttaaaggtttttgtttttttgttttttaagagacgcaaacaaaatcaaagaagaatgggacagaaaccaggtgtggcaggcaaagtttaaaatatcttctgtctgtccctttatagaaaacgttacttttctctgccgtagaaacttatggttgagccacaaccaataaatatttaatagaatgttgttttcagaattagaatacacagatgaaattctgctttttatcttctctccagaggagatctctccagagtctttttattatagagtggaggaaatcccagtggtcttcttgactcattaaatgagaagacagtatcttggaaagaaaagacttagttttttggttatttgtaatagtgccctaagaagtggagaattctagattataacacatatatacattctttatgcagttaaagttcccatacttctaattaaagattgtgtatttaatgacgacaattttttttgcctttgttctccattcacaattttttttgttactttattgcagtacgaaaagtacttcttacatatataatttttgcttattcgttctaaggtgtgaaatagcctgtggggataggagaaaggaactgagccatgactgccttccctggtttgggtgggcggggtgtaagaagtagaggctggaaagatcaagcttttggcttcttcagtgctgaattcctcttgtggagagcactgtaccatcggctttaagcagcagatcttagtcttattgtttatttgattctgtgtaattcctactcatatatgagaagcgattgattttctttgtgtcttttacttaatatggagaagtagaggaatagatttgtaatttgaaaaataaagtagaataaaaaaattagaccctatgtgttcatgattaaattttggaatagtcattcccttgattcagatcaatctctccatatatggatcattatacatcattacagttttaaattagtttaacttttgtaaataaataattataagctattttgcctttaactatagtatttgaaaagtggtaagtctgaagattaagtaggtggctattgtttgtttgcttaaacataagtgtgaaacatgtaactgatcatttttcccaaaaaacttgactggcatttattattaaaataataaagtcttaattgatgctttcttctattattattgttatattttaaaatattcatgataatgaaggccgatttaaggatttaaacctttttgtcattaaaaataatgcatttttctttattacttttaaaaatagagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataaggtagtaataactgtaattttataaattctatggagagttttagatgtaaaatgtggtgtaatatcatttttagtgaaaatctttaatacggtttaagagtcatttctattttttggaatgtagtcaagttttattatatgtttctttttggttcaaagatgcttcttaaccattttataaacttttattcttcagaatattttctaatattcatggcatgccttttgttaacaattctgaaataatagatcttataaaactgttttgcttaatgtagtatttaaaatacaaaaatttgaaatatacatattacttaatgaacataataaagaacttgttaatattactggtaacttggaaagaagagttaaagatttagaaggaaactaagataatatatttcatgggcctaaaattattcaattttagcttatagttttgctttaattgcactaagtgaggaagtaggtacagtagtgagtatactaatttagcaaaactaattaatgtaatttatcatattctttttgttttttaaactttaaaaacaaagactctaggtaagatagagcgtgcacatatatgagttagttttaagtgtgtagtacatctggctaggggagtatataagggttctatttaaatcacattgggaattgtaaagtctcaaactacttcgagctgaaagagaattacacattatagtcaaagtgtttataattctgaaggagtacttgtcttgtatggaagtgtggttttttattgaactcaatttaaataattaatgtgaagattgtgtaatggaaaggagtagtaaatattaaaaaatattccctctttggcctttgtatttttgcattggtatttctctttgtatgtcatatatatatatatatacagagagagagagagagagagaggaaagtttgaatttacccatattaaaagatctttttgttctcagtgactttaataaccataataatactgaagaagaataatgctattatttttatgtcaaggtaacaatacttgctatcatgtattttccatatcatttttggttttgtcttactagctctagaaatgaacttgtgcttgtacagttactttttctttcatgggtctttttgttgggtttgcatcctggttctgccattgttgatcttgcataggaatatttttgtaattcacattttgtattaatatgctgcatgcttttctttcctagttctttgagttttttcataaaatacttgcagtgtctttttaagctctaatagaatgatattaaatagagtgacaagcaaacaaatgaaatataagaaggtagaatatcaagaaaatacaaatccaatatgattgctaatgttaaattttagaattgatgggagcttcctggcaacatcaaggaaaagggctgaatataagcaattttgtaattcttctattcacaaagaaacaaactttgtcctgaacagctttgcaaactctgtaatttgtagtattcttttcacacgtctttcttgtcattctttttaacagcagtgataatgagcagtaaccctgtcatcatgtgtacacagctcatgtgacatagtgtatccttagtatcctaacacacagtagagtacctaaagtcagaacttttaagagatatacttgtaaatttgggcattacatcagagagtattttattaagttttgaaagttctcagctcactgcaccccttgttgttagcttgggttgatgataaatccacgggtaaatgcattttctcaatttgtaaatattataaatacagttgctaccatgacaggcatcagcaaaaattttttatattaaaaagctttttttttcagaaattcagagaatatagggaaggaggaatgcatttgatcagattgtgttttgacagaagaaaacctgagtagttcacacattatagtcacaattatcttggtaaagtcactttctgtgagtgaaggggtagagggctacagtggaatttttaaggtgtagagaatataataactagtggacatttggataaatcacaaatggagtttaaattacttagtgttgtataataacatagtatttatatttttttgccttaagttatatggaactttctttcattgtaatggtcagacaatatttatgattctgagcttagtgtagatagcatgtcaacatacgggcttcgaaattaataaaataagttaattctaccttcaaataatgtcatcaaactgtatattcaatggagcctatcacaaatgattttgacttgctggtcactggagtgctaggtaatttttgttctgtcgaatttttggttttgagcgttgcagtttatcagtaaatattctgtacttggttattttctggaaacagtaaataagttagggtgtcacttattaactaaatcattcagtttggaaaataaaatacagaaattcagaaaatatttaaaatactgaaaatctcactgtagatttgtctagtatggtaaaatttactatcagataagtttactgtggatctctatttggggttatttaatgtcttcaagattataaaatcttgtgtatcaggtggccctttgacataagcttgcaaatcagattttaacaaagtttttatattttatagttattactagatattttctcagtgttatgttaaccctgtgtggcaagcagttagtcttcattgccagatatttgaaaatttagctttgagttctctccttcatttatgaatatgataacaatggttttatgaattgctatatcataataaagttctaactgataagagaaaaagtataacacaacctccaaattaaaattcacttcagaggatttccaatacttgtatggaggggtgagctcctaacaaactgatcttctcacaaataaccatttgtaaactctgcatataatatagataacatctatagggttatggagattgaataaaagcaggcaggctttggagggtagtcaaaatatggaacagtcagtctgcatggactgatatccttattttttgcttttataggagactttctggccagaaagtttctctacaatattgtacggagtagtagtcacacaatttagcatataatcccaaagtattttttctaaaaataggaaaatgtgacttattctcaagggaagagaaaatcatcatataccaacaccaagataactcacatgttggaaatatcacatgaggtctattataactagtgaggtagagaaaaatttacttataatgaattaaaagacaggaagtatcagccatgaaataaaacaaagtcagatggcaattctagaactgaaaaatatatcggaattaaaaataagctgtatgggcttattagcagaattaatatgatagagaagtaaatgaacttgaatatagattgatagaaactttgaagagagttgtgaaagattggggtaaaaaaatagaaccctagagatggatggggcaattttgaaaggtctaataggcacagtataagagaaagccagaaaaaatatttgaataaatgatgttagaaaacttctcagatttggtaaaaggcttacatttatagattgaagaaactccgaaaactccaaccaaaataaatgcaaagagaaccaaagtaggcacattacagtcaaagtgtggaaaaccaaaaataaagagaaaatcttgaaatcaggcagaggaaaactagacattgataagggaacaataatttgaatatctgtacacatctcatcagaaagcagtaaagccatagaggtggaacaaaatccttaaagttctgaaaggaagaaaaaaaatctgtcaacctagaatttttttatccggtgaaaatattctttaagtcttttgaaagaaaattaaataaatttgttgttatttgactgtcattactgactgaaaaagaaaacctggatgattaggagtatatacatgtaatacatatgacaactaacagaaagatttgtggagaggctataaatgcacctacgtagttgaaaagttgctgtattttacaatgcatcttgatagagtgatgttgactacaattcaatggctaaaacaaaattaacaaagtcaaaattgcatgtcttttcttgaatgataggccaaatatgtatccagtatttcatttacccacagcatatgttgtagactcctctttcaaatgaaaggtaacaaaagctcagttgaaaggaaaaacaaaataaatcagtgctagctactacagataaggtacactaaatacaaataattagccttcactaattcatccattcattcttttattaagcagttgggcactgttctagatgctagggatataacaattaaaaccaacaaaacccctgcctgtattttggagaagtagggtgtgcagtatcatgggagaagatagattacaaaacaaaagaaaaatatatagtgtctatatggtgataagagctatgagacacacaaagcaggtaaaaaagttggaagttgatgctagccaagtggatatacggggaagagctttaagggcaaatgccagagccagaataaaggccattagcagaagcttacttcacagattaaagaacattgtgactgttttcctgtgactgttacagaaggagcaaggggaagagtcaaggaagattaattcagagaacaattacatgctttcagaggattgttatgactttatttttgctcttgagtgagaggaacagccattgaaaagttttcagcctgataccaatttgaaaaggatcactctggttactttggtaaatagggagaaaaggtggaaatagggagactagttagggggctgttgcagttatttagtgaaagagctctggaaagtattgagactcgattagatttttgataaagcatatctaaaatatctaagactctaaaaggtcagcttttggatatactttggaggtagtgccagtaggattttctgtcactgtgaacatggggtaagggagcaagagaggattgagaggagcaagtaagtgaccccatgaattttaggctgaaaaactgagctgatggagttgtcatttactgagatggggaggactataaagaaataagttttggcagagaagatcaaatatttggttatggacataggttatggacatagttgtttgagatgcctgatagacatctaaatgtaaaaatgaagaacgtctggagttcagaggcgacatacaggttggagatagaaatttggcattggcaggatatggacaggatttaaaggtaaaggactggatttaggtaccagtgaagtgagttcagagaaaaagataactgagaaatgagtccttgggaaagccagtgtttgtaagttgaggagatgcagaggaaccagcaaaggagaatgaggagaacaagggaataaggagaaaaagcaggagagtgtggtgttttaacttgacctacttgaagttaaatctcctttcttcttcattgaggatactgattgtcaaatagacacaggataatagattagaaaatcctgtaattatacataaagaacagtctcagaataacaatatcaataatgcccaattgttataattactgaaaatacagttaatttgtttttgcatatgttatcttcattctccatcttgccatttttaaaatagttgaggtatgttacaaggtgaattatgttcccctaaaattcactaaaattctaaccctcagtagcccgtaatctgactgtttttggagacagggtctttaaagaggtaattaaggttaagtgaggtcatttggttattgggccctaatccaatgtgactagtatccttataaaggggaggaaattaggacacagccacacgcaaagggaagaccatgtgaagacacaggaaagaaaaggtggttagactgtcttcaaaccaaggagagagtctccagaagaaaaccctgctgacacccatatgtcagatttacagcctccagaactatgagaaattaaacttcttttatttaagccatccagcctctgattctttttcatagcagacccagcaagctaatacaaggtcttatctgtgttgtgagcgcacacagtcactacataccattgactcttaactcttacttaatcatagttctataagtacctgtgtgtttaaggcttatattatttccttatattgatgtgtttcggctgtgttttagctctttctgtagtagattcctcaggaagagttcatggaaatagtatttcttgagaaatgcattttgatactagtttgtaaggggctttatactttatacttgaaagccattttgcctggctataaaatccctgacttttctttctttggatgtcttaaatatgctactaatttttctctggcatgaggtattggtattgaaagcctgttgacaatgtagtatcttctccattacaaggcacttagtcttgttagatgttcaaaggattttttttttctttttccttatatctagtaattttggtagatatgtattggtgttggtcactgtgagttaatttctcaggtatgtggtgtccactttcatatgtagtttgcatcttttcatattttaagaaattgttcttgtactatacttttagaatttcttctatttccttgctttggttttcttctccagacacttgactatgcatgtttatttactttgcttatctttaatatttctcttaaatcactcctcatatttcactttctcttaaatctttatctccttctttatttctctctcattttaaaatttaaaagtaaaataaaaattacaggaaagctacaagcactatcccagtcagtttttttcctgaaccctgagagtaactactgacatgatggttatttaggaatgtgtttatttccacatatttgtgaattcatcaaattcctttatattattgatttctaacatcccagtttggacagataatatactttgtattatatctgtcttcataaatttattcaggtttgttttatgacctgagtttggtctattcagggaatgtttcgtgtgtacattttttttttggaaacagggtctctccttctgtcacctaagctggagtgcagtggtgcagtcctagcacactggagccttagactcctgggctcaggctatcctcctgcctcagctcctgggtagctgggactataggcacaagccactgtgcctgactaatttttcagttttttatggagacagggtcttgctctgttgctcaagctagttttgaactcctggcctcaagtgatcctcctacctcagcctcccaaagtgttgtgattacaggcatgagccactgagcccagctatgtgtactttagaagaatgtgtattaagctgttttaggatggtgtgttctagagatgtctgttagttctgtttggtttttgttcaaatcttcagtttccttcttgatcttatgaatggaaagttgagtattgaagtgcccaactattattattaagttgtgtgtttctcccttcatttcttcagagatttcttcatgtattttgatgctttgttgttgggtgcacatatgtttacaattgctatatcctcctgataattggcccttttatcattatccaatgtctttttaatatctagtaatatatcttgttttaaagtctattttgtccgatattagcacagccattccagctttcttgtggtttcttgattttttcccattttatttactttaaatatgtttttatctttgaatattctataaacagtatgttattgaatcttattttattatccagtctgacaatctctgccttttgatttgattggttatttcattcatctttaatgtgattatcgataattaggtttccatctgtcattttattttttgttagctatgtgtctcatgttctttttatttctttatttcttctttactgctttctttggattatgtgcttattttcttatatagcattttcaatttttaaataatttttttcacttaaaaaacatttctttagtgattgcagtagagcttaccatatacatcttaactcactggaatcagccccagatttatattaattttatcctagtgagttatataaatgttacttctatagagctctatttgttttctctgtttttgtgatattattgttatacatatagtatctgtatatgttacgaacccaacatgacgtaattattacttcatataattgtgtcttttaaagaagctgagagaagaaagatacagtatatgtttatagattttgttatattgatcttctgatttatcatttatgaatctcttcatttgtttctgtggattcagttaccacttggagtcgtttccttagctcagtacaactttgcttccatctaccttctttgttatgctgaagtggtccatactgaaaagaatgcatcatactctacttatttgagtgtaattagtacaaaatatattcataccttcttttcttcttttaaaataattataacagttttattgaagtgtaatttacatgccatacaaatcattaatgttaagtgtacaagtcaattatttttttataaacttacaaagttgtgcggacatcactacaatttaattttagaacatttctatcaccccagaaggatcctacctgcctatttgcagtcactcctcattctcatccatctcctcctagtcatacagatttatataataattcttcctctgaaaatccttctgaaagaaataatacggtaaacattgatatttatataaaggcttatacttttatgtaaaatattttctttaaaaaaaattttttaagactcaaggtctcactctgtcacccagggtggagtgcagtggcatgatcatggctcattgtggtctcaaaatcctggacttggtgatccttccacctcagcctcatgaagagctggaactacaggcgtgtgacaccacacttggctaatttttaattttttggtagagatggggtctctctgtgtgttgtccaggctgatctcaaactccgggcctcaagtgatcctcccaccttggcctctcaaagtgctaagattacaggtgtaagcatagtacatgtccgcctttatatataaatttaaagacatagaaataacctaatactgcaagtaaggaaagataagaaaattttcttcatttaatggattctatgtttatattgaaattacattatacactttttttaaacctaaaacttgtagatttattacataaacttgttttcctcctacaaaccaaaatagcgtatggtatgtatcatggactcagaaaaactaagaccaatcaatgtttttccaaataaaaataggttttattagatatcttacatttccacaaaatgattttaaatcttttaagagaatatattaaaatttgttaattccagtgtaagcagtatgaacaaaatgaaagcaagagttttgttctagacaatgggatgtacaaatgtttcagcagtggtaaattgcagacacggaaagctgatttcagtgtttaacaacttatctgtgtgttttaattcagtcactgtttttttgaatgcaggtatgctgagttcttaagcattctagtgataacactaccctcctcattcaaaaaaaagtattatcaatgacatacttcagactacagcatacacaaatttttaatcgttcatgttgctcttgtcttggcacatgcctgataactaatggtttgcatccagttttcttttagatagtctctacacgctagtccagaagtaaaaactgacatgtttggtctgcacagtgttaaaatgtttgaattaaattttaaaatatagtgattttagataaaaattcagatttcatgtttctcttgaaaaatatggaagaactagcaacattgaacagttgacttgagctgaggagtgggggccacttttagaaaggacaaatcttctctagtttgaggaagtccccatctggcccaattcacttatatgcatatctgtatgcctcccgtaagaacttgagtttgggacatttaatttaaccttataacattagagtaagaaaattagagccacatcagcctaatgatttgctcagcatgaaaaagataattagtggcagagtcaggattttaagatgatttcactatcgaaacattgaatatggagtataaatcagaagacttagaattacgtgctggccccttctacatcttaatttctgtaacattcagttttcatagttgtaagttgaaattaatagtaatactgatatgtgattattgcaaaggttaaatattatttatcattattagattcatatctgcagagcaattttaaccacatctaacaatacctttcttgttatagatggcataggtttagttcttgtgtttcataaaaagtaataacatgttttaatgaacttctcttctgagttttgtatgtatattgtgatattattattgagtagcattggtatttcataggttgatttgctttttagtaaagatgtgaatatttttacatgttaactttttatagcctcaaatgatagtcatttttctctataagtaattcatgtgccaggcactgtttatttacacaaatactttttaaagtgttaacaagaaaaattcaacttaagctctgatgtagtcaagtaacatcctatttatatataatatcaggtttgatattttttctaatgaaatgattttgccagtaatcaaaaactttaaattagaaaatgaagatctgagcatttttattggcataataaaacttaactctcattgaattgaagtgacaataacaaagtaagtaataccactgaatagtccctgacacatgaaaggtacacaagtagtttattattgtaaatgtttctctgctttaaaacttttgagtgtaattgttgcttttaaaaagagtgtttaccttagttttattttttcagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggtgggtgaatcgtggctttgttttcatgttcttgtcagaatttgacagtatctttattttatatatcaaacattgctcatctataaatctatgatttttttgcttcttttttggcttttgcagatcttttaagtgaaactttaaagaatatctctcttttctatagcaatatactctaccctggccttgtctccttagtaggaaatctgtcatatccattatcttatatagcctttgaaattaaatcaattaactgaataagttagttgttagatataaaaacatactttgctttaagaatgtattactaatattctctaacattaaaattacttgtctttaaatccatcaatagtatttctgattttaaaataacgtttgattttaacttaatatttttagtgtgaaaatgcctcaacctaagatttgaaatttaaaagtgattagcaaaggtattcacttttttgtcttatatgtgtataaaaattataattgaaggcttaaaaatgtccaagtatgttatttaattctattataaaggtatttggaacaaggaaatagtgatgaaatcattctatagaagtttaataaacatttttgtttttggacataggatgtgaaagcgatagtaacacattcaattcatagtgcaattcattcaattggagggattcaagtgctttttccactttttgcccaattggataataggcagctcaatgacagtcaagtggaaacaactgtctggtaagttttctttgcatgtacaattgctggtattttatacacacttaagactatgcatgatgtactcagtgctgtgtaaatgtattacagtatttgggttctgcccttaaagtgtaataaaaaattttttagaactaatggagatagatatttatacaataaataaagaaaacgctgacatttaggttgttatatcataaaggaatgccttccttgataataaatagaaaattcttaccaaagatagcataatgattataatatgtagttgagggaaaaatattaatcctgaccttatcatttgcatatactcatggtttgaattgaccatgaaaccctgtcaggttgaagaaaattactagggtaaagttattcagaagaataacatttattagcaattacataatttatatcttaaagaatggtattattttataatgcttttgtcatggcataagtctagcataatattaattgacatcagcccttatttatatatagtttatatgtgaggactcaatctaaccaggcaaatccatgtttatgtaaaaattaaatctcttctaatgagtgtgatttcatgtacatttttatagtttctcttttattaaaaaaaaccttatgtgccagactctaatttaatgttatatcttagaattatacatacaagaatttaaaaatgaattgtagtagctattttgattatacacattgccatgcttggggattttaatgggcaagttatatagataagcattaatttttattccaaaagtaacatagtagtgcttcattagtgtatatatatacatatacatgagctccttaatgggttatctaattttgaattgatggcgaatctagtgaatgaagatatgagaaaaatttaaggtacaatgaaatgctttttctcataattattatctaaattagctattaatgaaattccattttagtatttctaataatattatttctgttttgggaacatctttatgtaaagtataaatctaaatatggatatgagatttgtacatttataacattcacctcccgtctatgggtcttgccttcttttatatcaatatagtgtaaaggttggagttttgaaagtaaaaagctttgaagtgaaaaggaatcctgaggttatgtcctgctgtgatactattttgcttgtgagatcttaaataatctaattggaaggcagctcagcttagtggaaaaatcaaactttaaatttcagtcctttatttaaattcaaaatgttttactatttatcatctcagtgaactaggacatattatgatcagtatttaaaatctagtcagtactgtgaaaagaagtgggagatgaagtagccactagaaaaatccatgtattaatttaaatatttcttatgaaataatatgaaatacatatattatcaaatcttactgctaaaaccatatgtaataggttatttggtttattcatccaagacacatggttactttttactgtctttcttcaaaactcatttaatatttatattatatcttggtatttaaattgtatttatttcatcgtggagataaaagatagtgtgaggagtcagcatacctattttcattttgattttagttctttaaatcatcctaatatttccctatattaactaattccaaccttttcagtgatgtctattatgtcttttgtttgtttgtttgtttgtttatttatttatttgagatggagtcttactctgttgcccaggctggagtgcagtggtgtgatctcttggctcactgcaacctctgcttcccagattcaagcaattcccttgcctaagcctcccaagcagctgggattacaggcacctgccaccatgcccagctaattttttttatttttagtagacacagggttccaccatgttggccaggctgatcttgaactcctgacctcaagtgattcacctgccttggcatcccaaagtgctgggattacaggcgagagccactatgcctggccctgtttatagtttagccaatagaaaacattacaagaatgatactgctttcctctttaatacgtactcaattccaggctaccctgtgatttagttatgtactatttttaattcttatctattactttttcattaattatttcagtatcctaaatatctgagatttgctctttggtacagacaattgtgtggatcagtaatacagtcttttgttatttaatgttttatagggaaccattatagaaaagtatgtgcatcagtgaaatagtctgtgattttgcaagctgttaagtgggatttctccctctatttgaaaaatacagattcatggctatgcaggggtgatagaattttatgttttatggctatatcatcagttcatatcgatgattgggaccttgaaataggatttatcatcttatttagttgataataaattgttctagattaaggataatcaatttgaagtttttaaatcttacagagaaaatttaatatactcctttttggaagtctgattgcatggtaaatagatgactgaaagttgcaatactgtctaatttttaattacttttttgagaaatggagctaagctcaaatataagttacttctttgccctctgtgtttcaagctgaagcattttatcttccacatagttttctctactaagtagtaccttttaatgaaacttttcattgtttcttaagccttacctctgttggcactactactttgttttatcaactttgatgagtttttactttatataggggatttagaatttttaaaaaattattggctgggggtggtggctaacgtctgtaatcccagcaccttgggaggctgagagtggtagattgcttgagtccggaatttcaagacagcctggacaacatgacaaaacctcgtttctacaaaaaaatagaagaagttagacgggcatggtggcatgcacctgtagccccagctactggggaggctgaggtaggaggatcacttgagcccaggaggtggaggttgccatcagttgtgatcacaccactgctcttcagcctgggtaacagagcaagactctgtatcaaaaaaccaccccaaattattgaaggaataatttcattttctagagtcttcaaagatggatttatttttgctggataatttttgtgactttttaaattatgaaggccacttatagttgttttatgtatggactttcaagtcagacaaacatgggttcaaatcttgaatttagtatttattactagtacaactttgtgtatgtgattaattttttgagcataactcaaactctgaagtaatatagctttcgtattttgtgtctagaatgactcaagaaattaaatagaaactttattttcctttgaattggatgattatgtagactgagtacatattcttattgagtacatgttattgagtacatacatcttattgagtacatatttttcttacattgagctatgtttttaagaacatgggtaattatgtaggtgatacaaaataaaaccttcctcattgtgtgacctaagacagttttgctttgaaaaaaaattatgttttctggaacaaggtataaattgagttttgtatatcaaacaattaaaaatacaccaggagaatagtttcattagaaaccagtgtaatatattgcgtaagtgttcttttggtggaagacaaatttgggctcaaatccctgtcctgttttatactgtccgatgttaggtgatgggatattcatgggtgtgtagtagtggtacatggcatttattgaatacatactgtgtgctagtcacttatttttaaaaaataaattttattgtgtatgtttaaggtatacaacatgatgttatgggatacatataaatagtaaaaaggttactatagtgaagcaaattaacatgtctgttgtctcacatagttacctattttttggggggagggaagtggctaaaacgtactaattatgaatcacatacaaaatataattctgttacctacagtcctcatgttgtacattagatgtactcgttcaacctacatatctggtactttatttactctaacctacatctccccacttccaagccctgtgtcccttttccctgatagccactgttttgttttttatctctgtatatttgaattttgccagtcatgtattttagtgtaattatttgctgatgaagaagagaaaaattgaataacttgttcaagatcacagagacataagtggcagaaccagggttctaatcctgcaagcctgactctagagctctgactctaaaccactgtggactactctgagaatcacttttgccagctgtggaatgattttaataagtgccaactttatctgattgtaatatgaattaaaataagacatgtaaagtatctgtcatagcgtctgtacatagcatctggcatttaatgagttttctttttactttcttccgtgagttactagtctattggttagatgcaactttttaattattaaaacttagttttaatgttattgtaaactatgatcatttttataaagtagaaatttcatgtgataatttaaataaattatcttaagtatatgaatatttttctaggaaaagcattttttaaaattacaataaatacagtttgtttgctagaaggatggaatgtaagaaataaaagtgtttagagaatcccataaagcatttatgtcaacagtcctatcatatgaacagtcctcttgtaatgtgaatatttatgactcattagtttgtttagtgaacttaaatcacaatttattttttaagattaccttgctaattaatcaaagttattccagtgattaacttgaattttacagccactttaataattaagcagccccttaataattaagtatttcattctaatattctgattagcactattgtaatacataaagcaacagaattacctggaaaatttaaatatttcagcgtctaactgccttagccagatttcctcatacacttagaagtgacatgaaaatcctttatctgaccatgtttcctgatttttaattcagaaaaaatatctattatatacagcgttaaaattttattacatactcttaatccaacttaatctgacttaaaaataatatgtgattgtttttaatagggaaaataattaaaattagtacctgtttataataattgcttatcttatggaggtggtggttcttatatatagaatataattattaatttagtttccaaaaacatttaaaatatttgtattaggctatagtttatacagttatatttacttaggtttttcggaaagaatataccactgatatgtcttaagattcatatcactttgtttgcctttaaaaaaattgctaaattggtactgaaaacattttgaagtgatagacacaaaaaaatacatttgatgtacttgcactactacttttagaagagaaaaatgaagtaatttggttagtgagatttaagcagagtaaaatgaaatatatattgaattcactatgcaaatgaatttataagtagtaaaaagtaaaatacattattctgtctgaaacatcaggaaacattacatttaattttcaaatagctttttcttctttttaaatttagcgacagccactttcaatgctatactactttgtgttgtttagttttcaacacttaatttttctctgtaaatttttctttgtcttgttacaaggtttatgcttttatctttgacccttcactccctctctcttgctgtggaaaaaaggcacctttttggcaataagattaactacaaattattccttgcagaaattctggcgaccatggacacatcttcactaaatttgttgccttaattttcttctagtttgcatttccacattctgttgtctttaatttttcagtcttactatcttctaacaggagtattgttattttactcatgccatagatttcatttcttttaactgtcttacattaccttccttcatttattttgattttatgacagtcgtgcaggtataatggcatcagcccaaaactaaaataaatattatttgcctttataaagagtattaccacatgccataattcatcctcagaaacccagaatacttttaatagattgtagctataatactgattgtcacaagtgtttaaaccctcttctttttccatccaggggtgagatgtgatgaccataacatgtaatgaatggaattttcaagaaaagatttagtaaagcatactaaggagattctagctaacttagtattataattttattggtttttgtttctaattctactcagatttttaggtccacaatcttgttacctaggctggtaacttccagtgcttatctctagcttgccttcaatttaggcttatacacataaaccattgatggaatatttccatgtggaaagtatctcaaacttaacatgactcaaataaaaattcataaacttctcatctacccaatttctattgcttttgattttctaatgttactgaggaacattgtctccaggcagtctcttaaattagaaccccaagagaactcatcagttactttcctccctttgaataattaaaatattagctgttcctgtatttcccacatacaatctatcatgataaactattgatattattccttaaatacctcacaaagctaccctttcccctccatccatattgctactgccttagtctaggttcccattattaattacttcagctagtatatatccagtaattgctgttgcccttttccagtaattttcaatgggtagaagagttatctttctaaaatacaaatctaattatttcacaccagtggtcattcactggtttcctgttgcctcagaacaaagtcattatctgatttggtcatgcttacttatcttctctagtcacatttcttgatagtctttccaaacccaaattcctatatatagcaataaggacaaagggtggaaaatgctagcagggacattctagaacatgtatttatgaataaaaggtgctacaaatagggacggcctcagcaacagtgtatagttgggaacatggtttttctgcagtccttggatttataatgtcagtgaattagggaggagatttaacagaatacttcatttaaggtgtcttggagtcttactacctgctttataaataaaggggaaggtttctgtgcgcttaaatctggctttcagcttcagaatagagatggagtgtctgctgtcatgcaagtggacaataagcaaagccataggtaatctgtataccaaatgacccattatttgttggccaataccctgtttaacagatcttgtttaataatcagcacagagaaacctatcagcatagaacttacattatccagcatttgctagttatagctgtagtaacaaacaacctcaaaatctggtagcctcataaaacaacaaaagttaattgttttttcataactggttgtgctgtgttccctgtgtcttctcattctgggtcctaaaagattagctgtgatatggaatatgtttttcttgtgtcaaagaagagcaagaatctgagttaaacaatacaattgctcttgtagcttctggtcaaatgagatgaatgtcatattcaatctgctagccgaagaatgaccaaccaagcccaacttcaatgaggggatttggttgtaaaatatatgtcctggaagtgggggtggaaagtaagtctttggccataggcaaggatttataatcttcttactgagatggaaaagtcggtaattgggaataataatgcaatctcccatgggacttatgaaaaagtattacggtgcacaggaaggaaacccatatcctgaagacttgaggcaagccgacttataaaactttgagaggcccaggcgggcggatcacgaggtcaagagatcgagagcatcctggccaacatggtgaaaccctgtctctactaaaaatataaaaattagtggggtgtggtggcacgtgcctgtagtcccagctacttgggaggctgaggcaggagaattgtttgaacccgggaggcggaggttgcagagggccgagatcgcaccactgcactccagcctggcaacagagcgagattgtgtctttaaaaacaaaaaacaaaaaacaaaacctactaggaggaattcagaagaaaattttggtaaaatttagggtacaaaatgaccctgtatgaaatagcagaataccataaggctgacattgagacaatactatcagaatttagagatgatggccaaagtctatatttttgccagacattgtagaatattctgatataaaatcaggtgtgggggaaaaaacaaagaatgtttttctaattccttttggtaacttctcgttgaattaaaaactgtatatgtgccttcttttggatttactggagaaagtaaaaattaaaaatgtaatggttacaaaaatacggaaaacaagggaatgggaatagaaccataaagcaactgttaatataaagtaacaggttatataacctagagatactattaactgttaaaagacagaaactcacatattcattcaataagccagaatccaaatatgtaagctttaaagagaaactgtttcatttaaaactaaatggtaaagaatataggtctcaatttttggtctgctgtagtctggcaatttttttcttagtataccactaataaaagtgtagatagtatactaataaaaatgtggctattttgtcccatatagaatgcatggatggtatctttttacctaagaaagcacatattcctcatttgctggttagaataaaatcatttgttaagctacacagaaataatagaaaatagtccaccatgtttgttacattttatctagaaagtaggttaggtcactcactactaagctattccaaaacgttccctaaaattttacttctcatgggatgtgggcccttttgcaactattcattttcacgtaattcatggtggttttatactttttctataggaagtgtcaagacatactgcatggcttgaatgataaattttctatagtataggtacccatactaaagacatagtagtagtagtagattattataatagtaatattacctatttctgaagtatgggtacagatgcttgtttctttctgcactgtgtagtttttagaacaacacaattctcccttttcaatggttgcctaatgctgagttggcaccttcaaattattttgtcaagagagtataggggtcatgtaccatataaaattaaaaaattgtttatttccatatccagaacatgcaggtaacttttgtccctcctagtacaactgtcgtacatattattttaattgatatcattgaggatctctcccttggtggcctatgggtgcctattaatgcatccagcatttagaaacagggaagtcctttgcaggatcattttgacattactttactgaggatagtagtcagggacttgagtggggtcttacgtatctgatggaaaaagaagattcatacattctctgacaaagaggttatgagcaaaacctctgcctttaattatgtaatttctagatattctttatcagaaagtccaagctgaaattggagggtaggttacaataaggctcagctggaagaagaaaatatttttgccatggagaggagggcatataacctttggggcggtaaagctgactcatagcagtttgggtatttggtatgtatcccttgtaactcagccaagtacactaggtagcacatctttaatatagttgaagaccagacttaaataggtttagaaacataaggagttctagtagataagcactgttaggaagcaaagggtaaaaagtttagcactaattggttcctgtgaaatcaatgtggaagtcaggcatgagacacataaatttatttactgccaaatatttttacagatggaaatgagatacaggagttggtacctttggtatcttatgtatagtgaataggaccaggtatgatcccttccagcaactcttggtggagctttaatgaggatccaatgtcagaccaaagatgctggcattcatcatcccaagtttatcagtagggctttttataccgctaaaaggtttaccttaacacaatgactttatgatttaaaacatcgaatgaaatatgtatacataaatgcttcgtagtatggcttgctgctggaaggcctagagggaagtttcatgtgcctcacactcagcaattcatgggggaatagcaggagtcctatttttctggtggctgtatatctcatcagggttatgagcatctgcctattagagcctaatttttgtacaaatcctagctatttattatttttgaattctatcttggcattttctgtatttgtggtgaaaatattgttgaagttgatcttctttagacacttcctttgcaatatctttattaatgggcaaccatactctgaatctaggtattaaattttatatgacagcttttgtgaatggatttacttagctatcttgataaaatacatatattattttttgaactttttttcatagaaacaaacaaattcaatctaaatatttattaatggctttcaagatgggcaagctttttttttttaagtgcttatctccattttgcaacaggcaaatatggcaggaatgacaatatgtgtgaggcatttgagaaaacagtttggaggatattaacaatgtttgtttgcataactttttattttttaccttttatgccaactcatttgcaaagaacagaagattttttatataatctaacagcaatttgtggagtataaaaaagtgaatcttgtttttaagagtatttttttcttttcttcaaaatttattttgttgattaaaaatactttgcgaaatttataggtgtatgtgaatatttgttacattcatagaatgtgtaatgaccaagtaagggtatttgatcatcaccatcaccttgagtatttatcatttccattttggtaactttttttttattatactttaagttttagggtacatgtgcacaaagtgcaggttagttacatatgtatacatgtgccatgttggtgtgctgcacccattaactcgtcatttaacattaggtatatctcctaatgctatccctccccacttccccaccccacaacaggccccagtgtgtgatgttccccttcctgtttccatgttttctcattgttcatttcccacctatgagtgagaacatgcggtgtttggtttttttgtccctgagatagttagctgagaatgatggtttccagcttcatccatgtccctacaaaggacatgaactcattattttttatggctgtatagtattccatggtgtatatgtgccacattttcttaatccagtctatcattgttggacatttgggttggttccaagtctttgctattgtgaatagtgcctcaataaacatatgtgtgcatgtgtctttatagcagtatgttttataatcccttggatatatacccagtaatgggatggctgagtcaaatgatatttctagttctagatccctgaggaatcgccacactgacttccacaatggttgaactagtttacagtcccaccaacagtgtaaaagtgttcctatttctccacatcttctgcagcacctgttgtttcttgactttttaatgatcgccattctaactggtatgagatggtgtctcattgtggttttgatttgcatttctctgatggccagtgatgatgagcattttttcgtgtgtcttttgcctgcaaaaatgtcttcttttcagaagtgtctgttcatatacttctcccactttttgatggggttgtttgtttttttcttgtaaatttgtttgagttcattgtagattctggacattagccctttgtcagatgagtagattgcaaaaattttctcccattctgtaggtggcctgttcactctgatggtagtttcttttgctgtgcagaagctctttagtttaattagatcccatttgtcaattttggcttttgttgccattgcttttggtgttttagtcatgaagtccttgcccatgcctctgtcctgaatggtattgcctaggttttcttctagggtttttatggttttaggtctaacatttaagtctttaatccatcttgaattaatttttatgtaagatgtaaggaagggatccagtttcagctctgtacatatggctagccagttttcccagcaccatttattaaatagggaatcctttcccatttcttgtttttgtcaggtttgacaaagatcagatagttgtggatatgtggccttatttctgaggactctgttctgttccattggtctatatctctgttttggtaccagtaccatgctgttttgcttactgtagccttgtagtatagtttgaagtcaggtagcgtgatgcctccagggtcgggttacccacaaagggaagcccatcagactaacagctgatctctccgcagaaactctacaagccagaagagagtgggggccaatattcaaaattcctaaacaaaagaattttcaacccagaacttcatatccagccaaactaagcttcataattgaaggagtaataaaatccttacagacaagcaaatgctgagagattttgtcaccaccaggcctgccctaaaagagctcctgaaggaagcactcaacatggaaaggaacaactggtaccagccactgcaaaaacatgccaaattgtaaagaccaccaaggctaggaagaaactgcatcaactaatgggcaaaataaccagctaacatcataatgacaggatcaaattgatacataacaatattaaccttaaatgtaaatggggtaaatgctccaattaaaagacccatcagtgtgctgtattcaggaaacccatctcatgtgcagagacacacataggcttaaaataaagggatggaggaagatctaccaagcaaacagaaaacaaaaaaaggcggagattgtgatcctagtctctgataaaacagatttaaaccaagaaagatcaaaagagacaaagaaggccattacataatggtaaagggatcaattcaacaagaagagctaactgtcctaaatatagatgcacccaatacaggagcacccagattcataaagcaagtccttagagacctagaaagagacttagactgccacacaataataatgggagactttaacaccccactgtcaacattagacagatcaacgagacagaaagttaacaaggatatccaggaactgaactcagctctgcaccaagcggacctaatagacatctacagaactctccaccccagatcagcagactatacattcttttcagcaccacaccacacctattccaaaattgaccacatagttgtaagtaaagcactcctcagcaaatgtaaaagaacagaaattataacaaactgaaactgtctctcagaccacagtgcagtcaaactagaactcaggattaagaaactcactcaaaaccgctcaactacatggaaactgaacaacctgctcctgaatgactactgggtaaataatgaaacgaaggtataaataaaaatgttctttgaaaccaacgaggacaaagacacaacatagcagaatctctgggacacattcaaagcagtgtgtagagggaaatttatagcactaaatgcccataagagtaagcaggaaagatctaaaattgacaccctaacatcacaattaaaagaactagagaagcaagagtaaacacattcaaaagctagcagaaggcaagaaataactaagatcagagcagaactaaaggaaatagagacacaaaaaacccttcaaaaaatcaatgaatccaggagctggttttttgaaaatatcaacaaaattgatagaccgctagcaagactaataaagaagaaaagagagaagaatcaaatagatgcaataaaaaatgataaaggggatatcaccaccgatcccacagaaatacaatctaccatcagagaatactataaacacctctatgcaaataaaccagaaaacctagaagaaatggatgaattcctcgacacatacaccctcccaagactagcccaggaagaagttgaatctctgaatagaccaataacaggctctgaaattgaggcaataattaatagcttaccaaccaaaaaaagtccaggaccagatggattcacagccgaattctaccggaggtacaaggaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgcaaaaatcctcaataaaatacaggcaaactgaatccagcagcacatcaaaaagcttatccaccacgatcaagttggcttcatccctgggatgcaaggctggttcaacatatgcaaatcaataaatgtaatccagcatatgaacagaaccaatgacaaaaaccgcatgattatctcaatagatgcagaaaagacctttgacaaaattcaacaaccttcatgctaaaaactcttaataaattaggtaatgatgggacatatcttaaaataataagagctatttatgacaaacccacagccaatatcatactgaatgggcaaaaactggaatcattccctttgaaaactggcacaagacagagataccctctctcaccactcctgttgaacatagtgttggaagttctggccagggcaatcaggcaggagaaggaaataaagggtattcaattaggaaaagagaaagtcaaattgtccctgtttgcagatgacatgattgtatatctagaaaaccccatcatctcagcccaaaatctccttaagctgataagcaacttcagcgaagtctcaggatacaaaatcaatgtgcagaaatcacaagcattcttatacaccaataacagacaaacagccaaatcatgagtgaactcccattcacaattgcttcaaagagagtaaaatacctaggaatccaacttgcaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcagtgccatccccatcaagctaccaatgactttcttcacagaattgtaaaaaactactttaaagtccatatggaaccaaaaaagagcccgcattgccaagtcaatcctaagccgttttggtaacattttaagtcctctattccagctactttgaaatgtgccctacattgttgcaaactatagtcactctacactgatattaaacatgagaactttgaccaactatctaactgtatgtttgtaccgactaactaacctttgtttattcctcctgctaccctggtacccttcccagactctgtatctatctttttactatctgcctccatgtgatcaattgttttagtgcccacatatgagtgagaatgtctttagccatttgcctgttgatggaaacttaggttgatttcatagctttgcttttgtgaatagcgctgtgttaaacatgtgagtgcgtgtatcactttgatatacagatttcctttcctttggataaatactcagtagcaggattgctgggtcgaatggtagttctattttaactctttgaaacatctccacactcttttccatagtggttgtattaatttacagtgtgcaaaagttccattttctttagatcctcaccagcacctgttattttttgttctacttataatagctgctctaactggggtaagttgatgcctcattgtggtttagatttgcattcctcttatgcttagtcatgttgaatattttttcatatacctgttgacaatttctgtgtcttcttttgagagatgtatgttcacgtccttagcccactttttaatggggttattttttttttattgttgagttgtttgagttccttgtatgtgctggatattagtctcttgtaggatgaatagttagcagatattttctccagttcaaacacaaattgtctcttcactcttttgattgtttcctttgctgtgtagaagctttttagttttatatagtctcatttgtctatttttattatagttgtctgtacttttgaggtcttaaccatgaaatatttgtactgaaacaataaaacaactagaaaaaaacatggtgaaaacacttcaagatattgatctaggaagagatttcatgtctatatttaaaaattaaaatatttatattaaaatgcttccactaaagttggtacctaatcttatataaggaaattttagagtacactctggagaagtccagtcagcacaacattaaaagtatgaatttggaagtggaagggattacagctttggctgaagcatgagccactattaacatcatcatacagcttttggtcagcaatgaattttataatagttacggcagaaggaagttgtaaatgatgtaagtcataaagtagcattaaaataatattccagagagatttttttcaatagtaggcaaggaattcttattatatgattgtgtaaaatcatgaacagcttcagaactgtaaaagaagtcatggcatctatcaacattacagcccaaaagtagacatttatgaaaggcatggatatatgctctagagagagcatcaactttagacaatttcagacacttggacagaatagtcagaaggcaaaataaaacgttttgttacttgatgtaggaacaaatggtataaccagagaaccttgtagactatatttgacgtacattagagataagatgaagattttgaagtaggaggtttgttaaacgatgttggttttcatcaagtggtcaagttttctatagctggagtttggagtaaaggggttggtacggggcaccaatagtaatgtaacacagggaagaagaagactttatattttccaggcattagaaaggtgcagtgttttggtattttggataggtactgaggtatcacctaccatagttagtgtcagacaggaatctattacggaggttgaaaaatcctccattattattgcagccatagctactgaatgcaatccaaaaggcaagcaagctgctatgagattaaggggagaacttcagtgagcaattggatattgtttgttcttttgaatctcccttaatgtaccctaaataattccatacttcaaaagaaaggtaacaggtttaatataattaggaaaactcaatatagggactttggacagacgttatttaggaaactgataaatcttttcagttttctggttctgtgatgacagcctgccagtttttatggtcgttgagctattgtaatataatccaatttccatggttagccatagccatgtggatttctcaaactatatggtctgggggtatcccagatagcttctatttaggaaaatgcaaggtgatgtttttagtagaacttagtaaaaatttggcttttccagtgtattctgggtcaagtttattggagtacttgatatgaaagataactaagaattagatattaggctggtagggtctctgaaatacatagtagtatacaaactttttttaaaaaaaatctaaccaaaacagcatggtaccggtaccaaaacagagatatagatcaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaactgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggagatcatcattctcagtaaactatcacaagaacaaaaaaccaaacaccgcatattctcactcataggtgggaattgaacagtgagatcacatggacacaggaaggggaatatcacactctggggactgttgtggggtggggggaggggggagggatagcattgggagatatacctaatgctagatgacgagttagtgggtgcagcgcaccagaatggcacatgtatacatatgtaactaatgtgcataatgtgcacatgtaccctaaaacttaaagtataataaaataaataaataaataaataaataaataaaaatctggctgtattagtcagtgtaggttatatgatatcaaattagccatgagaccttagtggctttatacagtaaaggtttatgtagtgttcctgtaatcaaatatagtttcttcagcaatctaaggtattgggtttcaccatcctatttcagagtagcccagtattcattgtaggaggcggggagagggactagagaattatgcataggtttttcattgttgcaacccacaagagatttctgataacatttagttgatttagtcacataattaactataatggggttaggaaatgtcttctgtatacacacgaagtaggaaaatgacatgagaattattaataacaaacattgtctctagcatacttggtttcttagctggtaaaattaatgggttgcaatggttcttggttagaattataggttttggtgtgaaaggatttgacaactattagggatgtggtggcatagcagtattaaacctgactttaactgatgtgatgctatatgccaatatctgggcatattgaacaactctgtctaattagtatgttgagatcaagatgtggggactcagaaggattttttgagtcatcttagtttggagcttcattcaagtcagtaagaatacaaaaaaatcagttccaattctggttaaggtagagtgagcacactctaccctgtttctcctactcaatgcaagaaaaacaccctacatggacagaattcacacagccactatttcacagctctgaaaagtgaataatagcaggtagaatggggaacaagagcagaattcacagtgcctttgaactggaagtgagttcactatactttttgtccctttattatcccctaacatgaattaaatggattgaaaacctgaaattgtgcaccagggtgcagtgagagacaactctgggagaaatcctctagttctgagtgccctgttaatttttcttttcttcacgttgttctgttatggcccagccctcatgtggtcttatcaccaatggaaggctatagaagccaaaactctgagggaggcttttctttgatcagtggagctagagtcctaagagggtgggacaaacacccttttcttcttaatctctctgcctttctgccagtggccctggatatgaacagacttgtagaatacattgcagagcagagaaactaaagccccagcgttttgacagaagaactgaaaagaagagcctcagaactgaaaatatcagggatgtcatggaaagggaagaacatgagaaagtaaccctgtaaaattttttaatgaaattcagtcctgagttgtgcatacatggatctaatccaaattacaagttgtagctgctacaataaggtaagaaaatgaaagtcatacagattataaaggaaaaatagaattatctgttttcacagatgacatgattgtctatgtaaaaattctcaaggaaatgacttacacataaattctagcactagtaagccatgtttagcatactagtgtcacaagatacaaggttctcatacaaaaatgacttgtatttctttatattaacaatgtacaatgtgaaaccacatttaaaaataacattaaccacagcatcaaaaatgttaaatactgagatataaatttcacaaaacatgtacaggatgtgtatgctgaaaactacaaatttctgatgatagcaatcaaagatctgaataagtttagggctatatcatattcatggacttaacatataaagatgtcattaaattggtagatacatgtaacataataacaattaaaatcctagctgaatatgttcattaatgtagacaagatgagtctaaaatttatgttgaatgacaaagtaactaggatagttaaaacagttttggaaaagaataaagttggaagaattatacttaactgactttaagactgacttttaagctgtaataatgaagaccgagtaatattagtaaacacatatatcagtgaaacagaatagagtccagaaatagtcccacacatatatggacaattaatttttggcaaaggtgcaaaagtagtctaatggaggaaggataatcatatgccaaacaaatgtgctttgacctaaacctcacaatttatatgaaacttaacaaaaaactaagtctaaatataaaacatgaaactctaaaacttttatgggaaacgtataaggaaatttatgggacttagggtaggcaaagctttcttagttgtgacgacgaaagcataattcactaaaaaagggataaatttcgttttgactttgtctaagttaaaaacttttgctatgctaaagatgcaatgaaaagacacagtacaggctggaggaagataacagcaaattgcttatttgacaaaggatttatgtcaagaataaataaaggactttcagtccttaacaataagactacaattcagtttttaaaagtggacaaaagagtagacactttaccaaagagaatataaggatgtcaaaatagttcatgaaaagatactcaacattattaaccaacagataaatgtaaattaaaactatataaaaccattatatacctagtagaataaaaaatagctgttgtgctaaatactggcaaggatgtgagaacaactagaacctgttactggtgggattgccaaatggttcagccagtctgaaatacagtttggcagtttattataaagttaaatatacacttattgtatagttcagcctttctactcctcggcatttatttatgagaaatgaatggaaatcatgtccacacaaaagcctttatgtgaatgtttatagtagccttattcacaattgctattctacaacccaaatgcttttacaaatgaatgggtatacaagctgtggtacatccattaatactcatcaactaaaaagaatggactcgatgtatgtacttacttggatgcctctcagaggcaatatgctgagcttacaaagggagacttagaaggctacagactgtatgattccatctatgtcacattcttgaaaagtaaaaatatgtagtgatagagaaaagggataagtactagagcctatgggtattgagaaggtgtggctataaagctgaaaagtgatagcacaagtgaattttttggtgtgatagaactgggctatattttgattgtggtggtggttatacaaatctatgtatctatttaacattctcaaactggtacaccaaaaaaaaaaaaaagagaaatttcactgcatggtcatttaaaaaataaaattaactattaaaagaatagaaaattcctgacctgtgtaaagcctaagtattaaagaattgtttcaactttgtgtattcagctgtttatctgtttattttcttgcatttgcgaattccagcacttctagtgtatgttaatcctatttctcttaaataggttggggcttgggtgaaagtggagccagcaccaagataaaggactgggcatttggccttcctgctgtggcatgttttgaccttgaagggcattagagtatgcataaatagttaagatcatccatgtgtaattatgacctgtttccaatttagaacttaagttctccttaggggttaggaagttacattattaaatttctaaagcattcatctatccatatttactatagtggtggctgccatttgtaaaacgtccaggacgttttcataaagtgactacaacatttagtgcactgtaaggggtggtttgttagttgtggttaatctgtggtactattaggctttgaaagttatttcttttacctttgaaggcttttagtaaatatatgaaaggagcttataataaaaaggcattttgctctcaaactatataaattttgttacatactatatactaatatatagtaatataagagatttataatgatttttttacatatgaaaattttaacattttgttttcctcagaagacaaattgacacatttcaagcacttttttatacttcttaaaactatatttgtcaaaaataaaatacgctatacaacataaaattaaaaatctctgacaagacaaaggaagatataaatgagtaataacctcacttttaatagagtctctaaggaatgctcttaaatatccatgacagtggtagcaattcagtttataaggctgccttgcctttttatcaggatgaagaaaaaggtagaaattactgagaagagatttcatggctccgggcagactcagtgatttcatgtgctatcttatgtatccatctgtccttgtattttactgtgttgcatttcacagttttccttatttcattctgcatttaccgcctatgtaggcattggtcttctttgagatcacatcttcatgagggcgttgtctaaaagtgactgctaaatatacctggagttagaaacatgtggtttagccctttctaatgttgaactgtgaaggaaatttaactcttacaacttattgtgagttttttgtgtgtcaccgaaaattatcttggatgcgaaattgtcttgggtgtggacttgaattgattaacgtacagtgaaatcaattatttctgctatgatcactctcatttaggaatagttttgtagtgagagaaatactatagaaatatgatattaaatattttacataattttaatcatcttttaaaatatttcactgtaattcagtcctaaattaggcttaagagatgaaaccttttaaaaatgtcaaaagatttttcccccttactgataccgtaaatctgatttggaacttaatctacttaatcaattactttgcaacattcttttaaaaggggtggaggtattggattttagggggaatctttactttttatgtaaggtatttccagtcttcttaataaaaaggtgtttatttaaaaagccaatctagctgtggtacttagctttttcagtaaaaaccaaattgaatagccagtttatgtcttcagagagctacctttgaacagaacttaggtttatatattcactcttaatcattttagttatgaattagttgtatctttatgatatattgaattctaaataatataagtacctcaaagataataaaactttatggatcacattacatgagttatctacattagttattaaaaaaattaaatacaaattgaaatggataaagttacagtaaaataagtcaaaatctatatttaaattttaatggaatataaatatatatattttattataaacaaattagttatgtttatacatagttaataaatattctcaggtatttgtgggccaagactgttgtggtattctttatcaataaaggccaaaaagctctggagaagtaataaatatgctaatttataagagatattattatactatttctttcatttttttcccatggtctagccctttaaaatatgatacttgaaataaatgttagtttctaacttaaatgaagcttattaagaattacaaggtggtaattatttttaagaaaaaacacccactaggttattaacatcattttccttaaaaagatacaggattacaaactcttatccattcttgaagtagaattgctacttacagaacatgtattatggtactgtctgttgaaaagtttagcaattatatatcatgacataataatcagcatacttttggtctatgaagtaaaatactcctatgaaaatctgttcctaggtattgctatacttttcaagagaattttctatgttgtattagttttggctgacacagatacttgctttttggtttatcctatagtatatatttagatcctctgcagatgaactgatgtgttctagacaggaagtggtatgtaggagatataggaatgggctgaagtatcctttatatttgcctttgtatctaggggagttggaaataggcaagaatggagagaaattttgtatggcagtacacagaattttgcaagtttattgtgagccctgcaacaatccgatgcattttagttactggtaagtttgttaaattatgtttgaaaatgtacctcttcgaagatggccatctatttactattacgtccaccatgtcaattataccttattgtaaagatttttttttttttttgcaaagatgtggtattgctattgcattgggttttaggtataaattaaaacgacttttgttagtgaatgcatttgacatttcaattggtgtcctggttaatattgaagtgaaattaacactttatggatagcagagtcctgtgttaagattttggaataataatattaatatttctgtttttgtaatggaactccactgtgtttagaggtctgagttaactcattagatgtttgagagtgagtagttattctgacataaaagaatgagaaaatccatgtcatccttgcaattttacatggttctatatagtagggcgatttactgtaagaaatacttttttgccttttttcatggatcatagggaccattgtgaggcatttctagtcgttctttttggcagtgctcatgcttaggaatccattttccccctaaatcactaactttggtgtatgtaagaattctatgaacagattaggaaattgtgtaatctctacccatagttttctttattctttttaaatatctaggcagaagtgttaggtgtaatatagtacttagcaattattcgtgaagtggccttgactattcaattcatttaaaatggactagattgcttaacagctgtgcttctttacagaaacatttttttaaatcccaagagattccttggtagttgtatttttcttgtaagtgtctgtctttggcttaaggacaaagtaaaagaatatcattgatttgtgatagtttacttttttttgtggtttaaggatataggatcagttaatataattgaattttaatttcctgtaatgaagtactttatttctagatactatattttgtctagctggtatgtaattcattaaactatgaatttttataataatgataatgataattttgctgttggttcttgttatgagaacatttctaatttgaacaaaagtagccacattatgagaaaaatgtattatccctattgaaactggaagagctagaataattcaaaaattagaataacttcagattccttttgggctttaataattttcaagttttccttattaccagattgtctgaatcacttgtaagaatgagtacttctgcatttaaaatatgtttagaaatttgtggttttaccctttcttatgaatataaataggtaatttatggtatattataaaacattgtaaattgatactattttaattcatgataaaatctggtctataacaatttattttgagctacattaagcatatacaatgaaggaatatgtatttccgttatttagaatactatattcatgtatcagtgttgctggttaaaatcattatatgtaactgtgaagtaatgcattatcaaagcttaattcaatgcaatcatttctttttattttgtttcttcattgattccaaagacaaatcaagtgcttaactttgacacctctttgtctgcttttatgtatttgtttatatattgtgtaattgtcacttttcatttcaatattacataaatcattttatttgctctcatgagcttttcttagggcatacctggacataagtgacatgttacatatttctctggattttttttaatgaaaggtttttgaagaatagttctaaatgaaaagtttatttaaaaatagagtttgttgttacaaagcaatattgcatctatatttaaaattctctacaatagcttgttattcaaaagaatagtatgatacaggctttattatgatacattataaatgatgtgtatatgtttcttaggtttacttgaagccagacatataaatatacgtagagataaactttgatgttttactttggaatgtaaaaaaactacacagttatgattcagtttattatatttaatttgtaaaggacaacagtagttttctcatgcttatgaggaaatatattctttcataatataaggcataatagtcattgtcagtaaaatagagatgagatttgaatatggttatcttttggcataataaaatactgaagtgggacactgtttataataaacatgtgatgattacataatgatgtctgtactttacatgcagtgctactctgttggcattcctggttgaactacttaaaagttcagtagccatgcaagaacagatgctgggtggaaaaggctttttagtcattggctacttacttgaaaaggtaagtgatatgtgttgatggttttattgtgtagcttcacagttggacagctgttaatcactaatttttttttctgtaatttcactttccattgactgtgtagagattatactatttgctaattcacaaacgtcttagatttaagtgtagacatggaattaactgggtatcggaagtgtaattaagaaattttgaataaaaaaatctaaataaaaaatttacatctatatctattcaagcaataagtatcatttctcttaagttttctaagtagtaccccctttatttctactctcactttctaaggtgtcacttacccatggtcaactgcagttcaaaaatagcatggaataaaccatttataactttctaaattgtgtgctgttctgaggagagtgatgaaatctcatgctgtccctcttcatcaagccctggacatgaatcctccttttgttcagctttttcatgctgtatacactgtctctccattagttatttagtagctatctcagttctcggactgaaaatcgtatttattatccactaggggtcttggaactatcgcgtcaggataaggagggagtactgtagttgtttctttgctatcttttcacttagacttttttttttttttttttgagacagtgtctcactctgtctcccacagtggagtgcagtggcatgatcttggctcactgcaacccccatctcctgagttcgatcaagcgattctcctgcctcagcctcccgagtgtctgggatcacaggcgcgcaccaccatgcctggctaaagttttttttttttttttttgagatggagtcttgctttgtcacccaggctggagtgcactggctcaatctcggctcactgcaagctccgcctcccaggttcacgccattctcctgcctcagcctcccaggtagctggaactacaggcgcccaccaccatgcccggctaattttttgtatttttagtagagacagggtttcaccgtattagccaggatggtcttgaactcctggcctcaagtgatctgcccgccttggactcccagcgtgctgggattacaggcatgaaccaccgcgcctggccttagactgtatctcgaaagtcttttttattaagataaaaatcttaatctatatttagtatacatgaatttacctgttaagttttgtgttattttttaattatgcggtcaaaatttttattttgtggtaatagaaacattattttgtgctctttttccctgctcttaatatatattatttaaagtagtttttctgatctacgcataatataaacaataaaaattagatgggtttactttttcccattttgtgtcatttatgttgttttatgacctcttttgctttagtcaaagctgtgcttttatgatgagtgctgaatttctgattatgatctcacaggagtttagttgtattatgtgatttcctttgaaaattaaagtgggatttcatgaataagcgtttttttataacaaatacctatgtcttttattagcactctctgaccttttcttatcagttagttaactctataatattcagctgctctgaaaatgaaactgttggagaagtaatagaagtgagatctcaactaagggataaacatatttcctttgcaaaaaaattgagaagatattttgaagtagttttaattttacctccaattgttttacatttgaaatattatcaattgattaatggataaacaaaatgtggtatatacatcaattgaatattatttagtcacaaaaataatcaagttctaaaatatgctatattttatatattacatgtctttatacatattgtgtatataacatgtcttttctttgaaacaagtgttgacctttctttaaggattaatgattgaaaagtggtagattgttaagtagattgatcattggtagcatttctttattaagatgattttttccataacattattaagaacttaaggtcctttggcttatttttttgaatgacagaatactctttttctgtatctagagtataatatttgtttagaagatgtatgataagctacatttaacatgaatttgataacatatgaaatgcctttgtaagattactgtgtgtgacaggatttctgtgaggacttaccccgttaaataatttgctttcatttgtttgatgagaatgtatcagaaaattctaaagtaaatattcttttacttaaaacttagcttataattagaaatatttgtaaaagccttcaaataaagacatatgttaatatttcaaatattataatgtcaatttagtggatgcaaaatatttcattgtggttttaatttgcacttttcctagatttcgaataagattagacattttcatatataattatagaaaattaatcttttatcttctttgttattcatttcctttaccagtattccctatgtctcttcatgattcccacccctagtcaacccataattcactttttggctttatgaattgcttattctaaatatttcacataagtgagatcatacaatatttgtctttttgtatttggtccattttgcttagcataatgttttcagtgtgcatccatgttatagcatattttagaactccgttcttttttacagctaaatagtattccattagatgtatatacattttgcttctccattcatcagttgatatacatttgtgttgtttctatcttttggctattatgaataaagctgccatgaatgttcatgtgctaggttatatgtggacatatgtttttatttctgttcagtagatacctaggagttaatttgctgggtcctatgtttatttgagaaactattgatgtttttcaaagtgactccagcattttacatcctaccaaccatatttaagagttccattttttccacatccttaccaactcttgttttgtatgtctttttgattctgaccctcctagtgggtgtgaaatggcttatcaattttaaatttgcatttttgggatgactagtgatgctgaatatcttttcatatgcttgttgtctattttcatgtgcttattagctatttattgatatatattctttgaagaaatatctttagatcctttgcccatttaataattgtgatatgtgtcttattattgatttgtaggagtttttttttaatattctggatactagtcccttaatagacggatgattaacaaatatatttctccattctttggatcacattaatttgtatttccttgatgacaataaagttgaacatatatttattttcctttgggatatcttcttttgttaaatacctctttagagtgccaattttcatttgggttgtctgtcattttgttactgatttgtggaaatcatatatgtattttggatgtgattacttcattggatatacactgcaaattatctcttcttctttggtgtgacttttcactctcttaatggtgatttttgataaacaagttactaattttaatataggttaaaattttcagtttcttttatgactagcccattttagacccatatcctgaagccataagattattctgtttccttcttaaaattttgttttatctttcatatttagatctataatctatctggaattgaattttgtatatggtatgaggtataagggtcaaggttctttttttctataatctatctagaattgaattttgtatatggtatgaggtataagggtcaaggttctttttttcccccatgtatgtcatctagctggcccagtaccattttttgaaaagatgatttcccactgcattgcagtctaatctttgccataaatcagatgaccatgtatgactgggattttttttgtgtgtttcagacagtacaacagtattttaatttgtatagctttttagtatggcctgatatttaagagtatgtcatctagctttactgttgttcttgaagattgccttggctgtttttgggtctttccatttccatatatatatatcagcttatcaacttccaccaaaaaacatgaggatttttattgtattatattgacatctttcctatattgaatctttcaggttatatacttggtatattcttttactaattgagattttcttttgtacttttctgtatggaacagtttctgtctttttgatggatttatttccaggtatttgatattatttgatgcccttaaaattttaatattttacacttgatcttacccaaaaggccaagaagcaattaaaagttttgatttttgttactggtacatagaattataattgatatttatgttgaacttttatataccagtctttctgttcctctattaaatctagtcatttgtagattttttcagaaaaatttttgtagacaataataacattggagaatgatagttttgtttttttcctttctaattttagggtttttttccttgccttgttatgccacctaaaaagtgccagtacagtgttgggataaaagttgtgatagtggccatccctgtcttattcctgatctcatgggcaatgcttttaataattacactaagtatgatatttttaatagattactttgtgtggattttttagttaaattaaggaattatctatttctggtttcctaagagttttctttattataaacaggattttatataacatcttttctgtagtacttgagatgattaagatgtttctttatttttcttaatttagtcaattacatggattatttttcagattttaaaccttccttatattcctggactctcgtttactcctaaacctactcctattccaacctggttttcattcttacatgtcctttaagatggctcatgtctttgtcaccagtggccttcataatctgtcctgtgattatttctcagttcttatcttatttgacctgtgaatatttcagttgaacattctttccttcttgaaatgctttcttgcattgtgttttgtgatggcttgctttttttttttcttacttattctctctcattagttctgcttcatctttctaaattctgatgactgttctgtcccagtgattaatcctggaaagcgtttcacttttccatctacacagtaccttactctaattgagattatccacttctacagtttccatgatcctgtaaatactaattactctcaattgtttctcctatttttagttccacttggatttctggtaatcttcttgactaaattatccaaactgatttttctcttaatttttcatccttcagagttctttatcttatttagtggcattactattcaacaagtagttgaaaccaaaaagttaattctttttgactctactttttttgcgctctagatccaaactcaggaaattatgttgtcttactgtcaaaatgtatccagaatcaattactacttcctctttacttctcagctccttaccatgtcagttgatatcatcttagttcaaaccatgatcatccttcaccattggttacctacaatccatttttcacttgcagttagactagttatcctaaaatgtgccaaatcttattcaagtcttcatccttctcataatgaagtcataagccttatacctcacttcatctcttcccactcttcttgctttctctattttaggcaaaggtctttttgccttttccttaagaactaaaatggtaaacatttacccaaggacttttgcatttacttcccccattgtttccatcactctttcttcagatactcacagactttgattctatgcttcattcaggattttgcttatatgatgccttatcacagaaatattctccgatcattctaaataaattagtattccttccataaccatcagtgtttacctatgctgctaattttgcagcaccattctggcatgttttatattttttactaattttctgcctccttctgctagaatgtaggctttatgaaagcaggggcaatgtatatatatttttgtctccccttattgctgtatcttcagcacctagaacagtgcttagctcagtaaatggttgttgaattgagtatatgaaaagtccttgtatgcttgtctgattacctgcaaagagtaacttttttacctttcttggaggagtgctcacattttgttatttttaaataatcactggcaaggttagtattaatagtataggtaatagaagtttcattttttaatttcttaactaataacaggttactggttaactgccacttagcttttatatctccttgtcatagaagatgtcttaggaagatagtatatgagaggcctttttattaataacaattttactgttccacgaaaaaatttttaggtgtttttgttctgttttgccaaaatgtgatcttgtgggaaacttagaggttatccagcgtattcaataggatatttttgattgtggttagtagaaaatttgattcaaagtatcttaaacattaggaaaatatactaactgatgtaactgaaagcctagtgttagatggcatatcagttatattcttggcagggaacagatggcatactcaacctaggtttttgagaagactttaatgcaagggtatttaaaaagttgtaagcagggagcttggcaagatttgaagagatgagggaaataagtgtttagcataacccaaagagaaagttattgtagctattaggagaagggtacctgatgggagcgtggtcttcaagaaaggagtatagtgtaagtgtactgaaggggtaaaatctggaaaatatatacccaacttcattttctttctgtcctttaatttcttgctaatgtcttcaattagtcaaacccaactggaaaccagtaggcaagggagcatcccaagcataaaaataggacagggaaggttggaaaggcagcaaaaggttggaaaagcagcaaacagtaagttgtgtttcagggctgggttatctaagtctcaataatgtcatcagagacccaggttttatctatatctctgctgtaccagctacagtgttgattttatgctaaagctgatactctttgaggtcacaaggctgccagagagaattggcgctatagaccttcacatccaggtgaagaaagcgagctcatttctgtcaattactgagcaagattcttctctccaatttgattggttagcttagagcttggctagcctacctttgaaccagttgttgctatgagaatgctaaactttgatactgaatctctgagctgatcattgcctgccaccctcccctccactccctaccaaaacaacaacacatgattaatctggttggattaggctatttggagcacaaccttggagtcctgggaggagcagaatggataatagactataaggtacctctacaattacaatagttttacacaatttattgaatatatactcatacacattatatgtatatgtgtgtgtgtatattatgctttctacaataaaaatgaacatttctgataacctgttctattatgggctaatctaaatgttggaacaatctctctttattgaatagaagtttctctttgtaacctctagtgctcctatttggtttagttaattctggagtggatgctataacgcaactatttgtataacttcttagatattatttccaaatatggttagccatgtcacatatagtacttcttaaaaattatgtattctgccaccacatgaaagtaatatatagatcaaattccagagcttacattttctgtaagatttaaattgtatttccatctaaaggttacagatttataactataaattatccaagtatagatctctttctaaaatagctttacttgagaaaatgaaaacaaataccaaaatataaaaatattttaaaaccgttaatcaaaggaaatacatttaaaagcagagtcagagatcttctttcttcttttcccaggctgtgttttttcctacctattctattcttactgtttttgaatttgacattaattcagttaaacatttcctgagaaattagggtagggatcaggaggataaaagatgaataagataatatcctttcttatattaggaaagagatttcttttttacactaacaataatacaaggaggaaagataagtactactaagaggtaaaggtaacatgctgttgaagagaatattcatttatgcatttatatactatttacaatccaaaattgtaggattttgagtaggtcaataaaaagacacaattttagaaaaatattttccaaagaataattttagaatgcaaatctgctacccaacagcattaattggtatgcgaaaacaatggccccctccgccttttttttttaaagtaatgtagaaggccttgtgatgcttctagtataccttttaatatcatggtccaagttccaaacttgtttctatattatgaattcatcaagtggatatgtttataatggtcagcctgattttataatatgggttaatgttcttcatgaggacatgatgaataatttttatgagctacagtctggtcacctagcatgtttatctagtaacaggatctgactgtattctattttagagttttaagtgtaagagtagaatgtatcagatcatgttcttgaaatcattactactgaataaaaatagaatgtataagataagctatgtgaaattataattagtgaaggagctggctacagttttaaataactagtgatctcttattttaatttcatccctttacaaatattttttaaagtactatattattttcattgatattcctttaaatatgattacccgatctttactttttaaactcaaatacttgttttggttcccccccctttattaactcagctatttatttagatcatttccaccatcttctgtaaaattttcattgaaaattatgtactaaggtttggtttgaattttgtaggctattgcttatgtagtaagcaccattggtaattttgtcagacacataattctattatattaatactaaatcatttttaaccttataataatttgaaccaattaagtggcccccttcttagtaaaacctgttaaccatccttctgcaaatgttttatctgccccatagtttcttccatgaacttagtaacctctaacattttacatattttacctttttattttattaactatgtgttcctgccttatcatctcttagaatatgttctgtgaggaagagtttttttcttcaattttgctagctgcttttttgacagtgccagggagcatatttgactaatagtgagtaatcaacatgtatattttctaaatgactaaaagtcttgagttctacctttaaggtaaaggaaatgtatgcaagggtgttacaaactgggggagcaacatggtaaagcagggaagcaaacgtgtcctgtgggtgaaattggcccacagtaatattctgtaggactcagcaaagaggttagttttggtcctcaccaatctttattgtctcctactctagtttacacattgttgttagttatttgcaatcattttagttcgtgaccgtttatgtagaagtgtgaaaattcatgaagtgcttaagtcaaatatattgagttatccttattatgagcatgaaaaatgtagctaaatcatatgggaggtaaaattggtaagacaatttcatcccttttaaacttagattgttttaaactgatattcagacttcagttagtgaagaatagcgaggaaagatgtgttgtgtgatgtgtgcttcaggattgagtgataggtgattctttaccctatgactgaaaggatagtgatactacaaaatagtatcactagatgaggaagaaaagatttatgtaggaagataaattttttgatatttgagtttgaattatcagcttttatgaagagcatttttttaatattatagcatttttatctgaaattgtattctagtatagcattgtccaattaaattacaattcaagcctcaggtgcaatttaatattttctagtaaaaaaatacaggtggtattaattttaataacgtatttagcctagtattttattttgataatatgcaatatattatttcaacatctattcaataagaaaatatgatttttaaaaatattctgagctggaaaaacccagttttttcatacttatgacacatctcactttcaattgcaatattccagcagctcaatggccacatagggcttctggctactgtatgagatggtgcagctttaaggtttggtttcaattttggagagtctgttgtttaaataccattggtaataggtacatggtgatagtagttgaaaattcttgaagcgagtgttcagcatagacatagtgttatatgaagctgtgaaagcatactatatcatccaaggatagagtatttatggagaagagaaggccaaggaaataatattttaagcagtattttacatatttttaagcagtatttttacatattttaaacactatcactttttatttctatgtctaagatctcttcttgtatgtcaatttctacaaaaaatgaaatgaagccattatttataacatttcatttctttagctaatagtagaattatttaacttgaattatttatctgtaattgtcttagatcaggcttcaaataacaagctatcactcaaagaaatagctgaaattttagatctcttaaagttatattttaatagcaaagaaaacaaatgtttatttcatatttattagggatagcatatgaaaaattcatgtgtccttatgctaaatcagaaattatacaatttgatattctggatgtttcaagctagaatttctgttttctttcttagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggtatgaattttatacttattcagtttgatttagtgtaatgttatacattatagttgctggatctatagtattcagtggaaaacatttgaacattttagcttattttatagttaatctgtggcaattgtgttaggcagtatcaggagatcaaaatatttataagcagtaaaataaatgaaacaataggtaaaaaagaatctttgtgtaacactgcattctaacatctttagatgtgatacttacttttcaatgaagaaaatttgctataccaatttttgaaagactaggaaagagaacagataactaattgtattatgactgtaatcattttgctggaaaattgctttcattttgaaggtagaatttatatcatgacatgtaaataatactaatttaaaaataaatatatacatgaattaaatattttccagataataacagaaaattcttattgttttatatacaaggatttagtcctagttgaaatcaataatgagggatattttgattttgagctatcttttatagtttaaaaatatctcaccgagttattaattattgcctaagcccaaatctgaattttgacaactcttttttttttttttttttaaatgttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaaagaagacatttatgcagccaaaaaacacatgaagaaatgctcatcatctttgacaactcttttaaccaaggtgtctgacatgccatctctatgctcacatggtcagattgtgaaagcgaactatatgttatggccataggtgaggagaatttgaaattgcatgaacttttaggatatatgacaaaaatatgtatgttttcagatatgctttagctgactgatgttctattgctatgaagaaatttttacattgaaagctactgaaatgtactttaagagctttagttgacttttaaaatattttaatctttttatcagattaatttcaataaattattaaatcattttaaaattatttaattgccacagctgttggactacctctattatgagtttattagaatatgttaattgcagattatatattttttaaatataaataatattgaagaagaaagttatttttaacctcataataaatggtcatttcttggtctttactaattcacatttaaattaaaactgaatgtatataatatgagcacttgaggcattttaaattcattttaatgatctgttaatattctgtattaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattaggtatgtataccacttccactgtatttacatttgcctatgattattctgtattctgagtactgttaaagtgagcagtgtacatgactatgaaatcactgaaatgttttctttcttatatagcaaactggcatattgagaattgtttgtggtaaagaagtttagggcttttcaatattaaattatttcggaataaaatcagttaaaaagcaacaatagtctttattttagcctgtatgcttttttttcattcaggaagatacattcataatattaaaaacagataaatgatattggttataactggtgtgttctagtacatcagttgctttcaacattttcagattgttaattttttatattttattccaaatttatcctttgttctgactataatggaaactaattcttcactgtgattttttttttgaaaatatagccagtttttctaattatacaaaaaatatagaaaataaaataatacagaagaaaaaatatatttatgacccaaaccccaagaataattactgatatgattttggcatgttttcttccagtgtttctcattgcatacatatataaaaatatttaaactttttaattatagattgagattttctcaatttttctatgttgttcttttctcagctcaatgtagtaatgtaaggggatgtaccatttacatcgtttctaaagttttgattctgtaaatgttagagcattctctcatttatatatgtgtttacctccatctttgatttgtttaaaattactgagaaaggggctaatgacaaatattttaaatttttttcaggaatgtcatattattttacagttttaccagtatatgttagagtacttccttttgcgtgctcacaatagcattgaatattatagttttataataatcccgttgataaggaaaaataacactttcctttttttttttttttttttttgagacggagtcttgctctgtcacccaggctggagtgcagtggtgctatctcagctcactgcaagctctgcctcccgggttcatgccgttctcctgcctcagcctcccgagtagctgggactacaggcgcctgccagcacgcccggctaatttttttatatttttagtggagacagggtttcaccgtgttagccaggatggtgttgatctcctgacctcgtgatacacctgactcggcctcccattttactattctaatatttatataagcttacttttatttctttttattaatggggctttagaagttatttatactcagatctgttgttttgtccttttatggcttcttccattgcttttaagttagtaatgcctaaaatttattggatttttctgccaagcactctacatgttaatttgtttaataatacatataatgtaattatagataaatagacatattcatatacatacataagactgcatctatatataactttgtttttgatattatcctcattttaaagattaggaaactggaagttggtacaaaccgaacagcaccaaaatttgaatcatatccatctgactcagagacctagttcttaaatgctacactatgatagagttttctctagtctaaacaaatcatatattcacacataataatttctgccttaaaatattaatttctaatttacagaaaagttacaaagttgcaagcattgcacaaagaattctcatatgtccctcaccagattctcaatattttacatcttatcactttagcctttactattctctcatgctctctttttatgtatatataaacacacctacagatatatacacattttttttctgattcgattggtaataaattgtagacatgatactctgtcacctctaaatactttattgtgtatttcctgaaaggtaaaggcactttgttaaataaccagaggacacccattaatatcaggaagttagcattaatatgatactatcatctaattcagagaccccattcaaatttcactaattacactaataatgtcctttctaggaaaaagaaaattattttgccctaagtctgttgaggatcgtatgttgtgcttagttgcattcttacttttaatgttcttcaatgtaggatagttttttagtatttccttgtctttcaggaccttgacatttttgaataatacagaccagttatttttttgaataaccttaaatttgaattttctgtttgttcatgatgattcaggttttttcatttttacaagaaataacacagaagtcatattgtatctgtctccttgtatcatgtcaaggaggcacatgatgttgagttgtccttttacaagtgatgttaactttaaacatttgattaaggtattatcttccaggtttcttcattacaaaatcactcctttctctttggtaattaataagtatttggtggagaaatacattgaaactatataaatagcctgttcttcaacaaagtttcacctacttgttttagtttgttgatgattcttactagattatctttattgtgatgactgacaaatgatattttctaagacattaattaagttggcatatctactgtaaggaagaacttgttttactcctccactcatctatctatctatctatctatctatctatctatctatctatctgtctgtctatcatcttttatatcagtatggactcatgtattcaatgtgttatatcaacagttagcatactttctttgcaaagggccagatagtgttttaggcttacggagccataaggtctctgttgcacatagtcagctctgacattgtattgcagaaataaccacagacagtatgtaaacgaataggtgtggcttgttctagtgaaacttacaaaaacaagtggcttcatggatttagtcctagggctgtggtttgtctgtctcctgggttgtatcattatttcgatgctcaagatttggccagtaggacccttcacatggattatgggacaaatgcccataagtttttaatactattttactttctgaaacaagatgtttctgacttgtcctacactttccttatcccgccctgaaattagccatttttccaggaagccctggtttgtttggtggatatggtttttagaaaccaagatgtggatgtgaggtgtgcttcttggtttttgaatgtcattgcttctacgtacttttagtggacagatctaggaaatgatgtttatatctatgtatataggtacatctcaactgatttatctgtattaaaaccatgagttcacagcagtaccttcaattccagtccaaagccacatggctcaacctagcctcaaactttttaaatttgccgctttcttcttcaatagtgagaaatcttgctcctattgtctttaatatatttatatattttcttattctactttataaaaccagtgttttgatacacacggcataaccttctcagctttaacattgctagtcatctgtaaccataccctcagatttgactctgaatggcccttgttgtctcctcagccccagttgtttctttggcactgccaccctcctgacctctactgtctccttggccctgaccctgaaagtccttccagactcacttggctctggctctgtaagaccctgggtatcaccagggcctctgctccctccatagaacccttgcccctgaggcctcactggctctagctacatcaaagagaaggaaaggaagagtaccagtacatatattttaaatgaaaatgacaggaaagtggaatcagcatttattttcctttatcatttaaattattattttactttaacattttaatactttgaaattaattttgttatatagtagaatgtaaggttctgacttgaagtatatacttttctaaatgacagcatttttcaataccattttaaacaaatgctttcttttaaggacactctaaagataatttgcactacactagctttcgtagaactattcatgtgtaggcactcgccttgagaagtaggatatttttgctttaactgtaacttaacacttttgtctcttaaattattattatatatagttaagtgtaaaagcattgagatatattaaaaatattataggtcaggtaatacatatttatggtagcaagtgaaatcatacaaaggtttataaataaaatgttactactctcccaggtagccaatgttaccagtcttgtatatctttctactgctttttctctgctcatacaaacatgagcttactcatgcatacatataggtgtttcaaagctttattttgaatacatcatgaacacaaagtggtataattacatatatcgatgtaatatataaacaagttataattataaatataaatataaaatgaaccttatttaaacatcactaagcctaagaaacagaatattaccaatgagcctgaatattctcatgcgtgttcacacctcttttctactccctgtcatagaaataactccgtcccaaattttacgttatttcttttctttacttgggtgcttattattttttactatgttttactcttgctatttatgtatgtattactaatttattgtttagcttctatagtttacataaatagtattatttggggatttgtttcttcattcaattttatattagataaatccgtttgtattttattttgcagaaatggatttatatcatgcacaaagcacacaaatatgtatatatttctttgcaacatgctgtttatattatgcagtatacaataaaaataattattgctaacatttgagtgcttgtgattaaaatgggcctggtactagtctaattcctttacatatgttgatctatttaatcctcacaagatgtcctatgacaagcagtattattattcttaccctaacaataaagaagaaaacaaacctaaggcacagagatgttataaaactggtccaattttattaattggtagcagaaatagaagaataaggaaattattactaagacggtatctgtctgttcttgaatggagtgtgggtgtggtcaggaaaagcaatgtggcacagagctgaggtctggagcatggtgagggctttggcatgcagggcaggatgggaccacaatcagttgttagatattcaggaattttatgagcaccttgttaaatcattggtagcttgaacttgaaatcagattattattaatatgatagaaatcagaagtacataaatgctcaaaatcaggacctcatccctccactctgcagataattcctttaccagcataccaatggttgacgggtttccctgtcaggctactgtcagtgttcaatttcttgaccaaagaagtgtttatacaggtgttcatttcatgataattcgttaagttgttcatgtatgttttctgtacattggcaatattttacaatgaaaagtttttttaaagtaataccaagtgtcaataggaggggaagagtactttgtgcatcttggtggcagtggggcaataaaaggtggagagcagtctgggaaatagggaagatatttcttttattataataggcgggatggattttttggataataacttgcttgcagatataataatcttcatgtaaatattaagtgaataagcagatgctatacattatacatgaagggattatgcttttaaaacttgtaaagcagtagataaatactggttgctacaagaaaggcttaatgttacaggatttttatgaatctagcttcattttttaaaagtattctgtattgtatattatgcatattagaatatattatattttcatttttattagtaattaaatattttgaaattactttaaaatttgtacgttatgatagaactgatatgcacattttaatattttatactcattttcacttattgacgcagcataaatgcccactataatatgtattttctgtatacaagtgacatagaagaaataggctgcaaaacaaataattgcaataaaacagagtgtcattttttctgtgctttgttaaataatgtgtggggtgaaaatggagagagtccttaaatgaagacaagtttaattgagagtggaagacatattgggaaacctattaatgtaataaaaacagaaaaaaaagcattaatataaatacttggggattatacatttataaatggatattaatatataacaactttttaaaaagttcttttttccacaaaatcagacattcagtaaataatttgaaattgtcaaaaatttgaaagttaatttttggatactcatatattattaaaattttatagcattaatataaatattgtaattttaataaagataattattcaagaatgccatagtatcccaagataattgcatttagctaatttaatatcttgtattttttattttacttttttttctgttttgttctagatggtccccggccatcacaaaaagaaattatatcactgagggcatttatgctactttttctgaaacagctgatactaaaggtaaaataattttatataatttaaaataatagtatattaggtagaaaggaatttctggcatgttttaaaattattaaattagtaatagctacctttaattcatgaattgctttcaaaattctccacatcttagtattcacttttattgaacttaactaacttctgattaaatgctctctgaaatcttccctattaagggatgtgacagaaatggacaaggaacatatgaataagaattgagcccttattcttatagtaattgaccattattcgagaaaatgatctgtgtgccagtttaataaggcttacataatgtattttattgtagtagaattttttaaatgttaagatgaaaccaaagtgaaaataaatataaattgtgagatagtacacaaaaattgatactgtatagtcttgcatttatattgttttaaggaaagagtaagtgattagaaaatagtcataagaatacttagatggtcaaaatatgctaactttttatagtgaatgtcaatcaaatactaatgacttttaaaaattgatataattttctaaatatttacttaacttgaaataatacagtctataaattgtgaaatgtgtggggattttaattaaaatatcactacattaaactaactcttattttcttttacaatgattattttgacatcttttttaaattaaaattttaattttagatgtaaagtaataaaatattttttaaaaattaggatcgaggggtcaaggaagatgaacttcagagtatattaaattacctacttacgatgcatgaggtaggacatgttatgggccttttattttaattatttaagccaatctttagagtaaaattttaaatcaacattggtgatttatgcaggatgaaaatattcatgatgtgctacagttactggtggctttaatgtcggaacacccagcctcaatgataccagcatttgatcaaagaaatggaataaggtatgattataatattagtattactattagactttaatggagcacagttgttcctcctagaataactgctattctatgaatatttgaataaatatagcaaagtcttgcacataagagaataaatggagaatgctgctattgatcctcgaatactcaggaaactgatgaagtgtataaacagtagtctcaggaatcaagaagagtaattaaattgtatttgctatagtaaggacattacaaattgtgaatagagcatttttttttccaagaagacacgaaaaagcaaggcacattttaccaaaagaggatacaatgaaattttatgatatgaggcccgagagagattatagccagatttggaaggttcatagaatggtaataactttagtggtttttttctttcagctggtgatgaaaattaaagaattttgagtaggggaaatgttgtgctcagattgctattttgttagatttacaatcaccagtgtgaaacatgagttgaaggacaaactgatgtagcaatatcagcagggagattattttattcatcagtattaaagatgatgacttgagacagtggcagtgcaatggaaataatagagatgaaagatgttttggaataacaggccaaagccaaaagaaactgaaaaccaacttttgttgtggcaattgaaatgtaacttggtagataggtgaaatataatttcttaattagtatttttatgaacttaaccctatcatttagctttttaaggaattcttcgtttttatttttctggagttttaattagtgggatgagcaggatatcgaggttatgccatgtataactcagtgaatttccacagttttattgtgaaaaagagtttggaaataatatatcagtgactgtcaagggcttttttaagtgccttttttacttggccatttatatcaatgaataacaactttctagacttgaagaactccttttcaaattagagaagcaatcactatctctttatgcatatctcagttgtgatatgagtattacctttgagtttataattcatagggctgccaatctatttgaagaagattatacatttagtgattaacaactgttacaatttttttttctttttgagacagagtcttgctctgtcgcccaggctggagtgcagtgtgcagtggcgcaatctcagctcactgcaagctccacttcccgggttcacgccattctcctgcctcagcctcctgagtagctgggactacaggcgcctgccacaatgcccggctaattttttgtattttgttttagtagagacggggtttcaccatgttagccaggatggtctccatctcctgaccttgtgatctgcctgccttggtctcccaaagtgctgggattacaggcgtaagccaccgtgcccagcctataattttttactctagagtttgagctatatgaaactgttgatacttaactgattttacaaaataatgacaatttcatatagctcaatctaataatgtagtacaattactctcactcttctgaacttatatttagattgaataattagtgtccttgtccttagattttgctttgtttattatattacttgataaatttagtgaatcagttgaagatatccacattactcttgtagaagataccaaacttagattgtctagtatgatgaaatgcagaaatataattgtattattttgacacatcggaaatatgatcctacaattgagagtgctatttggtaagacctttaggatttacatgtattttaaatgtatggtacgaaagaactaattaagcacaacagattaaaaggccttgtgctcatggctgaccatgagcagaacatgtcagattgttacccgtatgttaaaaacaatcacacagattaaaaaacggcctttccttgacacttcagcttttctacttcaaaaatgtggagaaagctggttcagaatagtataaaagatgaaaaaaataggcttattagatagaaaatattgaaagtggctaacgaatttatatgtctgttttctagaaaatagccattaaaggctaacagttgtatatgaagtattttgggaggaaaattctagtctgttgtaattcatacagttgaattcagtataacagttgaacaaaaagaatgaactcagtttaattctgatggtatgctaattgggcttaaggaagcccttgtaataacagaacactgaagtaagcagctaaaaatttgatgtttttatatctgggaaatttcaaagaaaggaatagacagctacctctcttatatagcttagaccatttgcttactgaatatagtgagcttaagcagatgtattaggattattgttatttagtaataatgtatattacaagtaaacattaattaacaaagtaaatttcttattcatactgtatcacatccctaggtatgtagatgtgtgatggacctagacattttcatgtttcaacattagtcataatttctcttgacccagggtggggtctaataccttttttcctgctactcgaagttattcctagacaatagaaactctgtgagaacttccagttctatatttgagtgtagccacatttttagactgtgagggttttttttaattttttaatttttttttagagtctcgctctgttgtctaggctggagtgcagtggtaccatctcggcttatggcagcctccacctcctgggttcaagcaattctcatgccttagcttcccaagtaactggcactacaggcatgtgccaccacacctgactaattttttttgtattttggtagagacagggtttcaccatgttgcccaggctgctcttgaacttctgcgctcaggcagtctgcccaccttgacctcctaaagtgttaggattacaggcatgagccaccatgcctggcccagactgtgagcttttactttggttctcaagactatttttgctgtttagtgttgcttcttatgatttcttgaatgtgttttttttttttgacatgtctgactttgctattctcagacttgtcttttttcattactgatcttggttcctaaaagttttgaaaatggatttcagtgtaaacccatacatatttatgaatgtgggatttgaaaaaaaaatcttccaaaggaaataatcacttttctcatagtttattctttaatagatgaaatgcaaagcataaaagaaaaaaagagaaaaagaagcagtatcaataacatcttttcttttttaatagtataagctcttggcaaaactaaaaataatgactttaagctatttgttcccctttgtatcactgaaactatgaaaattatattgcatcttttactagattctcttgttcagctgagtactttacctcaaaatatgccatggcattttattttttcagaaacatatttaataaaataaagcacactataatgttacagcccctaaagaaccttcttgtattctagaatttgttgccagtgtatatagttgtcattgtcccttctactttatggaaacaaattactttttttaatagaaaaaatggaataaaatttctaaacacttaaacaaatgttataatgaatatggccctacttttatatagtacttgaagtgattgtataggttaagttgtatattagtggaggctattttgctccaagtaacagaaaacctctaaagcttttaaagtaaaaactgaacaatatacttgttaaaaaaaaccttaccaaaggattataaatcatgctgctgtaaagacacatgcacacgtatgtttattgtggcactattcacaatagcaaagacttggaaccaaaccaaatgtccaacaatgacagactggattaagaaaatgtggcacatatacaccatggaatactatgcagccataaaaaatgatgagttcatgtcctttgtagggacatggatgaagctggaaaccatcattctcagcaaactaccgctaggacaaaaaaccaaataccacatgttctcactcataggtgggaattgaacaatgagaacacttggacacaggaaggggaacatcacacaccggggcctgttgtggggtcgggggaggggggagggatagcattaggagatatacctaatgtaaatgatgagttaaggggtgcagcacaccaacatggcacatgtatacatacgtaacaaacctgcacgttgtacacatgtaccctagaacttaaagtatataaaacaaaatcttagagtaggaaccaggaattgtagggctgttaggaaacaagtttgctttatctactgctttctgtaagctgtttaatccttccttctgtatgttgactagcctttctgaacagaaacaaaacgttactgttctagtttctattttaaacagtttttgaattcaagagcccagcaaagaggagatattgtttcttagacctcattccaaattctcaaaaaggagaaagaactaggcaggtgcctacctatcatctaattagttataccaagaaaacagggttagggtgcaggtggctcacgcctgtaattccagcactttgggaggccgaggtggtcgaatcgtttaaactcaggagttccagactagcctggtcaatttggcaaaacctcacctctatattaaaattaagaaaaaagattttaaaaaagaaaatagggttatcaagtttaaatattggggccaattcttagagagaagacatgtggcctaactaagcatgtgttagtatgttgggaggcagtacttatgaacaccagtcacattgcccttttgagtgtatggctgaaggactgtttaaagaaaaattattaaagcatgctagtttttaatttttccaaagaattataatcctgagaagaaaatcttcagagttttatatttcacatatgtataatttatctgtaaagcatgtagtgtgtttttgtttttaatattagtaagtttttaaaagataatttatatattttgtagggtgatctacaaattattggcttctaaaagtgaaagtatttgggttcaagctttgaaggttctgggatactttctgaagcatttaggtcacaagtaagttgatatttgtcataatgcattctagaaataactattgagattatgtttttatgagttttctatgtaatgtagcatgaaatttgacttgaaaaatctaacagcggaaaataatagctttctgtggtagaaattgtaaaaatgttttataaaatatattttattaatagtagattgtgaaacaaaattacaatttaagtaattagtttatttctatattcttcctgaaaagaaagcattatctattctgaagatgtaataaaatattttgtcaagataaaatgatgcacatataggtatgatttcaaggaaagctttcttgacaaggaaatactgtgtatatgctgaggtctttctcagagttgatcttatgcttacatgctgagtcagtatttgttattagtttctaacagtagggcttattgattaattttgtgacttaaagatgctagaatacctcatttctttccccaaatcaagaatttgaatactttctaagaacactttttgtgtaagaaactgctgctggcttaatgattgcaattcatgctacactatccagtgtaggaatgttttaagagtatattttccttacaaatgaagccaaggaagtagtgcaactataatttaaatgttactagatgaggttcctatcagaacctcattttcgcccttgtttttttttttttttggtgcttacttaaatttgcaaagcgcttatttgtaataatcatgaaaactgcacaaaattcagacaagacatgtctaacaagctgtatagcctagaagtttaaatatttttaaaatttcggtaccaaagaataattaagtaagggagactagatatactatggatatggatataaggaatagttcaaacaaagccaggattgtagaaaaggatatatatgtgtgtgtatacacacacacacacacacacacggatatatatacacacatatatggatatatatatacatacacatatatatggatatatatatacatacacatatatggatatatatacacatacatatatatggatatacatacacacacatatatggatatacacacacatatatgtggatatatatacacatgtatggatatatatacacacatatatgtatggatatatatacacatatgtatggatatatacacacatatgtatggatatatatacacacatatatggatatatacacacatatatggatatatatacacacacatatggatatatatatatatggtatatggaactgtaagtacacttggtgacagagtgctgggagtgaagaagcatatgccctttttatattaagagataaagatcacttctttaacttcagttaattaaaataaactgactggagaaagttaaaggattgtagcccaagatgcagcctcctaaaaatgtcaagaaagcacattaaaaaatttacgaaaagatgaaaactcagttaatacaaaattaaaaataacaagcaggcagtttcctgtataaagatgctgtttgagatagcctattttccccctttttcctgtaaaatgtataaatgatacaacaagaagtaaaaaatgtactctctatcacaaatgttatcacaagtagaagatagatgcaaaatatgaactccagaatacgggtatcagctgcttaaagttgctcaggttgggtaaaagctgttaaggctaaagagaagataaaatgcaaagagaatggtgagagagttcacttatagcaaataggaagtgtcagtgaaagtagagtttctgaagatgagaggcacaccttaaattacaaaaatagatcatttgtttgaaataatagatatacatatatcatgcctgatagcagagttttatttgaatcagattggtttcagaaaaggagaagatatatcacaaagaattacacagatgagctgtatttgtggcaagcagtctatctctgtggctatagagaaaggaaagtttgtggattgtgaaagcaaaaggttacccttgtcccttcttttacacatatgcatggaagtgtcctgcagacagatggtccacgtaaattagactgcatcaaaagaattggcacatcatcagtgcaggtgaatcagataaaaaacatggaaaaaataagttaaagtaaccagtacatgaatagcacttagcagaaaaatattgctatggaatacatagcattttgatttaaaaatttcataagttaaaaataaacaaatgcatacatacatacatacatacatacatacatacatagcttctgagaaagaaccactaaacagaatttggagaagtaatccagctactccggaggcttacgcaggaggattgcttgagcccaggagtttgagtccagcctgggcaatgtagcaagatccatatctggaaaaaaaaaatgttgtaagaaatgttaacatagtgatatggtttggttgtgtccccccacctaaaatctcatcttgacttgtaatcctcacctgtaaagggtgggaccaggtagacataattggatcatgggggcagttcccccctgctgttcttgtaatagtgagtcgcatgagatctgatggttttgtaagcatttggcatttcccctgctttccctcactccatcttcctgccctgtgaagaaggtgcctacttctccttgccttccaccatgattgtaagtttcctgaggcctccccagcaatgcagaactgtgagtcaattaaacctctttcctttataaattagccaatcttgggtatttcttcatagcagcatgagaatggactaacacagatagcatggaagtatttaattatgagttaataaaatattggacaaatactggaagaaaataactatacacaaaaaaataaaattggaaattgctcaaaggcaaaactctggctagtagcatagtgaaatacacagaagataaaactgaaaaaaaagcaaatattatgaatagatgaaaatatgagtttaggattagaaagaaaatgagcgacatgggagaaaaacaaattaccataatggcataaattggccaggtgtgctggctcatgcctgtaatcccagcactttgggaggccgaggtgggcagatcaacgaggtcagcagtttgagaccagcctggccaacatggtgaaacaccatctctactaaaaatacaaaaattagccgggcatggtggcaggtgcctgtcatcccagctactcgggaggctgaggcaggagaattgcttcaacccgggaggtggaggttgcaatgagctgagaccgtgccattgcattccagagcctgggaagcagagggagactccatctcaaaaaaaaaaaaaaaagccaaaataataataatggcataaatggagttcccaaataagaaaagcagaataatggaacaaaacgaatatttaaatctataattcagtgaagtctagatgtaagattttgccatttttatttagaggacatattgtttgccagggaaaactgacctagaatggttagcatcaaagtgcattactggacttaaatagaagaatactttgtataatagtgcacaaataaggagaaaaatgagtctggctttagactctaaaataaccttcaatacaaaaaactataacaatcataattaaatgaagaaagtgggagccaaactatcctttaagtaaaaaggatgctgtcaaatattttttagccatacagcaaattatttctgtgactaaatcttgaggaaattgtggggaataaagtccaaccaactaggaatgactggagaaactattgctaaggaccgctggtgagcactgaataaatttaaccataaaactaagactaaaataaatgttcatattactgtgacagaccagaatttactttttatatatgctaataatgtacaaatgacacaaccgtaatgaattgggaggggactgagaaaagaaggaaagtagagcaagtgcaaagagtcagaatttccatgtaagtggacagatgaaatattacaaatataggcctattgactaaaatttgatgatgtagatgaaaggaaaaaattaagagtaaatatgctgacatttacatttctcatagtagggaaataccctttttaaacagatggaggattacttattctttcacagttaaaaagataagcagttctataaaattataaagctttcaaaatatttaagatctgtatggataaaactaagaacaatgtatgtaatggaactttgaaaaatccgtaaagatcagtaagcataacataaaatatgaaatatctaagaccagtcttactgtcattaaaaaaaaatgtaaaagcttttataaatcagctgttgtaagaaaaatatcacaattgatcacagtaatgaaacccagttctgtatgcaagaaacatacccaaaaaccaaagtggttttgaaaggttgaaagtaaaaggatgagtaaagttttattatataagtacaaagaaagcagaaaggggtggggggaggggggagggatggcattgggagatacacctaatgcgagatgatgagttagtgggtgcagcgcaccagcatggcacatgtatacctacgtaactaacctgcacattgtgcacatgtaccctaaaacttaaagtataataataaaaaaaaaaagcagaaagtaggaaccatgatcttagtattggacaaattagaatacaagccaaaaagcaataaccattagataaagaagaattctttataatgataaaatagaaacattcataaactagaaattacaggagaaacagacagtcacttaaagtttaagacttcagaacgaactttaattcacctatttcagtccacaaaaagccaagaagatctgaaatgggataaatctttttgaccttaaacttgtgggtcggtgtgtaggaagattggagtgctatcatgctggctccaggggctcatggtgcaggacttatagcttgctaagttttatactacaagtcagtaagtttaaagggtgctctgcctgacactacctgcagggatctcatcatttaaaattcacagccatgagatttgaccttgactctgtgggtagtgaaaaatagcaactcatctaaaggggcctactagccagaggcaggatgagagaatcatcaaactgtgtacccagtgaagtaaaactatggtggaggctgttgtggaacatctgaatttcatttatacaaagagattttgagattcaaatagagcaccaatgataatattctgctcttttagctgatgattttttaacccttcaccctacttaatggaagatctgaaagcatggatgaaaaatagagagtgagagaaaagataaagccttagaaaataagagacttcacatgtggctattaagagttcaaaaccaaacaccacatgttctcactcataggtaggaattgaacaatgtgtgtgatgtttctccttaaacatggggggaggggggagggatagcattaggagatatacctaatgttaaatgatgagttaatgggtgcagcacaccaacatggcatatgtatacatatgtaacaaacctgcatgttgtgtacatgtaccctaaaacttaaagtataataaaagaaagagttcttagaaaagtgatgagtgtaaaaactagatatcctgaaacactttgatctactaaaaacttagaaatgttagataaaaatatgtcaaaaatcctattaaatatataggtgtgcacacaaaagtaagggaaattctcacattccagaaatgaaaatcaagcatactaaaagaaacaagactttaaaaacaaggtaatttaaaaataaaccatgtaattaaaaaaaccctaagtaacttgtgaaaatgtaaaggtagtaattacaatgaacacctatatggaaacattaaacagattagacaaagcttcacaaagaattggtgaactgagggatagaactgaagaaattacctagaaatcaacaccaataagcaagattacaaccatgacattaagagagggggaaaaaaggaaaggtttcaaatatggctaataagagttatagaaaaggggaagagagaatgaggaagaggcaatattcaaagtaaattactaaagttttacaaaattgatgaaagacctgatttctcagattttggaagtaaaatgaattctaatcagggaaaattagtatgaaatcttaccacaaagtgaaactccagaacccaacaaggacaaggagaacaacaaagggaagttagccatataatattaaaagaaatataatattttagtaaagaaaacaatatagtacatatttgtgaataaacagcaaagtgcagtccatagattgacccaaatacttagtgattttagtgctaataaaggtgccatctctgatgaatagagtgatgatttacttttaaaaaatgctgtctgttaaaggaatggaacaaatgatatatttttatttgcatttaaaaagttaataggcagttataacaaatgtaccactctggtgagggatgttgacagtggggaaagctgtgtatatgtaggggtagggacatatgggactccctacattctgctcaattttactgagaacctaaaactgctctaaaaataaagtgcatttaaaagagaagggtaaagtggtagggaaatgagaaattataaagtgttcacttgtatgggggagctgtgagtgatgtggaaatgtaaaggatgagttgggtgtaaaatctctatgtatttttttatgtcatatatttttaactaggtaagtgtattacttattctaaaaattaaatgataaaagctgttattgcattatttaaatatataaaaataaactttaaggcaaaaaatttaatgaggatgaagggggccaccatgttatgaaaaaggtgtaattcactaggaatgtaaaagtttcaaatgcgtatacacttagtgtaggtgagtcgtagaaatctattattgactaaatttggaagagtattttacaaattttaacatatttttttccttagaagatcaattacaaaaaatctcaaaagtataatttgaaaaaaaaaatccattggcttgagtgtcatacacgttcttttcaaacacacaaaactatagaaattatttaaatgagaccataaagtaggctcaagaaatttaaacaaattgtcatacagatgactttctctgcaaacagtgcaattaaacaagaaatcaatgacaaaaattaaacttagaaaatagaaatatatatatcttctaaataactataacaagaagttattcattatacaaattataaaatgcagtaaaaatatttaaaattatgtatatttacacttgtgagatttggtctaaatgatactagagaaaattcatagttgtgaatatttatattaaaagcagaaaggtacttaggttttcatttttctaggttctcggttatgcttacctcattaattgtcagcctaagaaggcaaaagaaatagtaaagggcagaagtgaatgaaacagaaagcaagactattaaacagagtaacggcaaggccaaaaagccgtattattcacttataaaatacttttccatgactagctaaagaaggaatcggccactatttcacctaatataattcatacaaccatgataccaaaattggatatggattatccaattataagggaaatttatggtcaatctcccctatgaacatgagtctatcagttacttttttaaaagtatacagcataaccaaattgagggtagtcatagaatgtaaaggtggtttaacatcaggacaacatttcatctatttattaacaaaggagaatagctatataattatgatgtgtgcaaaaaattttcataaaattcagtatcatttgtcataaaaatttttagcaaaccacaaatagaaaataatttattcaatctggtaacatatgtctactgaaaactttccacagtcctatttagtaatgaaatgttagaagcatcccctttgaaaaactaacaattaacaaaagcctgctttcaccacccctgtttgacatcctattgggtaatattttggcatttatgaaacactccacttaaagctagcaaaattgttttcaagtgcatatgcagcattctccaaaaggtattatgagttggggtgtaaaatataaaacaagtctcagtaaatttaaaaactaataaatcaaacagagtgtattatctgaccacacagaattaaatttgaatgaaagaggtttgagaaattgcaaggtatttggaagtaaagaacgtaactaatccctgagtcaaaaaagaaatcataaagaacattagacgttagttagaactgaacgaaaacaaaaccacagcatagactacttactgaatgcttatgcattgctgatggaatgtagaatcctgcagccatgttccaaaaggatttcctaatttcttaaaaagtattaccatacttaggaatgtatccaaaagaagtgatagcatgttcatagccagacttcgcatgaatgttcttagtactattattactattattattattttgagatggagtctcactctattacccaggctggagtatagtggcacgatctccgctcactgaaacctctgcttcccatgttcaagcgattcttctgcctaagcctcccacgtagccaggactacaggtgcgtgccaccatgcccagctaatttttttgtatatttagtggagatggggtttcactatgttggtcaggctggtctcaaactcctgacctcagatgatctgcccaccccagcctcccaaagtgctgggattacaggcgtgagccactgtgcccagccagtactattattaatagtagctccaaactagaaacaatccaaaagtcaatcagctgatgaatggacaaacaaaatgttttatgtctatacaatggaatactattgtgcaattaaaagggaacaaactactgatgcatgctatgacataatgagtcctaaaactattatgctaagtgaaagaagccagatgcaaaaactatatactatatgcttctgtttatatgaaatgtccagaatgcaaataagtggttaaatggggctagcaatgggagtgggaattaactgccagtgggcacagggaactgttgaggatgataaaaatgacctataactatattgtaatgatagtggcatgactctatataatttttaaatgaattgttcatttgcaaaatgtgtgaattttgtggtatgtgtattatagttcagtaaagctagtaaaaatgtgaaaaacaaaatttaaaactctttggaagtgcaggataatagtattatcaccttggattaaggaaggatttctaaaacaataaatacacataaatcatacagcaaaaagataaatttgaccattagaataaaaagtactttaaaagataccataaaaagtgaaaagacaaggcacaaagtgaaagaagatatttgcagtttatctaggatacagtggatttgtatcctaaacatacgaaaaaaattgtgcaaataaattagaaaaagaaaatctgttaggatcatgaagaatataaacagacaattcactgaagaggaaacttgagttagcagtaaacatatgggtgatatactcaacttcagtagtaatcaagaaaatgcaaataaaacatgcatttaatgcttatcaggatggtaaattttaaaactgttgacagtatcaagtgttgacaaaggatgtacatcagtggtaactctccagtcactggtggaattatatactggtacaatcacattgaagaacaatttacaatttttgaaaaagataaatatacttatactctatgactaaggaactctctccttgacatagagaaagtctcatgtgtgtgaacagtgttcaatataacattgctaatattaaaagttggaaacaacatagaataggagaacagataaataaactaaggtatattcatacagttggatatattcagaactgaaaatgaatgaagtaaagttaccttgcacaaatcaaatataaagcagtaaagcaagttgcagaaggatacataataatgatgcaatttatttcaatttcaaaaatacgtgaagacaaaattgtaaattgcgtatgaatagatattcatctaattaaaagtataaagacgtacatgggaataaaaaacaaaatttatgattattggttatcccgaagtagagtgtgaagaatgggatgatggacaggtatccagaaatacttactaagttggttggtggttacatgaatatttattatgtttaaaaaaaaaactgagtaaagaaacgtatagcaaacaaaagtaaagcagaaatttattatcactgtaaaaatcagatgggatttgaaagcccaaaacacaatgagttgaacctgaggttaaaagttcaaaagagaatgtggaaggacattctgtattttgaaaggaataatttaagtagatggtgttaagttcataaacctgaaaacatcaaatagcgatgtcaaaaatataaagcaaaattcatttgagatgcaaaagaacttgataaaatagaataatggtagagatgacatatctctctcagaatgggaccaattgataatacatacagatatagagaaattgagtaatagattcataaaacttggctcaacagatatatgttcaatcttacatattttgaggatatacttcatggctaaagaagatatacaaaaaaaaaaggcgggtcatgtcctgggccatcaaatgaacaaagcagacagagtagacattttattggacactgcctcctgaccataatgtgataaaattggaaataaaaaaagaaattatgcaaaaatatcttacctacttagaaattaagaagcagtgtgaagatatcctttagagaatagaagaaaataaaagaaaaattagaaattatctaaaattttctgtacttcatagcaaaaactcttatcagaaataaatacctccattactgaaaaataaagattaaagttagaagaactttgtacttatattacaacattaattaaagtacaataaagtaaagtaggaagtacaaattagtaagggtggaggctaacatgaagaaacgagaaaaataaaaacgaactgttgaaaggatcactaactacaaagctgatgtttttaaggaaccaacaaaatgaatcaaactttcccatacctcattgagataaaatagaagcttttgaataaggaaagccttttcaaattataggacagattataataattataagaaaaatatagtacattataatgacatataagaggtccacttctaattcttggtaatatcattttctatatattttatgtgttcattcattcggtttttcccacatatacatagtacttttccatcaattaaaaaatgggaagggtaatatccagtcattaataaataaaataaaactacaggagcacaaaacatgccctgttttgcttcactagtaatcaccaacaaacctatcgtatgctcccttaatgcagaactgtgttttgatatagtttccgtgtaaacattggtgcatatagcattgagttcctataccttatcctccattctagcctcaaaataaaatgctggggagatgtaggttaaaatctgaaataatattacaactgtcctgatagattgaagaagatcagaaagtataataatatctactagttgagtaactactgcttcttactacagaataatatatacaatgatagccaaaggaaattggaaatgtaaatacaattataaattgcttcctgaaaaccattaaaaattaaaaatacagtaaatggagagctatgctgtgtacattaatgggaagactcaattatataaagataaaattgtaataaatcaatttgtaaacatgtcattctggtaaaaaatataatttttatttaaaggttaaaaaaactcttcaaaagctaactcagatgaacaaataagtaaaaatgtcaatagaagtttgaagaataagaataatgagtatttattgtaataagtctagtggactttatatcaaggaataaacttaaagaaggggtgtagaatagaaagcacagaaacacatcctgatatacgtgtatatctatatatatatatgtatgcttagatactagaaacataattaaaatatgaattattcaataattggcagtgggaaattatttaacttctggattgaaggtggagaagaagccttcaaaccatatcaccacacccagccccctcccccctcaaaaaaaagaaaaccaaaaccacaaacattttacaaagaataaacatttggaattgtggacttccagatcaagttgataaagagagatgaaagaatatcccttgtcccaacctaatgaaataaacattatatagtaaagtagagactctccccctccaaaacaacaaattcaaatgtaaccagacaaggaaagcagcatcacataaagcaatgcatgcaaaatattgacagcgaaaaaaaagaacccagagattctggagtgacttcgtaagtatccttccctcatttctatccctacaaagccaacggaattcctagatttctcccttaataatccccacattagagtgataggaattgattagatatacctggtttttcttctttaggacttttggtgagtgaaaatagttcttttttgaaacaaggagaatgaactgagattgatgttctgtgatgaaaatgggattccaagtttttgtattaacttatcacactgagggatcaagtcaaggcctgaaacaatttccttttggaaatgagatatagtcccttaagtaatgtatggaaaaagcacaccatcttctaggaaaatttgacagagaatgataacactaagatatatagtatttaaataaaagtttagtgattaaaaaagagagttcctaaaaagaaaatggaaaacctaggcaaaaaagaagtactttcaaatggttaaacatttggctggcctcagacttctcccagttgaattcagtgccaaaagaaataatgcagtgtctgcaagttctgaaagaaggtgtgacccgagaatattatatcctgccagattgttaagtatgtagacatcaggtcagaattcagaagacagacttcttcatctcctcttgaatggcatccccagtcaattgagagctgagtcaaaagaaaaaccacaaatggtaaagacaaggtcaaggaagtgaattcatttgaagtagacgaagacccaacaattcatacataacagcagtgttacaatgaaaataatttaagtgttttaaaccttgatgttcaaatagcaatatagctcacaaaaactagatgacataaagtgtgaggatggtaattatctgtctttaatataaaagagtaaattgatactttctaaaattgaaatgtttagttaattatgtaacactttgttgttttattcataattattttttaagcctcatagagatttttaattagaaaaaagccctttggccgggcacggtggctcatgcctgcaatcccagcactttgggaggctgagatgggtggatcccttggtcaggagatcgagaccatcctggctaacacggtgaaaccccgtctctactaaaaatacaaacaattagctgggtgtggtggcgggtgcctgtagtcccagctactggggagactgaggcaggagaatggcccgaatgcaggaggcggagcttgcagtaagccaagatcacgccactgcactccagcctgggcgactgagcaacacacagtctccaaaaaaaaaaaaagcccttcatgtggtaaagaaagtcatctgaagttttaaaaatttttttattgtttcatgcccttttctttattttctgttaaatgtgagtaaaattacatttgatgctttttatttaaaataaaatttagtatgagtttcttctatccttctttattccctctttcttcccttctcctttattaccttctcttactctccataaaaagatatctaatgtttattgttatttattgtgttacttttgggtagtagaattttaagtcttgtactttctgtttccctacagtttatgaatttctatgttgtatatgatttaacacaaccaattaaataattatgaaaaatgagttaaaataaaaatcattttaaaatgctatagtagaaagaatgagtattaagtataaatgaagaaatgacaggatgaaaacttgatagattttattcaagaaaattaaaaaaaacctttgatgccacaaaatcccttgaaattcagaaagtggaaaatatttgtaaatgagttgacaaaggaataattttcctgatattattaggaatctcataattagtagaaaaaagatgaacacacagaaggaaaaaatgggtcacaggacagtatcaggaagttcttggaagtagtataaatggttagaaagtttcaattgatcagcaattcttgtcaatgaaaataagatctactttttacataccaaattgactatttttctgattattataatacatagggttggtaaaatgcatttataccttaatagtagaaatataaatgtacatatttttggaggtcagttcagcaaagtctcataaaaattaaaatataaaagcttttaacccaatcatttcagtttttatcctaaggaaataaccatggttatgcccaaaaatgtgtctaaaggaaaagtttatttatggtagaaaaaaattggaaattacataaatggctaacattagttaatggataaaacaattatgctactttttttttttttttttcgagatggagttttgctctgtcgcccagcttggagtgcaatgatgcaatctccacccactgcaacctacacctcccatgttcaagtgattctcctgccttggcctccagagtagctgggattacaggcgcctgtcaccatgcccggctaatttttgtgtttctggtagagacaggatttcaccatgttggccaggctggtcttgaactcctgacctcaagtgatcctcccacctcagcctcccaaagtgctagaattacaggtgtgagccactgcgctcggccaattatgctccatttttcttatcagttatattttatgacactgaaaaatacacaatatattgttgacttaaacaaactataaattaccttatatagaacaatttccattgtattcctctcatcctgtcatttatatctgtgtgtcatatatggatttatatgcatagtaattaatctgtatataaaatgatatttataatgattatgtctgggttgaagaattatggggtttcttttctttctttattgttttctttactgttttcatatatactctgaatttgttacaagaaatatctttttttttttttttttttttgagacagagcctaactctgttgcccaggctggagtgcagtgatgcaatctcagctcactgcaacctccgcctcccatgctcaattgactctcccacctcagcctcccaagtagctgggactataggtgcatgccaccacacctagctaatttttgtatttttagtgtagatggggtttcaccatgttggccatgctggtcttgaactcctgacctcaagtgatccgcctgcctcggcctcccaaagtgttgggattacaggcatgagccaccacacccagcaataagaagtatctttggccatcccacaaaaagattgttttgtgaagaaagaaatttaaatacatttcagtggaatgtatagtaagctaatacatctataatgtgcatgattacaagattctgtaaaaaaaaatagattacactgtcgatccatgtgggcagaaatcctgtcaaactcaagatataaagcaaatcagcactaaaaactgaggtctctagatcttaaaggtaattatgatgttagtttttccagtaaatgtcccactgaagcctttcctgaactaaacccacagagctaggtctttcattagaagtcctataaggaacaaaatcatgtgatgtacagggccagtgcaccatttcctgcctaagatgatggatggcgttttttttttttttttttttttttttttatctcttgactgctgtgcaacaaaatgtactggtaagtattgttttaaagaaaactacaggaggaagttgactcatctctactgtggtgtatgcacagcatcttcaagtttcccccgaacctagaattaagcatctgtataaacgtttgcattggaggagataatcaagagggcatggatttcttcggtagctgaagtagtagtggcacagttaagagaatattctaaatttcagatagcctacttaattaattagttcacttttttgagaccaggtctcactctgttgctcaggctagagtgcagtggcacaagctcactgcagccttgatctccaggaatcaagtcattctccccttcttgagtaactggggactataggagcctgccactatgcccagctaatttttttttttttttaagtagagatgaagtcttgctgtgttgcccaggcttatctcaaactcatgagttcaaatgagcctcctgccttggcctcccaaactgctgggattacaggcatgaggcactgagctggcctttagatagactaatttagacatatgtttaccagctccttgtagcagagatctatttcaaggccaatgctttgtcatttgttctttcctgattgggagcaaaggaacacttaaggcctccttttcttgggcgaggcttgagttggaagagatttaaaccttcccttccatagtcccataatactcattagccctgtattttttttaaatagccatttgacctttttcagtcatatttaagtgttttgcaaacacagctgcagaacagatgccctagcttccttttgagtttaggtcattttgctttttccttccctggactgaggcagatagggtgagggtatcaacaatcctgtgtcttttgttatggagtgtggctcttggaggctaatgttagaagagaccttttgcagatgaatggtacggacataaatggttcatttgatttctgtattaattatggtaacagtagctgccataactgataaataatgaaattctagtcacttaccaggctagtagtttatttcatgttcacttaaaatccaaataggttttcccaagcagttgattatcttacagtgatttagagacccaggcagcttctcccaccttgtagctccattgtcttccttctgtggattctgtgttgctggcttggggaaagagcatggaaaatgtgcatgagtgcttttcctgtgggtcaggactaaaaataatctacaacttttctcttcacattttattggctagaactcagttaaatagtcacacttagctataagagaggctggaaatgtaatacagatgtggaccaaggaagaaaggaaccagagtttagtgattactttgtcaggctgtgtcacagttgccaatccagagaacaatagaaaattgaagaaatgaaatactgagaattgggagagaagatgatccagattttgaattctttttttgtttttttgtttttttcttgagatggagtctcactcttgcccaggctggagtgcagtggctcgatctcggctcactgcaacctccacctcccaggtttaagcgattcttctgcctcagcctcctgagtagctgggactacaggcatgtgccaccacgcccagctaatttttgtatttttagtagagatggggtttcaccacattggccaggcttgtctcgaacttctgacctcgtgatccacccacctcagcctctgaaagtgctgggattacaggcgtgaaccactgttcccggcccagatcttgaattctaaggaagtgacacaaatgagaggcctgtagtaattcttgagctagagctaagagttccaggaggcctttaatggaaccttctatcctgagtatgggtgtgggagggacacaattaaatcaggcaacattaagtagaaagatattttttaaatccattggtagaccacaaatacaagcaatgatgaactctctttaattatgcagaattattttgttttatgacaccaaaattaagctagagtatttatttttaaccatagttttagttcttgatattaaggtttgttacagcctatgttataaactttgaatttgtacaggcatgatttaaaaattatgtggtctgtatgttaggggataccaataattttaacccaataaaataacttcaaaatagttatttgaaatttgaaaataataacaatgacatgtatgtaatattccataatttgtacatttcacattttagttcacacagatattttatttgaaaagtttttaactaatagtcttggaactttaggatacagttgtgttacaaactgttgtttctatagatggaagttcatgaaaataattacttgtattattctgtatctgcttataaattgttctctcttatctaaaagtcatgtgatcggagaatccaatgtgtttcatggtgttttatttttcctccttctctccaggagaaaagttgaaattatgcacacccatagtcttttcactcttcttggagaaaggctgatgttgcatacaaacactgtgactgtcaccacatacaacacactttatgaggtaaaaataaaaaatgtgtgatgaaagttttaagtgtatacagtggaaaccctcttaatctatgcaattgagatgagtagttggtctgttaatctaaaagctaattaaaccagaaaatggtttaatggtaaaaaatgaatatataccttatatttttattttattttaaaacatatccatgtacaatttttgccaatttctttatgtcgatccaagagcttttcttcttgtatgggttggctgactggcttcacacaaagtctttctcacataaactacatccgttatgtagtattagttctgcttccccatccccacccctctgtttttatcctctcgttcctactctctctctttctgcttctattagctatccactgccagtattaagctggagttgctactgggataaatttcggtaagaattatttgtaaaaatgatatctggaagcatctttggatctcatcatttcaatttagaggttccttttttatcacttccaacaaatgggacagttttgggttcagtattttctaggaaataggtatactacctcacagggtggctactttcatttttaaatgctagtaaaatgttagtaatgtccccttacattaaccttaactctgctttcctataactgatcttcagtggtcccagttctttttctctagcacaagagctaactgccagcatccatttttgtatggctctaagttaaggaagctttttatatttctaaatggttgaaaataatcaaaaaaagaataatatatgagttgtaaaatgtataggattttcaaatttcagcgaacacagtcacactcatttgtttagctgttgcgtgtagctgcttttgtgccacgaccgcagagttaaagagttgtaacaagaatatttgttatgctctcctcaccttgcactgttgcttggcaaactagaaattacggtgatgtaatacctcaacagtgtttcatgtaccacttgtattgccaaacctaagttttctgcttttaaataccagtgcatacccatcatgtcaaaacaagaaaagaaaagtggatttttaatctcacactttgaaatacagcagagtgtagattattttgttatagatttagatggcaaggccttgcgtctgttatacaagggcattatagtcatgctaagagaagacttacaggtactactaaatatccataatattattcctaactcagaagagcagtggtcagaaaacattaaacagaatatctcatcattgtagatttctttataaaaatgttttaaaaataaaaatgagagacattgagaaagggagatgctaagcttctgaatggaattgtactataattttgaattaacctgtaatctcagctacttgcggggctgaggcaggaggactgcttgatcccaggaggtctgctagatcccaggaggtcaaggctgcactgagctgagatcgcgccactgcactccagcctgagtgacaaagtgagaccctgtccccttcaaaaaaaaaaacaaaaaaaaaaacaaaaacaaatttacacttctctaatactgtttcttttcatgtaagccatggaacagatcaagtcaattgcagattttgcacagtcctcaaacaggataggttttacatttttaaatgatgggggaaaaagtgtattttgggatgtgttcaattatatgaaattcaaatttcggtctctgcaaataaaagtttttgtttctttgggttcttttaaggaaaagtacagagagttattgcaaagagaaaagtacacactcaggaaaggggagtgtgggtatacttaagagagagttgcatgcaagggtttttggggctgctacctttatgaatttcttctaaccaagggatggatggaatattcataaagattacagtaaaagggtagatatttcccagaactgtgatgctatctagttttactccaaatatgggtgttcctggaaccattatggtgctggtgagtgtgtgatttagtatgtcagtgagtgtataatgaggtcctaggtgaacctccatcaaatccagtgccatactgggtgcagttagccttagctatcttggctctcatcctggcttttcagggtcttgtcaacccctagtttctgaagctatttcaacagtttccttttgctagtcatgcgaaactgctgcctggagttttttgttctcctgcaaccacccttattattcctgtttcatttccccttccccttcagagatgtccatctcttattcttatgggctgatgagggagaaggtcggtcttctttatctacttcctgctgattagagatgttggccctgcctggcaagggtatggaaatctttggctgcctggcctgagggttctaagggtgagtcatcaggagactctgaatccaaagcagggattggaatcattgcatgaccatcattttgacatggaactgttgtaatgtaaaagacacaaaatttacaaggaggttaaacaagtaaggacaaagattcatagtaataagagagctattaaaggtcgaaggaaggaggaaccatgtcacagttggtaggtatcctttgatggagtcccagatggtttgagcagtgggattatattgaaattatgtagccaggtagcctgttagtaaatcttttgaactttcagttcaactaatcctgaattgttaatataagaacaacaggtgtggtttattactgtgcaaacccctctttgttcagccagaacataaagcctcttgttgtttccttgaccattcaagtagttcatgctttggcacggttagagcttcatacagtagcttagcaatgagcctaaatcatgggatcaaaatcttgcaaattcctgtcatacccaggaaagttttgagttgcttcttcggttgtagaggcctgacctttaagatagcttccttttgttcgatggacatggtgtagtttcttgggcttaggatgtaccccagatattttacttccagtttagaagtctgggccctgggtggagagactggataccctttctcccaggaagtttagaacttgaataacattcttatctgaggcctctttagtgggtctgcatacaaggatgtcatccacatattggcgtgtggcttccctttctggctctagttcccttaattctcttgccaaggcatttctgaacaagtgatggctatccctaaagcccggaggcagtacagcccaggtatactgccaggaaatactattttcaggattagttcgctcaaaagcaaacaaatagtgacagtcaaggcataaagggatacaaaagaaagcatctttaagatctaatatcattaaccaattggtgtcttctgatatttgggtaaatgtggtagaaggatttggcactttaggatgtaagggaattacagcctcattaatggttcataagccttgaactagacaatattcttcattttgtttttggacagggaggacaggactattacaaagagactgacatggaactgggaggccatgttttaaaaacttcttaattacaggttagagtcctcacctggcttcttgtttgaggagatattgatgcttatgtgggaaattatttttgtcttttaaagagatgatcactagctgaccatgtattactttcccaggagtttcttggtctcatacttgtggttccatttccagatcttactttggaaggaatcttctgtttgtctgatactggtatcgaaaaaacaagcattgccaatacttgaaagaaatgtttcccagggcctgataaacataaagtgactccaactgtggccaggaaatcccattccaataaagaaatgggacatagagttttgtagcctgcagctcaggggtaaggtaaagcgttttgattttggagtgtcatcaacatccatgacaatgcagttattggaagataaggtccaagagtggcctttaggacagagtaacttgcccctgtatcaattaaggaattaatattatttcctgccatgtcgagttacccaaagctccttagttgtgaggaccatgcttttgtgggagccgccaggaacgttgggtcccttcagtcctcagttataaccattatggcctcaagtttccttctctccctttggagctgagggcattcccttttccagtggccctcctgcttgtagtgaggacagggtctggttgggctcccttggctgggacaggtattgcgcctgtgtcacagctccccacacttgaagcagcaaccattacctttaagttttctggtaggtctgcttggtccatgggtgaagcatccctctgggtgactctgaggttgcaggatgctgcttatagtgactgctatcatttgggcctgctgctgtctcattgtttgccatgctaggtcctttcagcatattcagccctatctctattattgaataccacaaaagccacatcaagcatttgattaataggcatttgggatcccaaagccaatttctgtggttttcttctgatgtcaggtgctgactggctgataaagtgtgtcccgagtaaagtttggcaagcatcagtatgggggtcaatgttagtatattttcttagggcctccacaaggcatctctggaacaaagctgggttttcatcctttctttatttcccttattttatcatagtccacaggcttggtgttacattttttcattcccttcactaaacaagtcaccatatgatttctttttcttagatcaacttggccctgttgatagttccagttagggtcattgttaggcacagatgtggccctcataccatattcttcagagtccccagatgacagattgttagcataagcctgggcctctgcccaaatatgctgcttttcttcaggggtgcaacacatggacaagatgttatgaatatctccccaagttaactcaaatgagagtgagaaagcccagaattccttcatgaatttagttgaaaatcaaaggtacatgcacctgatgaatgatcccagcatccccattggctacctccctaagtggacataacttagaatggtcccttaggagggtaggaaacaccactgcaggtgaccccagcagggctcagttcccttggtagggaaggttatataggatgttaaggaggcggactagtaggagtctgggtgctggagacagtggaactaggagaagactgaggacttaaaggtggagctgggtaagagggagaagctgtgggtgccagactgtgtctgggtcaggaggtgagggaaggctctggattagttatttgatatttcctaattccaactaattagttgtttgatattttccaaaaggggatcatttaggatatctggttccccatttggttcccttaaaggaaagggtgtgagtataacagaggcaggaattcctacaaagctcagggttttgataaagagctatgaaggcctgtacatacaatatttgagtccatttcttctgatgttcacaaaaaacgatctaattacaagatggtattaaaatttagggtcctgttctttggctgttgcaccccattttctgaaagagagttacccttggctttgacttgttcttgggacaaccaactgccagtgattctaaaatgaggctgatgatgctccaggctggctcatcataaagataatactggtgggctgggcgaggtttccaaacactggtgggaccttgaccccagctggtgttcgggctcttgataataggagttcaaggatgagtcacaaaatagtgatagcatggagatttcttgcaaagagaaaagtacaaactcaagaaaggggagtgtgggtgtactcaagagaaagagttgcatgcaagggggtttaaggctgcttcctttatgcacaaataaagttttatagaacataactcattaagtaaagtccattggtcacttgacactacagagttgagtagttgtaatggagattatatgatccacaaatcttaaaatactatctgatcttatctataaaaagtttgttgaccactgctctacagcagcacagagaaatttaactcccctctgttgttctttttattacaagctgtattatagtcttctgtcagaattaatattcatcattgcaaaaacttggaaaatgtagaaaagcaccaaaataaaatttagcaaatactgattaatacttaagaatatatatatatatttctcaactcatacacatatgcacacagaacttttataaaatgttatcctaaatatagttttcttgtccagctttttgcacttataattacaaatatatttatcacaaaatatttatctatagctgggaaggcaaacttttctggtaaagggacagatagtaatatttcaggctttgtgggctatacagtatctgtcacaactactcaaatctgttgtagctcagaagcagccatagacagtatgaaccagacaggctgtgtaccagtaaaactgtattacagaaacaggtggcaggctagatttagcccacaggccatagttttctgacccctgctctataatattacttttaactacttaattttttctctattttatcagtaaatttaagagtggctgctctttagattagtgaggaaatctactgactgctctgaattgtttgtttgtttgtttctgagcttaatattccgactttgtgtcaatcattccacaaatcacaagattagtagactatgcctttctgaacaatgcctttttgaattatagtagtgttttaatattgtttcaatatttggcatgcagaactgaataagtactaacacaatggcttttccctatgcagagtataatgaggtcattttctttctttattctgatattgtatttccctcatcatagtaactgttttttattgggcacttcttatgacaaacatggtaaattctttatgtacattgtttcagatcttataactaccctatgataatggtattttttttgcttgtgaaaacagacaaactaagactcacaggttaaataatttgctgtatgtcatgccactaataaataatcataaaataggtaggttccatgatatatatacataatgcaaaaatgtcagaatctctcctcagttgacagcattaaaatcctcctctgaatcaaaacctgctacaatatcagattaggcttctgaaggctagtgcctaatattcatgaacacgtgtttatgttttgattttttggacctactaactggtttggtcaatgatgcctatgtaagtttttaatcattgttttacctatgtgaatttttgagcatctgcttattttgacctcttatccataatagagagtctgagtagtcagtgcaactttatattgagtgtagcataataacataatatgttgaatttgaaaaaccattgtgtagtactaacctttaaataagaaaatttcatatacatgtatacacacatatatgtatttctattagtcttcctgaaaagtgactcaacacaagtacagcagcgtttttacccaccacctatactcctgtgtatacctagtatccagattttggtctctggtgatattctacacaaaacaaagccaactaattgctggtcctgtgtcttagatgaggaaaactcaagataagtttgaattctctgatactggatgtgggatgaggcagagctcctgaaatgatgaaggaaccaacttacagacctctgaccaattttagtaataatacttgtttttaaaatagaataatgtttatggttactttaaataattttttcaaggactttgagtttataatgaatgcatattctaaaaagaaaagttaatgtaagtgtacaaaatgccaaaagagagagatgataaatgattggttatcattgttaatcctacaaaatagcagaaagagtcttcaacataagctttaatactatggccaaaccaaattttattatcagaatgacagggcagtggattactgtttctggatcaccagagtttaaacatcacatcttttgctgtgtcgcatctagttgcaaaaagattaacttgtgtgatgggtatcaatttaatttttgttaacatagtaaaggaaatttaactgaaaaaggaaatcgcttccagactctctgcttaggtttaattcatcttgttagcatcaaccaggttgtgtactcttagcaagaattagttgtttgataatccagagtttgaaatgtttttttaatcttcattttcttttttctgtttggggaaatcaccttaatctcagcaatgcatcagaataaatattactacaactctacgaatgtgtaagattaagtgcagaaataataaagaaccaacttatggtgttgataatgatattttagagtagagtagagtagagtagagtagagtagagtaggaggccaggcacagtgactcatgcatgtaatcccagcactttggaaggctgaggtgggtggatcacttgagatcaggagtttaagaccagcctatccaacatggtgaaacccagtctctactaaaaatacaaaagatttagccaagtgtggtgctgtgcacctgtaattccagttactcgggaagctgaagtagaatagcttgaacctgggaggcagaggttgcagcgaactgagattgttctactgcactccagcctggtcgacaaacaagacactggctctaaaaaaaaaaaaaaaagaaaagaaatttgttattttaataatttttttgaagtcttattaggataaagactatgttatagtgacctttgaaacttttaagtttgataagatgcttgtaatataataaacaataaatttgaagtcacaggccgggctcggtggctcacgcctataatcccagcactttgggaggccgaggtgggtggatcaactgaggttgggagttcgagaccagcctgaccaacatggagaaaccccatcactactaaatatacaaaattagccaggcgtggtggcgcatgcctgtaattacagctactcaggaggcagaggcaggagaatcgcttgaacccgggaggtggaggttgcggtgagccgagattatgccattgcactccagcctgagcaagaagagcaaaactctgtctcaaaaaaaaaaaaaaaaaattaaggcacaaaatcagatttttagcaggacatgtcagacaacattgtataagttgtgaagatgtaaaaatctatcttgattattttgaaaaccaaaaaaaattaataaattatttatgtctatagttttctgaggtgaatttattctgtaggatatatactaagaagtgagttaactttaatggacctctttttgaaattactcaaaactattttatatacatattatttaggaattgtaatatttatgaaacttatcttttaaattctatttgtatctttagttttgctttgttactccatctctaaattatgagtaattatgttttccttttgttaatgatttgtagtactctctaatacacttaagaattgtttgattgtagaatatgttttctgcaggcaaaacaagtagatttttatgtttaatacacttgtaaatctcagcaataatatctgtttcattacttcattgtgatattatttttgctttatgggttctctttgcatactcttcccttaatttagttaaacatgtagtggtgacacaaggagccaaatgtaagatcttataacctaaatgagagctttgttccttatagtaataactaaccaatttaaaggaaaacatatattttttaaattaactgtttctataaggatataacaatttatgagtgcaatcattttacgagttagtcaactttaagcacttaataatcaaagtttttctcaaaattatagaatttcagaggtggacagtatgttagataccatcttattcaaactttctattcacagaaaaagaaagtcacaaagttaggtagcttgtccaaacctgtaaagattctctgacccaaatacagtggcagttagatgcaacagcagggttaatagtttgccttttttttaaccaccccatctcaaaaagttgagcctactaatactacaaaatttatgcatgatgaagctggggagcaggtgcatcagaaagatagcttcagtagcccctgcttcagcctaaagttctgtaacacatgaattgcaaaataattccatttataaaatgaaatttcaatgtgtaatgctgggctcaggtgtatctctgtaaatagcatgtaaagttacctccatgcttatgattcattgttgtttccctccctgtcgattacctgtattatagccactggggacatgtggctgttgaacacttaaaatgtggctggtatgaattgagatgtgctctaagtgttaaatacacattggttttcatgtccatatccagctctgaacctctgtacaattttgttttagtgggggtttggggttactatgcatatctcttaccaatccagtcaaacctttggggcccatcttgagtcctgctctttcattagaatgtttgggtctacattcatctctttttatttatatttcattattccctttctccctttttaaacttacataggttctttttttttttttttttttgagacagagtctcactctgtcgcccaggctgcagtggcgtgatctcggctcactgcaagctccacctcccaagttcacgccattctcctgcctcagcctcctgagtagctgggactacaggtgcctgccaccacacccgggtaattttttgtattttttagtagagacagggtttcaccgtgttagccaggatggtctcgatctcctgaccttgtgatccacccacctcggcctcccaaagtgctgggattacaggtgtgagccaccatgcctggccacataggttcttaatgatagtctatcatgttttgttactttattggggcatgcatttatgcctgcctccagaacaataattaaataaattgctactagaaatgaagttgcacctagcaatgtattttcagtctgcaaacatttagcagagggagggcacataactggttattaataaatacatgttgaattgagtttctgagtatatgtttgtcattttaaaaacctttatatttgaatatgttatagttttcaaagcactttcacatatggagctttatttaatcttcctagcagttttattagataggcaaggcagttattcttttcattgttagatgataaagtagggacttaaaaagacaatataaaaactggtgacacttttgtttcctgtgcaatgtgatttcttctcttttggttgaaaacactttaactatcacgggagagtaggtcctgatttcctttaagctcgtctgaagttattttgaatcctttatttataaccacaattttcttggatctcatccactgggctataggtacacaccagggtcttcggggcaagttgttgtgaaaactacttatacgtatataccaagcaataagtgattgttctttagtatatggttttcaaataaattttatctcgtgtcaactccgtttgattaggagtgcatgtttggggtcctttgtttagaaagttgtgaaatgctgtttagttttaacaagtaagtgtttagtttcatcagaggtatgagaatgaggggaacgggggtaattaaatgctatattctttaataaagtaggtcagtttttatttcaggtcaatatcttttttatgaacattcctaatatacttatgtaaatgtcctgtcttagtctgagcagaaggggaaggaaaatgaaacttctggatgtcgtggtccttttctaatcagaagagaccatccctctctctcaatttgctttttccatcttcagcttctacaatatagctatgttcaattgtcctttcaactaacgttggtggttttgcagcagtttttgtacttgacttaggtttaactgtttattcagaatttgccatgttaaagctaaacaggaaattaaatcacagatataaaatgatgtctgtattaaatataacctcatagggtttatgtaagagataaacacaaactcaagcctaaaatacagtgagcagttgtacatacattattgatatataattaggttaattattctttaatttaacaaatatttactgaatgctgttgtgtgtcaggcattagtgctgattactaggaatataacagtgaagatgatgttcaaaatcctgctcccacattttagtgggaaagttagtaaatgttttagaattttctctttcctttatttggtcaactgtttttttgtatttgaaaggaataatttaaaaaactcattagtaaatgacaatgagccacattgttaggaagaactttcccttgtcacacttactgaagtaggggccagatgtggtggctcatgcatttaatcccagcactttgagaagctgaagcaggaggatctcaggagcccaggagttcaagatgagcctgggcgataaagtggaccccatctttaccaaaaaatgagaaaaataattagctgtgtgtgttggcatgaacctgtagccccagctacttgggagacttaggcaggaggatcacttgagtccaggagttggaggctgcaatgagccatgattgtgccgctgcagtccagcctgggggtaccatagtgagattctgtctctaaaaaaaaaaaaaaaaaaaaaaaaagtagttcataaataattttaggaacactgaaaaggcatttcaaacaataaattcattaatttcctaatctttccttctatagatactggttctggttttgtatgtataaataataaataaaatttggtgaatacagagttaaagagtttagaagtatgtggaattcattaaaaagtctctttagggctgggcatggtggctcacacctgtaaccccagcactttgggaggctgaggcgggtggatcatctgaggtcaggagttcgagaccagcctgatcaatatggtgaaaccctgtctctactaaaaatacaaaaaattagccaggcgtggtggcacatgcctgtaatcccagctatttgggagactgagggaagagagtcacttgaacccatgaggtggaggttgaagccaagattgcaccattgcactccaacctgggcaacaagagtgaaactccgtcttgaaagaaagaaagaaaaaagtccctttagaagagatgtttcttttggtttggactgcattgacatttcttttgcaggttcattgtatatctatattttgcaattattatttaaattgttttctaaatgaagttcaaattcttcatttttcagatcttgacagaacaagtatgtactcaggtcgtacacaaaccacatccagagccagattctacagtgaaaattcagaatccaagtgagcaaatggcagttctttactgtattgtggtaggcgcatggcaacatatgagactaaatcaaaacttttcctaaccccttaaatcattatggtgtttacctagttcatgacagttttaactcaccttttatagtgttaagtatttatttgaaagttggtaatactttttgagttgaacataggatatggttacaaatctacaagttttttttctttgtttacagtgattcttaaagtggtggcaactttgttaaaaaactctacaccaagtgcagagctgatggaagttcgtcgtttatttttatctgatatgataaaacttttcagtaacagccgtgaaaatagaaggtaagcagtttggatactgtaacaacactttattccataattaatattttctctcttttagattttcaattcatttcaaatcttttccatattgctaaatacttttaatcatcagaaaaggcattttatgtttctttgacataatctgtattcggtattcttctatttatttttatattatttttattttgttacgtggatattatattttaattgtatatatgaatatacatataaacaaactcttatttagaatgtaatatcccttttagtggtacctatctatcaccaatggaactttcagttgtaattgtgttggatttccccattttcatctatgctttccaccccatatttcttatggccgaatgttgtgcatttttaagctagttagcttgaacatggggtaaagtctgaggccatgaactctggggtagtcattgcctgagtctataatttaacaaatattgattgagtgcctactgtgttcagtgtaagactttgtgctacacaagatagtcttagtacacagtctcagtacattccagtgggaaaccataaagcaatgattaatgtataatgtgttaagtacattgtgagtgctaaaggtggtgagaaagtagagaagcaataagtaaatctgactgtgaaagttaggaaaatgattttgaatgataattaggatttttcctggtagagaaataagagaaagtcattccaagtatagaatatataacgtgcagcatgactgtacaccttgctttactgaggtcagatcatattttcactattttatttatcaaagtttcaaaatagtaaattctaacttaatttggatatttttaatgagatcaaatttttttctccctagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtaacacgggatttaacattttaacatcatcagagttattgcagtggattaaatggctacaaacatgcatctggtgccatcttgtgggcatcttagattttgacagattcctgtatctcagttttgtatttttccctcattgttcatagactgttagaacttgaaagtggcttatagatgaattaattcaaaccccaaatttataaatcaggagttttatacccaaagctgacatacatctgttttatagcaaatctgggaactttaatctgagccacttgctctttcaactggttcttggaagaatattttatgaaatagtctctgaaatatactttttaagacttttttttaagaagtcagatttttttatttccaagtgaatcataaatacagtgtttaagtttagtggtattttaattgctttatcttttctttatttttaatcttaaaaatctgtatgtctattttaagtattatttgatctttggtaaaatgaaatagtgaattaaactgtacaagtatatacacattagattctggaaattcagagttatgggtttctcatcatgaagtgttatagaagaagcatgggtgtcagaagtatggcttttaatttagtctgtgccataattgagttttgtgattttaggagactcattaagtcttcttgaacacgagttagaaaaaaatgtttaaaaggatagatagtaaatattataggctgtgtgggctctatagcctctgatgcagctactcaactctgccgttcagtgtgaaagacaatacataatgtaaatgaatgatcatggctttgtttgaataaacctttattcacccaaagaggtgataagcagttttgtcccatgggccttatgttaccaacccccacttttgggacttgctttcttcttctgtaaaattaaggggatttttgtattatgagatattctttaaaggatggtccccccaatctaaaattctgttaacttatttaaatatacattaatagaacccatgtctgtaagagaaagtctgtgaactttaaaaaatattagaaaagcttttgtttcaattataaatttacattttgtgaagtattgacacctcagatttatcattgctttaacaaatttgaaaatagcaaagaaaaagacattgcaggtctttgtgcaaaaaaaaagtattctgattattaataaagaagcctaagtaaagtaacaaagccaaaacagcttatataaggataaaactgtgatattttaatagcttgtaaatttatatatttaatgatatgtgtgaattttttaacatcagttgttgggaagggtgcacatatgagcaatagatggtgaaaaccaacatagtaatagtactttggttattgtatattattagctgcttattctctgtttaagcttacataaatgtgtggaagttaactggcatatttggtttgggtaacattgaaatacttagcctaaaagaaaatagcttttaatattgctgagttatctgtgtgattttggcaatccttataataaatcatatatagctgtatttgttgattatttccagttacttaatgaaactaagcacttgctttaggactaacaaatgccagctttgaagtcttaaactttctggcattattttttctatttccacaatttaatttgtattatttagttttttctttttgatatgtacaaaatgccttaatgttttctttacttattcctaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagtaagctaccttatatgagttctagaaataaataaaaatgcattgaagagttgttagcaccaaaacagagtaatttcttatcagttacttcatgtttatattgaattatagtataatagtaatttatggaactaaatagtgcggtataatttcatgtatgtaagaaactaaaaatatctcaattatatttccaactctgccacattcttctgtgtaactttgctcaacctctctgggcctaagtttccttatctagtacaagaggttgtactaaaggatgacctttaaggtctctgccagttctaacattttataactctgtgactacatttacacattttgtactcaagatcttcattctgaatacttgattaattttaaccttttaagcttcaggcccaaccctgttctgtggattatagaaaagaggacttggagcccagattgaactgataaatgaaggggaagggaaaagggaactgttatttatccagtgcctactatgttccgggcactgtgctatatgttttcagatttaatcctcacaacaaccctgtgaggtaggtaatatggctgagaaaaattagaattgttagcagtgagaattttctgttcaaccacatgaatagaaatttgttataagacaattaaagactcttaggtctggttgttaggaaatgttagtgcttcagttttgacctcactggaataaagctaaaaacagatgatgttttctgatatggattttaattgttgagctctgagttatgactgtttctttattttctaggataaataataccttatggttaagagttgaagaaataagaatacatttaccgttaatgacttgggttttgttatcctctgggtgccccacttgccttttaatgtcattgaaaatacattgaatgtgtttccattaggtttatactatgaagagtaaaccatgcctgtcttgtgtctttgtactccagtaagaatccttcataatatatcgtgtgtggggaaagtatttttattttttctctaactgccaatttccatttttgtggcagttgcattgtagtgataattggcaggagatgagcatattgaattagatacagatgtaaaataaaggaaaacatcgtgcgttgtttattgaacaataggcttgcctgttgaacactaggcttgcctgtttttcatttggagtttatagacatttttctggtttgttttctaacttatcaaatgcatttgtgtttttgaattgaagtactgtaagtgaaacagacttcaaagttaacttgaaactgtcaagtaatattttttctaatcttgtgctttagttacaattagttgatgacatatatccagtatacttcactgtgtatatgctcacttcattaaggaagtaatgtggtctaatttaaagactcttaatggggtaaaggggtctggttttcagtgtgaactttggtgttaactttaggtatttgattatcttgcctagtttctgcaatagtaaaataaaagcaataatggagacttcagcccaaaaagtttcctgtgcaaggaattaccaggtgaataatatatgtgaaatatattaaactgctaaagtcatatgctaaagcattaaagcattattcactttactatactcacagtttcattttaaaatgaggcatttcttttgtattccacaaaagttcatcttttccttctttaggctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggaggtagaaatatttcttttttataaattaaaagcaaatatttaaaatatgccattgcctattctatttggttttgacaaaaccaaaaatctgccttgattaaaggaatttccacatttttcttgtatcttgtttaaattaataccatgtactaaatttattagtgataataatatatactgtttaagtttaaaatcaccctgtgacatgtgtattcagagcctgtagtatttaagcagttagtggatatcagttcaaagatgataacttagacaacaaatctacataaagtaaaccatggcctttctaaattttcaatttaattttttaatagtaaatgtgaaacaaattaattaagagagcacatcatttacataggcatgaatacaattaggaagtcgatggatataagtagcaagggcaacttaaatgatctagcacaacattcttagaaatgttggcttccatgcttctcctcattttccttttaggattcaaggtggctgcttcagctcccaacctcaattcataagaaacctgcccaaattaaaaggcagagatgactcttcttccttcctcttcttcctgtttttcctctgcctcctcttcttctctctcctctttcactttctctttttcttctcctcttttcttcttttttttaaaggaagcccgtcaagaaatttcccccttatatctcgtgagccagcaggatcacatcctctttcaaaatcaatcatcagaaaaagaaaatgggattataatgactggcttttagagactaatactggttaattaactagtaactagggttaggctagtctttcctatacccagtcaagctcaataataaaacaaaatataaaatgtgtgttagcagggaaaaagttatgactgttgtggaagaagtcaataaagtctgccatagaaagattttacttttgattttatttgatcaatttgttcttagactactcatatactttcattgctaattgttatatgataaattacctagagatggtaactgaggaaacctaaataccatgaaatacattgctattaacatgaagaccaatgtatggagataaattatgtaatttgataattataatatcagtagcctccaagtgagtgatactcagctttttttccaaccacctactctgtgtttttgttttctttaatgggctctcatgaaattacccaggtagaatttaatgtaatttaaattttttaaaggtaacactttatttttaggacagagagaaacatcttgaaatttaagatacacagtgatagataataattcacaactctaaaagggtgagaattattgactcaattttgaccatgaagtaatttcttttttttaatcttatttttttcccattaaaaaacagttcaggctaggtgtggtggctcacacctataatcccagcactttgggaggccaaggcgggaggatagctggagctcaggagttcgagaccagggcaagaccctgtttttacaaacattaactaggcgtggtggtgtccacctgtagtcccagctactcgggaatctcctgggcccagggaggttgaggatgcactaagccatgatcccaccactacactctagcctgggtgacagcagagatcctttctcaaaaaaaaaaaaaaaattatattcttgactgacaccaaacgaaagcagggtatttttttgacatctacattgtatgttttgtatgagaacactgtactaccaacttactttgagattttttccttttcttattaaataagttcttgaatttgtactgatttatttatactcccctatcatgtcacttctttagcagtatacatttcaatgtgactagtcaaaggtggggctgaagtcattggggatgtgacaaattgaaactgcctacaaaatagaactttcagttaaatttttaggttttcggtttcaaattttatttatggttatgaaaattttgaattggttatattttgagtttccatattatttttaacattagacatactttttatatttaaaaggttttgcctttcaacaaaaaacaatcagatttggcaaaataaatatttttagccaaatttgttgagtcagtcatatgtcttagaatctagtactgtatttttcaagcaaagtaataatataatgagttaatatacttggatacaacaaaatcctgtggagatgaatgcttagtttttggtaatatgatatctcaattataaattgctttattttataatttaattttaaatatagctagctcctacagttctataatttttcacttgttattctaattgtctaagcttttcatttaagtaagccaaaacatactcatttctgttttctgtattttagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactgtaagtactttgcctccatctagtggttatattttataaatacatgactttagcatttcagtggtggtctaggctataaacacattttaaccagacctgtactttttaggcaaatttttaaccatttaaatttctatttccaccacttttgtttatcagtgttgggttccagctgtgtgtgcttatgaaaatgtttctctggtaattctgatgaatacttcatcagaagagtattgcattcttcatcaaagatattgtatatctcttcaaatctgtagtataaataaactcttaaaatccttgttatttaacattttcatttatttactgattcaacatttattttacaaaatctagccttgtcttgatttgtttctatataaaacattgaaatgtgttaatataatacattttaaaggcatttaatgttaattgtgtatgtcatttaaaataaaataggtcaatgttaactttgtattttagttgtcattaaaaacaaattctttgattcagaccaaggcagactccatagctacttgctcagatgggaaagaatatagaattttgcttcccatattacccacgttcttgttgccgtattagaaactcatccttaagctcagaaagcatacctttgccagagggaaatatttcattttactaagatgtgctttagttggtgagacactgtttccaagttgatctctaagtgtatttcatcattaacaagctttttctacatgactctttttcttactgttcttttgttaatgccaccaccatcaccagagcagccttgaaacttcaacattagcagccataggctatatcctcacacactttccccaggccttactcttctgttttattcatgaatttgctcaagaagtccacaaagggaagcattccagttcagaaggaggaatgcaacagagcaagtcaccagtagggccttaatcaaattagcagctgaaccaaggaaatggagctaagaagaacagtataaattgttgatggtgtgtgaagagtgcaagtatacatacaccactccttttctttaatctctcttttcctctggtgatttataccaaattctggtaaattgagagttgtgtatgatttttaaaatgctttctaatagtgagacatagagggcatttttttcttctcttttcttttctttttttttttttttgacagagtatcattctgtgacccaggctggagcagagtagggcgatctcagctcactgcaacctccgcctcctgggttcaagcaattcctctgcctcagcctcccaagtagctgggattataggtgtgcaccaccacacccagctaatttttgtatttttagtagttatggggtttcactatgttggccaggctggtttcaaactcctgacctcaaatgatctgcctgtctcaacctcccaaagtgcagggattacaggcatgagccactgctcccggccaacgtgttttttgttttatatattgaagactgaataaatcaatattttctttgtgacatttttcttgatcatataaattgcattttgttttataaattatcatttgttatgaagaaatttttaaaaggttgtattgaaattcactttgaaatgtaatattgaatgtttttaaattttgcatggaacataaaatgcttcttatgtaaaaaaaacagtttagcaataagttatttcaatttgtataggtttaaaatattcacattactaaatagttttccaaattttaaaggcaaaagatctttaactattaagatagaatattaaagtaatgaagtaaactataacatacatactattgcaccagtcaaatttgcttatttgttttatgatgattgtacagtaaagatactgacgctttgaggttggcttccaaaattattacgattcaattttgaccactgtagtttggaatttaaaattatttattacctagactatctcaacagacttgggaattcattcaattatagaaacctttgtttattttctcaatttctatatttctgttattttggcccattaactgtttggacctatgcctggttgtacaacatagctgattttatgtttttagaatgaattgcttccttaagagaaatagccgaacctttctcccattttgtatctggtagaactatgattggtgctgactgctgaatgttgtttttctattatgaatgttgtttttgtattactgggttgtataatattcttgctagaagttgtaacatagcagagggaaaaagttgggaaagaggaggttgaataatgagggaaattaaaccgaatatttgggctttttatatttaaatttaaagtgtaaaaagccaaaagagaattttggaagggataagtgaaaaaaggaaacattggcaacgtgaagattactgaaaggaaacattgtcttgtaggtgcttttagaattttaatcctagatatatgaagagagatggaaacatttgaaactaaggtttgagtgagctggtaattttgtttatatatatatagtttttcagaatattcttgtgtgcattttatgaagaaataggaataataatggtttatggcagtagttcacaaacttttgtgtatggggccagatgggaaatagtttaggtttcattggcagtattgttatctgtcacagctagtcaactctgctgtgatagtacaaaagcagcaatagacaatacataaacaaatattttttgtctgctgtttctgtgagattgacatagaagtggtctcttttctgccctggaaatttagatgagtacagtaatttatactagagataacatttttgtattgctgttatagtatcatcatcatggaagaaaatttttgaactgtttaatcttagttggaaggtacatatcttaatggaaacttaagaaaaaaagaacatatatatattgtttataatgatagtttgagcaccttgaacttagtactcttgaagaagcagcactttatgggagtttcagttttgcccagattacttaaattcatatgtagcatagaaaataaattacaaaaatagtttcagatctccgagttagaccaatagttttaactgtactcagggaaaaaaaatagacctcttagtatgtagtttggccaatctttgctttgggaaagcagcattatttttgttgttgttgatttttttagttgatgtttctgtgactagttaattgaatcctctcatttattctctaatatattgtttaacttggtcataaatgaaagtgaaaaattggagaagaaaaagaaaagcaaagaacatggatcaaccacaaattgcacactttgtgattttaagttgaccactttagtcagccatccagaacactgaatattatggagcttaattcagggcttaattttctctgtcccagaaaaatagtagagactgacatttctagctctcctaatagtttcataattataagaaagaagagctgctttttctattctgtccaaaaataacaaagtcttaattttagtttatttttattatcagaatgtatcataaatagatttggaaaaattatgaataatgttgttggttttgctgttcttttgtttatgtcataggactgatcatactttactattctcaggatgcttttatatgttttcctatacaatgtaccatgaaaatagcatattttaagatttatactcacatgtacttgtcaaaaattagaaagaatagttgatgatttttattgtgaaaactaattctatctgatatttgaatataatgaatataattattaatgtaataagaatcttaaacttagtataatacctatttaattacctttattcatattcaggcctcatttagtatatcaagttattttctagcatggaaaagtggtttataagttataatctctcaaatattttgttattttattaacttctcagaattttcaactataggaagctttctgtatatttgagaatacaaattacattatttccttatagaaaattctagaggttggtataaatagttcatttccctgagtcatttctgcctaaaccagaattgaggtagggattttgcagaggcattatgttagcttatttattaaaatgttccattaattataggaaaagatacttgttttgtaaaatagagtatgcattatttctaatatatgaactatacttatatatattatttgggcagagttactacaataaaaataagttgaagtctaaatatttgatatttaaccttgatcatgtataatttataaaatgaaaatctcttctgagaattttgcttttaataaaataatcaaatataatttttaaatatattattttgtgtttcaattttacattgtattttcatttaatttaataatttccttttcttgtactttttggtctgttgtctgttttgtctaatgcatgtccagggttctaaggttagtattacttttgtagtaattttcagctttcagtttcaagttttatttttacttatttatgaaatttttgacttggttatattttgagttttcatatcatctttaacatgagacatatcttttgtatatttaaaagagtcattgaaaggattattttcccaatgcattgatgtattactattttattatgcacaataatccctagattaaactatcatattgaacacaatggtgttacagtcatatgtacaatcagattttaattggttctaaggaaagtaaattggatgaaatatattattttaagatttaataattgtatgagagtgatctttattttttagccctatcttttgatgcttacatacttcattttttaaattacttttatataaaatggaatacaaattctcttttagactgttgtgttgaaagtgccttctactctaaaatttaattttttcagtcaaaaaaacactttgatggattatatggacaccttaataattctatttataattcactcattttaaaatgaaagcatagtttgacaggtcaaaacactcaaaaccattaaataatgaatatagagagatagctatctgcaatttcagtgattcaaaatgatgaagaatttgtgaacacagatctagatattctaaattctaacatttgaaaaattatttatagtatttgatagacctaagaaatggccaagttcttcattcctttatagaacattttaaattgaaaacagatttaaaatgaattttttgctctttcttatgagctatgatgtcatggtcatagatttttaattgatattatgaagtgatgctgtatattcatgaagtgctaagaagtaaagaatctgcattttaaaatccaagtaatgaattaatcatttctttatgccatgtgtactgaattggcataatgttgtaacaactgaaaacacatttctgtctctttccaggctcattttagagagaatggttttaaccctattttgctgttaaatggaaggaggaatggttgttacattttatacatcatttaaaactgagcttagttatataatgcttgtagtagccacctatcctttttattacccactttgtgcacaagaaatgttttgagtattttgagttcttttttcagtgttttctgctcacgtttccatgttaatgctcctgcttcttccaagcaggaagaagtttaggtataatgatggctataaacagtgtcaaaatggaacattaaataggaatagatacctattacatatgctaaccttgtagttgaatttatcatttggttaagagttaatattgattggaatggctagtgtgtccattttcagaaaatttaaataatttttttttacttatgaagtattcccttccttggttccttgaggcactgataaaatgaggcctagtcctaaggaacaaaaataattaaaatgctgtatagtccatggtgcaaaacaaaataagaaatgttgacattgtttaaaaaaccataaagttgtgcattttaagaaacacaatgctttgtaatattccctctgaaatcagaaatgtagtgaaagtacagttttccaatctagaatgctatgattctttttattactagtgttttataagtcacgaattaaatatctatagatgagttagcgatcttgattatttttaccctagagttttatcgtacatgtaaagtacctagtagtttcagtttattctaaaatggataagaaattgttatgcattctaatttgacagccatctcattttgatactaagttaaattaccatgtattttccctattattcatcatacatctataggaaagaaaaatcaaagcatatatttttattaatgggaatgaagattttagaaaagaaatatcaatttaaaatctttataaattacaaaacaaaactagtataagtacatatatgtggttctgtctaaatatctttgtgaaatgatcttaagtttaggatgtcatttttataactaaagacatttaaaactaatgttgattttaaaatgggcttttcctttattcaaggataattgataggtaaagtaaccgaatttggtaaccagctctggtgatatatggaattagttgaacatttattttatttataaaatatggtaaatatactaaatttatgttcacttgtagtatgtatgtatatgtattatatttccaaatttccaaattttaaacaagacttaaatcttctacttttttaaagacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattaggtaagtctgttaaaacaatagtgcatgtcaaataattatctacagagcagctttataaagcactatggtacataaaatattaatgatataagttgatgattatataatatggagattatcttgagatacagagattatttttataattaatcagaattactaaattttaaaaaattatgccttcacattggagatttcacagaactgatcatctttaatggttcatagtttgaaatcaagagtgaaatatacttggaattctttcaaaatcagtaagactaacatttgtcattgaagtgatttttaatgcaaatccatttatgaatccaattttggtaaaccaatactgagggtagtgtcctggcctcacaaacatgtcagatacacataatgctagaaggttaaaataaactatcccaatcttactgtttcttggggtgaacaaatgtccctaataaatattgttatacccatgctgttcaccttttatctgtgtggcagtgaaactttagcactgaaacctcttagtaaatctgaatgaattctttagataagaaccatttctacctctcttaaaaggaacatttatttacactatttagactttcaaaaccagaaaactgctgtttttgtacttgccttagatcatgagcaggacataagaactgcaaggcatgaaataggaaggacgttcctgatatgtactgttttcacccataacttttaaagattatgtcaaaaattcctttctgattcaagaaaggaacaaagacttggtttaagaatggtgggatgaaacctttttttgtttgtttgtttcgtattatttatttaaagacaggcaagctgagaggaatcattttgtattcattataagagaaagattgaccacattaagatctttctggcaaccaagaggtgtgggttaactgacggtgggccattaaagacatttccattgacatataacaagagctgtcaaatgaactgtgtgagaaagagatatatatatatatttttaaaatggctcaatatcttgaaacctgcatttatttggttattctgtacttttatttttaaatatagtccaagactttactccctatttcatttttatcctaatactactagcacatttagttgtttaatcaaccacaggaaacttttataagtgaataataataaaacacttatattacctcctatgctatttactgttctaagcactttctatatattaattcagttaatcctcacaacagccctctaaggcagttactttgttcatcctcattttacatatgctaaaactgaggcacagatagtttaagcagctagcctaaaaccacacagctccaaactggaaaatacaggattcaaactcaggtcacggtctgatttcaaactctgtactacttgttacagtattctactgcttcttaaaataaatgaataaataaaaacatgtacatattgaatgcttattgacaaagcccagagactttcccaccatgaaggaaggtgaatttggggacctgtgagacttgagtatactgatgtactctattattgcccgaaatgggaagttgtgctcagtagagtcgacaagatagtcaaattaagggcagaagctttattaaatttttaaatcaaatatgaattttatgtttaaaatattttattgatccataaattcagaactgtgaaactcagagggtaacagaataaggaaggatacattgggggtttcagagcctctggtaatgttttatttcttcagctggctggtggtatatgggtattttgttttatttttaactatatgtatattttgtaggtactttcactactgtatttcataattttgaaaattattgatctagttgattttaagattaatagtttatgaagcaaggggaaagaaagggaagaagaaataaacttgcaactttttccaggatatcaaagtcaacaatttatattaacaatatgtttttgaatttttaaatagtttgttgtgttgctgtgagaaactgtttagaatgtcggcaaagacagagagacaggggaaataaatcttcccatggaagcagtaaacctcaggaagttcctcaaagtgtgactgctacagcagcttcgaaggtaagtaaactttttttcttggccaaatataatttacctgaaaaaaatcttttttaagttgatgagaacaaagtgccatggtattgctcagtgatagagagcaaggacattgtcattaggcagctctaggctgcttaacaattttgttaccaagattacttaacttctctgagatttgtgtgttttggttattaaatgaagttactaacaatttctacttaataaagttcttacaaatattataattagcactaaaaactgttatttctatttttaatagtcatatattttcacagaatttaatgtatgaataattctccttttaaatgggtaggcataatagtcaacaaaaactcactgaatgcccattcaatgaatggagtattttgaaatatactattagttttctttctaaattagctttctttatcatatgcttaactggcccttggcgtcacatccagtttcattaacatgctttttgaggttctgtgcctggtccttgcttacttctccagcagcagctctcagccctttacccttgcttgtgctgttttagtcataccatagacttcattctgttcatcaaaagaagctatttcccctaacttctcagacttttatatgatttcctttccataaagtattcatccttattttttatccagctaaaatctatgtaactactaggttaccttaaatgctacattttctcaggaaaatgttttttgacaccctcgctaccaccccagtcagtctagggttgttccttctgtttgttgttttcataaaattacataggtctgttatcactcattacacttgtaattacatgtttaatattgatacagtaactttttgctcaataagtgaaggtatgaaatagaagtttaattcatcttaaaagttctattgctttaaacttctgcagatggcaagcagactgaccacatatttatcctattcgttggttatttgcagtgttgtaacttttttctttttcactactgtcagagaacatttgtaatttgactatatattatttactgctcacaggactccatagtgctcttatttggtttgggaaattaaatacaaatggatcatcagtaatgcctgatatcatttgtgtaggcatagtagacagataggtacttgagggcagtgtctatgtgttatagatctttgtaacttcagagtaatttttttttttttttgagatggagtctcactctgttgccagggtggagtggagtggcatgatctcggctcactgcaacctccgcctcctggattcaagcgattctcctgcctcagcctcccaagtagctgggactacagatgtgtgccaccacgcccagctaatttttctatttttagtggagacggggtttcaccacattggccaggatggtctagatctcttgacctcatgatcactcaccttggcctcccaaagtgctgggattacaggcatgagccaccacgcccggccacttcagagtatttatagcactatgagtactttgtaaaaagaggacaactctagaatcagacagttctgagtttgtgttctggctttaccacttaactggttttgcgacctgagagaaatctcttaaatttctgtgcctccgttttctaatctttaaaatggatacaaatcttaatttacagagtgtttgtattaattagacaaaaagtgataatagactgacatgctttgatttctggcatgcagtgaacattcagttattactgatttgttcccctgtctagcagtttgacacttaatatattgtcgtgaaacgaataaatagtattttgaaggtgacacctttgagatgtaagcacttcaaaatagtaatgtatttagtaatttgtagatatactaaataaagtagataatagaaagtccttaaagatttttataactagtatttcactgattgtagaatatggacagaaaagcccagtgggaaggaaattggtagtaacttacttgagctaatcagtatttatctggcaagaactttggcagtgaaaaatgggtaagtagcgatgaatgtaaaaatactaggggaagatttgacatttcacaacaatgaatggatctgagtggtgtttctttttttttccttcctgtgttatgtgtttcttatgtgacattttaggaagtaaatcgagtaatttttgaatgcagtgggaaagtttcttgcaagtttcttgcatgaatcccataccttcatgtgacctcatttttatactgtgtgaaaaggaacaattacacaagcttctcctatcatgttgtctttataaggatcaaattagattaggggtagagaaatatagaaaagaaaatatttctaatcttaaaatctatgttataaattcatttatgctgtaaattatgtattattttctttaaccatcctgtagtaaatattattagtctgttattcagatgatgtagctgaagttcagagaggttaacttctcaccgatggtcatatagccagaagttttggaattgtaatggaaaccaaatactatcaacctttaaatactatgctctttttactatggcgtgctgccaaggaatcaaacattttaattttgggctagaatatcatgattgacattcattgagaaatagaaggtaccctgtttatttttcattgttagagtaacaacaagtgcatacctattatgggctggaattgtattttgcattatacatattatctaatttaatccatacaatttttaacacactgtataagtgagaaagtacttgattgagtttcagggaccctagttcacttagtagtctactatgtgactacattacctgaaatatgtagatgtttttcctccaactataaaatgttttgttggtaacaatctttaatgtctttcagctttaatgggctgtgactgattctttttaatcttaccgtttctaaccttggatagaccatgaaatggttacacatacaaaatctcatatactagtgtagtataataatctcatatattataaaagcatgatggataaatgaacccagaggctcaaagagatttgttaactagaggtagagaaatgaggctcaggaaatcttctgaagtccaagacgaatctttattctgctataactttacctgcctttatgagtctatagtggtagctgtgccaataaagaacaagaatgctagtatggaaaccatgacatgagtagagagcagaaaatatgcattgtaatagaggattatgatcaataaatgttaactcagagaggtggagatacatgatgtgaccagtttagcctgaattaagaagtgatacttctatatattatctgtaatatattatctattcacaattctttttattttcaaagactccattggaaaatgttccaggtaacctttctcctattaaggatccggatagacttcttcaggatgttgatatcaatcgccttcgtgctgttgtctttcgggatgtggtaagttatacctgattggtttccctgaaataaaccttctactgtcattcgtatgaaatacgttttataagaaagctgcttatgaaaacgacattccctagtatctgggattgttggtttattgcatacttctcattataaaatggttgaaccttagctttctctgaaagcttattgataatgttacttttaaaaaatggtctgaaattttgatgtaagttgcttgcatactaagaataggactagctctgaaaaattataattaactttatcttgtatcaactactcctctcttagtattccttgctccatttgcaggtactaaaaatttgttattattaatgttccttacattatggatgaaagggattaattcattaggtgttactgacaattacttttggaggaggggcaattaaagaataatctgcattttaaaaaatacaggtatctatgggaatttgagttagaaagatagcttaataaagctaaagggaaaagatgaagaggtttcatggaaccctccaatcttatgatcagttactccaggcaaataaaaataagattggccttttcaaaaattgcatagaaacatatatggtgtttcacatcagattcaatgctgacagcatctcttaacatggttattataaaccagccactttgaattctgtttttcttgttttagttgatgattcttatctagttgttgattgtatatgaaatgtagaagaaagtttatattttaaatttatatttaacagtaaattgaatggcatgctttgtactttagaacatgattaaaatatatttaggttatataacataatgctatatgttaggaatgtacaatagaaaaatcatcactctgtttaatatatattagttataaaatgctaggaaaattccaaacataccaacagaaaaataggcaatggacacaaggcaacaaacatgataaaaattcagtatccctagtagtcaacagaatgcagattaacacaggagtgagagatttttcactattaaataaactaaaaattttaaaatgataatacctagcattgtctgggtgcagtgaaagctgctctgtcaaatatcactggtgtttgagctttcgaatagctctttgccaatatggttaaaactcttacaaatcttgatgtcccaatgaaccactagaacccagtcgttctagtcagaatttgtttaacttaatgttttcatcagagatatctacaggaaatttggcagcattataaatatccagtaatagaattttggcctaaaaattcttggcgtagtcattcagcagtgacctattcagcctttaagcatatatttttgaaggaaatttaatgacaacggaaaatgatcatgatatattttaagagaaagcaacagcatgtagaagtacttacattaacaagtattacatatgtatactgattgtatgtacatacatacgtgcatctttatttttaaaaaaagactgaaaaaatataccagtattccaccaatgattatgtctaggtaaacagattttatttatccttttatgcttttttgtagttttaaattttttataataaacctatattgtttttataattaataaataatgaaggtttttttaaaaagggagactacattaaagtataaaaaccacaatgtaagaactcactgtaatctaaactctaacctagacttggaaagaagataccattcttactgacagtttaaccatttagaaatgggaatagtcatcctgaaaaaatgtgttgtgaaaaggattttttttaatgaatgaatgattaaaaacatggagctcatcttcatctccaaaggcacagtcagacgtaatatataacataccggaggagtttctattaagggtgacatagtgtttaaattgttagtaaattttgaattaggttatatggtaaatgatgatcatttcccttaaattcatggatattttataaatatgttggataacccagcagtggttgtatctgtgaaatatggtgatgaaaagagaatgctttggaaagatctgggtttgaattctgactctaccttataccagttgtgtggtctcagtgtttctgagtcttaactttttcttaacccttaactggaaacttaggataatatgtatttagtgcttgatacataatataaacccaattaacacaagttatattaccttgatgttgttcggaaggtacaccatggcaacacttaaagcagaccggagaaacattatatagctcatgtcttctcagtaataaaatacctgagcaagtcaattaatttgtataaaaatttagtcattccccagatgtttagcctctatgtatactgagcttcatttccaaagacagaactgggaataagaagcacaactgactaggagatctgggttaaaaaaaaataaaaaataaaaaataaaaaaaaaagctaactcttttcatgccatatataaaggaggttttcgtgtagctatgacagcagtttagtgtctgttatttacagcgctgccactgtgtagttggcattcattcattcattccacacatatttgttgaatgccttctgattgcctggtactgagtttctagtgttagaaatagaagtattatgggatattatggtctgtcacagcttgagcaatgtgtgaatctgttcttggttggtatcttttcttaatctgattgtgcttcattttcctttgtaataactgcttaggcatttgatttcttcacttctctctgtgtttattgtatcatcattgtagtgcaaggaatatgcattttaaacagtttgtaagacaaagtatctctagaaaagctataacccacaatgtatgaaatagtaaattaggaataattcagaacagattttgtgtattttggtcattttccccattagccagactgttttacaatattaaatcatcagtaaatatgtcttatttgctttttgcctgcaaatgcacataaattatgaatcttgtttgcattgtgcttagatgaagtaataaatataaagtgcctgttaatcgagttactagaatttattacttgcttgttttccttatttcttattctgcctcttatctgtgggccacagtaactgctttcagtttggtttgaaagtatcagttttacctagcttataaaagaagtttaataaagatttacattttattccttagatatactctagtatattagaggtcatataatttagacttgatacttattgtttccctgaaataagtttatctaggctttttgaatagagctctcaaggttacatgcagcttgttatatttttggaaagcatacttattttaaagttatctctctaccataccacagccgttgttttaactatcattgctttctgccttggccagtttttttcaaaccttttaccatttgctgttctcctctggaagaactccattttatctttgagtttggaaatgaggagcgtgaaatattggcagtgttttagaggtcatttttcctgtgcagaataatggactattatttcttttaaaaaatgttctatttccataggtttttgggaaatagtagtatttgaatacacgagtaagttctttagtggcgatttgtgagactttgatgcacccatcacctgatcaatatacactgaccccaatttgtagtcttttatctgtcacccacttcccacacttttcccttctagtccccaaagtccattgtatcattcttatgcctttgcatcatagcttagcttccacttatgagtgagaacatatgatggttttccattcctgagttacttacttcacttagaataatagtctccagtcccatccaggttgctgcgaatgccattattccattactttttgtggctgagtagcatgacatagtgtatatatataccacagtttctttatccactcattgattgatgggcatttgtgctggttccacatttttgcaattgaaaattgtgctgctataaacatgcatgtgcaagtatctttttcatatactgacttcttttcctctgggtaaatacccagtagtgggattccgggatcaaatgataattcttttagttctttaaggaatctgcacactgttttccacggtggttgtactagttttcattcccaccagcagtgtagaagtgtttccttttcaccccatctgtgctaataactattatttttttattatggccattcttgtgagagtaaggtggtatcacattgtggttttgatttgcatttccctgataattactgatgttgagcatttttcatatatttgttgttggctatttgtatatattcttttgagaattgtctgtttatgtctttagtccacttttggatgagttttttttttttgctaatttgtttgagttccttgtagattgtggctattagttctttgtcggatgaatagattgtgaagaatttctcccactctgtgagttgtctgtttattctgctaactgatctttttgctatgcagaagctctttagtttaattaagtcctgcctatttatctttgtttttgttgcatttgcttttgggttcttggtcatgaaatctttgcctaagccaatgtctagaagggtttgtcaaatgttacctgtttatacgatcaaagattgaattagctttttcttatgctgccataatcatacttctggctcatattgagcttatgtaaattcatgttttctgctcccccattgtttatttctcctctattttgtattcatatagtctcttgttccagttacactaggattttatatgtatttcagttggagttttatcctactaattttattcagttatagtatataaaacccttgatttttttaaaatccaggacattattcttttcaactttgtgccatctacatattttataagcacacatactatgttgttatgtaagtagtagataataatggacaaaaatggacaaagaataaaattttaatattctagtttttggaaattacattccaacctgtagatgatatattttaggagttttatatttatagttaaataatacttattaaataaatatatatatttagcaggttttcataaaagttacatatcatattttgcctccataaagataataaaatagcagtttctagtgctttaagaacttatacttcaaaaagtttgagtgttaaaactgtcttttcatttttcataggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacaggtacttaacattgtataattatttgaattttcaccatgatgtatctcctttttttcacctttacatctagatttaaactggacctcttcataatcacctcaaatatttatgaatggttggtatagaaatgctaatttagtattccttaattcaacaaaaatgtatgaatggtatttttatatagttgctacattctcattttatcagtatagctttggtttcagtgtttctcatttattaatacaaatcattaatttataccactatttaatatgcaagtaactcatatattgttaaatatattacttttttaacatttataaacatgaaagtagaaagtcattatagagttgttcaatgccaagggtaagccaaaatacaaatctttgtagccaagctcaaaagttggatttttttcttttttagctgtatacagttaattcagtatctaaatattctatcagtgatttataatcaaacatgtgttctaaactttataccaaagtggcctcaactaaaatcaaagacttgtggaaagttaacatggacaacaatgaaccaccttgggtcatgctgccttttttcatttgcaaaaaatgctcatgttgcagcagttcttgcattactagctttgcccactctacttgaacagcataaacacagtttctggcaactaacattttaatattggacaccttctatcattatcatttccttccaggtgtttatatcaaggttgtttctctattgtttgcagtgaaaccttgataacctaatggttatttcatgtaccactggattaatttgtagttgaaattttctttcctaaataaatgcatatgatttataaataaaatggatatttcaaaaagtgagtagaaattagtggtcaaatctctgcatcttgtttttcataagcatatcctatttcatataccttttattgatgtcatggagatatggattatgttttagctacagtattttgctgttgcatgatacatgtacttttaacacacaaacatgagaatatttcattataatatacttttgcttttaattttattattcaaattaaacatcatcctaccattccagttcatgttttttcaccatttaaaacactaagacttatcattttctttttcttcatttttaatgcttttatatccattatatgtacaaaaagtaatagtatagtgaaccttctagttctgagtttcttgtgtatttgtatgtctctgtgtatgttgctagaattactctacttaacaaatgtattattttctttctcttaatacataaactcttttcttcagagatgcattcgttattgctagtattgtttgcatgttgcagtaatacagaattgtcatggatcttcagtggaccatgtggcaggttgttacatgctggctcaaatttgattccatgattttctccacagttgtggtcataccatctatccctcatccaagtttgaaccatggattccttgccaagttaattcctgagcagagctttggccactcattttacaaaggtaatactgacctcatctcctgacctgtttgggtattcttatttcatgaattgttttaaaataaatattcatgatatacttgtttataaataagtatatacctcaggtttcatggagatatgatatgttgtatttatacctagctattgagagcgaagtatagcttttatatttgtattttattacatttctttaagtatcatctataaattaaggatacctaattatatgtatattaatatgcatagtggtagcactcaggagagatctcaggagagtcacagtttagtagtgggactaaatgagcctaatataaaggctactctagaataaaccttaaaaacatgccttgaaagcatcaaactgatctatacgttatttaacttccagttagaacaaagccccaacactgtaaaggaatgcgaaaagtccatatgaaaaaccataaaattaaatattagacatccaacaaaaattattaaacatgcaaagaaggagaaaaatgtgatgcataagcaaaagaaaaaaaatcagtgaatagaaacagattttgagacaacagaaatggcagaactatcagatacggacattatagaagccattacatgtatattcaagatgtttttcaatgtaatggaaaaagttaacatattgaagagagaaatggaagatataaagaaaaaaatgacaattttagagatgaaaaatacaatagccaaaatgataatatctctgtgtaggagtaacatgagattactgacttcagaacaaaggatttataagaggtagaattctgtgatagctccaagattttcctgtgtacgcactctgcaaaattcctgggatgataaatatgatggtgtttactcctgtgattaggttatgctgtatggcacattggcctttaagaaatggtgattatccaggtgggcttgacctaatcgcatgagctctgtaaaagaagagagtttcctcctctggtcacagaacaggaagtccgagagacttgaaatgtgagagaaatttgacatgaaggaggatctttattgcttagatggaggtgaccatcttattgcttagatggaggagcaaggacctgagaaaaccacatagctaatagcactcaccagctgacagccagcaagaaagtggggactttagtcctacagcaggaaggaactgaattctgccaataattgaatgagttttgaagaggaccctgtgctccaggtgatacaatacttcagtgtattccataactgcctaatcatatggaacagcacttttggaacaaataaagctagcaaaatatttttgttacaacttgatgaatgtacaaatattattttttataaatgtgcaacctttgaacagcatgatgaaatgaagggaaaaatatttttttcaacctcactgctggctgacaaacacatctagctctaaactgtgcaaaccaaaaaaaggatgagattgtcagcaaacatcacctggagtttgtctggtggagtgtgttccaaaggctctgctatgggaagtatccggttgtatctgcccagattaaggagcctatatcagaatagtaatgcacgttgtcaagaaagtcttgctatgaaaatagtgtcagttaaactgaaaatagtttcagttacactgaacagtggtgttagtagcataataaaattttgaattactttaaggccaatgtggtaaacttgctattattctttatattatgtgatactatggcagattatcataactgttattgcatgctgtagtgcagtggttattgggggaaaatgtctgtcaaatatttttcatgaactcaatgcttccaaacggggaaagatattttttcatgatagatatgatcaaagagcacaaacaaaagttaaaatcttagaggtacacaatttctgtgatatgtttcacaatttaataataattatcggcccagctcggtggtgcatgcctataatcccagcactttgggaggccgaggagagaggatagcttgagaccaggagtttgagaccagcctgggcaatgtagtgagaccccgtctatacaaaaaattaaaaaattaaccaggcatggtggcatgtgcctgtagtcccagctactcaggaggctgaggtgggaagattgcttaagcccaggaagtttaggttgctgtgagctgtgattgtgcctactgcactccagcctgagcaacagagcaagaccctttttcaaagaaaaaaattattaagtattctgatctttaggaatgatctgattttgttcatctttcaagttatcacctgtcattttatggattgggcagactattttatattttattttccagcaatagaagattcacaggtagcaaattaatggatctggaatccatttctgtcattgaaatataacttacatcttattttaactatacaaaatgtagaagagttttcattccatcaacatacctgtgtgacactactttctcctctttgagtgttattgacataaaacaaaaacaatttaagtatttattattcccgagttgctttattgccagttcaccttagattagataaattaacaagcaaaaagctcattgtcaacatcataaactttatttataatcgcagtatttgttcaaaatattcatataggcatttgggacgtgaggatcactctttacctaaaattttttgtttagttatgttgtgtaatgaagaaaagttacaagtgtaatagtagttgtctaaattaatcaccagttcactttcggtgaacaacacaggccatttttataattgtattctttttctttgtgctatttttgtctaattatatttattgatatgtaattttatgtctgcctaatcaaataacaaaaacagttgtgctgtttttgttttaaaaacaaaacaaagttttaaaagtttaaactttaacttaaactaaaactttaacaaagttttaaagtttaaaagtagttttaaaattttttattttttcagtaatttacaattggtaaataaaatttcatattttattttctaaatgtgtcagcgaatgatggatttaggacataaaagtaaattttcacaaatagtttgagaaacccttttctggactactcttcagctccttcacaccccactcccttctttcagctcctttttgagactttaagaaaactctgaattagctctctggtctctctctttaaattttgatgtaatcccttagttcagactcaaatcccttcttgaagtattgccatagtttcttcattggactcttagtttctaggctttctctcggtttattactgacaattttggaaataacactaatatataatacaacatagtaacagtaagtataatttatgtaccattttaatataataaatattttataatatataataactataataaagtaatttttcttcctaaaattctcaaaaggctccctgtaatttttgggacaaagttaaaatgccttaacatggcaaaactattctaattctgacttgactcaattacaataatcatctccaaagtgggttccttacttctcttactgatcgttattcttttatttttacagttttgctgcctatttcatggttttaaaagataaagcagattatgtcctttcttgacataaaatttctagtagtatttagagtaacatttcacaagggccctagataagatgactattgactacgtttccaactttatctcatgctattctttcttttgctcactatgaaaccatcagactaccttctagttttttaatcatgccaagcattttcatgcctcaggatgtttgtattttgttcctggcttttggctcttttccctgttttctgtgtgactggtacctactcattcttcaggtcacctcctccgagaggccttcccttactcctgtaactgagtagcttcctttccattattattctttctcatatcatcttgttttatttcctttcttctattcagtgctttgtttaatcgtttattagaatgtatgcttcaagagggtaatcataactaacttttttttagtttatgtatttatggtgtacaatgtgatatactgatatttgtatgcattagggaatgattaagtcaagctaattaatgtcttcatcacctcacgtatcattttttttttttttgtggtaagaatgtttaaagtttattctcagcagttttcaagtactgatacattattaactatagtcaccatgctggaaaatagatcaccagcattgattccgtctctgtaactgaaacattggtccttttggtgaacatcttcccagtccctagtaaccactattctactctttacttctgtgagttcaactttttaagattccctatataagtaaaattatacctatatttgtctttttatgtctgacttaatttaatgcagtattctccagattcatccatgttgtcataaatgacaggagtttctttttttatgggtgaatagtgttccattgtgtatatacattttatttattcattcatctcttcgtcaatagacacttgattccatattttgactattgtgaataatgctgcaatgaacattggggtgcacatacctctttcaaatactgatttcatatcacttggatatataccctgaagtggaattattgaatcgtatggtagttctgtttttaattgtttgaagaatctcaataccattttccataatagctgtcctaattttcattcctatcaacagtgtgcaagggttcccttttcttcacatcttctccaacacctatattttactttttgtttttttttttttttttggttgtttttttttgagatggagtctcactttgtcaccctggcttgagtgcagtggtgcgatcctggctcactgcaacctccacctcccgggttcaagtgattgtaccgctcagcttcctgagtagcttggattacaggcacgccccaccatgctgggctaatttttgtatttttagtagagacgaggtttcaccatcttggccaggctgggcttgaactccccaccccaagtgatccacctgcctgtgcctcccaaagtgctgtgattacagatgtgagccactgcacctggccacattttcaataatagccatcctgtgtgaggtgatatttctttgcagttttaatttgtattcctctaataattagcgaagttgagcattttttatatacctgttagctgtttgtcttcttttgagaaatgtctattcaagttatttgcctatgctttaattgggttatttgttttgttgctgttgagctgagttccttatatattttggatattaaacctttatcagatatataattatatatgttggcattttattattagtattattggttgcctctattccattataaaagtgcatgatacattttaataggatttatgagaagaaaaggaaaaagagtaaaaacaagctagggcaagagaaaagcaaaatacatatatatgaatatattgtaagctctagtcgataatttatttaaaatataaaaattataactacattaaaatttgagttctaaacattacttgtaagtggaacttcgggaagagcaaagtaagaacctccaaaatactgcttttctaaaagtagtattttcaaaatactactttttttatgttatttaaaataagaacactggcaaaaactgtcaaaatcaactttttcagttctttggaaagcaatcagaggtttacaacaacccagaggctgttaattcaagaaaaactctagacctttataagaacagcaagatttagagtgatttaactcaccctgttgccatctacctttcctcagctctgtggtagctttgaaaaccagaggccagacaccagtggtagttttgaaaaccagtagtctagcagccactgaggataggagtgggagtaggttaggtttagaatttcttagaaagtctcgaccttagagcattataactatttgaactgtatggaatcttcctggaaaactccattcacagggcttattattatttgacctaatctagagcttgtttagtgagaaaagcctgtctccaaggtatttgttgaaaataatcagcttttttctttaatgttgcaactgctcgaagtgacagtgccagttggggcaaacaagaaccttgcctaaaagcttaaacagatgtgagaatgagatatccatattcccagggctgtcctcaggcccagggaagacctgagaaggcctcagtctctcacctttggctgaccttgaggcccagcacaagaaggaagcgcaggctaagagagagttttaaaccatgagaacattgcaagcatacccaaacacacacacacagagcctgtggcaaagggtggaacatttattggttcaagacatttaagacaatgtctgtgcaatcattagctgaccactaggttaactgagcagagacttaagtggctgcagatgatggaaaacagattttacagaattagttcaggaaaatgaataaacagaacaagaacaaactgtaggtggggtcagattttcatgattgccacattatgttatttaaaatatccagtttacaacaaaaagaattatgagacaagcaaagaaataggaaagtatggtcaatacacagggggaacaaagcagttgatataaaatgcccctgaggaagcccagatacagaacttactagacggacactttaaaccagctattttacatatgctcaagtaattacaggaagcattttctaaagaactaaaggtataagagcgatatctcaccaaaaggaggataccaataaagatatatgtaataaagaaccaaatagaaattctggagttgaaaattgtaataactgaaatgaaaaattcacttagaggggttcagcagaagatctgagctggcaggaaaagaatcagcaacatgaagatagttcaattgtgtttatcctacgctggggaacagaacaaagaaagaatgaagaaaagtgaacagagcctcacagacctttgtgacactattaagttgaaccaacatatgtatactgggagtcccagaggaaagaagagaaaaagaaaggagcagaaagaaaatttgaagaaatattggcctgaaaactccctacagttgatgaaaatcattaatatatatgtctaaaaagctcaatgcactccaagtaggataaactcaagagagacccacatgttgacacagcgtagtcaaaacatcaattagaagattttcttggctcttaattttcattttgtctcttatgggcgtataagttagtaataatatttaattcctgaagttgtattcttttcatacacttagtgtagcaagcaaacaaaataaatcatatataaataatcgcaaataattcattgcagtatttttgtttaaaatgaactttaatgaggatttaaaatctttttgtgtattttttttcctctttggagttaagatatttaattaattttgcatttatggatttaatataaacaaaatgtgtaagttagttacatatagcttttttatgtttcattttaaattacagtgatttagtttgcttatattattatttgaagtgccaaagcttaatataatttttagtgctatactaacaaggtgctgtatgtttctttcatgatattccttatttagagagtttggaaaatggcaatttcagtaatttaatatgtaagacatattgaaattcttcataaatcatggtaaaacaggatttttggaggaaggaatgtgatatgtgaagtcaccgtgtaaatatcatgtcatttgctgaagttgtcctcatatttttctcaaaatgtattagatgaactcattatagtcaatgaaaaacagtaagaaaaagagacatctggcatccaaatgcctgtttctgacaaggttaagatcactctggctagtaatgtttctgctctgtgtactgacattgcctgttgctacagaaactgataagagctattgaaaacttacatgcctgtgattaatataacctacacagatgcaatcatttatagtttttctgcagttcatgcctaacttcctatttgaatcatggattaaatcctcaaagtactttagtgtcacaaagaggtattctggaaacacgagttatctaagttgaagtttatggtatcaactgagagcatgttctgttaaagatgtaaatgcatactgagaaatatgtaggttttttgactactgatctgtttttttattgctattataaaatatcctattggcatttagttttatttctatgtaatatcacagcgtgtatgctttacaaaacatatttatttgaataaaagtcattgaaatatcaaaattactacttcctttttgaaatcattcttttatcagcctcaataaaaataaaattgagatgtttttagtactatgtaaatattttgatgagctatttgaaaatattctaatatttgatttctagaaacttctaattgtgttttgtaatctagagatcaacatttatattgaagtttcaactatctagttagaaagttaaacattttaatatccattgtaagtcaaatagttgagcagaaaagcaaaatattatgtagttggtggcaaaagtcttttgatgtggtagcttgtgaacaccaaatcagattttatttccttaggtattttgtttgctagtgaaatgcttatattccagtctaatatagcttgagaagtttaaactttttgtatagctgttaatgtaacatgtcatatataacgatacttagacattatattaatggaaagtcaaaacactagaccatatctgtaaattagctaaattcacactaagtgttagatatgattgtatgacttctgataattaaactctataaaaattagcccatgctagtaaccatgacactgttttgtttttgttgttgttaaagtttttgtttctgcatttacattttctgtcctcttgtcgctataactatttaaactatttaattctctcctgatactttgctgcaattgttttctctcaaaaaatgtacaatccatagatacaaatgtatgttaaaatatattcagtggtatctctaatagtgaaaataactgcctcagtcatcttatcttctcattctagatttgtaggttattttatcaacttccaaaattttggctattgcctcagtttgaatgatcccaaaatgtacggctattcttcttttgacctacagatataaatatcttagagattctgtagactaaaagtgattcaaaatttagttaattattttcctgaagaaatctcattttcttcctttctcagttagtgacgtattaccactctttttcttaacctagatatttcagaaatacccttagtcttctcctccttctcatttatagggttactattctaatttaagtcttagtcttctctgacaagattttattaaaaatgccaaactattgtctttacttcttacctgtttccttctctagtcctttgcctactattattgacattgtcttgtcaaatgcagttattttaatttttaatcttggaagcagtaaagaatctaccctgattttcacattggtcatccaatatgaatgtttgaatattattatcatattccacagattaatctattctttcagtctatcatctttgaccaaactaacaaataaacaaacaaaatttaaatctattcaacaaatatgaggaaaactatgatataacattgcattgtgataaatgcatattttaagtcagtttaaattagtatttgatattaggaatattgaataatatgaggatgttatttattcctaatttaatgtatagatttgatataatttgactcaaaagaaaagggggagaaaaaaatgggagattttatttcaaaacctggcaacatttttctgatgcttatcctagaaaaagtattataaattcacaccctcaggaaatctgaatggtatgccattagtttaaattcaagcaattaaaaaaactgtctaatagacaacacccaagaattgagtctgttactgacaaaatcccttcatattgtttttaattttttagtatgtgtgtacaaaactttcagaagctgtgatcacacccaacaattctatcatcagaacaacacttctactagagatttcacaaaagattttgtgagatgtcttgctgacatcaaggtagcctattttcctgttgggcagtttcctggtttcttgtcctaacaacctttgaattcaaagaaacaagcaaataataacaaaatctaagagaagttatatagaatttactgattttcaatttttaggagatctttgaaataatttagtctgtgcttctcattttcaaagattatgaaactttcaaacttaaatgcaagtttaagcaatacaaatagctaacatttactgagcttctactttaaagtgagaactgcagtgaatttacatatagtagcttaatggtatcttactttattcaaaacgattaagttaaggactgttatctccattatacttagatgagatacacttttcaaggttatcgtttagaatttggtaacattttattatatggagaactttattacattaacctttgtatgatgaaatttgatagaaatttaacattttaaagatttttttatttcattacttttagttgttaatattatatgtgtatttcattatctgtgtagttatatgcacatatatgtttctgatttaattttcacaaattgaaatttatatttatttacaaagaatgagcatgagtattccaaaatataggccttgtccttgaggaacattattatattattaatgtatttattcttttgaactaatcatttgacttgctttgcattttgcaagtgtgtcagaattttacgtattgtaattttaaaatgatcttcgattatcttgaatatttcagatattattagttattgaagtaccaaagaaagtataaaaatgactttatatttttaaggaaactaatagagaaatataagaatttctcttctatgattggcagctaacaatcaaaggataagaggggaacatcatataattattatttataagctgctttaggaaattgttataggaactatttcctgatgcttttgaaggcatcagttttgaaatgccagatgatttaagaagcaagaggattattttgatgctccctgaacaaaatagtaggtgtattggatgatatctttttgtttttttttttgtttttttgagatggagttttgctcttgttgcccaggcaggagtgcagtggcatgatttcagttcactgcaacatccaccttccaggttcaagcaattctcctgcctcagcctcccgagtagctgggattagacgtatcccaccgtgcctagcttatttttgtgtttttagtagagacggggtttcgccatgttggccaggctggtctcgaactcctgacctcaggtgatccatctgcctcagcctcccaaagtgctggggttacaggcatgagccatcatgtctggctggatgatatctttcaactgagttgtgttactactatgcacatccgtttagcaattttttgtttctacaggttttgttttctttatttgaatatatgaaaacatttgattaataatacaagatttttactttcaaagcttttttctaacctagtttctttcattacagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggtaggtactgaacttattattcacagggctttatacataaaaggaaaattagactttgttaattttaaaatataaggaagatcttgaaaactttattaacgtagattcttattacaaagacaatcaaaatgatggctcaacctaatcttataataagacatcttaataatacatcttaaagaagaggtttcaatgtgatatgatggatagcacattgaattggaagtagggaaacatggattatggttatattccattatcaaaggactacagtacatcggggtgttatttttctctttggacttagtcgtttcatgtacataatggggaaggggatgggtcacatctgtccaaggtttatcctggctctgaaattccattataatattataaaatactataataattgttggagattatatgacatgctttaagtgataatatttaaatttgaaccttaaatggaagtatatggaaaaattttaaaattgtttgtggtcatcttctttatgagatttccaataccaatgtaaaagctgtattttgaagcatgtatttaaaagtaaatatttttgaaaggtattttggcattttaggtatcgaaactatttataacatggcccatatgtcatatatctacattcaaatgttaaatcatgcaaggaatttttttaaggaacaattaactttttattccagtatacattcaataaaaatgatagttcacagaagcagaataagatattttagaacctaataccctagtcatctaatatcttccactatttaaaaacatgtgcaagattagaagaatattttagtcactaattactaacagtagtacttaacattgatcactggggttaatgcctattccaaataatgtttgcgtgttaatgtattaactgaaaaatgtgatggcttaccttttaaagtaaatcattgttattgatgttttaaaacatcttttcataccaaaaatttatgtatatgtatgaggtgattgacaagcaagtgttttttttgttttagaaagacaagatcaaattaggaaataaaatgtttctaaatggaaatgtcaaagtatatagtcaaaaaataatatctattccatattgctttctctaaagtagccagactgctcttgttctaagtaacattttagtttaggggtagaggatgtggcggtatagtcatttcagtttggatgaatacccttttttttttgtttttgagatggagtctcactctgtcacccaggctagagtgcagtggtgcgatcttggctcactgcaacctccacctcctgggttcaagcaattctctcctcagcctcctgagtagcacctgccaccacgcctggctaatttttgtatttttagtagagacggggtttcaacatcttggccaggctggtcttgaactctgacctcatgatccacccgcctttgcctcccaaagtgctaggattacaggcgtgcgccaccgcacctggccgaattacccttttaatacacaatataatttaaactttgcctgtaaacacttttgccagtgttttacaaatacgtcttgaaaatctgttgtggaaaatgttaagtggcactggttatcatgcagaatataaagatgaataaaattagttttatcttctatgaatttagagagtagtaagaagatgtttgcaaataattgctataatagataaaatgtgtggtgtcagaagttttaaaaagtaaaaaatggtaggactataaaatgtaagaaatatttttctttttttggtattttggtattaatattgtgtttggatgttcattcatatagtgatgttccctgggtgttccttatgatgtttcacatttatttcacctttttcacatatttggtttatgttttcacgatatgcctatatgtgtgtttataagtttgtataaacatatgcatgtaagtatatgtacttgtgtatttctataagcctataaggtaatatatagtaatttaagttttgtattctagttaattttaaattatatctttaaatgttggtaaaatacaaaccaataaatacagatgattattgtgatttacatatgaaaatccaatgaaataaacattaagtaaaattttttgttttaatttggattattgttagaatgagttttttaattaaaactttaaaaagcagtcacctgagtgctaatattcttagctactcaaaatttattatacttttgagaatattgctttaagaaaaatacagctttttatgttcctatagcatttgtacaaaatgcagtaggagtggaatcattattctaaattgcataagtacaaatgaaatggaagagcacaaagcatatttcagttctttttaggaaaagagtctctagtgtagttaatatatgcaatagctcaagtactatcaaatgtaaatgatgaggtgatattgatgaaaggaggggattgaggtctcgggggcgctgatgacggattgaacagaagcggccttgcactgcacgtaactcaagtctgtcgtcttcactactcaaagccataatgggaggtggcagtttgaaatgagttgccacggcaaagagtattatttttgaaatgctttcacacaaatcactaggccctgcatacaacttagtttcatgctttaatgtcatcaggaggcacaaattggtgtgtctaattgtttgccacctgccagcaaaatgagctgccagccagccagacgggtttgattgtctgtcagccattcaatagattgagagtgacaacatcaaaaatttaacttcaaactctgaagctttgagcagcttttcagagacatcatccccacaagtgcttctggaccagtgcatttttcaattatacttccagggtattgctaccatttgccttatctgtcttaaggtagctataattacattatgaggtatataaacatgtttctgaagcactaatgtctgaaatccaagttatgacatgtcttttaacatcagattgaattcgttgaaaatgagatccaggatgacaggctttagaatgaaagtcctgaatgctaccggtttcaaacacagaatctatcatgggtcttactttaccaataacgtgtttttcattttaatctttagttgaaaagtagatataaactcagttggtcgcttctttgtaactaaatcacactcctaataatattgtacagtctcaatagaattcatgtaggattttacttttgttaaccagttgtttattgattatattgcagacatgctaacaatgatttccttatacttatcctggattttaaatttggaaataatttcctagaacaactgggataatttgagttatgttaacttgtgttctacgtcgagtgtatctcaccccttaggatggagcattggtgaatttcagtgttttgaagtttataataaaaaattgcaacatcaaattcttagaaacatttagacttaattaaaataaaccttttttctttactattacatatttcatcagattatgaaatattacataaatgttctgtacatataaggaaagtactgattctttttctatttccttcagtcatctgtgcagattaagtatatatctttgattatactcagtgatccgaacagatgtgtactcatgaagtattaaaatgctagagatcctctagtactgttctataatgagcaaacactgtatgtaaagaggaaatacaatcataaaactataacaattttttcaaagttctgttactgtgaggcagagagaaatatttatgatggttttatttttaacagaaaagcttaataatctcattttagaattcttaaatcaagttgccaagttctctaacaatactatctctttagatagattgctatatttatcgatggtttataaaatgttttaattgagctattatttttcatgtactgtgtaacttttactttggagtaatgcttttatctaaagccaccaattaaccttttacttaccttttaaactaaaaatttaatcttatatatctgcatgctttttatcttttgagtgtttggtatatatatatatctatgttttggtttagttttaacttcctaggatttccagagattcccacttagtttgaacaaaagacaaaaaaaaaaaaaaatagagggcaatgtgcttctcatacatttttaactgttagtatgtttttaaaaattgttttaagtgtgtgatatcacacaaagcttatagttgtgttgcttctttggctaacagacctcaaacttacacttcactttttcagattttgcaaacctcctgtattcaaattactgggtttgatatattcagggaaactagtaggtattttttcctcaaaattttaatatccttgcttcccagtgtttaattatctgaaaaagaaaaatctattttgtaaataatatagggccaaaaaagcaacttagatagacttcatattattaaccatgaagtataagcttgagctaggtattttctctttagtttcattagtattctaatattgatattagtggtaaggatgaaatttcagggtaaatatttttaaaaatattgagtagagttaatgaggtcttatgttgatttatttaaagttagaattaagtaactatgaaaaattataattacttctgaagacttcaatttgttcttattactatttttttaaaaaagtattttgaccctatcacttaaaagatgaacaaataaacgtaagccaaattgattattcatcttccagcctttacaattgaaattttctacatctagccactgtaatttctgcttttattatgctgcaagtgccctgagtatatattttaaggtcaattgctggaagattcagttttgactgagcatgtttgtgtcctcatttccccaatgttgttgactttgtgtctcctggcatttatagagagctgaataaagttcagtgagctgaataaagtatctctcattaataggtgatttaatgagattctttattgtttcttaaacatatttttttatattgcaattctcaaatattttacaaaataaggaagcatgatagataacatcatgagagcattcaccttgcgatttctgatgaactgaagtaaattgtcatgttatcctagaatcagtaacaaattatttttctcttttaagtttcaacgttttctttcaagatacatatttaacatccacatcctagttagagagtgataatctggaaattaggggaactggatattaatagttggtctctcttcaatttgttccaggaccttgatccattctttttggctctctggaactcagtttcccaacccatataatatgatataaagctacatgatttctaaaaagtctcataaatttccaaaatcctatttaaatgaaatgggcttattattagtcccccaaagcaacagatagatattttcgagcttggctaaaagatttgaatcccagaaaaggtgcatctccattctcaaactacattagcccctcagcgtctctaaggtggattctttctgttacctcctaactgccctcactatttccatgtttcctctctcaccccaaatttatcttttacatttatgccatagacatttttctaaagtgtgaagctgatgaaaattctgaaataattcttgttatttatataataaaggaggattattttagtttggaatagaaagtccacacctttcaccagccagaagtatctaaagcaattcctttaacctaccttgttttttcatgtctctttgccttgctaggtttttactattaaatttttgtatgcacttttccctacttggttaatttctattgatccttttcatttcagcccactcttccttgattgtgcacagcctgtgttcctgaaaggtcctgggcataactctgaccaggtcaattattgaaatatattgcatggtcagtttgtgtgtcatattccttaaagtatctaaggaatatgccccagggcatggggcatgtattatttgtcttgtgtctcccaaacttagtgtaatcccctgttagtgctcaaacagtagaagggaacagaaagaacgggattcttatagtgtgccatgaataattataaaactcacttgccttaatgagtcactgtttaaaagctctttcttatcttcagtatctccgtttgtacctaggataaaccatgatgtacacagataagatagtatccctgtttttacaaaatttaccgaactgtttaatggagactgccaataccctatccttataccacttttcctgtccctttgcattcacttctttggccatctcatccactctcctggcattaaatagcatctgtatgctgatgactcttatatttatatcttagtttgaacctcttttctaaactagagacttatctatccaattgcttattcaacattgctatttggatgattaaaaagaggtataaaaaattagtataagaaagctgctccaaccatattcttccctatcttagttaatggcaacttgtcctttctgttacttaaggcaaatttttttgcataatccttgactttactctcatgttcacctccagttcttatttaaatcttatttgctctgccttcttaatattgccaaaatttgaatcacttctcaccaggttttactttgctattccactccaaaccaccatcatttcttgtttgtagtattgtagtctcctagccattctccacagtaaccattgtccctcctaagactatctgtgacatagcagccagagtagtcctattataacataaggttatatccttctgtgcataagccttcatggtttctcatccctctctgaataaaagccagcatctatacaatggactacaaggccctgtgaactcagccctcttacttatctcatctcttacagctctccatgtcacccagtattctcttgtcacactagcctttgtactgttacctctgcctgtgatgctcttctctagatagcctcctggcttattctttcacccccttcagtgttctctcaaatactaccattttttgtcaatcttctctgagccgccctttcaacattattccttcttcttatctatgctttatttttcttacagcacttaacatctgatatactatatttactcatttatgttactgtatttgctatatctctgtattgaaatgtcagttccatgagagcagggattttattctatatattgctatatctccagaacttacgtcagttccacacacattgcaatgctcaataaatatttgttgaatgaatgagtgaatgtatcacctctagctttgagataggataaattcaatgatggaagaattcacacttacatgtattacttattagtcaatttattaaaatcatataatcaattaatgaaatattttatcaagtgaattagattgaaatatgtcctggcttataccactttgatgataacttttacaaccttggagtgtgtatagattctatgtagtataaaagaattatccactttcttgtagttaagagtcttaaagatgtgtgatagaagtttgaaattgtgtggaaagcatagtattgagattttttaaaaaattccattggtaaggaatatgtagaatagagcaggggtccccacccctgggccatggactggtaccggtctgtggcctgtcaggaaccagacagcaggaggtaagcagtgggcaagtaaacaaagcttcatctgcatttacagctgctcctcattgctcgcattactgcctgagctctgtttcctgtcagatcagtggtggcattggattcttctaggagtacaaaccctactgtgaactgtgcatgtgagggatcaaggttaagtactccttatgataatctaatgcctgatgatctgtgactgtattagtttgttttcacactgctgataaagacataccgaagcctgggaaggaataaaaggtttaattggacttacagttccacatggctggggaggcctcagaatcatggcaggagtgaaaggcgcttcttatatggtggtagcaagagaaaatgaagaagcagcagaagtggaaacccctgataaacccatcagatctcatgagacttattcactatcacgagaataacacaggaaagaccggccctcgtgattcaattacctgcctgcccctaggtccctcccacaacatgtgggaagtctgggagatacaattaaagttgagatttgggtggggacacagccaaaccatatcagtcactggtgccaaaagctttggggaccactggagtagaggattcaaggtatccgtcaggatgaatagcagatctaaaagaagagcataatacctgaatagtttagttcaatggctcttaacctttttgtggctatgtatgtttttgaaattcattaaaaactatatgttcactctaaaaaaatgtttttaccaccaaaatttgtatatattttagtgtatttatctaccctaaataggttacccacagtaggtacctagacttctaggtaagatttttttggtgtagatggaatagatagccagtgtgaaacgttgtgtaacaatctgatagaagattttataagagttgaaaatttttactctcatatatgaatagttgctaataccaagtaacattttaaaagataattaatttgttatcaacacatactggttagtgtggactttcaaattaattgtaagattgattgctaagaaagagaatggtttgagataaaagggaaggggtaatgttggtgaagaaacaatattaaggacaagaacgtgcagtcctttagtcctagataaacagtttggccatctgaatcaaaggggaaatagttcttacaaactcataatgtaggtgcagaaaaagatcggagaaatcggtcaaatacaggttcctgcttctctcaactaaacccttgtaacttggtcatctcagccatttgaacacataagtgattagaaactggaattcataaaaattatcagagatttttttcttcttgttggtcctaatttggtattctgaagtacatggaagtttcattttgttttcttatcagactttcagattttttaaaaatgctgtaactttttctcacccttttactgtaattttctgtcctttcagcctttcctcatatgacttgttttccagatcaactgtcatcctaactgttctcttagggacatgattctgtttgtcattatccttgaaatatagtgcctaaaactacacgtatgagatatgacaatagcagagtatatgaggattattgcttctttcagtctgggtatttttgctgatatagacccagactatatcagcacttttgggagccatagcaatactcgtaatagctaaaatgtattggctgcttagaatattccatggactgtgctaagtactttatatgtgttacctccttttatctttataacaatcttattgcacccttttataacaatctttatagcaatcttaagtttatgatgatattaccattatgcatctcattttaatggggaggagaatgaagcttagagagatctatgtgcccaataccacgtagtaactgctgaaggtagaattctaacccgggtctgtagggttagaattctgtgccatactgtcaaactctgctgagtttgcaagcaatgaaatatctggaggctttcacatcaattgctattaattcagtgctttgagatttttagtaggcatttaacctgtctatattttacttataagtcataattatgggatttagagattttttttctctcggtctcataacttatttttcctaatataacttatttctcatagcttccacattagacaagataccagtctgttacagagagcttttgctcaaagttagtaatgatcaacagatcagaaatttatagtaatagtttttctaccttctgcaaattcatctcatagcactgttaattagctcatgattctttatccataaataaacatctttgtgtctgctgttctaaaaaaatcatgagagatgcagaaaaaagagcattatactttcactaatgacttatcttcaaatcgacagttgatggttttgttttcttgctggagagtcaatgaaatagtacatctcacattattttataagtttagaggagaattttgataacaaactccaaatattggcaagttccttttttctgttgatttttatgtagatcattataagtagatgccttatatctcatagacaaaaatatatttcactttagacagtggtaatgattattaacatttataatacacttcataattgacaaagtccatttaaatatgatctcatttaatctccccaattgtatgcgaaggaggtagcattagtcttacgattttacactcaaaaaaatgtaagatcatacagtttgagagtggtccagttttcaagccttagttttgaaatatagtccacatcttatattcttttctgcaatgtcacactacctctcaatgaaataaacgaaggcattagatgaggacttgccaatatagggaatgaaggcataatgtgtgctttaggtaattagatagatagttgagaattaaaggttgagtctaaagaatttgacaccaacatgcttaaagagaaaagaagaaagtacctagaaggagatagtgaagaaattttttggcatgagtaaaactatttaagattataataccttaattatattaaggtattatacaaaatgttttaagtatttctaaaattaagaataataattattacaaatatagattattaacattaaagaagtcactgaagatattaacaaaaccacttatttgtggaaaaaaaagtgttgatattaaggaagtttaagcaacaaacttatttgagaaaggaccattgatgtagttttctttaggtagatttttttcattgagtaagtatgaaatagagatgcattaaaaagatgtaaatcaagttggatattttagtactgtcagttaccagtttccaagcattacatttgattaaaatagatcataaatctatttgtagatgaataaattctgtgatggttgagtaaggtttggaagatatttgctaaatgaagtttgcagtgctataaactttgagaagaatgaacctttactgcaagaaaatttagatatttattaagttagagaagtagtttctttatacatttttaaaaactgactaatatccatatttatttgtcatttaaccttaacacaatgtcaaattcagaaatttttaaatgaaatacatttaaaatacgctaaagaaacctggggaaatgttgaactcctctgttaaagaaaccaaggctcaaaagtgaaataaacttctaaccaaatgtctctctatcatctctgttctctttcattctaataatattcctactataaaagcaactcaattttgttcagaaaaataaagcataactttattgtgctcttagaagtttatttattattccttggtttaattttcagctttactatgaagaagctttagaatttggcatttaaagtctgggcacggtggctcacgcctgtaatcccagcactttgggaggccaagtggatggatcacctgaggtcaggagtttgagaccagcctgaccaacatagtgaaaccccgtctctactaaaaatacaaaaattacctgagtgtggtggcacgtagctgtaatcccagctacttgggaggctgacacgggagaatcacttgaacccaggaggcagagattgtagtgagccgagatggcaccactgtgctctgcctgggtgaccgagtgaaattctgtctcaaaaaaacaaacaaacaaaaaatcaaaaaacaaaaaaagaatttggcattcaaatgttttatgtttttacatatttatgaatattttaaacatggagaatgtgatatgggtaagatggacattttttatgtatattttgccaaaaattctatgtgcaaaggcaaaatctcctaactttagcacaaatttcttaatattcccagatttatgatcacagtccatttgccatcttaagaaaggtttgcagactcctaagtcttcaaaaatgttggccaaatcaattaggcaacacactttataatatatccttaatgtccatatcctttccactgacaaagctggactaaggagtttaaaatttttttttaattaaaagaagagagggagaaattcgatgttgactatgtatatctgttgcagcaggattataattcatcttcaacctcatgtttgttattttcaatccttcatttctttgcaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtattgtacttacatatttttgtgatactcatctttttatgttttctgtatcatttttctgcttatttgatcttaaaaattaaaataccctaatcatttaagattatcttaatttttaagaaggttatattttatgttatgacttttagaatttgtctgtagttgtagagtgcattttttagtggtcattttagaggacagtattggttttgagtcttctcaaaacagtgctgtttattttcagagtgaaatcagattactgaaagatatttggggagcagaagcaaaggataatttgaacactgaagtttgatatgtaaaaatcagtaaaatgtatcaagaatatcaagatgtactaaaaatgttagtgacagaaagtagatttggggacatgattggttgagttctaatatatattctttgctaaatcccctaagggaggcagagctcccctaagaaccttgacgatatgcaagcgcctcaacttgataaaaagtgcatgtgaataagaaccattgtttgacgttgaattaattcatatacatagattataacttgatccaattcattgcccaacaaattcctaatgaatctaggaacaaaaaatttcaaatcaattacaaatattaaaagtctgcctaaaataaccttttttttttgtaaatttccagaaatgttcctgttgattattagctaaataaatccttacccaaatctttgtgattccattttaggtatttatacagcgcaagatgatccctgacttttcttccctgactatagtagtcttctcttctccaaactgtatagccttgaacttttccatttattatcattacttagattcttcccatttttattaatttcatagctcttttttgtgctttctgtatctatcttgtttatcataccacctgagtctgacatatcatgaacaacacatttatggggttgtagtaagtagaatgtactctattaagaatatttatattggcaaatgaatgtcattaatggcattgtgtcaaagaatagaccatctattgtttacctgtattataaatagatatttctatctggcttgtctgaagactttaaagtctttccagtattagagtttcattctttatactcattcagctttctagaaataggagtaaaactgtttttcttttactaaagtatatacgttaaaagtgtaaaggttttaaaaatatgaataaagtccttattcttgttaggagttaggcaaatgcaaaatgaaatcaccttttttatttttatatgagacaagtcatgatgttttctttttaatttctattttaagaattaataatatggaaagtgatggtagcaagagttttgatgataatataaagtatataatattataatgagaaaaatgtaagtgataaacttcttaaaagtgtgtgtgtgtgtgtgtatgtgtgtgtgtataaattgtgagccaacagctaaagactgggcatactgttcatttcaaatattggcacataggtgctataaaatgttatagtggaaatcccagtaagcaattcagttttatgggaattagtataagataataatatttaggaacactagatgtccctcaactccacagctacttaatatacttacgtggcatatgatagaaaaatctttactaaaatggcatctttatatcattgagggaagactcattattttaagaccaggtactaatgtaactcattatagcccttcttaagcagtgatcttatcaaaaggagcattagatgcttcagtgccacaaatttacgctcagatagttcactccaaactatgtcttaaatgatgaaaaccaaaaatattacaatgtagctataaaaagataagtttttcacccctaagtttgcattgttttatcagcatcattttatcgaaaaattttttcatttcttgatgttttttatttataccccatttgtagtatgtagttttgttagattaatgtaagtaaatcaattagatttcaatgcaacatctgttatataaaattatgttcattagcatacttactaatggccaaatgattaattgtcaaattcggttttgaaaatctgatgagtaattctttcaaaatcagatagtaatggtgtaattaaaatttttttaaataaatttatgtttaaggctaaaaattattattttgggaacaggtgccgtggattcagggtcctcctcctcttcctcctcttctagttttgtgaatggtgctactagcaaaaaccttccagctgtacaaactgttgctccaatgccagaagattcagctgaaaatatgaggtatgcatgactactttttattcattttaactctttttaaatgtagtgaaacagtacacaaaaatacaaaaatatagaaagagttcttgagaatgaaggttaattattttgtgattacatttcacaattctgatatttttggctagttattatgtaaaaatctatgatatatttcgatctaagcagagatcttcagtgattttaaaatgttcactgtcgtatagtgtatagtaattcactgtcatttagtgcatgttactatttccggtaaaggttaaaacatgtacaaatggtaacatgataaaattgggcatctttggggggtgataaaaagtttaaaatataaactttcaggctaggtgtggtggctcacgcctgtaatcccagcactttggaaggccgaggagggcagatcacttgaggccagaagttggagaccagcctggaaaacatggtgaaaccttgtctttactaaaaatacaaaacttagcagggtgtggtggtgcacgcctgtaatcccagccactcgggagggaggctagggcaggagaatcacttgaacccgggaggcagaggttgcagtgagcctagatcacaccactgcactccagcctgggttgacagagtgagactgcatctcaaataaataaataaataaacaaataaacaaacaaactaagtaactttcaaaataaatctacaatgttatatataacatcattggaacttgaataagcaaacattaccttatctgtcatgattaaagaccattcctagaagagactggccctcattcttggagtaagattgtgtatacgtgtacacacacacacacacacacacacacgtatgtattcacagtttttatagaagtataacacaaatatagaatataaaagcttattgaaagaatgaacacactcatcatcaacaaagtcaacaaatagactgtacaccaggaacgcctactttgcacttttttcccagtcactgttcttgcttttcttccaattccttaccctgacttttaatactaagctagttttgtcctttttgaattttatgtaaatgtaagtacatcctatgtatttctttgtctctggcttcttttgttcaacattatttttatgagattcatctactattgttgcatataacgagtttattcatttattctccttttatttatttatgtgtctataccataatttattaattcattttactgatgatgggcatttggaattttccatttcttagttattacaaataatactgctatatagataaggccacttataattactatgagtatactactattacatgtgtgtactgcacattaatatgcatatttgttagataatttggagtgtaattgctgattcgtagtgtttgtatatgttcagttttactagataatgcaaaatggtttgcaaaagtggttgtactagtttactaactcagcagctgattatgagaggtcttgttgcttcatatctttgataggacttagtatttagtctctgtcattttagccattttggcagaagtatagtggcattccattgtatttttagtttgcattctcctgataataaatgaggttgaatactttttaaatacattggtcttttgttttcttcttttgatttgcctgttgaagtctctagtccatttttttaaattgtgggcttttttttgtctttttctaattaattttttgaaaatgagccctttgtagattatatgccatacatatatcttcttccattttctggcttttcttatcattatcaatatggtctattttgatcaacagaagttgtaaattttaattaaattcactttataattttttggtttataagtgcttttggtgttgtaaatgctttgtctacattttccctgtcttgccttctggctgctttattctttgctttttatatttagatgtgtaatccatttagaattttttgtgactaaaatgaggtaggagtaataggtatacgaagatgacccagcaccatttatttgaaagacacttcttttccctgtgttctgtcacttttgtcacaaattagtttttcatatacacttgattatggttcagcaagcagctctgcctcatctctttgtctgtctttaagtcataccatcttaattagccttaggtttaataaatattgagttgagtaagatcttctcaccctgttatttttcctcaagaaagtctgaggtattcttgatgctttgcatttacatttatatttagaattagtttgtcagtatccattttaaaaacaacttgctggggttttcataagtaatggagtatttggatctattgcaagtggggctatataggtctctttcaatctgtgactaacaaactgtgattatcatatattcctaccatttccttaggtgttcttattttttttagtaatgatttttagttttctatgtggaagtcttagatgtttctaaattgatttattcttaggaattgaatattttgtatgtttctattttcctgaagttttcagataaacttcactgaaactatttgtttatattgttcaaactcaataaaaaacactcattttgagcatacattttaatgagttttgattagtttatgcatccacataaccaccaccacaatcaagatgtagaatatacccatcaccccgaaagttctgtgtgccctgtttgttattcactcctatctctgctccagggaaacactgaagtgctttttaacattgtgaattagatttgccttttcaaggttttcacatagatagaatcgacagtacatactatttttggtgtctgtcttctttcattcatcctaatgatctgtgatttatcgatatctttttgtttatgagtagtctattcctttttattggtaggtattatcccattatatggctattaataatctactcttcttttcacctgttgatagccatctgggttttcccattttgttgtagttataaataatgattctatagatatttgaaaacacgtcttggtgtggacataaattttcatttcttatggctgaacactaggagaaaaattgtggttggatagtaagtgtatgcttaaccatttgagaaactgctgagctgttgtgcaaagtagtagtatcattttatattactgtcagcaatgtgtagttctattttttccatattcttgtcagcacttggtattgtcagtctttttaagactttataatgggtgggtaaccatatctcatttggttttatgttttctttcctattgattaatgatggtgagtattcttttttgcatatgcttatgggccattgaaatcccttgctatcttttaaaatttttcttgagatatgagttctttatatattcttcatatatgtcctttgtgagaaacatgcagtctagaattttttgttccattttgttgtatatatttttattttcttaaaattgttaataacaaaagtttctaatttgacagagttcattgtctcaaatagtttcgtcttttatgatttgtgccatttgtaaatcataagaaatctttacctaccacaaagtcatgtagatattctactatattttcttctaaaataaaagttttgtagttttatctttattaggtttctgatctgttttgacttagtttttgtgtctgtggtgaggtaaaggttgggatttggctctgtctttatgtatattaatgttttagtaccattcaattaccttggaattgatttaaaatcaattgaccacctatgtgtagatctatttctagactccattctgtcccatgaactatatgtcactactgcactatcttcctgtatcgtagctttatattaagttttgaaagagatgatgtaatgtaagtcctgtaactattttttttttacttttctgggttaattcgcattttcatgtaaattttagaagtgacttgtcaattctaaagcaacaaaaaaagaaattctgctgaaattttaattacaactctgttgaaccttttaatttgaggagactcttcatcataatactgagtattcaaacttttgaaattgtcattcattgggatctttaatttttttcagcaacttattgtagttttcattgtaaaactcttgtacttatttttatgtctttttaaatttttatgtttttctaaattttcatgtgtttgatgatattatattagattttttgctgtaaatttccaattgggagttagaagccagaccaaaaagagtacatagtgtatgattccatttttatgaaattataggaaatgcaaattaatttatcttaaaaaatagcaaatcagtgattgcctgtgtcaattttacctcaataaaactgaaaaaaggggataattttgtattagtacattgatttttatatattgattttatattttataatcttgccacttacttttagtaaacgtggtaagttgtttagaactttctaaactcacataatcgatctaacactttctgtagtttccttattattttctatgcatgagataatgtcacttgtagctttagtattatttatcctaaaatgtttgagaattcaccagtacagccatttctgcctggaattttctttctgggaaaatttaaattatagatttagtttttttaattgataaatgagtatccagatagtatatttatttttgtatctgttttgttatttttgtcttcaatgaatttacccatcttatctaagttgttggatttattgccataaattctttgtaattttaaaaattttattattaatattttaaaatataagcatgatccctaatgatgttccctctttcatttcagattttgttattttgttttttctcattttttcattatcagaatagctattgcttttcaatattatgatttccccccaaaaatgatactgtgttcattaatatttttagagtgttttttttctattatgtgaattctgctcttattactcctttctatttacatcacgtttgcttgcttttttcttcccatatcttagagtggaaactgagattgagtgtctataaactgtggaccatgggccaaatcattctgccaccagctttgtacataaagttattggaatacagccacactcatttgcttatgtattgcctatcactgctgtcacattactgtgactgagttaaatagttggaacagagacgatatggcctaaagcttaaaatatttactgtcttatcctttacagatgtttcccagcccctctcttggatctttgattttagaactttcttgtttaatgatatggtatatgagcatttaaagccataacttttcctccaagcacagttttacctgtattgtacaaatgtagtattttttatattcaattcaatatttttttctaattttccctatttcttcttggattcatacactttacagaggtgcattttgacatttatcttccttcactaaaaatactgccatgcaatccattcaaattgttgcatgaattaatagtatgttccttttttatttctcagtcatattctatggtacggatgacagtttgtttaaacatacacctactaaaggacatttaagtttttttccagtttggggctattaaaaataaagttacagtggacatctgtttttatgtgaacatacatttttgtttctctgggataagtacccaagagtgagattacttgctctatggtaagtatatgattagttttataagaaactgcaaaactgtcttctagagtggcttaaccactttatgtttccactggcaatgtgtgagtggtccagtttctcctcattgttaccagcatttttttaagcattctgatagtatgtagtgatatcttactgtggtctgaatttgcattttcctaatggataaatatgcagaacatcttttcttgtgtttattttccatcaatatgtctccttcatgaattgtctgttcatgtcttttgcctattttttaattggatcactgtttaacttttgaactctgagagtttttgttatattcaaatacaagtccttttttagaaatttagtttgcaaatattttatcttagacgtgctccctgtttcatccttttaatgggttttttagcagagaaaaatttaaattttttttaatctggcttgtcagatttacctttttatagttaagcttttggtgtcatgtctaagagctcttcacctacctctactttcccaaaatttatattgtattttctataaagttttgtggtttaaaagttgttttacttttaagtctgtgatctattttgagctgatgtctgtgtaaggtgtgaggtttaggttgaggtacacatttttgcctatgaatgttcatttgttccagcaccatttgttgaaaaggctatccttgcccatgaggcatgtttttaagaccttttaaggcaaatttagagaggcctctcttcttggattgcttttgccacacttagaaagggtagacttgctagaatttctcctgaatgctcagtgtatttaatgagatctctcctttctggctggagggaatacagactattcccagcactatgcactctcagtgatgtttgtgttgcagctccttcataattattcttttcaaaaaattattctattctagcccttggagctttcaggcttcacataagtagattgctattcagcctaagactcaggttttgggaaatttttttcttcatagcttcctcctctcagggactctgttctgcaaattctattcaccttggccgttttgaactacagtctcagtcgtgtcaactcaaaaacattgcaggactcagtatttgccataatataggaaatacctccataaaggaaacatggatgatgggggagctcacctcattggtttccctgtccttagggttcatagtcctgtactccctgtattgcctgaaaatagttgttccctgtatttgtctaatatttttaactgttagcatggaaggtaattttagaccatcttactttttcaaggctacaaatgaattttatattcttatcatgttgtcaatgatttcttttataaattttaattcttttaattgtttccctttcagtatgttgacagaatatcctgaaatgttaactcacttattattcctaattatttttctatagattgtttcaaaatgtatatgtatatacataattctgtcatccacgaataatgggggagttttttctcccattaaaatccttgcaccttttaatttctttttctgaacttacagtgccacccagtacctctaatgcaatttattatagtcatggttatagcaggcattctttttaaattcttcatctcagatgaaaaacattgaacatttatcattaactatgatgcttcttacctattaattatatataattttcaataaatgttatacatctcttatatttgtaattaacaaaaacttgctatcatgacgtatgttgaagtttatcttatgctttttaaatatacactaagatgatcatgtggtttttctccttctgttaacatggtatactatattgatttaatttttaaatgctaaaagaattctcaatttctgtaagaaatccaatttcattgtaatgtgaaatagatttatctcttgaaagcttctataagattatttttttattttttcccctgaaatatttagtaaacttcacaagcaaagacacctaatcctggatctcttcttttaggaaagtttcttaattaaaatttcaatttaattagttacagatctcccaaaattttctatttttttctggtgtcagctttgttaggtttttgctggcataaagcttttcataatattattgtgttattcttttaacattcatataatctgtagtaatgtcccttctttttaatcttgatattctttatttaagctagccagcttgtctgccttcctgccttcctgccttgccttccttgccttccttgccttccttccttttcttgataagctctggcagtgattaatcagttttattcatattgccaaaaaaatgtctagagagaaataacaagaaacggttaagttgaaagttgtacattgtttgtttccttagtgcagtagttttctaacatcagcatgcatcagaataacatagagggcttgttaacatacagattgctggatacctaattcagtaggactccagtagggcatgagaatttagggcacctctaacaagtttttaggtgtgttagtcaagcttatttagagaaacagattaaataggatgtttacattcatatgaatatacatgcatatacacatgatttattataaaaatttggctcacatgattatggaaactgaaaattcccagtatctgcagttagtatgctaaagacccaggagaaccaatgtgtagttctaatcaaagtaccaaggtcggagaaccaagagagccagtgatacaagttcctatccaaaagctggctggctcaagactgaagaagagccgatgtttccgtctgagtccaaaggccaagaagagaccagtactcctagctcaaacattcaggcagaaggagtttgctcaacttttttgttctattcatatcttcaactgactagatgaagccttcttccatgaaggagggcagtctacctattcaaatgttaatcttatcaatagataccctcacagtcatacccagagtgctgtttaatcaaatatctggacacccagtaaaattgacccataaaattaaccacgatgctagatcatgctgatgctgctggtccagaatacacactttgagaaacagtgtgtaattgataatcctccacatcgcaggagttatccttgatttatcgaggtcctattcccagacaatgcatggcccttccttactctagtttaacttaatttaccccaaattttgcagacatacatgtacatatgtatgcatgtgtgcatgttcatcttaaattcacaccctgcaagaaagtatacttattttattggtcaacatctgttttgatttagccaaatgactatcattttttgttgctcatcattcttttctgaatgtctgacctccacctagtatcatatttcttcttctgaaagaacgcttcttagtatttgatttagtgcaggtttgcctgtcatgaatttttagttcctatttctctaaacatcttggaaatccacctcgatgtttgaaaggatattttgaaccaatagaattctaggttggcaattattttcttatagtgctttgaaaatatcattttattgtcttttggcttttttcattctgtgttttatttatttattttataggttaattcctagtcatattgtttctgttctccactccaacccacctgatgtctgttttaaaggtgttctgtattttgggagttgataagttttactatgatgttttcaggcgctgtggattttctttgtatttatcctgcttaagatttgtagagtttttcaaatctgaagttttatcactttcattcaattttgaaacttcctagccattacctcttcaggtattgcttctgacccattttatccttctgttagagcttatcttacataaaaattagactttttaaaaatacatttcttacctatctatatcctttccccctatgcctatttctctctcagtgattttgagtattttcttttaacctatagtctactttactaattatctctttagctgtgtccagtcttctcagttcttaatttcaagttttataagtactcaaatttccatttgacttttgtggtttaatattatcttccagctgggcgtgatggctcacgactgtaatcccagcattttgggaggccgaggtgggcagatcacaaggtcaggagttcgagaccagcctgaccttcatagtgaaaccccatctctgctaaaaatacaaaaattagctgggcatggtggtgagtgcctgtaatcccagctacttgggaggctgaggcagaagaattgtttgaacccaggaggccaaggttgcagtgagctgagattgtgccattgcactccagcctggcgacagagtgagacactatttcaaaaaaaaaaacaaaaaactaaaaaaacttccaattgtctatcttatccagttgtttatcttgatctttaatttccttgaatgtaaatatagttaccctaaagtctttgattatttatcagagctacctctgtcatcttgtgttacttttggtattcaataatatcttcctgtctacttatatttcttttcttgttattattatgtgaaaaacctatgtagtatctgaaagattataaacataatatgaaagtacaaagtggtgttttcttccagaaaaaaatgtatttttttctagtaagcattagcaatcctaaaggaccttaatgaagtcaaggttagagggccagtcttttttcgattcaccacttctttaaagtgtagttctataggatctcaacctatagaatcataaatcagataaacctatagaaccttacatcataagggtttttctaagctttttttcctctttagtaggctctgagctccaaaaattttgttgaatttcaatcattcagttgcttctaccaaaacatgtccatgggagaagagcggtccagaaaccaaaatcatcttagagtttcttcttcaggatcatggtcaaataattgacttctgtcttaactctccatttccctcagagaagtgtttttgattttgtccagcttttttagttgttctcagcaggagaatttgcctattactaaaggtagaaatccacattatttttatatagttattgtgtttatgatcatatattagatggagtgtaaatgttaaaatggcttggttttttttaatcactgatttcagctggattatgtcagatccattccttctgatccttaattatataatagaaaaatgtgtaactttttggtaatttttaagttgtataaagttcatccaattaaacattttcaactccttacatgactttctttattttagtgaagggttttgatggtaattttttcctttctttaaacttgtctatatttttatacttaaagcagttctgctttttaaaaaaatcaaactgacaatttttatattttaattggtatttctacatcatttgcattcagtataatcactgacatgattgtattgatatctaccaatttggtaattgttttagaataaattgttactttccatctgtactttattttctttttcttcttttatgccctctgttgggttaatggagtattttttttattatttcattttctctccaatattgtcttattgtagacaatatttcaaacatttttaaaatgcttaaaataaaagacaactttttaaacattttaggggcttctctacgacttacaatataaatctttaaattatcagactcagtttttaatattattacaaagtttcatgtgttaataaagatgcttgtaacagtttactcctaattcctctttcacatccttagtgttaatgttgtcatacgttttacttttatatatcttaacgaagaaacagtaggccgggcatggtggctcacacctgtaattccagcacttggggaggctgaggcgggtgaatcacctgaggtcaggaatttgagagtactagcctggccaacatgctgaaaccgcatctctaataaaaatacagaattatctgggtgtggtggcatgtgcctgtaatcccagctactccggagtctgaggcaggagaatcacttagaacccgggaggcagaggttacagtgagctgagactgtgccactgcactctagcctgggcgacagagtgcgactctgtcttgaaaaagaaaaagaaaataaacagtacactgctattttgctctagacagtgaattttattttagagcaattaaaaataaatgcattttatagatttatttatcttttctagcactcttgtttgtataaatctgtttttgtctggtatattccttatacttgaactacatttaaaagtattcgtagtacaaagtcagctacatgaattacctccgtttttgttgtctaaaaggtctttattttaccatctttttctaaagaattttttggctacatataaaattgtggacttatgtaattttaaaatggctttgaaagggatttcatctcatttcttctggcttgcacagattctaatgagaatgtcattcttatctttgttcctctttatggaatgtgtctttattctctgaatgccttcttcagattttctctttatatttgaatttcagcagtgtattatgttacatatttttttacttatttactaaaattctagttggtgttttctgggcttcttgtatctgtagttttatgacttcattgtttttggaaaattctcactcaatatctcttaacatatttcttctgctctggtatgtctctgtgttagttttctattgctagaataacacgttgccacaaatttggcagcttaaatcagcactgatttattaattatatcacagttctgtaggttaagagtccaacactcaggtcacactgggctaaaatgcagatgttggcagggctgcatttcttattggagactctgttagaaaatgagcttccaggctcactcaggttattagcataattcggttctgtatggctgtagaacacatggacctgtttatttgcctgctgtcagaggcttcccttatctcctagaattcgccttgcgcatggcctcctacattcggcattagtaataatgcatccagtttttctcaaacttgggatctgtctgttttcctcttatacgtatcttttctgccttcctcttttgctgtacttctctagccagagagttttctgctttttagaacacatgtagactgaacctacctacgtaatctaggataatctattttaatgcccataaccttaatttcacttgcaaaattctttttgccatgtaatatagtttattcaaagattccagggattatggtttaggtatctttgtggagccattatttggcataccagcatactgcacttctctttctgtgactccaatcacatttatataaaattatttgatactgtttaatagcttttgaatgcaccaatgtgcacactccgtttgagtgtgtatatattcttttttctttttgttttaatatgtctatattttattggcctatcttcaaattcactgagtctttccttggcttcattgagtcttttgataagtccattgaaggcatatcatttcttttactgtattttttatttctaccattgtttcttctttacagtttcttacttttgctgaaaatttccatctgtttatgtatgttgtctgccttttcagctattaactcttgacatgttaatcacagttattttaaattattttatagttccaacatagggttcatctgtgattttgattctatcggtttttctctggctttttttgtttgtttgtttcttcatgtgtaaggtaatttttagttgaaaactggacatcatgtataggatagtagttcctgacagtcgtatttgtgctctaaatgggtctgcctctccttatgctaaggcttttgtgagaggggttgagtcattttagtctggaattgagcagggtttatgttttcttgttgtttttgttactctctgtgtaccacggactttaaatttctctacttttactttgtgtttagttaggtgctagtttttcagagtgtcttactcactatttctgttctaccctgttctgattcagagaggttctctacactatgtagtcccttctgcaatagtagactactgttatctgttactgggtgcttgcaagcctggtgttcaagggttctcttttgtcctggtctagactccattttagtcaagtgctgtcctggatcttgaaggtagggctttttcagtgattttatgtatttctacatgattggggatctgtaaatttcaggactcagaacgtttcccttcccctccctcagagtagagggttttttatgttcctttcctccagctgcaacaggcctcctactgtgccccaaaagtgacaggatttgttgtctttctctcaaatgcataaggcttccattctgtagaggagataggaagaaggatctaggcagaactttgtatcttttctgcagcaattaattctccctcctttaacctggagcaatgaaggaagttttctgcagtcttccatgctgcctccaatttttctcctgaatactggttaggtttgaatggaagaggctgggcatcgttgcaaacgccccttgtgtctatagctctgggggttttattctcttatagttcacacatggacttcagaaatttatttaaaaaatttagctgatttttttcttgccagcttaatgtggtgcccagtgctgctgcttcctgttctctgcctcaggttagcaagttcatgcatcctaagtcttcttggagttcctatcctcagatttcaagctgtttggttacctagcaacctcagctctctgatgaggcctaacaaagttataattctttagattatctggctttttcttgtgatttttgtgggaatgactctagttttctacatctgaaatagaagtcctctatttaattttaaaagttcaaattcttagttgatttttcaatttatatattcaaaaatattatattttactaaatactacactacaaaatgctcattaactgctattccagaaaacaaattctttcggtgctttactggggaatattcttgataacaccacctgtaaataagtggcagtggaagattggtctgaaggaaaagtaatgcaattgtaagagatattccaggccactccatgggaaagctctgaaattggaatggctccagaggtgtcctcaattgggtcaaaggagctggggtttttcatttttcttctaattgaccattgtttgaattcacactgctcctaatgagggggcttaaccttgggtgaagcagctcccttctagggagggattcagctgtgagccatcaccccacagttctcctcagaactctccagggaaagaatgtctctatcctaaaagaggatcttggatcttggtgagacaccacagctcctactacattaaaatatttttttaaatatacgaaatattgtatttaggagcataaatgttattattacaattttcctgtcaaatatttaagatacaattagccttaccctttttatcactagatttgttgtttggttttagttagacttacattcttgagtttatatttttatttcactatagttaaattttgtgtcatttaatttaagtgattgactggaaacaaggaattgttctacatcttttttttttttttttttactttcgtaattagcacactccaaaaaacttttctaagttggggatgtctaagggcatccccaaaaaagcattacataatgtctattcacagatgcgatcatggcacacaacagctctgaattcctgggctcaagtgattttcctgcctcagcttcctaagttgttgggactagaggtttgcatcatcatgctcacgtaggcattacacatcttaaaacttgaaaaatgtttacttggaattttgtttacgatataaagcagtaaactttttacttataaaaatattctatttagcttcaatttcttagtcttctatagctttatctacttttttaaccttttcatcatgcacttgaaaataattctgtttaggagtaataaagacaaaatgccagttttaaatttataagatcacagggaagtaaaataagtaagcattttttttttcaatatcatgttttccgtagcggccacaaccttagaaagctgtaacttaataaaattgtcagtaggtaattatgtcacaggtttgcagatctaggatacatttactcatcagctattttagtatgttaaattatatttaatattagaaatttagtgacaacagacacagtatttgagttgtgtcaattcctagtcataatatatagctgataagaatttaactttacaatgtgtgtttattctatcattaatactctcttaatcttgtcttttcatctgtgtttacctaaacccaatcagttcacttaccgatgcctacatttcctcatttacataggagcattcaattaataaaaatctactatagaattcactagtataataatttcttttatgtctgagtaaatcttttaggtacaatacttaagggtatgtaattatttctttttgttctatgttttcttattataaactacctattttatatgatttaagaaatgaattaggaaatttaagcactctaatctttcaaatcgaattgttgtttattatatttgtgacattgtgctaagtacctaggagaatacaaaaagtaaataaaatcaaaaataagtaaaaatgactttatgaagtagcacaaacataagggtgtttgttaaaatagaatacacaatgtatgtagggccctaaataagaatagaattattatatttttctagaattctaaaacatataacattaagaaaagatcactttgttatgaactatgtttataaggggattcatttagatgacaggagagaaaaatcttcttttttttttttactgatttgtgtacttaaaattaccatggctttggatatttcttgaggccagttacatttggcaagatttgataataattaagccgtgggttttcatacattatttttcccatggattaattgtatttttattcatacgaatttcttagaattaagtgtgaatgagacttccttaatacaggtaaaagccaatacatgattgcagtttttaaaaaccataattgtaagcttttgtgttttaagtcatattgttttaatccaatcattggagctatagaatttcatctaaagccttattatttcctttgaatattttgttttgagttggtaattttgttagagtggtttataatttctcaagtttcagcaagaattttcttcatggaaataagtaattctctttttttttttttatttgtgtaaatttaagggatacaagtgcaattttgttttgtggatatattgcgtagttgtgaagtctgggcttttagtgtattcatcacctgaataatgtacatgatacccattaagtaatttcttacctctcgctcccaccttccaccctccagcctttccaagtcaccagcctccagtgtctatcattccatattctatgtccatgtgtatacatcatttagcgcccacttataagtgagaacatgtggtattcgcctttctgtttgagtcacttaagataatggcctcctgttccagtaatttaattctttttcttaagagtttacacttactattaagaaaaatagccaaattcaaaatagtcatcaatcaagcatcttaaacacatcattagtgtgacttaaggggaaaaaatagactggggagaatagaatgagtggcttgaaattgtatgcttttcaaaccacacttgataaagtctgtggttagagcccaagaacttaaccaaatattaagttattagagtataagattataaaactcactcagactgtgcagggcagattcccctacatagggaaatacacctttgtattacttctgtgcataaaatgtcttagactaaatgaatagtttttgtttttgttttctgtggcaaaataggggtcttgctctgttacccaggctagagtgtagtggcatgatcatagctcactgcagccttgacctcctgggctcaagctatcctcttgcctcaaccttttgagtagctaggatcacaggcacccgccaccacacctggctaattttttaattttttggtagagacagggtctcaccatgttgctcaggctggtcttgaactcctgggctcaagccattctccttcttcagtcttccaaagcgctggaattataggtatgagccaccatgcccagcctaaatgaatgtttttgaataaatgaaagtaaactttcagagaaaactcaaaaatcactctttagaattttcccctaaagtcagtatattatgccagtttttcttacaaaaataatttgctgaagaatacctggttttattctggtggctatatgttctttgtatttttattttaaggagaaaattttatttatttttataggacttaagggcatgggcttttctcacattaacatagcttttaatttatttttttacatattaacagatagctgtctcatgtgtcttggaattggggaaaaggagttttacattgtgtgtttctttgagatgagaatggaaataacaaaatgacaatatagccacaatatgtcttttttggtattttttgtaattaatccttattttcaggcgataaaggaggttcttaggctgaagtttatgtttgtaccattttctttcagaatttaaattgtgtaacaatgaagctaatttatacagcatttacaaccttctttggaatacattgtggggaatctgtaaaaagcaacaacaacaaaagctttcttcactatgaaaaatgaggatgaagtttttccatttagaatattttgctgttgtaattccagcagaattatttgataatggtttatatacataaaacttctaatctcttgctgagtaaaatattatattctttgccccctattagaaaattaaaattctcattgcaggatgatacgtaagagcaacatttactattctaataaattttataagaaaatatttgcaaaaaaatcttaatagggattcactttctgagaaatatctgtttttatctattaccctttagtcaagataatcgataataatgtatatttatacatacttacagaagtaatcagttgctcggattaattgaagttctattttgtatttaacttaatcaccagtaacagtatttttgtaattctgaagcctctaaatcacaccgaaatctgtaaaataggggagaaagttctcaacctaggataaaaaatgttcctggctttaactcaataatagtacattaaatccaatagctatgatgcaaccctccattaatcaataatttttataattttactctcacttattaatcttaaataaaaataatcatacttcatttataattgagcatcagaaactattatatctagatttttctccttttaataaactcactcttaccattcttaccatttcttagtagagggaattagtttagctgggaagagctgtaggacatgattctagagatttgaaggaattaatgaaattgtagattcaaaaaagaatctctttgtattcactaacaggtaacttactgtgattatgcttattcggtgacttcaggtagcctttcttttgcttgcttctttgttaattctttctaatagtaaatactctcattaaaacagtcattctcaaagtgtgtttcctggatcagcagcatcaacaccactgactgagaatttgtacttctaacaaatgcttgccgtacacacagacctgctgaatcagagactagggtggggctcagcagtctggttatacagactctccagataattctgatccacattaaagcttgagaaccagtgtcttcaggaggtccttgctttaggaattacagagtaggggagactattgaaatctcttaatttcagtaagtctgccaaatccccttcaaatccctttttcttacgggaaaatgttcctccagaattttctaaatatatgtggcagtgatcaaacttgagttttctccatggtttctcctttctctagagctgttgacacgggtaagaggagacagagttaaacagaagtgctgatggtgatacttagagtgctcaaagatttgaaacttggctgtttccaatttaggaaagaagtcatccgatattattctctaatagctatttaattgcttaaaaaatttaaaaagaggccatagtttagttttaaaccttagtaatatattgcaaattattttatggttaattacctttttttcatttataaatttttgcctcatgtgtaacaaaatgttacctggcattgtggcagaccttgtattattttgtaacattgtttaattgctaactgtacatatcgtctgtgtagaagaatgtgtactcatctaatatattgactttggtttgtttaatgtatcagaatcacattttgtgagtgtaaatatgggtgtgttcaaagtagagcaaaaaagtgaacattattgacctctcactgtgtgctgggtgcttttctgtgcactttatatcccttagcttgtttaatcctcactgggtaggtactgcaatcatcttcattttgcagacatagaaagcctaatgtgcctaaggtcacctagctagtatatgatagagccaggattctagtctaagcagtcttactccaaagcacttttatctaagacagataaatctgttactatgttattcatttgtctaagcagaaatattttcctcctccccattttttacttttacatgtaccaaagtatttttaagaatgtcaagtagtgcttatgtatggctattaacttaaaattcaacagtgaactatataataatacagcagtttgtaaagaaaagtaaataggcttatgaaatggaaaatgcctactttggcaaagcattcaactgtattacaacgaatttcagttattcccttatttgtccagatttcaggtaatacctccttgagagcaagaattaaattatttgtaactggcacagggacccacattgtcagtgttccagatcattttctttgatggatagatacatagagaaggcatacaaaaactcatttacatgacgctcatagagcggtggacagtctttggccctttcgggtggcataaccccaattctttttcatagtatagtcattgcaatttagctgaaacctttcagtagccttatgactgtttgtgaaactgtacagggtatcccttatacatgaagcttgttattattccatgggctagaaaggacatttatgatttttaaatattttaatttagaagtaaagtttatttgacattttatattgaattatatttattagtttttatgtcttaatttcaacagcatcactgcaaaacttgaaagagcgttagaaaaagttgctcctcttcttcgtgaaatttttgtagactttgccccattcctatctcgtacacttcttggcagtcatggacaagagctattgatagaaggtatgatttctctattataattattttagtttcctataatgtatgtattaatcatggcataatttgtgcttctggaggaatatatatttccaaaagaatgtaaaggcattacttcacaaattctaataagatattcaatatgttttctcttcactcattttttttaaataacatgtttgcatggtcaatgccagtaagaaaactttgaagatgaagaacgttgaaaaggtgtcagaatgggaggctttggctctttaatccatctatcagggctgatgtatatcctgtcattaagataacctgtttattaagcagtgatctctgaaatttccttctgactctgagagccatgcacctttaagtgatttttcttattcacataacatttgtagtgtgggaatccttaactaagaagacattaaaaatctagagaaatacttaacaaagaattgatgaacccattgtctcctcaacagcagcttacatacagtaaggaggcaaaggagaaaaatttacaaggagagtggctttgaaaaatatggttaatcaaaatcgtatttctttttaaaaagttttgttttatgaatatttctgagcttcagaaagaattagataatatcaagatgatctgtaggtgaataatggctttagatgctgtttcaggtagtcctgggatttagcatccttgtatatcttttttgcttttcacttcctgtttactgtagaagaaagagagttttcctgtgcctgttctgttattgtcccaactgcttctacacagtgtttctattaggaagactgtgatagttaatgactcggcatctgggagctgactttgaatcctagttcaactactttcttagctttgtggcctttgtgaattacttagccactttgtatcttagtttcctttctataaattggagtcagtgatacagcactttagggttcttgtgaagattaaattatgcaaggcatttgaagctcttagaatattgtcacataatgagcttctcaggtttccaaaagtactgagttccttctgggctaggtactatgttacatagttttgatatattagtaaacagacaaagacgcttttcttcagatggagcatatattctaacaaggacacaaaatcaataagcattaaacaaaatgaataattaaattacatagcatgctagaagatagtgaatgttatgtaaaaggataaatacaacacagagaattgggattacagaatgacaaggttaggctgaagtttaaagagagtggtcaattttaaataggcctcatggtaaaagttacatttgagcaaaaccttacataataagtaataaaacttacttaataagtgccatacagcttattagatgaggagtgttctatgcagagagaatagtcagtacattggccctaaaatgatagaaagatgttcttggtatgatctaccaacagcaaaaatgccagtctcatgtgaaccagaaggacagtagtcgaatattagggccagagaggtaatgggttctttggctttaactagtgtgttgtagggaggctgctgatgttttaagtagggctgtcaccctggatgctactattgtcattattatactcccacctacaaagtgaagtataaaatgctctgaagaattggattctgagaagaaccatgctaattcaaagcagccgcaaaatgaactttaaaagttcttggaagcttaaaaactattgcttggccgcagattgtgtgtgtaatttaaatagctttgttctagatgtgtatgattgactacacaaaatcatgtattcattgattcattcaaaacagaagaaatattcctcatggagtttgcagtctaatgagcaaagagacataaaaaccaataattaaaattaaataggatatgtgctataatgaaagtatatacaaaggtacagtgggaaatgagactagatggcctactgaccacttgcagggcacatattcttctaactgggtcagtgaggtagttgtgtatacctggtcttactcctgctgccataaagccacttcctcatctttatgaggacacaggtttgaaagggttatgttccctgcttctacctaactcctgtaacagctcaacccagtcttctgaattccagacatagttgaagttacctagcatagacatctaaagccatatactccagggatacctcaaactctgtttatccaaaatttgttttccctcaatttacttttccttctaaatgtatttattttgtcattagcattactattaatgcaaacatttgaggtgaaaatttgatttttctttagctcttttctccttcaactttaatatttacaattacttcatgagaatgaataatttccgaaaacaatatttagaggatagttcttcaaatattattaacattacaaatattatatcaagccatgtataaaaaccttccaaagtagcctaaatattatgttagctaaaagtggtggcatcatagttacggattctaaaaggtactaggttatcagttggtccttcttgagttcctttttttgcttttaattcttttgatttcctgtagttagatgctattgaggagcaagaatgctggttattgatatttttattttcatgcttttctgtaacatgtgttactttattaaaataaagaagttcagtaaacatcattgaaaaaacaaatcttaaatgtttcctcattccctacaagataaaagccttttattttttctgttgctatctatcttttcctaaaatgatttgataggttttacagaaatgtataaatactgaccaaagacataataaaataaaacagggaataaagttagtcttgtaataataatgttagtagtgagtcctgcaatgttattaaaactaagacaaattctgtgcaagttttctagccgccagagcaaaggcacaattatgttgttataagactcacgttactggctcctaagtgatagtctgtggcaattttatgttaactgctctgtattggaaaatcaggaacccctgtgtgtagttatttcccagaatcttccatgaccacacattcacattgtttcttacttatttcttctcatcaatgcacagagaaaaatgattgagtaattgagagttattttttttagcttctctgtttacctcacatattctgaattgagtggaaagaccattaagaacatgccttcattgttatcagtgcatccaggtgaacctggatttttttttaatgtaactatgctagaaatgaaatactggaacgggttagatattaaaaagttcattttgtgttcccctggcagtatacaattatatcttgtaactttctacattcaaagaattttaatacatcctactttttaaactatatggatgtaatatttatgtctttctttgctgatgtttaaaatgacttctctttataaaatgatgacagcaaatggtagatttttaggttttgagttttgctttttaaatgccagtgacttggcagtataaaaagctgacaaccctaaaatatgatcctttaaatttttgctagttcatacaacccagaactctggaaactatagttgtttaaaagaatgactttcagtatccctcacaatttggtcataaccctcccttccagacccaactagtctttatcttcttgctataaaaaaacatttcttaaacatgtaaagaagttacatactatcacatttccttgtttttgtacagctcttctttctgcatttaatcctttttgttttgttttgttttgttttgttttgttttgttttgttttgttttgttttgtttgagacggagtcttgctctgtcgcccaggctggagtgtagtggcactatcttggctcactgcaagctccgccttctgggttcacgccattctcctgcctcagcctcccaagtagctgggactgcaggtgcctgccaccacgcccagatatatatttttttttttttgtatttttagtagagatggggtttcactgtgttagccaggatggtctcaatctcctgacctcatgatccgcccgcctcggcctcccagagtgctgggattacagccatgagccaccccgcccggcctaaaccctttttttttttaaatctccccaaattatactcatcctttgagtccattttcaggctcattaagcaaattaatgtcatgacttatgtgctcctacagtattttacttacataatattaataaaattattttacacttattgaaataggaaatatcttattgtttatattgtcattacctaacttagactctggtacatcataaatattcagtgtttttcccttgtgtttgcataggatattatttttctttcttgggaggcgaaagcagatgtattgcttgaggccaggagtttaagaccagcctgggaaacatagttagaccctgtccctagaaaaaataaaaaattactcaggcctggtgacatgtgcctatagtcccagctactctggaggctgaggtgggaggattgcttgagtgggagattgaggctgcagtgagccacgatcgtaccactgcactccagcctgggcaccggagaccctgtcgctaaaaagaaaataaggaaggattggtaagattttatgttctgtggtaagaactcctggtattgatcagttcttcagacctaggagtttgctgctgcactcatccaaggtccatacttgctctccaccccagcctgtagaaatgtatgtccttttattttctcattcttgagcatgtactcttactcattctttgttcttcgctctccttctgtttcccttctttctctaatttgatatgcttttcctttcccttgagaagaaaatgtatcaaagcattatgaagaactcaggacatttacatgataaaaacatatttaccctagctttgaatatttccatttaagaaatagtgcttatgatgaataaatctcactgcatttcaatttaccatataaatatgtgtgtgtgtggtaggaacaaaactgaatttaggtaactgaagatactttaatgtctatgaaaagaaaaagcaattactcttttaacttcaaatagccataaagtatatttgaattgcctctttattttatgttttatattccatttttcttaaggcacacatttatttttgtttaaattatttcttatgggataattaatccttggcagtttttattgtcggtgtcctttcattttcttaattatctattactttgattagttagcttgtgattgtatcattctagaacaatgtagttcaccttttaagaccattcattaacagtagctatttttaggtagcttttgatgtgtgttttctcttagcaataattaaggatttttgaagacagtaatttgaagcttactgaattttaagaaaattatgggttttcaatttataaactaatgcataaaaactacttagaataggtatgtatgcaagtatcaaaacctaccagccaaagataacaaagctgcctaagaatccagtttatgttctgtgagcattgtttatgttctattgggagctcacagaaatattcagagtaacttagttatgatgcggatatagcagaaagtctcatatgtgtccaaggacaggaaataaaatatagttgatcttcaggcagcctggaaatgggagagaaaagtcagtaacaaagactactccctttgattcgcaaagcaactttatagcctcctgtcttttattctctctgtgtatctactcagtgtttttactttcctcccagaccaacttctcttgcttagtcatcagaacatctcttagcatagcaccttagccctgaatcttaatgcatttttaatgtaaatatcctgcatcatctaactatagtcacttaacttatcaacagagaatctgaatggcttagccaggcctattactttgttcctcctgggttaggtgtctgaccctgtcataatcagctaagcctgaggtgggatagaggtgtctgagatacatgaggctctcccttttaggctctatatacaagttgaaacattttagaaagagatgttagcagtgcaggaaatttcactgaagggtccactctacttttggtggcatcaataaatattttattaaaatcatataatactcaagaatatttatggtttccacgactagcattttttaaaagtatataaatatagcatgaaatttctaccttcaccaaagaggatatcactgacatattctaaaatgaatgagcctagtcaagaagctccatatcattcacagatcatttgtagtagcattataggcacataatcagaaaaacttgccgtatttttatttaaaaattatagactaaaatataatttcagaattattgtttttaaattacaataatacaaaaaaatgtacacaagaaaattgggtaaatggaaaatgctggcataatttttaaatattcctgatttcctccataaaaaatggatggaagaatagataatgaaacaataactacaagaacaatgaatggacatttacaacaaaactaggtgacaggtatctcattggaccccaaaatatgcctaggtggggaccatctagcttatagctacatgatatacatgatatcagcttatttgtggcaaggactcatggtggccatcaaatatagatctatttggagaattaactaaatgagggttatataggagaaattaaaggatatgactgcttattctgaaaaatttgaaaaatggggcagtaattatgttggtagtaatattatcgatattacaaaactgttatgtaatgttggataaagctgcttggtaattattaatattctaattattttatcccgtgttcttgaaaatcaggattctggctgaagaaaggcgatccagatataaaataggagagtttaagtaaaagcttttaatttggaatttgaattggacattttcatgtaaacttatgcatacatatgcatgtacatgcacacatacacgcatacccatattctataggtatatgtatactatactagtagccctgtctgttgttttgcctggacacaaaaaccaagtcagtagcagtgagtacacttagggtccatatttactattaaaatatcatttgccaatgaaagaaactgggactttatcatagagaaataagtgatgtcaaggctggggcaggaaatattaatcatttacctgcaacattttgtgataccacaaagcaaggaaggtatcaaatgttgtcagaagagctcaggagctaacttaaagaaattcctgttgtcccaagatggagcagtttgagcatccataaatctattaggttggtgcaaaagtaattgcgattttattagcaattggcaaaaatcgcaattacttttgcaccaaccaataataactgcaatgcattgaaacacctggatatgtttaaatctatgtattcgtaatgataatttagaaaatgattttgtcaaatttagagaatgatagagaacttactttgaaaactgataagaaaattaaaagaataaagtatttcttatgtcctttctttgtgaacggatcattgtattatgaagttattgaggggggatgttttgtttttacaaaaatatatcatctgataaatagtggtgggatatgtgagttagattatcgtttagcaccctttaagaatttaatagatctaagcttcaatggctgctaaactcacaaatagagagacagctagacaattagataggaaaaataccatcacctatcaagacggtatgtatgaatgaatgaataaaataaaagcacacctgattaaatctgtatattcaacgtgttgaattataccatgggaactcaataatcaaaattaatactggaggaaattctgcaatacaaattgagttggtctcttcaaaataaattacatggggaaaagagatataggaagaacctgtagcttaaaagagatttttttttaatttcaaaaatcaccaaaactaagttgtttgtagaaataactctatgatttaggtattaaaaactataatcaaaggcaaagtgattatcataaaaatcagaataatggtttgttataagtagggagagggttagaatgggaaacatggagtactcctgggatacgtggtaataatttatttctttagctatttagtggttgcaaggatgttcacttcataatagtttattaactgatgttttctgcagtttacttattaatattttgtaataaaatattttaatgttctctggagaagatataaaaattcttgaatgacgttaaagacctaaataatggtgaactatatcatattcatggtaggaaaactcatcacaaaaaagttatttcagtccatgttaatatatcaattttaataaaaatttgatttaaaataatttttaaattattttcatggaatttaataagctttatcttaaatttctgagcagaataaagggatgaaaaaatcgagtaattttggaaattaacaagctattatagttaaaacagcatagcagtagcacagagatagatcagtgtgtcagaataaatctccaagaacagatcccacatacatatggtaacattatgagacagagctccattgtagactggggagaaatacgtgaacagtggatctagatcaattggattcccttttgttaatttaaaagacaaaacaaagtggatctcttcctccctgaacaaacaaaagacactaccactgtggttgaaaatcaaatatcaaatgtttcaggagaaaaaaacataggaaaatatctgtaataccaaaggtattatgtaaactagatacaaaagcgtaaagtgtagagggtaaaaaaatcaccatattaaaactgttttgttttatcaaaacaacattaaaaagtgaaaagattgagagtaacatgagcaatatagtgactacaaaccttgaagtcctcattctcccaaagaaaaaatgaatgtacaaaaatacatggaccaaattagtgttgttagaaagctaataaatcaattaagattcattagatcagataagatgttgcagcaatgaagtaaacacctagctaagacagagctactcaaaacgttaggaaatccattgctattttgtttgcccttatcccacaccctcctcaacacagtgcagcatacatgataatgaggaaattgctcagttcccaattactcctttggggtggaagggaaagaatggaacttgcttgcaacattctcactaaagactgagaagtgactatattttttaaaagcccgaattttaacaaaaatagtacaacgcactcaaagaaagagagaaacatagttcatgcaaaggaacaaaacaacttccagaaaccacgtttaaagaaatgtcggcctctgacttcttttaaaaataatttaaaacaactgtctttaatatgcctatgagccaaaaggtagcagggactgtcaactaaacaaaattaggaaaaggttttatgaacacaaggagaatatgaacctaaagaaattatttaaaagcaaaaactaatttgaagctgaaaaccacaaaggaattaaaaaattcattattagggttcaagagtagactcaattagacagaagaaagaatcagcaaacttgaagacaggtcatatgaaattactgagctagaggaccaagacaaacagaatgaagaagagtgaacagagcctaaaggaccacatcttcagacagactaacataggtattatggtagttgcataaggaaaagaaagagaaaagggcagagagcgtatttgaaggaataatggctaaaaaacttctcaaattttaggaatcagacatacgaactgaagctcaacaagctcccatgggataaattcagacacatacagagacacattttaatccaactactgaaagtcaaagataatctcaaaagaagcaagagaaaattgtacatgtacaatgagcctctataagttatcaccaggtttctcagtagaatccatgcatgctggaaggcagtgggatgatatatttaaagtgcatgaagtaaaaagcaaaacaaaacaaaaagaaactatcaaccaataatactacctccagcaaaactgtcctttaaaaatggaggagaaattaagaattttccagataaacaagagctgagagcatttattactactagatctaacctacgagaaatgctaaagggagtccttcaacttggaaagagggattctacacagtaactcaaagccatatgaaaattaaaagttctacaatagacatattacaaatatgaaaactttattattataattttggttctactattcttttaaaagattaaaatccaaaaatgtaaaaacaaacctatgaatctatgctaatgggtaagcaatatataaagatatgacttgtgacataagtaacataacttgtgcagatgactgagctgtaaaggaataaagtttttatatgcgattgaagttaagttgttcagtttaaaatgaactgttataattttaagatgttttatgtaatccacatgataaccacaaagaaaatttctatagaaattacacgaaagaacaagagaaaaagcaaatcacaacaaaattcaactacacacaaaggagggaagtacgggaagaaataagagacaaaaatacaatgacatacagaaaacaacaaattaaaatagttcttcctctttcagtaattattcaggatgtaaatggataaaaactcctcaatcaaaagacatagattagctgaatggataaaaaatcaggaaccaactatgtgctgtctttaagagacactcactgtaaatctaaggacacatagaagtttaaagtgaaagagtagaaaatgatattctgtccaaatagtaaccaaaacagaacagggatgtttaatataagacaaaataagcttttgaaactgttaaatgagacaaggaaaacaatatataaggataaaagggttatacaaagaaaatgtaacaactataaatttatatgtaccaaacatgagagttcctaagtgtaagaagcaaatattgacagacttgaagggcaaaaaagttctgcaataatcgtgggagacattcatatcccaatttcagtaatggataaagcaaccaggtaaaaggtgaataaggaaatggatgacttgaacaacactatagatcaattggacttaacagaccaaagaatacttcacccaataacatcagaatatacatttttctaaaatgcatatggagcatcctctaggttagaccatatgttaggtcattaaacaagtcttaatacattaagaccatatgttaggtcattaaacaagtcttaatacatttaaaactattaaaatcttacaaagtatcttttctaatcacagtggaatgaaactagaaataaaaactagaaggaaatgtagaaactccataaacacttaaaaataaaacaacatattttgaataatagaaataaaaagtagaaggaaatttagaaactccataaacacttagaaataaaacaacatattttgaatatgccactcaccttataaaaaaatcaatatttttttataaggtgagagatgaggatcaagttttattctcctacatgtgaatagccaattatcccagcaccatttgttgaaagagtatcctttccccactttatgtttttatttgctttgttgaagatcagttggctgtaagtatttggcttcctttctgggttctctattctgttccattggtctatgtgcctatttttataccagtaccatgctgttttcgtgactatggccttatggtatcatttgaagtcaggtaatgtgatgtctccagattgttccttttcgattagtcttgctttggctatgtgggctcttttttggttccatataaatttgaggattgttttttctagttccgtgaagaatgatgattgtatttcgatgggaattgcattgaatttgtagattgcttttggaagtatggtcatggtcattttcacaatattgattctacccatgcatgagcatgggatgtgtttttgtttgtttgtgtttatgatttccttcagcagtgttttgtagtttttcttgtagagtactttcaccttttggtattttattttattttttgcagctattgtaaaggggttgagttcttgattagattctcggcctggtcactgttggtgtatagcagagctactgattcgtctacattaactttatatactgaaactttgctgaattcatttatcagttctaggggctttttggaggagtctttaggtttttctttagggttttcagcaaacagcgacagtttgactttaccaatttagatgccctttatttctttctcttgtttggtctgatataagaatacctactcctgctcacttttggtgtccatttgcatggaatgtccttttccacccttttaccttaattttatgtgaatccttatgtgtcaggtgagtcttttaaaggcagcagatacttgtttggtgaattcttatctattctgtaattctgttttttaagtggagcatttagaccatttacattcaatgttaatattgagatgtgaggtagtattccatttattgtgctatttgttgatgaatccttttttttgtaattttgttttataggttatgtgagattcatgctttaaagagtttctgttttgatgtgtttccaggatttgtcaagatttagagctccttttagcggttcttgttttgctgtcttggtagtagagaattctctcagcatttgtttgtctgaaaaagagtgtatctttcattcatttatgaagattagtttctctggatacaaaattcttggctgataattgttttgtttaaggaggctgaagataggtttccaatcccttctagcttgtagggtttctgctgagaaatctgctgttaatctgatatgttttcctttataggttacctgatgcttttgcccaacagctcttcaaattctttcctttgccttgactttaggtaacctgatgacagtgtgcctaggtgatgatatttttgcaatgaatttcccaggtattctttgagtttcttgtatttggatgtctagatctgtaccgaagctggagaagtttcccccaattattcccctaaatatgttttccaaacttttagatttctcttcttcctcaggaatgccggtcattcctaggtttggtcatttaacataattccaaacttcttggaggctttgttcatttttaaattcttttttctttgtctttgctggtttgggttatttcaaaaaccttatcttcaagctctaaatttgtttcttctgcattttcaattctgttgctaagagtttccagtacattttgcatttatctaagtgtgtcctttgttttctgaagttgtgattgttttttatatatgctgtgtatttcactgaagatttctcttgtcatatcttatatcactttttcaatttccttaaggtagacttcacctttctctggtgcctccttgattagcttaataatcaacctgaattctttttctggcaattcagggatttcttcttggtttggatcttttggtagtaagctactgtgattttttgggggatgttaaagacccttgttttgtcatattacgcaaattatttttatggttccttcccatttgggtaggctttgtcagagggaagatctggggctcaaggctgctgttcagattcttttgttccacgcggtgctcccttgatgtcatattcttccccttttcctagggatgtggcttcctgctagccaaactgtagtgactcttttttccctctggatccagccacccatcagggcttccaggctccaggctggtactgaggtttgtttgcacagagtcctgtcatgtgaaccatcttcagttctctcagtcgtggataccagcacctgctccaatgaaggtggcaggggagtgaaatgtactctctgaaggtcctcagttgtagttgtttaatgcactagttttgtactggctggcaggaggtggtgctttcaagagagcatcagctgtgatagtatagggaggatcaggtggtagtatagggaggatgggcagggccctagatctccaaagagaatatgatctttgtcttcagctaccagggtgggtaaggaaggaccatcaggtgggggcagggttaggcatttctgagctcagactctccttgagctgggcttgctatggctgcaatgggggtgtgtggttcccagctcaatggtgttatgttcccaggaggattatggctgcctctcctgtgtcaagcaggttgtcagggaagtgcaggaaagccagcagttacaggactcacccagttcccactcaacccagatggccggtctcattccaaccatgcctctcccaacagcatcaagtttgtttccaggcagtgggtgagcagggctgagaacttaccccaggctaccggcctcctggcccagaaagcaagcagggcttctgcgtctcctgcctgtcatgtcttcacactgaattcttgccttcccccaagttctgccaggaaacttcacattcatttggaattgttacaaaattcagctggaggtttccttctccctgtagtcttttcccagttcctctggcagccctccccaaagaccccagtgagacacattaggaatggcttccctggggacccagagaacccacagggcttttccctgctgtttcctctaccctgtattttgcttggctctctaaattgtctcagtttcaggtaaggttagaatcttttccagtgatctagaccctcacgttccccagtgagggtgtgcattcaggggcagatgatccccttttcccactttcacagtttggacactcacagtgtttgggctgtctcccaggtcctgcaggagcaatccacttccttcaaagggtctgtggattctctcggctttcttggcatattcatcttgaagcaaaagttgataatgtgagtctccacattctgctctgtctatccaagtagaagctgcaatttagtcttgcctcctatctgccattttttcatctcccccaaaatagtttattttattaaaaagatcaacaaaattgaaaaacctttagcttgatttagggaaaaaaaaagaagattcaaataaagtaaaaaatgaaagagtaggcattataaccaatgccacagaaatataaaaggattgattataagagaatactatgaataactttatgccaacaaattagatacatagaggaagtgagtaagttcctggaaccacacaacctacccagatgaagaaacaaaccatcaacagacctacaacaggatagaatatttgcaaactcataatataaggtcagcattgccctgatattgaaactagatgcagtactaaaagacaactataaaaccaatatccattgtgaatattaatgcaaaaatcttcaacaaaatactataaactgaatttggcaacatattaaaaggattatataccataaccaagtaaattttattactgaaatgcaaggatggttcagcatataaaaattgatcaatgtaatacatcacacagaatgaagaaaagaattacatagatcatcttatttaattagtttactgtgtggggaaaaaaagccctcttaaaattcatatggaatctcaagagacccagaataaccaatacaatcttaagaaagaacaaagctgggggactcacaggaccgattttaaaacttctacttacatagctccacaagtcaaaacaatgtggcactggcataaagacatagtagaccaacggaatagaatctctagccaaaaacaaagcaaaacaaacaagcaaacaaataaacaaacaaaaaaagccagcccttacttatatggtcaaatgattttcaacatgggtgccaagaccatttaataatgaaaggacagtcttgtcaacaaatcatgttaagaaaacttaatatccacatgtaaaggaatgttgttgggcccttacctttctccatataccaaaattaactcaaaatgcattaaaaacctaaatgtaacacccaaaactgtaaaacgcttggaagaaaacaggataaaagcttcatgatggccgagcgtggtagctcatgcctctaatcccagcactttgggaggccgaggcaggcagatcacctgaggtcgggagttcgagaccaccctgaccaacatggagaagccccatctgtactaaaaatgcaaaattagccgggcatgttggcatattgctgtaatcccagctactcaggaggctgaggtaggggaattgcttgaacctgggaggcggaggttgcagtgagcagagattgtgccattgtactccagcctggacaaaaaaagtgaaactccatcttacaaaaaaaaaaaaaaaaaaaaagcttcatgacattgatgacattggatttggatttggcaatgatttctttctaaaatcagaaatataggcaacaagtaaaaatagatatattggactacatcaaaattttaaacttctgtgcatcaaaagacacaatcaacagagtgaaaggcaaaggcaacctatggaaagggagaaaatattgcacattatatatctgttaagagcttattattcagaatgtataagaactcttagagttgaacaataaaactacaaataacccagtttaaaaatgatatagtcaaaagcacaagaagaaaccttacactcattaagcacaagaagaaaccttatacccattaagcacaagaagaaaccttacacctattaggatggctgctatcaaaaaaacagaaaataataaatgttgacaaggatatggagaagttgaaaactgtgtactctttgtgggaatgtaaaattgtgcagccagtatggaaaacagtatggcattttgtcagaaaataaaaaatagaattaacatatgatctagaaattccagttctgggtttatagccaaaacaacttaaagcaaggtttcaaggaaatattatttgcgacctacatttatagcagcagtattaacaaatggtcaagtcgtggaagcaacccaagtttctatcaacatatagatgcatttcaaaaaatgtagtatatacatacaatggaatggtattcacttaataaaaaggaagttctgacacatgttgccacatgaattcaaccttaaggaaattatactaagtaaaataagcaagtcacaaaaacacaatactgtatgattcacttacacaagttatctagagtagtcaaattcaaagaaatagaaagtagaatgttatttgccagtgactgggggtgatgggaaataggagttgtttaatggggtatagagtttcagttttgcaagatgaaaaacctctggagatgtgaatatatttaacactactgaactgtgtgctttaaaatggttaagactaatttttatattatgtgtattttactacaattttaattaaagtgaaaagtttacccatagactggaaaggtatatgtctaacaatgataatcaacaaatgttgatatctagattacacaaagaaactcctaccaatgaataagaaaagcacaattctatagaaaaaatgggcaaaagaataaaaatctgttaatttgtggatgggttaaatacaagcagtcagtaaacatgtaaaaaaaagtcaacctcatttgcaatctcataaatggttaataaagccaaaatgaaacaatttcactcccatccaataagtataaaatttatacttaaaatccatttattaggaaaggtgtagagttttctagtgggagtctaaattgatgaaaccactttgaggaataattttgcattatcatgtaaagttgaatttgtaaatgtacattgactcagcaatttcattcttgggaatataccatggaataatttttgcatgtgtacacaagaagatacagatgtaaaatgcttattaaaaacagtgactttacccaagacatactgagaacaacctaaatgtatattaaaagaaaattgtataattaaatggtatactatgcagtagtgaaatgggatttcacaaaaatgatatttaccataaaagcttaacacatggataaggatactgtatcttctttagggacacattcataagtgataaaaatataaatgccaatcaagatgataaatttacagtagttattacatctaggggaatggtatcagtgctgtaactctaacgttcatgggggatgcatgtggacatcagaatggaagcaggtgtaagggttccacagaagaaaacatggctgccaaagctcagcctggccttagccattgcacgaggcatggtgaactctgccttctataatgtggatgctgggcacagagctgttttctttgactgattctgtggagtgtgggacattgtggtaggggaggggactcactttctcatcccatgggtacagaaaccaatggcattccactgctgctgtcaaccatgcagtatgccagtcgtcgctggtagcagattcatagtatgccagcatccctgtgcatccgcttccagcctgtcactgccagcttcctcacatcctcaccagccttggagaggactccaatgactgtgtgctggtgttctgccatctgtcactacagagatcctcgtcagtggtggctcactttgatgctggagaacttatcactcagagagagctgttccccaagccaggtgagtgatgaccttgtggagtgagcagcggccacctctgggctcatcctggacgtcatgtccttgatgcatgtgaccttcaggaaggcgttcacagaagcagtggaagccaaacaggtagctcagcgggaagcagagatggccagatttgaggtggaaaaggatgagcagcagaaagaggcggctatcatctctgcctatgatatggctccagagcaactcactggtgcccggggatgactacccgatggagctgtacatgctcaaagccaccaagagcgttgcttaccagctcttgtgctctcagaatgttacccacctgcccacggggcagtccatgctcctccacctgctctagtgctacctgcacctccgcgggccaactgggccacagctctgatgattgttaacaccagccttccttctgctcccaccccagaaatcactgtgaaattttgtgattggtttcaagtgaaggaaataaaagtaaaatcactccagatctctaaatactctatcaaatgaagcactttcatttttctcacatccatctacttttttatccacttctgtattagtccattttcatactgctataaagaactgcccaagactgggtagttcataaaggaaagaggtttaattgattcacagttccaaatggctggggaggcctcaggaaacttaacaatcatggtggaagggaaagcaaggtaccttcttcacaaagctgcaggaaggaggatcgccaagcaaagggggaagaaccccttatgaaaccatcagatctcatgagaagtcactgtcccgtgaacagcatgggagaaatcacccccatgattcagtcagctctgccaggtccctctcttgacacttggggattatgaggattacaattcaaaatgagatttgggtggaaacacaaagcctaaccatatcaactcccctgccaaaaattccaaagtatatatgcagactggctttaagccccaattcggggcctgctggagctctggcctaggcactggcaattgtcataacaaaggtagggcagtgtgtgatcgactggggagcacagttgtcagcctgagtaatgtgtagcctctatcctgtccttgatggttgattaaagatttgaggatgatggatatgtagctgaaccgagaaggcaggcctcagttttactagctgtccctgcacagatgcagctgaagagaggtgctaaccaaggtcagagaggaagtggtctgtggtctgtctcttaccctaagagtggttctctctaacagtgtgaccagccaaagcaggtgtttgtaaagtgggcatggactgaagaatctgttcctgttgagctggatgggcctgaatgttgccccccaggtccctaaaacttgggatggacttgagagaggaggcctggaccaagatgtgagtcccattgaagacatcctctctactccccaccttggtctctctcaaatacccaacagaattccaacttgaaggattgcatcctgacagggctgaacatgcctgccgaggaagtatgcatcctgtgttcctggctcactcattcacagactgctcttctcaaaggctctgtgcctgtgctttgaaggaaacaaccatgggaagaaaacaaatgtgtgtaaactgctgtcaataaatgacacccagaccctcaaaaaaacccgaaaattggaaataaaatatatacccaggaatacttctttttattgtgcttcacttattatgctttacagatactatgttaacaaattgaaggtttgtggcaaccttgcatggagcaagtctactggcaccacttttccaaaaacgtgctcacttcgtgtctctttgttggcattttttagcaatggtatatttttaaattaaggtatgtactttgtgattgttagccatagtgatatcacacacttagtagattatagtatagtgtaacataatttttatatacactgggaaacgagaattgtgtggcttgctttatcgtgatacttgcttcattacagtggtcttgaactggaccttcagtatctctgaggatgcctgtatttttaaaactgtgtgttgatcatcattatattatggtgtataccaggtttcagccaactatgacctagcagtcaaatctgcttttgtaaatggagttttattgaaatacaggcaggccattcttttatgtattatctagattgtctttgtactacatgggagagttgattggtttcagcagagaccatgtagttcacaaagcctaaaatatttactatctgaccctttaaaaaattgcttacccttgatctatacttctatacgtttttgtaagtaagaagtattaagaaaaaaaaaagaacagaagaatggtatattggtattgtcattgtcatctgatatccttacacttttgatgaagttatgaagttctttcgtgatccaagttgaataaagttgatgattgctgggtatttagtcagggacattttgttggaaattagtcaactacattttttgtttctcctccaaactatagcagtatcatttatttcctaaattttataacatatttttgtacctacatccttatctaattttcagctgaaaaaataacatgatcttatttctcccacctttttggggaaactattataataatatatataagaactttgccccttgatgaaagcatttgattaatatttggtccaattttagccagaatcttcaggggtaatattcttactataaaatgcttaaaaaattaaaattatattgtaaaacttaaaacttttaactaagtttctaacatttttattttttacttttttttttttttttttgagacagggtcttactctgttaacaggctggagtgcagtggcatgatcacagatcactgcagccctgaactccttcgctaagttgatcatccagcctcagcctagcctgggacaacaggtgtgcaccaccacactcagctaattttttaaaaaattttttgtggagatggggtctccctatgttatcaaagctggtcttgaattcctgggctcaagcagtccttccacctcagcctcccaaactgttgaaattacaagcatgagccaccgtgccaggcctatttcttacttttgatagcagtattagtatatacaatactttaattttgttcctattttaaaaattttttttcaagataaagacagtttaattaactatataataacttctggaatactatttttagttcaaattccgttatctaaatttaaaagcacttaaagttgatacagcaaatatacctcattgttatatccaaaatttcaaattggtaagaataaatctatgaactggattcttagaaatattctcctttttattgttacattaaaataatatttttttaatataaaattattttgaagattatttctccatagggaagtattatataaataacaatttaatgggaataatacaataagattagtttctgttactaaagttttacctgttgcttgtgaaaactaaaaaataaaatgcgattttgtttcacagtaatattaggttatcaaatttattatttaatgaatcgacctcatgttgcttggctatcagggataaaaggtatagagtaccattaccaaactctaaaacattacttatttttttccccactgaatggttatacttagtcactaattttggaataaatagggactgttgcgaagcatcactttcattctttccatattgaattataacgtgatattgtcatgggatccttggggtgtcactttgccagccagaaacctctgtggctagtggcacttttccctgagttttgctcaggcatgctgggctcattccgcccacttggcctgacatgctgcactcagctcatgctgctggcctagatcccatgcgagccaggcacagagcagcagtgggtgcatgagcgggcaagcgcaggttccggccactgtgcacaaccaggcacactgactgctgcagtggggtaaaaagctctaggcactggcacaggcgctagcttcatgcaggcctgcagctagatcaggtgcatcatacgcagcttccactgcaggcacccatgtctggatgagggcaagatgatagcacctggaagcttggagacgccagaaattacagagccccagaaagggtgtcacagcccaggcttggggagcccctaggtctgggctccctgagtcctgcagctgttctctcctcatcacccacagtgtggtgagcgggggtgggaggattgtttcagccctgtttgtgttacagcttttcagtcccaccatttggtgagtcccaagttcttgacccatgttcaggaagaatgagatatgtggacaactagagggtgagcaaggtggagaggagcttcactgagtgacagaacaactcttgggagacccaaagtgggtagctcctttccgcaggcaggtcatcccagtgagtgtccagctgtcagtggaaaggatacctggagtgagtagctcctttccacaggcaagtagtcctgacaaatgcagccctcagcagagaggagacccagagtgggtagctcctatctgcaggcaggttgtcccgataagtgtcccagctctcagcagagaggagacctgcaatgggtaactcctatgcacaggcaggttgtccctatgaatgtccagctctgatcggagaggagacccatagtagaaagctcctttctgcaggcaggtcatcctgacaagtcaaggagacccaaagtggatagtttctttctgcagctggtagtcatgatgtctgtgtaagtctggctggttctggggtctttatgggctcagaagggaggaagctcatgctgactggtctttgggaggccatagacaggcctgaaaaaatcaccataagttctcactctggactgcagactatacccagaactgagagcctggttcccaggcttcaggccattcctggcttgaaggtggagcttcaccagggtcccacccctttctgcccaggagcctttcttcctcctacgccgtcaacatgatatccatggcacccaggctgttcatgccgaggggcgcctgcaggctcacgctaagccatcctcagtaccctctcagcctccctcctgtgctctttggcacccaatgtctggagggggccaaggtgataaggctggcatgtcagcaccacccaagcatgtgcacgcccagctaggtcgtgacaatgcctgggtgtggccacaactttgctctgcccaggagtgggtgccaggagtagggggagcccaggcagcgggagcaaacactttcaagcctgtgggggcaagggcttcctgcacccccaagagtgcaggtatgccagggtctggagccatggctgggcagctgcagttgcacccgggagcctgggactcctgccctgccaactcaatagtggagggagctcccacctgttccagcccccacctagtccatgcagcccacagccctggccatgcctcccccactgcagttggtgtctttgtagtggccactccagatgggccactgctgccatcaatgtcactttttaaaagtgtgtgagagaaaggaagtggatagagtattacagagaaaaattatagataggcaaaatctgttaaagagcatggcagcttgatagaattatagtagtaaagtggataagtttaacttgttagcatttttatatgaggcatgtacaggtcaaattgtcattaaatactgtttgtggaaaaatatgtttttggatgctaactgttctgaattttcctttctagttttgctaattctattggtattttgaaatctgtttaaaatattttatatatgattaatttctgtactactcctgggaggtaacataaaatagtcacctaactttgatcacaaaatttattaaaatttgcattaattaagagcagcaatgtaaatgactactatggttatgtttactatttgagatatttaaaaaatacttcatgtggttacagtttccatttttacacaaatttgagcttataatatatacaacatgatggtatgacatgaagaaaatggaaaggaaacttagctatgttcaataatctaatgaaaaaaatattttggaaaaagttgtatataagtggtaaactatttgaaaatcattcttaaaaaaatttatttcctgctttttaaaatgtgacagactccacctttctatatcctgttgggccatttgtccctgtgcaaacaaaaattggtaattttcatatagatctgattaacaaaaataaatttaatgaagtctgacatatgaaaggaaaatgctccagtttttttcttacttgagtgaacagttttttcacaatctaaaatgagttaactcatacaggaaatttgaaagactcttcatgttttatgtctctccaaaatggaattttgactcacttttacaaaagattttaatatttattatttttatttgtaatgaactttacatataatacaaattttcattttatagatttttacattttattttgttttcctaatgtttcatgaattggaagtactgtaaaataaggttttgcaaactttttctttgaaggtttgggattgttagccacacagtctttgtcatttttttttttttttttaaacaacatctcgctctgtcaccaggctggagtgcagtggcgcgatctccactctctgcaacctccacctcctgtgttcaagcgattctcctgcctcagcctcctgagtagctgggattacaggcatgcgccaccacacttggctaatttttgtatttttagtagagatggtttcatcatgttggtcaggctggtctcgatctcctgacctcatgatccgcctgcctcagcgtccctaagtgctgggattacaggcatgagccaccatgcccggccatattttctggtttttgtgttctcttatttttatgatccttaaaaaccataaaatctgttcttaatttactggccataaaaaaaaaacagtggcagaataggtttagcccatccatagactacagtttgtcaaccccattcctagaataagaagtaataacatcatcaacagaaaaattaaatttagatactgttgataatgttggtgtttatttttcatttaattggctgtgactattatactacatgatgatgtaacttgtaaatctcatatgatatctgtacaggcagtccttgacttacaatgatttaatatgattttttaaattttaatgatggtgcaaaaacggtatgtattcagtggaaactgtacttcagtacagcattcaataaattacatgagaaattcaacatgttaccataaagtaggatttgtgttagatgattttgcccccaaatagggtaatataagtgttctgagcatgtttgaggtaggctaggctaagctatgacattcagtaggttagctatattaaataaattttttacttaagatgcgttcaacttacagtgggcttatcagtacataaccccattttaagtcaagcagcatttgtggttcctttccatgctaagcacttacaagcttttccttaataaatggttatgggaagttagttttctccattttgtttattatctggtgtcctgaatacctgttcttgaaacctttgttttgaaataaatttcattttatttttagctcggcaccagactcaactggtaaaatttcctggccatctaaatttattactatgttgtttaataatgaactacattgactgcagaaagcatttatcttcctatttttgataactagttttcatcaattttgttaacaggtatcattttcagttatttgcataatttctgcctaactagcagtgagcagctgtagttcctagagttgttattagttatcttgtttaaagaaaatggtcactaacactttaaaaatattttacagacatacaccagtgatgttttgtgtaacatttcaagtttttgtaaatgatagattctattttcacattaggggaaaaataattcacttattttgctaaatctcacaaaaacttatcaatctaaaatcaatcatttttaccctaaaaataaaacattttattagcaattttaaaaaatatattataattattctttagagatacctattggcatatgaacagataatcatttgaatttttacaaatatagttaaatgatatttcatcaaaagatctcataactttcaaaaagccactgaaattttttaggtatgtaagttatttgggttctcaaatggtcaagattttgtgttacaacataacttcaatcaaagaaatgttatttcaggaatgatatttaaaatatagaatatttggatagtcatcaagatggaaaaagatggccagttgattagttgcatcagcttactcaacattgacaatcagtgctttaacaattgatggctacattgccttcacatagaaattataatccaatatgaagatatggttatctttaatatctgtaacatagtattttgtatacaatcaaggattttacttcaaacacgtaagatcatgtccacacttcttcgtgctttcagagatggggaaatcaaactaaaacccatgaaataacaaagtcagtctttagccaaggttaaagcttctttagtattgattgaatataaggccctacacaggatattgacaggaacagggaaaaagaggcagtgacatagtgttttgaaagaaaattctaaaagacatactttgatttcttctttttctcatgatggcataacaagaagtagccttattaataatttccaattataatcactagaaaattggacaaaatatatgaataagcagtttttatacattgaacagtaggcctcagataactgtgaaccatgagagaacagaaataattgagttgggctctttaatttctctgatttgcctggaggcactttctggattgtagtacaagaaagggaatttccagtaaatcacagcactcttgctgagttgaggagacagtgatcagagttcaggaagttatggagcagaattttgtggaagaggaagcatcacagtaaaatagcttgagaaatctgcctataagccccttgaatcttgaattttttgagatgcatatgtaaagggcaaaattccacaagactgggtaaaatatgaccgtggacctttagagcaagaaatttctagagctcacagagctgaaagtgtttttctatctctaatcagccagagtggctaatcctaattgatttcctgggacagagagtagacagtccagaagagtggcacattagtagtagagttaaattatttctagagtaaagggttttctagaaccattcaagtctaaatctgatctaaaagtatcttcaaaataggcctcaaatgaccaaattgtttcgccagtaactcaattatgagaacaaagcccaacacattttaaaggaatacagcaaaatgcaaacacttaatgtaatactcataatacccagcatccaaacataattactagacatgagataaagcagtaaaatgaagcacattactgaaaggaaagtcagttgtaaaactttctgggaaatgacagggataaggggtttaaaagacaaggattgtcagctactataaagatgtttaaatatttaaagtaaaatatgggccaagtgccatggctcatgcctataattccagcactttggcaggctgaggcgggtggatcacctaggtaaggagttcgagaccagcctggccaacatgatgaaaccctgtctctactaaaaatacaaaaattagctggacatggtagagcatatccgtagtccagctgctagggatgctgaggcaggagaatcactggaacctgggaggtggaggttgcagtgagccaagattgtaccactgcactccagcctgggcaacagagcgagactccatctcaaaataataataataataaagtaaaatatgaatgtgaagtgaattggacaatgtaaaaaagaaagaaatggaactctggaaaatgaaaaataaaggcctaaaatgaaaattcatttgatgacttgagccgaatattttatactgattaagaaatagcagtgaactcggagatgtagaatagtatgtttccaaactgaagcagagaaaagacgaaaaaagaaatggagaccagagccatagaaacctattacataaatcaagcagtttaatatacatggaattggagttcaaggaaaaggggttgagagtggaaaataatacccaaatattttgaagactataaatcctaatatccaagaaattcagctaaccatgagcaggattaacacaaataaaaattaccacgtaacataagtaaagtgtttaaaagcagtgttaaacagcaaaatttcaaaaaactcttattagcaagagacaaatagctagttcacttaacagtgacttgaaaagacacttcaccagtgattatattaaatgccagatgagcacatagaaagatggccaacatcgttagcgatcaggtaaatgcaaattaaaaccaaaattaaatacctctacaaatatatgagaattgctaaaataaaattactgacaattccaagtgctgccaagaatatgcagcagctggcatctcatccatggttgtcatccatggctttgagaatgcaaaatagtagccatagaggaaaatagtttggaagtttcttatttagttaaacaaactcttaattatatgaccgagtaatcccatttctgagtattttccctgaagaaatgaaacttatgttcacacaaaaacctataaatcaatgttcacatcagttattggtgtaatagtcaagagatggaaaaacacaaatgtccttcatgaataaacaaaccatgatttaaacacaggaatgctactgaacagaaacaaagggccacacttataaacctgactatgtagatgaactcaaagacattattacaatgagttttcttgtgagtaagaaaactcatttcaaaaagttacatattgtgtatttccttttttgggggaaattctcaaaataacaaaatcatactgatgaaaatggattagtggtggccaggagttatgggtgaggttaagacttccaaggattccttcaggcagtggagctattgtgtgttgattgtggtggcaaaacacagtgcatgtgacaacactcataaaactacacaaatactgataaaagacttgtacaatgaaaggtacaaaccactgctgaaagacattaaaggcagaaataattagcaagctattccatgttcatgggttggaagagtttacgtcagtcctacccaaagcaatttatagattaattgcaatttctataaaagtcccaataatgtgttctgcagaaatagaaaaatcaatcctaaaattcatttgcaaacttaaggaaccctgaataaccaaaataatcctgaaaaagaagagcaaagctgagaggcacacacatcctaatttcaaaacttgcaacaaaggtacagtaatcaaaacagtgaagtactggaatgaaacagacatataaaccaatggaatacaatctctagcccataaataaagtctcctatatacagtcaaattatttttgacaagagtgccatgatcattccctgggaaaaggcagtcttttcaacagatgggaaaagtggatatccacatgcaaaagaatgtagctggacccttcactaacaacacagacagaaaagatagactgcaatccaataattgtagcagactttatcagctgacttttagcaatggagagatcatccagacagaaaatcaataaggaaacattggacttaaactgtactctcgaccaaaaggacctaaccgacatattgaaacattctatccagtagctacagaatacccattcttccccaatccacatggagcattctccagaatagaacatgtatcacaaaacaagtcttaacatatttaggaagactgaaattgtatcaggtatcttttctgaccataaaggaataaaagtagaaattgaaaacaggaggaacaacttcagaaaaatcacaaatacatggaaattaaacagcatgcttctaaacaactaatgggtcaaagaagatattaaaagaaaaactttaatatttcttggacaaacaaaaatggaaacaacataccaacacctatgagatacagcaaaaggagatctcagagggaattttacagtaataaatgcctacatcaaaaaagaagaaagatctcacacaacctacagtgtacctcaaagaattagaaaaacgagaaaactaagcacaaaggtagtagtagcaggaaggaaataataaagatccgagcagaaatagatgaaatagagactagaacaataggaaagattgacaacacaaagagttgttttttttttaaagaaaaactttacaaaccattagctagactaagaaaaaagagaagactcaaataaaatcagaaatgaaaaaggagatattacaactgataacacagaaatacgaaggacaacaagagactattatgaataactatatgccaacaaatcggataccctagaagaaatgaaaaaaaaaatctagatacatacaatctaccaagattgaatcatgaagaaatagaaaatctgaacagatcaataatgagtagggatcaaattagtaataaaacatctcctatcaaagaaaagcccaggatctgatggcttttctgatgagttctattaaacaactaaagtgtttatactcatctcaaacccttttaaaaaattgaagaggaggtaatatttccaaacacatattacaaacccagcatttccttgataccaaagccaaagacattatgaaaaaagaaaactgtaatacgatatccctgatggacatggatgcaaaaatctgcaacaaaatactagcaaacccaatttaacagcacgtttaaaagatcagtcaccatgatcaagtgagattcatcctagggatgcagggatagttcaacatacattaatcaataaatggtgatacatcacaataacagattgaaagacaaaaaccatatgatcatttgaatagatgaagaaaaagcatctgaccaaattcattgtttttgcatgatagaaagtctctacaacttcagaaggaatatacctcaacacaataatgggcattctgacaaacacgactagcatcatattcagtggagacaatttgaaactttttcctctaagatctgagagagaacaagtaaactcactctcttcacttctgttcaacgtagtagaagtcctggacagaacagccaggcaagagaaagaaataaaatgcatccaaatgagaaaaaaaaaatgttaaattgtctctttgcagatgacatgatcttatatgtagaaaaccctaaagaatcctccaaaaactattagaactaataaatacatttagttaagttgcagaacgcaaatcaatatacaaaaaatcaatagtgtttctatacattgacagcaaattatttgtgaaagaaatcaagaaatcaataatatttgcaattgcaatgtttcctaagtaaaatgcttaggaatgtgtttaaacaaggaagctctctacctgaaaattataaaacatagatgaaagaaatggcggaagacacaaataatgaaaacccatatggatcatgggctgaaaagttaatagtattcaaactacacaaagtgatctataaattcaatgcagtccctatcaaaataccaatgacattcttcacaaaagtagaaaaatcatttctaaaatatgtatggaaccacagaagaccccaaatagccaaagtaatcttgagtaaaaaaaatttgaggcatcacattagctgactgcaaaacatactacaaagctatagtaacccaaacaacatggtactgacataaaaatagacatacataccaataggatagaaagatagcccagaaataaatccacacatttacaactaactgatttttgacaacggtgcctaaaaacagtggaggtagggagactcttcaataaatagtgttgggaaaattggctatccatgtttagaaaataaaatgagaccctcattttacatcacacacaaaaatcaactgaaaatgaattaaaaacttaaatgtaagacctacaactatgaaactactagaagaaaatatagtgagaaatctccatgacattggtccaagcaaggatttttggatgtgactctaaaaacacagacaacaaaagcaaagacaaatgggattgcatcaaactaaaaatcttcggcacagcaaagaaaacaaacaacagttaagaagtaatctacagagtaggagaaaatatttgcaaactatacatctaacaagtggctaatatccaaaatatataagtaacttaactaagccagaaaacaaataacttgatttaaaaatgggtaggagaactgagtagatatttctcaaaagaagaaatacaagtggccaagaggtatataaaagtaatgttcaacatcactaatcagaaaaatgcaaattaaaaccacaataagatatcaccttcctttttaaatataaatattaccaaaaagataataagtgttggcaaggatatggagaaaagggaacacttgctcactgttggcgggaatgtgaattaggatagccattgtggaaaacagaatggaggttcttcaaaaacctaaaaacagaactaccatatgatctagcagtttttctactgggtatgtatccaaaggaaattgaattagtatgtcaaagagatatctacactctcatgtttattgtagcattttttcacagtagccgagatgtgtactcagtttaagtgtccattaacagattaatggataaagaaaatacgctatatatacacagtggaatactattcagcataaagaaggaaatattttcctttgcaacagcatggaagaacctgggagacattatgttaaatgaagtaagccaggcagagaaagacaaatattgcatcatctcactcacgtgtggaatataaaaagttagactcataggtatagagagtggaatgttggttaccagggcctagggtagttggttatgggagttggggagatactgatcaatggatacaaaatttcaattagataagaggaataatttcaagaaatctatagtacaacctggtgactattgttaacaataaacagttatcccatgaacaactcagtgttcggggtgctgaccacgtgtgcagttgacaataccatataacttttcaactccccaaaacttaactactactagccttctattgacaggaagccttattgataacataaagtaaattaacacattttatatgttaatatgtactgtattgttaagaataagctagagaaaaggaaatgttattaagaagattataaggaagagaaaatatatttactatccattaagtggaagtggatcactataaaggtcttcaacctcattgcctttacattgagtaggctgtggaggagaagaaagaagaggggtttgtcttgctgtctcttgggtggcaaagacggaataaaatccatatataagtggacacaggcagttcaaagctgtgtctttcaagggtcaactgtattatatttttgaaaaatgctatgagggtgaatgtaaagtgttcttaccacaaaaataactgtgcgaggcaatgcatatgctaattagctagatttagtctttccacaatgtgtatatacttccaaaaatgatatttacaaaatatacaattttatctgtacattttttaatgaacaaaaatactccaaggagaaaagcattagggcattggatttggcaattatatcttggatatgacaccaatggcacagaaaacaaaagcaaaactagacaaattagatgtcataataattttagacttttgttgatcaaaatacattatcaacagagtaaaaaggcactccacagaaagagatacatatttgcaaatcttttatctaataagggatttatatccagaatatataaaaatctcctaaaactcaaccacaaaaaaaaactcaaaaaagcacaaaagacttgagtagacattttttcaaaaaagtacatacaaatggtgaataagcacatgaaaagatattcagcatcactagtcattagggaaatgcaaaacaaatccagaatgagatgtcacctcacaccattaggatgggtactatttaaaaaaaaaaaaagaagaagaaaaaacaataacaaatgttggtaaggttgtggaataacttaaacactgaactgttggtgggattttaaatggtacagctgatgtgcaaaccagtgtggtcgttcctaaaaaattaaaaatataattaccatgtcacctagcaatttgacttctgggtacatacccaaaggaattgaaagcctggtctcaaagagacatttgtatacacacgtgttcattgcagcattattcaaaacagctaaaacattgaaataacctgggtgtccactgatggaagaatgagtaagaaaaatgtggtacacatgcaggggaatattattcgcttttaaagagaattcgggcatataatgcaacatgaatgacccttgaggacattaagctaaatgaaataaacctgtcacagaaaggcaaatgatgtgtgattttatttatatgagggacatagagtagtcaaaaatcacagagacagaaaatagaatggtggtggccaggggctgcagggagtggggaatggggagttactgtttaatgggtgtaaagtttcagttttacaaaataagagttatggagatggatgatggtgatagttgtacattatgactgaacttaatacctctgccttgtacacttaaacatgattaatatggtaaattttatgttttatgtcctgtaccacagtaaaatattggaaaaaatatacaaacttagaattaaacaaattctattaaaaataacacaaacacgccaacaacaacaaaaaaccatgcagccctgttgcaaaaaatcttgaaaactgacccaaattttatctgtaatcttgcctctgaacattatcattttgtatattcatttccagtctttttttagtaaatatatttttatgtaggagaacaagtaaaaaggtccattttaatgtatgatcatttaaattttaagttttaaaaaatctgtcagaagaaaaatcacatcacttgcaaaaatagacagaaattatgcaagccagaagataatggaacatctttaaagtgctaaaatgatagactgccaacctgttattcttaattcagtgaaaatattcttcaaaaatgaaggtgagataaagactttttcagacaacaaaagctgaggaaatttattgccagcagatctgtattgtaacactgttaagaaaatggttttcaagcagagggttaaagataccagatggaaacatggacacatacaaatgaaaaaaggagtacaagaaatggtttctgtgtgaatattcaggtgctcctcaacttatgatggggttacatacccataaactctttttatgtaaaaaataacataagttgaaccatcacaagttggaggtcatctgtatattaaacattgttttctcatttttagtcgatgcagaaaatgcatctgttaatattcaatacctagtcataataaaatctcagaaaaataggacctgaagtgaaaaaaagctgaactaattggtatctaggaaaaaacaacttatgacatatttgacagtaaaagaccaagtaagattgggcaagagttttatgtctcattactttaacattttactgaatattctaactagtacagtaaatatgggggatgcatattccctcttactacatggaagtggtcaatattatagagaagtcaacagaaggaagattaggaacagaccacatgatgtcatcgttagaatctttgatttggagacagacctcagaagagtagtggaaacgaatatagaactgtagggtgtaaaatgtttgaataacaaactgagtaaacagaccattcgttggagaaatttgacaatgaaacaaaagaggaaaattggtggaggtttgtgtaactgttgaagattttattcatggaagggaaagctatgtttgtttggatatagaggaaaaagaaccattggagatgtaaaaatgaagattgacagagataagagaaataatgcagaaaagctgtcatgagttaagaaaggacttagaagaaatagagaagtttgctctggaggggagcaaggacaacttctaaacttagaaggataaattataggctaggaatagacatgggttgagggaaatgtaaatggaattttctctgtccattttatttattcaatttaccattcaggatattctaattcagttattacttgattttgtgtccaaaggatacctctttttgacttgacctgatgttctgagaacttctccaaattatttttttcttacaaataaatagaaattaagtagcccccaaagtaatccaaatgtttactaaatgtagaagttgacaaagatttttttcattacagttaaattctaccaataaaacaacctccacatagagaaattatactcttttgtcataaacaaacatttaaaactgcacagtttagtatttcaatatggaaatttccttttatgtaataaagatggttaatccaaagaagacatgatttgtcaagaagaatggttacagaccactttcaagatggctgagtgggaaaagctttggtctacaggtcccagcaagatttacgcagaagatggtgatttctgcatttctaagtgaggtacctcgttcatctcactgggactggttggacagtgggtgcagcccatggagggcgagctgaaccagggcagggtgtcgcctcacctgggaagtacaagaggtctggggatttccctttcctagccaagggaagccatgagtgactgtacctggaggaatggtacacgcctgcccaaatactgtgcttttccaatagtcttcacaaccagcagaccaggagactccccccgtgcctggcttggtggatcccacacccacagatccttgctagctgctagcacagcagtgtgagattgacctgggatgctggagcttggcagggggaggggcatctgccactgctgaggctttagtaggcaggtatatgctcacagtgtaaacaaagcagcagggaagcttgaactgggcagagcccaccacagcccagcaaggcctactgcctctctagattccacctcttggggcagagcatacctgaacaaaaggcagcagacagctactgcagacttaaacgtccctgcctgacagcaccgaagagagcagtggttccccccagcatggcatttgagctccgataacggacagactgcctcctcaagtgggtccctgacccccatgtagcctgactgggaggcatctcccagtaggggcctacagacacctcatacaggtggatgcccctctgggacgaagcttccagaggaaggatcaggcagcagtatttgctgttctgcagcttccactggtgatacccaggcaaacagggtctaaagtggacgtccagcgaattccaacagacctgcagctgagggacctgactgttagaaggaaaactaacaaacagaaaggaataacatcaacgtaaacaaaaaggacatccacaccaaaatcccatccataggtcaccaacatcaaagaccaaaggtagataaaaccacaaagatggggagaaaccagagcagaagggctgaaaattccaaaaatcagaatgcctctgctcctccaaaggaacacaactccacgccagtaagggaacaaaactggatggagaatgactttgacgagttgacagaagtaggcttcagaaggttagtaataaacttctccgagctaaaagagcatgttctaacccattgcaaggaagctaaaaatcttgaaaaaaggttagactaatggctaactagaataaccagtgtagagaagagcttaagtgacctgatggacctgaaaattgcagtacgagaacttggtgaagcatacacaagtatcaatagctgaatagatcaagttgaagaaaggatagcagcaattgaacatcaaattaatgaagtaaagcatgaagacaagattagagaaaaaagagtgaaaagaaatgaacaaagcttccaagaaatatgggactatgtgaaaagaccaactctacgcttgattggtgtatgtgaaagtgacagaaagaatggaaccaagttagaaaacattcttcaggatattatccaggagaatttccccaacctagcaagacaggccaacattcaaattcaggaaatacagagaacaccacaaagatactcctcgagacgagccaccccaagacacataattgacagaatcaccaaggttgaaatgaaggaaaaaatgttaacggcagccagagagaaaggttgggttacccacaaagggaagcccatcagactaacagtggatatctctgcagaaaccctacaagccagaagagagtggggccaatattcaacattcttgaagaaaataattttcaacccagaatcccatatccagccaaactaaccttcgtaagtgaaggagaaataaaatcctttacagacaaacatatgctgagagattttgtcatcaccaggcccatcctacaagagctcctgaaagaagcactaaacttggaaaggaacaaccggtaccagccactgcgaaaacatgccaaattgtaaagaccctcaacgctatgaagaaactgcatcaactaacaggcaaagtaaccagctaggatcataatgacaggatcaaattcacacataacaatattaacctaaaatgtaaacgggctaaatgccccaattaaaagacacagactggcaaattggataaagagtcaagacccatcagtgtgccgtattcaggagacccatctcacgtgcaaagacacacataggctcaaaataaagggatggaagaagatctaccaagcaaatggaaagcaaaaaaaagcaggggttgcaatcctagtctctgataaaacagacttttaaaccaacaaagatcaaaagaaacaaagaaggccattatataatggtaaagggatcaattcaacaagagctaactatcctaaatatatacgtgcccaatataggagcacccagattcataaaacaagttcttagagacctgcaaagagacttagactcccacacaataataatggaagacttaacacccaactgtcaatattagacagatcaatgagaccaaaggttaacaaggatatccagaacttgaactcagctctgcaccaagcagacctaatagacagctacagaactctccaccccaaatcaacagaatatacagtcttctcagtaccacattgcacttattctaaaattgaccacataattggaagtaaaacacccctcagcaaatgaaaaagaacagaaatcacaacaaactttctctcagaccacagtgcaatcaaattagaattcaggattaagaaactcactcaaaaccacacgactacatggaaactgaagaccctgcacctaaatgtctactgggtaaataacgaaatgaaggcagaaataaagatgttctttgaaaccaatgagaacaaagactcaatgtactagaatctctgggacacatttaaaggagtgtgtagagggaaatttatagcactaaatgcccacaagagaaagcggaaagcagaaaagatctaaaatcgacaccctaacatcacaattaaaagaactagagaagcaagagcaaacaagttcaaaaactagcagaagacaagaaataactaagataaagagcagaactgaaggagatagagacacaaaaaacccttcaaaaaaagtcagtgaatccaggagctggttttttgaaaagatcaacaaaatagatagactgctagcaagactaataaagaagaaaagagagaagaatcaaatagatgcaataaaaaatgataaaggggatatcaccaccgttcctgcagaaatacaaactaccatcagagactactataaacacctctactcaaataaactagaaaatctaaaagaaatggataaattcctggacacatacaccctcccaagactaaaacaggaagaagttgaatctctgaacaggacaataataggttctgaaattgaggcaataattaatagcctaccaaccaaaaaaaagtccaggaccagacagattcacagccgaattctaccagatatacaaagaagagctggtacctttccttctgaaactattccaatcaatagaaaaagagggaatcctccttaactcattttatgaagccagcatcaacctgataccaaagcctggcagagacacaacaaaaaaagaattttagaccaatatcctgatgaacatcaacgcaaaaaattctcaataaaatactggcctactgaatccagcagcatatcaaaaagcttttccaccatggtcaattcagctccacccctgggttgcaagactggttcaacatatgtaaatcaataaacataatccatgacataaacagaaccaatgacaaaaaccacatggttatctcaatagatgcagaaaaggccgttaacaaaattcaacagcgtttcatgctaaaaactctcaataaactaagtattgatggaatgtatctcaaaataataagagctatttatgacaaaccgatagctaatatcatactgaatgggcaaaaactggaagcattccctttgacaactggcacaagacaaggatgccctctctcaccactcctattcaacatagtattcaaagttctggccagggcaatcaggcaagagaaagaaataaagcatattcagttatgaaaagaggaagtcaaattgtctctgtttgcagatgacataattgtatacttagaaaaccccatcatctcagccccaaatctccttaagctgataagcaacttcagcaaagactcaggtacaaaatcaatgtgcaaaaatcacaagcattcctatacaccagtaatagagagccaaattatgagtgaattcccattcacaattactacaaagagaataaaatacctagaaatacaacttataaaggatgtgaaggacctcttcaaggagaactacaaaccactgctcaatgaaataaaagaggacacaatcaaatggaagaacattccatgctcatggacatgaagaatcaatatcatgaaaatggccatactgcctaaggcaatttatagattcaatgctattaccatcaaactaccactgactttcttcaaagaattggaaaaaaagtactttaagtttcatatggaaccaaaaaagatcctgcatagccaagacaatcctaagcaaaaaggacaaaggtggaggcatcatgctacctgacttcaaactatgctacaaggctacagtaaccaaaacagcatggtacttgtaccaaaacagacatatagaccaaaggaatggaacagaggcctcagaaataacaccacacatgtacaaccatctgatctttgacaaacctgacaaaaacaagcaatggggaaaggattccctatttaataaatggtgctgggaaaactagccatatgtagaaagctgaaactgaatcccttccttacaccttatatctaaattaactcaagatggattgaagacttaaaatgtaagacctaacaccataaaaaccctggaagaaaacataggcaataccattcaggacataggcatgggcaaggacttcatgactaaaacaccaaaagcaatggcaacaaaagccaaaatagacaaatgggatctaattaaactaaagagcttctgcacagcaaaggaaactatcatcagagtgaacaggcaacctacagaatgggagaaaatttttgcaatctactcatctgacaaagggctaatatccagaatctacaaagaacttaaacaaatttacaagaaaaaaacaaacaaccccatcaaaaagtggccaaaggatatcaacagacatttctcaaaagaagacatttatgcagccaacggacacatgaaaaaatgctcatcatcactggccatcagagatatgcaaatcaaaaccacaatgagataccatctcatgccagttagaatggcgatcattagaaagttaggaaagaacagatcctggggggagggatagccttaggagaaatacctaatgtaaatgacgggttgatgggtgcagcaaaccaacatggcacgtatatacctatgtaacaaacctgcacgttgtgtacctgtaccctagaacttaaagtataataatttaaaaaaagaagagatgagcacccaaaagttgtagatggcatatctgaacatctgctatagggctgactgaatacatgtaatttttagtcagtataagatgactttatcccttactatgaaatcaatcttctactttgatatggtgattagaagacacttttgttttacaaaataagagcacatatggcctgtgttgtatattccatgataatttttaaagggaattattttcccttttgttctaatacaattggtgtatttgtataaatttttaaatgcgaaccaggaaaataccaaaaaaaaagaggctatgtttagaattaccctcaggcatctggtgtgagcttggattgttttgacaaatcaagacatttgggtgcttaaaatacaaggtaatgtaatgaaaggtctatatattccattaaatttatgtcattgaataacaggtttggtttggagggcatacatgtaacttcttttgagacaagaaatatttttacattatgaaaaactgcatgctgactataatgtctactcatgataaactacatggaatcttcaagaagctaagcatggaattaatgttggcttttattattatactctctgggatactaatgcacgttagagaaatatgtaaacaacttgggaaaaaactaaattgggaaatttttaaaaaggaaatacattgcttagcacttatattgtagtgtttacattttccaagtaatttatatacttattacagacatactgtagttcctaaatgtgaatagactataagatactagcctgagtttatttagtagctgatggccttctgcccatcctcaggttgctctaagcaaagtccacgtttttttaattgaattctgattctttttgaatataaaatagattatacatttgtttaaattttgtaatattacattacatatttaaagaaaactttagagaacggtttactttttccttctgttttaacagagtaatggaaagcatgcatgcagaacaataacaatgcaacataagcatctgtggccccaggtggcagggatgtagagagaacataggagatacctatatgtaaaaattcagctagttatggacaagattcaacaaagctggtacttaccttaacactgctttgtttccaactatattcttaaaacaaaatttggtaaagtaaaaatacagtacatacacaaaaaaaccaaggtggatgacatgcagatcaggtttaaacctggcagagaccaggtattaaaggaagtaaagacatcagagagccagaaaaactcatatttgttcatgacttattaaaaatcacattaggccgggcgcggtggctcactactgtaatcccatcactttgggaggccgaggtgggtagatcacttgaggtcgggtgttccagaccagcctgaccaacatggagaaaccctgtctctaccaaaaatacaaaattagccaggtgtggtgtcacatgcctgtaatcccagctactcaggaggctgaggcaggaaaatcacttgaacctggtaggcagaagttgcagtcagctgagatcgcaccattgcactccagcctgggcaacaagaaagaaactccgtctccaaaaaaaaaaaaaaaaaaaaaaaaaagtgggggaaacaacatatgtatgcaaaggagggtagaaagaaaggagcagcgactttgccaaatacacatattctaaaggaaaaaaagaaacctagattctagtcattcttgaaaaaaatttgaatagaaagggacaaaattaaaatatgatttagagtcggttacagtggctcacacctgtaattccagcactttgggaggctgaggcaggcagatcacttgaggccaggagtttgagaccagcctggccaacatggcaaaaccccatctctactaaaaaatacaaaacttagccagtgtggtggcacatgcctatagtctgagctacttgggaggctgaggcaggagaattgcttgcacccaggaggcagaggttgcagtgagccaagatcgcaccactgcactccagcctgtgcaacaagagcaaaactccatctcaaaaaatatatatatatataaaatatatatatatacataaaatatatatatatgcacacatatatatgcatgtatatgatttagaaacagtagtgtacaacaagcattaaatagaaggagagtttgggtgtagaaagaatagattgtattgaacaaactcaataaggatgttataaatttgaacaatggaagaaaaaaggatagttgaaaggcagttttaaagtatatgaaagtggcttcattttctctacctattattgtattgtaagtttaacacatggcaatacaatgcaatgtaattgaccattttatgttcaagcctaatccctgctaaaagtattaagagcctttattggtcccatcatttaaccaaaatgctcaaggtctacaagataaaaccccgtgaactcacaaaaacagattctataaatgatttgtcatctttatgctaccgccaaatactgcctgttggtttagccacttttgattcttgttttcaagtacataattaaatagaaatttgatgcttaaataactaagaaccaatacttttccatatcatttcatttctgctatcatatatcttatttttggtaccagttcagcccagtaagacctgaaggaaggacttagaacctgggatactcaagacagaaagaactatgtatgctttagcacaaggattggcaaactatttcttagatgggccaaaacatgaatacttcgggctttgcaaccatgtagtctctgtcatagtgctcaactttcccataacatggaatttgctacatacaatatgtaaaagaataagctcagctgtgttctgataaaattttatgaacactgaaatttgaatattgtataacttttaagtatcatgaaatattgcctttctttctgtttttccactaactttaaaatattaaaactatttttagctcacaggccatataaaacagaaggtgggccagctctggagaattgattttcagactgcaggctgtgattcattaggtatacaatgtaatcaataaagcaagccctggccaatactttttaagggcaaaccatgccatagcataacatagatgagaatatcacagttaaaggaagtactattttgtaaaacatttgtttcagttacatatacaggatcatgatatgaaatgtattgctgtagactgtaataaaaaagattttaaatcattaatctttactagcaaggaaatttagtgtcaagaatgtgatgtgtcttagctcaagtttacacagctagtttgtagagactacattaaaaccagatattctgattttcagttcagagtttctttgactgaattaaaaattagattcagactaaaataattctgaaatacttataaaattgcctaattttgaatgatcaggataaaccctaacattaaaatatttagaggaatgtaaaaactaactggcttattactaacattcagattattagcaatagtcacctaatttgagtttaaaacaatacaatgaattagaaagtatacagacagagtttttcctggaccttgatctgtgctgtccagatatgttgttccttgctctctagtttcagactaggaggtcaggcccagggcatgtcaactttgaccatcagtcttcagtctgtccttctcaggtatcaaaacacaatttttcccattacacatgccccttaattaggtagcgttaccacaacataggtggacactggatcacaagagaaataagccaccaagaactaacttgctgaaaagcctgagaaaaataagctgagggaatggacatttcctaagacataaacctggagaagttatccatttctcctgtctgcccatcatgggtgtgtcaggttgattttttaaaggacaattttaacatataagactattttctaatttttaaattatttgaaatttattttagtagagattttatttgtgtgtatctagctaaattaatttatagggatatacatgttatattatccacacctgaaaggttgttctctctgtactcagtaggattgttctaattacacaaagtccaaccaaatatattcttctgattaaacatatattttagcttataaactatttacttaaaaagattatataggtaatttcaactgaaaaatattctcacattaagtgtgctatttacatatttgttttgttatagagaatatctgaggctctacatcctctcatgagtaaaagaagatgtttaaattaatttcagcagattttcttttataaattgaataatattatttataattactgatcctagaataatccctaggtcagtttttctctagaaattaatagctgttcattatttcaagttaaatatttcctactggtattttttaattccaccattttctaataatcacaataggaattacattaatagcatcatttagcttgcttaccaagtcaatatcctaaaaagattctgagataatacttggtctcatcataataaactgatcaatgtaactacctgtatactccattagaattcaggcttctccagcagatggaacataactgttttatatttgtgtcctggcctatggtaagtatgcacactacttatagaatcaaatctttggatgccttttatccttggaaatgactgggttctctttttgacagatttttttttttgccatttatttgatgcccttttttagatttcctagttcatccaatttcaaaatataactcactttgtaatagatctccgtcatattataactggattctgagtaataaaagtaccacttacttttagtttataataggtctaatattttacactagaagtgtttttttaaaattacgaagtgactcacatactgacttctttattgtatcattattggactgtattctggtatgtaatatagaacttgactcttaagatctcaccatgaattgtggatagttgtgatttggatataggattttctagttaggcaaaataatcttgttaattcaatgacatgtaattttttgtgtatatagtctttggcatactatcccaataaattatttcttgggttgaatcatgattataatagtttctgtgactttggggaatatcttcaatgttgtaaaattgaaggaaattctaagaacctatttcattcctatgaatgaatgcaactgtactgattactcatctctaatttttttcttaaatggaggattcgtaagaaaattcgacttggattacatttgagaatttattgctttgagcacaaataaggaactttgtgaagtttagtttgttttttcagggtatttcaacaatttggcaataattattgtataaagttaatgtgcttttggaagtaagtgaggttcgcctgactgacctctacttgaacctgccttagcctgaaaccatttttttggtgatttatgccttaattacaatgattatcaaatagtttccttttaccaattatgttttttctctttgacttcgtgaatatctttttatgaagagtgatacatagcatttccattttacatgatatattatttaagtatttcaaagaaaaaacaccagtgcttttttgaatacaaaaataaagatcttaaaggtgtatacaatacaaaagctacctgaaatttatttaaatttgtgaacttgtaattagtaaatatatttatttgagaatttaaataaatatcagaatttaggtagtttgaaactgtatacaaattgttcgtgtatacacactatgcttaaaaggatttatattttatagaatataaattatgttatttatttatttattttgagacggagtcttactctgtcacccaggctggagtgcagtggcccagtcttggcccactgcaagctccaccttccgggttcactccattctcctgcctcagtctcccgagtagctgagactacaggcgcctgctaccacgcccggctaattttttttttttgtatttttagtagagatggggtttcaccgtgttagccaggatgatatcctgaccttgtgatctgcccacctcggcctcccaaagtgctgggattacaggcatgagccactgcacccggccaattattttatttttaatatggaagcattactatagccacttttatttaaatgtaactacttgtgtaatgtaatcatatgactaacatggtatatgttctcttttgattattaatatttcttgaaatgatgtgtacatggttaaaacacatgtatcattcttaataattatttaggaccagtctttcttgagcagtgttaaaatttgaaccagacataggttagtaactttagaatttaattaaggcttttgaaatttcaaggagctcagagagaaataaagaaagttgatgcagaggagtgatacaggaataacaattgattctataattaaatttaacccaaaaataattgcaagatccaaatgatttatgatagcgaaaatgtctcttatttcccttatttcatccgtactcattgctgttgtgattatattagcaagacactcaggtcagtcaccttctgtagtagaaatctgagttactactgtgaataaaagtatctcattcaatttcaaaaataattgttttatattatttagagtcatagtactttattgtaatccttatttcagtaccatattctttagactcttacataaatctgtatttgtatgtcttatctctgtaactggtctgttagctccttgagaccgaagactgtatcatttctggatttcttaaagatccttatagatagtgcaaggcctatagcagtgatgtaattattgttccttaaataaatttttaaagcataaattaaaaaacagtaaagttggggcagtgtttcacagacagtaggtgttaataatattgctgataatgccattagagtattctcttcagctcatattaaaatcaggttactagtttaaatctgtataaaaaccatcactatagattcctttttgtattataatctgtcattttgtagaagatttatctgtgagtgttatgaacttcaattctggcattatgtaaaaaattctcagcagaagcaaaactataaaaaagaaaaaatattcacagtaagatttctaggctgtatcaacacaatgacaaaaaatttagaaagtttatttcaataaatcaatcaaaattattatttgggtattgtgtaactacaattaaacttaactttgtttctgagcaatctaaacattctgggattacaatttaaaagcacttagtcaaccattctcatgtggaaattgatttcagttcttccaaatatctgaaatttccgtagggaaatgtgtaatatcaaattactttgaaattgcaattaaaattaataatattaatttctttatcaatcttcgaaaatatctcatgtaacacagtaccactgatttctgacttttgataagccagatgcattttacaattcaaatattttggatcaaagaaaggtaataagtgcatatatttcatagcatctttaggaaaggctgggagagctccctaataaaacacattaacatgtctacagtaatacataaggattttcacaataaatagaataacaaattgtaaatagcatcacattattcaggggaaattttgctgataattgaatttgtgataatcttacatgaaagctttcagttttcagagctttttgggtttcagaattgtaaagtatcatggatgtacagctgaaataattgcccctgtgatttttaatatctatagatgtgtaagtgtgtgtatgtatgcatatgtttttctttttccttttctcttacagatatgtactcatgcacatgtgtacacagacacacacacacacacacacacacacaccacacagatgcatgtacacacacatcttgggatgagtaaatagtttccttggaagacagccaaactcatttgtttatgtattgtctatggctacctttgtaccacatgccagagttcagtggttgtgacagaaacttatagccaccaaagtcaaaaatatttactatcaggacctttacagaaaaagtttgctgccccctaatatatctggtatatccagaaacttacgttttgttcctattttaaagacagtaagactgccataagtttgtgataactcagtttttagtgaactaaagaaatcaatgaatgcatgaactctcactgtctttacagtattttgcagggttttttttgttaaaatttataatccaaacatgaatgtaagctgcattggcttaattatatttaaataaacttttttagtcaaaaaaatgaattttattatagttttaagttaatattagagttgattccatttgtaatacagttttaaaataaaatacttgagagaacacataggcaaaccttaaaatgtccaattaacatagtaactaatctacctatatacatcttaatattaattttagcaatgataaaaatttaagccattattgttatttcaaaggatgtttcatgtctatttttgtttgttttcttggttttgaattagaaagccacatgaattgcttgctttgctgttttttagggtttagatcttagtaagttcaggtgacttacatggtaacattgaaagtaaattttacagagagaagcatatcacagtgagggaataggaagacaatttcatgtttcagattaaaaaagtaaaagaatagtagaaaatatcagaaattactgttgtgcagatagaggtgtataagtattacaggagtctaaaagacactcattatggtaataccctgtgtcttagaatccttcacaataccatgggagaagtgtagagaacagaattttgaagaatacaccactgaaactaaggcaaatgaagcatattggacatgcaaaattcctttccacgtctatagttattcaacatttgttactgaaatgaaagtatttcagtgccattcagctctactaatttggggatttttaaaagttaagaataggctggacctggtggctcaagcctgtaatcccagcactttgggaggtccaggtggatggattgcttgagctcaggagttcacatcagcttgggaaagttggcaaaaccctgtctccacgaaaattacaaaaattatccactgtactccagcccaggtgacagagcaagattttgcttccaaaacaaacaaaaagattaaaaatcattagaagattaactaaaaactagttagtcctaggcatatttgatttttaaaattcagattgtcagtatagtcatgtctatttgatagaaaataaattggtatcttttattgtgaggagaaatattgtctataatgaaactgatcacttttccttctgcagatttgcttcttaatttgctttccttatctcagttaaaggtatcatcatcacactctgatggttcctttaccctgtcccaaatagttgttaaaatagttgtctaaaatagtttgtctcattacagaatgccttgagtctgtctctccttgcattgtcaccatcttgagctcaagctttcagtcgtgtaactaaactctttagttactagcttcttcctatactgctgacagaaagtggtctttccaaaatagagctaattctgtctgcgccctgcttaaaatcctgtagtggctccctggtgatgataggatagtgtgccatgtatggctctgcttcctgcctacctctctgtcttcatttccagtcacttcctttcatccttcacagcctacgacataacattccaactccactttgctgacgattgcatgcttctttatacctcagacatttctctgtcacctggaatgaccttcctttctttctactttttgcttagataggctcagcattatccaacttaaatgtcacattccccataacttcttctcctagacacagttgcttactacccttcctgtgcttctcacactgcattctctatgaaccccctaagattctctatcatgattatttgcttatattatctgccccacatcccacttagtacctgccatggtgtcaggcacattagacaatatgtttggtaaatgttttttgaatgaattgggatcttattctaaaaaatgatgttcttatttttgctcaaaatgtaattttttctctacagttgatagtgaatgatgatttatagatttattgattcaattaatatttactgataatatattcaaagcaatcatagatgtctgtcagagtctcctctcttggatccttacttaaagaaaactttgacatttaaaagattagttccatataagagcatgatttcttgtccctagaacatgtaatattcttcatctcccaccatgaggaacattctgctagagatggaatttttcaacggtattttaaagctttagggctcttttaacttgatattcaattcaacagatgtaaaaagttagacccgcagattgactcaaaagagtctgacagttctttattaaaataatatcattgtaccttttagtagtgtttgtattaaataaagatagctttgtcccaaaggccaagcttctaactttatactcattttggagatttcttatctggtttatcatttgtggcagttttttgttttgttttgttttgttttgttttatcttgttttttagtggggagggagtgtcattctgaaaatagaaattgacttcctacccctagtcagtgtgaacccaaaagaactgccagtttttttggataatggtttactcagctatatctgttttatttactgcctggatctggaccacctcaagtttgtccagctaattaatcttctcaagtacttgtatcttagccactcagtgagctgacttcatctttcaacaatatagttcataatatattcaaaagcacttaatggacggtttccttactgttagaatatctcccaaatatacaagcctccttcctcataggcccccacacatttattgtttacatcccaggtgttcattttatactgctaagctgtatggcttgcagtactgaatcagtaattctggttagaatatttattccagtgaacatatatattttctggtgaaaatattctattactttgcctgcactcctaactatatttttgttggggaggcacatatgtacagctcctttgggggcttcttcttaattaacaaggcacagattgtcatgatagaataggaatgctataaacagtccttagtatcatttctcccgttttataacttgctttaaattattccttttgtctttcaaaaccatataattttccttcaatcttaatctatctttggttttcaccctagccctccagtccacttttaaacactcttatagtctattcatccatcccccaagctataaaggtttttttcagattttctctttgttctctgcttcctgtgtactttttgcttaagctattgctttttgtccccttgtctgaccacaataagctactttcaccaggaaaactgtcaaaatcattcacctttgaattgaccattacaacccttctcataatcaaatattgccatcttattaatgccaaactattcatgtagctctgcagcaaacagaatgggctttgagttagatgacctgaatttgggacccagttccaccactgactgaatgacacacctttggctagccaccaagtctcttcaatttttatgtatcaaatgaggtagtaataactagtttaaacagttattaagagattcaaatgagtcagcatatatgtaagttatttgtaaattctaaagctctatataaattttatgtaatcttaatttgaattaaaatatgggcacttgggaaggtataaataataacttattactgtaaactccttagtactaacattatattttgctcataagtggagatatcaaatgagctaatttgattatgaattttttgccacatacaaaaaggatacactcaaactttttgagacgtacacttgtaaaatatttgtctcatgcatatacagcttaagagttacttatagcatcagtcagtggttgtattttcattatctctagtaaaacattgagtttacctcttttttttagtaatactcccaaccaaagtgattatgtaatttttgaagatagataggtctttcaaatttgcctctgcttgtgttctcaatgtcacgtttagttcttcttttgcttttgggagaatccatttattctttctgtccaaaactaattagacaaaacacatgagtaaaggtgtgaggttctatggacttgaaatcacaatagccttttacaaaatactgagagcactgtttgcaaattgcaattttgttattgtgtcaattttttgccattccttttgaacaaagcattaatgaagcatttgtttatatttttcttatgatggaatgatggtatttgtaaaaaactataaatggtcttgttgcatagggttttttataagttcattttaaaaattggtttctgagaaattaatgcaatttcatgtttttccaattttacttcaatttattatatatttaaaaactcatacacaaaatgtatgcgaataattctttatatcaaagccttattgtctaaatttacatgagtttaattatgatcctttggccttttacttgttttttctttgtcagaattcaaatctttgagtagtcaacaggtgataaatgtcccattaatctttctgactccctagaacctgagcatgagaattgctgatcagttacaccaattgtctcgtaaatgagcttctcacatctgcctcttatttcattagttaactgtctgcccaaatatctgataagatggaatactagtacctttttacagcttgttctgtcggtctgtacaataaggagatagggtcgttagcaaaatgggcacaaaagagtatttatccactacctacaataaatatgcatgctagtgtctagaaggcatttgagactgtttattgaaatcacctcaagaaacaaaaataactggtttcacttcgattttccatttagcaacaaataatgttaagaccatggcctgccttactgtatgatgcttttactaattacatttatcatcaaaagaagaaaaatgatagtatttctaaaaactatgaatgttcttgttacacagaagttatttttgaaagaggaaaaatctatttattaaattaattttaaaaacagtgaaaaactttagaaaatatttttaaattaccaaacatcataattaacgtactctcaacagtgtttttaatacttgattacctcattctctatgttggcacttcgaaaaactaccaattaagatctgctttcttatatacatcgttatacagcagtcatacttttaattggaaaaaatcttgataacttcatcaatacatataagaattaatgtttaaactgtttataggaaatatacgttcttaacctgtagaatgggaataataatactatgtcacagagtataatgataattaaatgagaccatgcacgtaaggcactgtgccagtgtgttaaatattgcccagcacatgctaagtgatcaatgagtagtagccattattacatagacattattgcaatcaggtttttttcttctgctatctatttggggagattggagtataacggtgaaatattttataagcattgcttgatgtgttaatcatacattttttattatttttaaaattatttaataactgataagctattgaaattacctatttgtaaattaattttgtcttttggaacaaaatttaggcagaacttcagtgattattgttctttgctccaaggaaacaaccatataataaatgtcattggcgtaatagcagctatacctagctcatcaattttaataaccttccccaccttgtttaaatgtaagaaatgcctcaaccaaataaacaaccaaagcatgaagtcagttttcgagtattttcacatcatcttgtgacaaacccacagccaatatcatactgaatgggcaaaaactggaagtgtatctaaatagttttaaattattgctaaaaatgtatgctaggtgaacattttcattcagtttaccttaggaattctatttaaaagaaagttttttttataaattaaaattatataatgaattaactcagaatgataatttctgccattgtaatttcattttgttttaacctttctttgttgtaggccttgtttgtatgaagtccagcacatctgtggttgagcttgttatgctgctttgttctcaggtacaaaatcccattcactcagttacattaatatatgagggttttttgtgactaataataaaaagtatgtgcatatatatgtgtatgtttatatatttttaaaatttccatctattatcccatagatggagaaaataatttatgttgagttttattagtatatagattatcttaccatgtaaatattgacttattctccctctcccttcttctactctttttagcagtattattctcctaccctttcgattcttccattgtttcctatcatatatatgtatataaaatacgatatataaaatatcttaatttataatttttaaatgtattattaattatcttgtatcttcttctcttatatttgagataatgaaaagtaagtttttaaattccatacccaaagtgtatgatacagcttattaatgaatggtctttgatataagaccttgctgctttctcttttttaaatgtaatttgtatatgtcagtgtaaattctaaaaatctacttgagctgtttgtctttaataatcagaatcaaagataaatgataattgttgggtattgtttcttcttaacaattacagggcaaccaaaaataaatgtaaacatattttctgattacttaaataggaacctattggtttttcttctcaccagctctgtcaagtctcctagcagtcctgattatcctgattatcatattagtgttaaatattttttaatatcagaaggaaaaaagagcttgtgtgtgtttgtaataagcagttattatctttattcgtagtttcctcagtagaaagaaacatatatctaagctattcctaattactggcctgaggtttgcctaaagccacagctaactcgcagacaaacaacaatatgctttcaagtgatcctctaaaacatcagcaaaactgaacaaaacaaatgaaaaacttaccaattgatttcagttttcaggtttattttcttcaagaatatattcctaggaaaatcattaggcccattttcctctttatagccaggaacaatattgataaggaagaggttaaagaaaacaacatccctgtgaggaggtcgtctgcagggcatttgaaaattttgtcacctactgttgaagtcctgagttcgagagactatctggaccttttcgattcatgatgatgcacagttctgtaaaatgcgtttatggaaaaatagcttagaattccttcttccatagccctgtgtttcactgcagttcagagaaataaagaggaatgtagcattaagatctagtgtctttgatggcctcatcatctaatcataggtttaacattactcatttgctggctccaggaattcctgccattaagggccctagagatgaaactttgcctcagatattgattgaaaggaagagtgagaaatttaagctctctatgcagtgcactttctttcagtgtttcagcaaagcaatgttgtaaacacacctctcgatttgatttttaagttgaatttttaaaataattcagtgtttttaaatattttaagtgtttaattgattaaatgcacctcatttaagtaacttaagaatatatgcttattctttaaaatagctcccaattgtttttgttattttctgtttaactgaaataatgctttcgactaaatatttttaatgaaacaaataatcctcctttattcttattcaggggggataagtttaccattttactgtgaaattaagcttctagaactatctttgtagatcattaattgctccatgaatgtttaaaatcatgtctttagttgtaaggacacacataccaaaaaatggacatgtcttcaacgtttcttaaaataatgtgccatttttctatactacttaaatttgagatgatttatatcctattttcatccattaacagggcaacatagcagtaacatacctctgaaaagagaaataaatacagttaatgatgctgtggagattgcttggcatagctctctccaaagcagtgttcttctacagcctttaatgcatctcttgtagaatgaagcacagtccctgtagaattagtacagttctgtaggccgtctttgtgccaaggcagtaggtaatcctgatgaatcttgaaagctgcagagttctgagttctttttgttttgctctacagacagccctttgtaagtcttgatagctccatgttactgtcatgaccagtattaatactaataaaaatagttgaaaatctgaatgagtaactttaagttactatcttgatatactatgtgtatatttttccacagtgagaaatccaactaagatattattcatattgtaatttaatgctggttagaataagttggaattctgcaaatggaatttttaatgtatttatttgcataaaatatgcttttctttttccaaatttagacaagccattgaaagataaaaattttttgagagaccgggcagataagtattaaaaagggaaaagaaaatgcaatattgtgttttttataggattttgtttttctttgctacaacacattagatggcttttatttttatgcttctcattttcattttggaaatttcctgttagcaactacatattattaaggatattagcttttctttcttatctgagctcctgaataaacttactattcctaatagtttgtgcccaaaatatggtctaaatttacgtgagatcatattacaagtgtctgaaggtacttgtcaaggataattcagttcatatgggcaaacttttaaactccaaaggctatatcatccagtctaccccccaatgtaatttttcatctttgtggaaaacatatttaagtcttaagaagaagctgttaatattatcattctgatatatttatcattccacaaatacccaaaacatttttgactgtattctggatttttttctgatatagatcttatgatacaagtatatttattcttcttcacttttattttgtattaaagttgttagtagcattttaaaaattggtttcatatcattttgaagtgaaatgaactaaagtaaaaaaattaatatcaaatcagtgcttaattagggagtacaaggttttctacagattcttcagtatatcacaggtctgatactatcttctatcatagctttttaaaaaagttttataattagatatgattgaagtgcttattctctatttgtgcttattggtttattacattatttttactgtattgtgctctttgatgaatagcagatttagttttcaagtaaacttctttaggtgctataatagttcctaattacttccagattttttaaggaagtctccataagatatactccaggaaaagtggactgatgttatcccatagcatttctgtaagtttttataagtaaagcttagcagatggcacttgcatttttctgtgccttatctgtcaatagaaaacattttataaattgagaaactgtacatttaaaaaattcttagtatttaaatgctttctgactggaggcaatgattaagcaaatgcatgcttagtaagtcatttctactcttactgaaaagctaaagatgtataagtaatataaagtaagaggcctgcaagtcttagttaggcatctgtgtatgaagtcactaacatgaattattttgtggtttgtttgaatttacttttttctaaatacctcatatacttaaataaaaagaattttagtgacttcattgatgtgatcaaagcattaacccaggacttctaaagacaacacttgtaaaagaaccacaactaaagaacaatcttttttttttttaatgatttggcctttgaacatttacgtttttcatttttcctccagtgtgatacagttgagtcaaatagtacaaaagaaaaaaatatacttttcttctgaggctgagttacaaagacataggtaagagaacatagaggcctattaaaaaatattcattgtaagtactcagtagtgaaaggatttttggtgtgtatagtaagaagatttcaaatataaggaaaccagggatggagtagatgttttttccccgttgtctttggaaatatcatgaaatcctaattatcatgatgaagttatgtcacatttaatttggtagttatttagtgactacattttttaaacattttaatggttactaaagacttacacattgttccatttctcatgtttagtgttatctatgaaacttgccagttttgctgctgaatttgaattcaattaagaacaataaaaaattatgacctgatacttaaaactgaatataaatgagcagttacctttgtatggttcagtaaatgggtcctatgtaccaacaataagattgtcatggaaaagtttattgaggtgaactaaaaatgagccctgacgatgcaaggtatcctattcagcataagcagcggagaattgggctgaagaaacagcctgagccctgtttcttcagaaacctgaggtctggagaggaatgagtctgttcaacagtgtctaatcatttggcttccctgggccacactggaagaagaatcatcttgggccacacataacatacactaacactaatgacagctgatgaactaaaaaaaaaaaattaaaaaaaatagcagaaattaagtggccaggcaatgtataatatttatatttaatatataaatataatatttataatataaataaatataatatttatttgtttatctagggtattatccatttccaggcaatgtgtaatccaataccttcctcaagagtatttttaatataaaatattgtagtgtgttaatagtatagaattaaggctagtaagaaatgtctaacttttaaacagtattggatagttcatgatcattgactatagattctgtttttagaagagccactttttcattttctaatatctaagaaatccctgcctttttctctagacggtgggtgaccccacctcttatctgtgatataatgtcatttccaagttaaaggggtcaaatttgggcatttaatttttttggagtgtctatgttatataatctttattgccataaaagtttgtaatatgtcctaaagtataaataaaagttaaacaggaaggtgaaaatacagtgaggcataaagattatagtcacctcagataacaatatttaaaattattagagaatatggagaaagttatgtactgaaaatgtagacattttaaaggaaaaagagtatcagtagaaaataattgggaaatctgtatttaatatatcttggggagaatcagtacagaacagattgcaacaggaagacgggctctctgttatatgttcaattacttacagcattcctggatgaaaatttaatcaaagatttaaagagcatataattcaaattacttttgattagttctatgagatattttattgttgaattctttttttaaaactcttagagaagttagcaggtataagaaattttgagtcagtctcttttatgttataaaatattttttctaagctacctgtgatacatacaatactcacacatcacataacacttatatataacaacttagcacatatccacctcaaattatagaggtaatagtttatgaataaacaaaaagttctgacctcatctgttagaaattataaactaagcctgatcgcggtggctcacgcctgtaatcccagcactttgggaggccaaggcaggtggatcatgagttcgggaccagcctggccaacatagtgaaacccgtctctactaaaaatacaaaaattagctgggcatggtggtgggcacctgtagtcccagctactcaggtgactgaggcaggagaatctcttgatcccgggaggtggaggttgcatttagctgagattgcaccactgcactccagcctaggcgacagagcgagactcagtctcaaaaaaaaaaaaaaagataaaaaagaacaacagtcttttttttcttatgtctaacttctcataattctaataaaattgagggaaaaaagaaatcaataaccctaggccatctgcaggatcatttttaagagtgtttaatgtctgtgacagaagagaaggaatgtagaatattctgaatccctgaatccctgacactaagcccacctccctgacctaaaatttctttccatactttgtctcaaaattcacatttccctttctcccagtattttggtttatttttctttaatctttattttcctgtgtctacattgtataagtttttcagacaaattacaacaactttgaaaaatagtgaaaactatatatatatatatttcacacttttacttctagtatacattctcttttttggtggtaaattttcttcatttttgtcacacatatttcaatatgctttatttttattagctatcatataataagtagttttctgtatcctcttttttgttacattgtacatttcctcatgatcattttttctgtggtttcgttgtttaaataattagagactcacaggaagttgcaaaaatagtacacagagtcccatgtacccttccctcagcttcctccaatagtaacatcttacatataactgtagtagagtataaaaaccaggaaattgatattaatgtagtactgccaactagatgatagacattattcagcattctctcttttttacatgtgttcatttgtatgtatatgtaactcaatacaattttattccaagtattaatgaaaccaacatggttgttcctgtacctcatatcttcccaattatttcaaactcttttatttcacgaagcctttctgtattattattgttataaggttctaatctctccatcattcccttagcatctgagtgcataaatctagatgataaatataggtatctgtttatatgttttaattggatgctcttatatgtgattaaggtatgattttctttatctaccacatttcaggttccattagaataagctgcatttctagtatttcctttctttttgaagaattctattctgccaatggagaaaataagtattgtatagtctcaatatattaacatttatgaagagcatttaaaatcatacattgtttatttacaacaatccagaagaaaagactacttaaggatgacacagaactttgcagtttcgtgaagtcactttatggatgttattcatttcaattatgctacaaatttacaccatactaaagatcactttatttttctattgccttctgttgtgcttaccactatgtcttccactcctagtataaatatccagcatatagtataggtagttattaatgacattttgagttattttataaataaaaaggaatatatattagctaaggtgatttgttatttatttttattgtgataaaatacataaaatgtaaaatgtgccatttttaccattttaagtatacagttcagtggcattaattaaattcacaatgttatgtaaccatcaacactacaatgagaaggttagggaggccagtccccctacacagtcaaaaatatgcatataactttttactcccccaaaacttaactactaatagctcagtactagtgaccagagccttaccaataacataagccatcagttaacacgttttctatgttatatgtattatgcattctaatcttacagtaaaataagctagagaaaagaaaatgttattaaaaatatatatagatacatagccagtgtgtgtgtgtgtatgtgtgtgtgtgtgtgtgtgtgtgtatatatatatatatatatatatatatatatatatatgtatatgcttctttttttaattttaatgtagtccaaaagtacaagaagctgtttcagaggtcaagaatatagtaggtcttcaaacaaatggcagctaattatgtgtcagagattcttgtacttagttaaaaatgatgatctctaaatttctctacagcactaatgttcttatactggcttccacaactattgctgcatgatcatttgtgaataaaatatgaaatatttaatataacttagtacctatttctaaatcttaaactacacatttgaatgtgagaaactttttaacaactcaaacctaataaacatgagtgttgtatatactcatagaatatgctctctttaaaaatatcttgtaaaacagtctagacttttttattacaaacacaaatacaaatacatacactcattttataataataagatgtgtccaatttgaaacataatttagtgatcacctaaagtcctggaagcctgcttatgtttatatgatacgccaacttttccttgagtaaccaactaaatatatttcagtatttcctaattttttttatggttgactattatatcggtaatcttctctttgaattgatcattcattattcatttcttacattcagtttttcctataatacttttagtaagatcttcataaaaataagaaatgaaaatgaaataaatggtactttaaatacttcacatatatattttcagtaattatgtatgttttatatgcattgaaaaaaattctcgtctctattttcaccctacagagtgtttttttcacttcactccttatacttactgacttcaacttacagcacagaatttctaaacatgccagttataatgaacattcactttgaaaattttaagaaacacacctatgtattttagtgacagataatgataaatagatattaaagatatcagaaatataaaatcaattctggaattcttgaagacttaagatatcaatttactctaccatttttccttgtaatttttttatatattcaaaacttttatgatggattgaatctctaaggacggtttatttaattgtatacaaagaagagggaatgaaaaatgtacattgagttgacatagatggggagaaactgatgggaagcattatattttggatctgagatttcttcgactagtccatctaactaccataaagcgattgtgaagagaacatagggattttatcgtcatccttctggaacttatttgtcttcaaagtgtttagtttcaaagggtccttaacatgagatccagttccctgaaaaagtccttcatcttgaggaaattttatgcatccatgttgaagagttaaaaaattgtgacaaaactatctaaagacttggcagctctctgcaggcattcaaacccaaagttaagtattgtccccatgaaaataaaaggttgttcatttattttttcagcagaaaagtgcatatatgtctatgtaggtgtgttttctcaaatggcaaaaaattctggaataatttgtaagataagactttaaaatatacctttttcctgtcattgccaagagcttgttgttgatgaaatgacagtaaattattcttatccctttgcatgtgttttcatgtatctgtgtgccttgttttaagcaaattctctaagtttatgtatttgtcagagagaattgttagagtgctaggacagggactaaagttgtcttccatgtccacctctatcccattttttaactttcaaggtagcttatatctcagcatccacaacaaacaaataccgtttctcctctatgctatgtacttttcttgtcacaaagttttgtttatctctcctttcaatattttatccaattattttttgaagctcttagaatcagttacatagtaatatgcacttaagaagtactttttgaaattagccgggcatagtggtgcacgcctgtagtcccagccactcaggagggtgaggcaggggaatcgcttgaacccgggatgtggaggttgcagtgagccgagatcgagccactgcactccagcctgggtgacaaagcgagactctgtctcaaaaaacaagaaaaacaagtattttttgaaattataaaaagaaatgtgcatcagtataaaagaatataatcattgcctacccaagtttgttacaaaaattcagaaccgtgtgtatctcatttacttcacacacactgtaaataaaatactacaaatataaataattccatttcagaggcaatgtttcatgattaataaaagtaacattaactgatgagaagatgatgtaggatttatcccatttcttattttcagagttttaaaactatttcgtttacatgctttaagatttgtttcattgctatcataaattcttagaccttactcctatggaaaagggcgatagaaatagaaatttttagacctgactcctatggaaaggggcaataagaagcataaattcttgtcataggtattgcacttttccataggagtcaggcctaaaaattcatcggtagcttaggataaccaatggagaagatgccctttgttacacttttcctataggatacatttttcttctcattccgtttttttctttatacttatgcatttttgtttgccacccaatactgtgtactgttgtctacctaggatgtaaagggattggacttctcaactaaatatggtaaaaaaaaaattatctttgccacttttacaactgtcattcacaaattattaaacatgctttaaaaaccacatgcaatcctaacattttctgaggaggaaaatatactttatcttgtgaagaatattttatagtcccttttctgtctctcatttagtaggtgaaaaaaataaacttctgttttcttcattgaccacaacaatgagagtccacaatatgtttttttttttttaattttactttaagttctgggatacatgtgcagaacatgcaggtttgttacataggtatacatgtgccatcgtggtttgctgcacctgtcaacccgtcatctaggttttaagctccgcatgcattaggtatttgtcctaatgctccccctcctctttccccaaccccccaacaggccccagtgtgtgatgttcccctacctgtgtccatgtgttctcattgttcaactcccacttatgagtgagaacatgcagtgtttcattttctgtttctgcgttagtttgctgaggataatagtttccagcttcattcatgttgctgcaaaggacgtgaactcgttcttttttatggctgcatagtattccgtggtgtatatgtgccacattttctttatccagtctatcattgatgggcatttgggttggttccacatctttgctattgtaaatagtgctgcaataaacatacatgtgcatgtgtttttatagtggaatgatttatcatcctttgggtatatacccagtaatgggattactgggtcaaatggtatttctggttctagatccttgaatcgccacactgtcttccacactggctgaactaatttacactcccaccaacagtgtaaaagcgttcctattgctctgcatcctcgccagcatctgttgcttccagactttttaatgatcgccattctaactggcatgagatggtatctcatgagagcccacaatatgttttatgctaaatcccagaaaatagctgatacaaacttatctttaaaatttctagttttagtgctgtctgtatggctaaagtcattaattctccaactcttctacttgaagcagcgcctcatgggctgcagtagggaggagttggaagggtggcccaaactgtaacgcatgccaaccaccagaatcacaaatgttctatgctcttaggctttcaaattctcattttactttattgttcttacattccttaatattttgaattagattactttagataattttttaattttttgttttcctctcaggctccagggggctggacatgtattatatatcctgggcatagttactgcctgtgtcttatgtatctcataccccaaattgaataaacaaaaactttaaactcccttccttcagaaaagacaattggtaacatttttgtgaccttatacattgttaatagcagttcataattgttcatgtagttaacagacattgacttggtaaattgaaattatgcaaatagttgcaaatagctgaagaattttgaaaaccttcaaaaactgaattatactctcttaatattaggtggaaccactttggctattgcttaggtcaaggcctgcataaactgttcttgtgccccagccatatcatattaatggagcatgtgtgacagaaaacaaaacattcatatctggcaaacaaactaataatagaacctagggaaaaaaatgcaccaggaaatataaaatttaaacatttttatacataaggattttttctgtgtttgccattcaatgttggctaaacttctagaattaaagtcttgtttccttaatgttgtagtatagtcattatgacaattgcaccatctatttcttctggccctagtgtcatcacagattaataaaacctgtctcttcctttaaaaatacagtacttaaaatctaattatataatgtgcacataaaacacataaagagtaaactgaactcatagagtcacatgaagaagactgttcagccagctggtgttaaactcccatattgaaaaattggtatttcaatttaaagttgctttaaattcctatatcaaataaaagtatttgatgtctacctatgtcaggacaggtgagcaggacagatagcaggatagacagaagacttaaatttcctgcagggcacagaggagaacaaaaaaatcttctttacattaaaaaaatcctttctcattttcataattagtaatactttttcatgtcttcatggaaaatgagaacccagttagattcgttttctataggattaaagaaacactatgttcaattagtattgttcatccgtagtagtattattttaagaggtctcattaccagtcacctggtttcatatctttggcaataacaagaggtggattgtatgttaatcactattgacccagtagatcactagttaataatatttattattatgttactcagactgtagcaggtattgatttaaaattatattagaatttaaaaccacatatatcttaaattcaaaaagaccaagacaaataagaccaaggagtttacagttttctgggaaagaagtaaagtttacagtcatgttactaaagtctgggtgccttcatgaataataaatggactattttatacataaacaagtacaggaaaacttcacactttttactctttttctgaagaattaactgttcttatcccttttcaggacactccattcttttatgcattcatcaggatttctgtcacctttcatctcttgtaatctttctgtctctccttcaccctttcattatggtccataattatattcaagtctcttcatcataaaaacttcacaaacactttcaaacctatctttctctgagcatcctgtccattgtttcttggctttaatcacaaagctttttgtgattgtttactctagttaccactttctctttctcacttaccagcccagtacaatgactttcctcccagcatttagggcctgtcttttgtcctcatcatacctgactttcctgaaatacgaaaatgacaatgtaatggcatgcaaacaaatgaaatagtgatagttttctaatgattgtattttaaaaatatggaaaatcttgcaaaattaaatgagaatgtgacacagtcccaccatcaaaatgagaaagtgacacagtcctactgtcagaaaatgtttaatattctcttcgacaagaagacttctgccaccctctcttcctctctaatagtgactcttcttttggtagaaaactaaaaaaagagcaactcaggccttctgagaaaggagttgaacacaaatacaggtcaacagtattatattgtcattgaacaaattcaggaattacattgccttgacaaaagcaattctctgtgtgtgtgtgtgtgtgtgtgtgtgtatatctgtgtgtgtgtgacggagtcttgggttgtcacccagactggagtgcattggcgcggtattggctcactgcaacctctgcctcctgattcaagcaattctcttgcctcagcctcccgagtagctgggattataggtgctcaccaccacacccggctaatttttgtatgacaaaagcagttcttgaagggaaaacatataattgcagtgatacatttttattcagaatgttttcataagtcttctgtgttcagaatctctctctgtaggctgataaagttactgtttcctttttgacagtctgttaccctgctttcagtacaagtctctcctgattcatcacagaaactctttatggttctgtaaaactatcactgttctaaaaaaattgtttttaaaaattttttatatttactgtgtgtattttaaaggcacataaccaacaaataacagacccctactccaccactgagatccactggtcgaaatcaactatttcaactcttttatctgtttactttattagtaaactatatttttgaaataacactgttatactaatgttcttggtttttcaattttaaatattttttaaatttattatatatagcatgtcactcttacaatgcggccactaccacctactaaaaaatatgggggaaagtttctgcttttctcagcatttccccactatagccatatcacagttttaagtgtgtcagtgtttcttgtaagtatcatctgtagctaaactatccaccatttccttcctaagataactattttcttttagagtgaattgcctcttcgctctttatttgttggctaagttttctggatgcctgttactaaatttcccccaaactttccagtagaactaaaaacctgctctaactctagtgcatgttaagtattctgtcagcctctgcttaatcctgttttggtacttccattaacaattatttagataattttcattgcctctgtcttgtttcagtctaccatttcttagatatgggtctatctctttttaaagttcttttcttatagtatgtttagggtttgtcacaagttctttccgtcttattgagcgcttttggtgtgtttgcattcccctcctccagtgagattgggcttcatcataggactttctctggccagtgaatatgggcaaagggacatgtgttacttctggctagaagctacaagagccggggcatgcttagaccccttctctttccctccatcttggctgccaacagtgttccagacaattgcaacatagtatgactcccaggatgatgccaatgatgatgtagagcagaacacagacagtggacacagaatttgagcaagaagtaaactttcatgttttaagcccctgagattcggggactagcacaacataaacttgtttctcctgtttgatatattttctcattttggcagagcacaccatcggtgggttcttgaacaagagtcagtgataaatttttatgcatgtgtgaaaatgtgattattctatcttcatatgttactgatagtttggctgcatagtttgttctgagtattctattcttcataattttgaaactggctgatgttaaactctcatattgaaaaattggtatttcaacttaaagttactttaaattcgtatatcaaatgaaagtatctgatgtctacatacatcaggacaggtgagcaggacaggcagaaagcaggatagacagaagatttactttcttccatcttctagttttgctgttgagaagtctaatctcattcagattcctgattctttatataaacttttattttttcctgcaagcctcttccttaaccctggtgttctaaaatttaatgatgatatacttgctaggttatattatgtattatattgttcatcatataattaaatcctagaaaatatttgaaattcctttgataatttcttgatacaatgtttctcattcactctttctaaaattcctatttactagatagtgacctttaaaaggaagatcctctaatttctttgtctcctttgttttctatctctgtctttttggttgtacctcattatctctttgttctattttctgggagatattttcaactcttttttaatgtatacaatatcttcatatgtcccagttttattactacatttttttggtgttgcttcattgtctctcattatttgggtttcattcccttccctccaacccccacctccattatccctttctaatattggtctgtgtctttaatataaggttgcaaacaggatcataggtagtgactttgaaagtaatatttgtcattaaagggtcctttctctttctgttttcctgaggcaatgtatatacgtggagtgttttctttcaaataatgctataatattctgcttctgttcttaaattttgatagatctttttctgtccctttctattgcctctttttgcaatcttaaaaatgtgaatcctttccagcctaggaataccttctcagcctagatatttgatcctcgttttgtttatacttcttaggagactttgcccaatgttatgccttactcaatatttctatgtaaataattctgaatttcacattcttttttgatataccattgccactgtaaatccaacaaattcagacaacagtgtttgtgattttccccaaatgtattcttcagtattttcataataatattaccattatcctggtcatgtacattgaaaacttaataatttttttatctcaacttctctacatcagctcttaaattcagattctcatctagtctcggcatctcttctttgtaacatctcttattttttattccctatttgaaatactcatttagactcctaatatttctcttgtggaaaggcgtgtaacaacaatatcctacaatttcctctggctcaaaactgacaaattactcttctaaaacactgatttattgaatgaagtcttgtgatcatatactttcattggctttctcaaactttaaactgtaatgtccttagcttagctcagacttacttctactgttcctccatcaaaggttgtaaattagtacatctcattggctgtatgcagattccatataattttagattgattcaaagataattttctcttgatttttttagacaaggcatactttgggatgcacatgtaatacctagatatgtactctgtgaaatatcttaccgaaaaatcttattcatgttagaagtttatggtgactaaagagtcttagtgtacaaacactatcacagaaaatcaggtgtaagaagttgtaagaatctagtcttcatagtggcatgggtcttcgtatgtaaaaatcaattttctctttaagttaatatcccaatgaatatgaagtatttctgagaaatgtatgtattttgtaggatcctgatttccaataaatacagaatatagaatgagaataacaaagaggctttaaattttgtaaacatttgggaaaagaaattttctgtaattgttttatacagaaattgtttgaaagtttcagtaagttctgtacaatggaatagcagtcttgtcatttggataaattttagttaaagattatgatagctagaacccagtggctttgtactatccccaagttaccatatctcttttcactagttgttgattttctctccttgggagattcaggatttgttattctataattcagcacacatttacttagagcagagaatatttatatacacacaagtacctactttgggggaccatatttattttcagaatgagtgtaaagcctttaaagggaaagggatcaggagtagaatgaagggttgatacagagactgtgttttttgtgaagctgaacccatggccagggcagctgatcacctctgtacaaccaacaccttattagaaaaatcatagggggaaaaatctatagaggagggccatgactggtcaataaagatttttctattaaaatgcattagggaactttgaggagtatttagttatagaaccattggaagggatataattttcaatccaaaacactgctatttactatatatatatatatatatatatatatatatatatgtatatatatatgtgtatatatatgtgtatatatatatgtgtatatatgtatatatatgtatatatgtatatatatgtatatatgtatatatgtatatatatgtatatatgtatatatgtatatatgtatatatgtatatatatatgcacacacacacacagatatatatatgtatttaaaaccccatatatatatttaaccccaaatatatatatttaaatatatatttaaaaccccaaaatatgtatatatttaaaaccccaaaaatagaaatcactagcataaaccaaaaacagtatataaattatattctaaatgtgctttaggaacagcataaaataagcatatgcttttctaatccaaaatacttcattataatcacttatgttcataatgatgagccttaccttgagaactgccaaattcacaaatataatctaaattagcagagattacatagttatctattacatatttagccataggtttactacttttttttacaattttcaaaatagttaatttgtaacttttttctaattagcattaaataattagcattaagtaatttggaatgtacatataactagaacattgcacttccaagtcaatttaaatatgttaatgtttctaagagtttatatttctagtattcattttattatcttaatgtaaaatttctatatgaggagctaaagttttctatcccaaatatttctagtccttgtgtagtcacattaggtctcttttggtcatttgctgtcttttggaaagaagctttgtgctcagagccccttatacctgcagtctcactttccatctcagtttgcatccagcctgaaattttctggtgaatcaaaagcaccttataaactaagtgataaaactaaaatttgattttttacaaaataatattcattacaaaatcttgtaaagacatttggaaataatataatgtggaagttattaacaatatcaacatgatccttaaaccagaagttactttcattaagtgttcacttttctcacgtttgttttggtttctccttttaggaatggcaaaactctattcagaagaatgcaggacttgcatttattgagctcatcaatgaaggaaggtaattaattttacaattttagacaactagtcagtgtacattttattccactgggcaattgctctttcctaccatctgttccaaaaatgtagaagaaaatgtcttttagttaaataatttatcacacaggtacttaattaatctttaacaaagtttaaaatgctaaacatttatttttgaagaaaaagccgtgcatgaaataaagggacaaaccttataaggtttggtgagatctgaagtacattttactgagtagtaaagttgttttacacagatcaagtgaacccaatctgcaatcccatctgccactccatctgttttcagagcagtgctcagtgtttactccttcagcttctcctcagtccatgtgaaacagttttatctgaacatgtcatgcattcaatgtccaactgaaaatgtgagggatattaaatatagcaaatatatctgtctcggttagaaatttgtatattctattattttttttttctttaacaaaatttttatttaataaatggttaaaatcgcagtgccaaaaatacattgacatttagcaatttcactgaaaggaagaaactacagaatgcacggtttcagaaagctattttaagttatttacaaataaagtatctaaaactcaaaaacaggctctgtatgctatatctagtttatcccttcctgaacaaaatttctgttatttgggcaaattcttaaaccatggtttaaaccgtaatggttacaaaccacaaacacatccatccaaagactgaaaccgtttttatccggtcagtggcaaaactgttgaaagggcaatagttgaagctgttgggttttatatagtgtgaactctgataaatattcctaccaggactaaaacacagcacgctttgcgggcatggctgactcacaaaggttgtatattctattattaaaacaataagtaaaattacatttgaacccattatttaccattttgtggtaaatagttgttaattattatttttgcagtgctttattggcagtggacacattaaaacagacgtagctgtcaccatgtgacatatatagcttctatcagcccaagacctgcaaactttacaacttgaatttcttgtatgatatagtgcattctttggaatatgatgattatttggcatgacctattcatttcatatttgaaaccagctttcattagattaatgaggaaataatgcttactgtatataaaatttatcttttcaagtaggggagtcatgaaagaatagtccttgaaaattagtttctatatggtatagatacccaatttttaaaaattaaatatcacttagtattcattttttatcactgtattatattttgagaaatatcttctgtttttataacaatttatcttattttatatttctcattttgatattttgtgacctaatcatgttagccagtagtacagatctaaaatttaaaataggctttgcattcactgcaacaccaaagttgcaggaaaatatcagttttcttttataacgcaaatagtgttttacataacagcactcaccatgtcttacagagtttcactgtgataagagttactaacaattattatccgttttcaggtgatgaataaacagaaaaaactatttgctaaggctaatcattgtcatttaagttttagaaataactctcaatgacatatccacaattattttgtttcaactgcgaagtaaaaatatatatatatataaaattattattatcagtaactctcctaagagttatcagaattgaacctctaaacacttaaattaagattatagtaataggcttagaaaaggaagggggtggaaaatttgctaatatcagagattttaagcttctgataatgcttttgtcagtcagtggtagaatttgggatttgctttatattaggaaaggttagaaataaagaaagtagtcacaattttaaaaaaaatttcaatctaggttgggtgcagtggctcacgcctgtaatcccagcactttgggaggccaagttgggtggatcacctgaggtcaggagtttgagaccggtctggctaacatggtgaaaccccatctctactaaaaatacaaaaattagccagttgtggtggcaggtgcccgtaatcccagccactcaggaggctgaggcaggagaatcacttgagcccgggaggtggaggttgcagtgagccaagatcgtgccattgcacttcagcctgggcgatgagagcgagacttcgtccccccaccaaaaaaaaaaattcaacctataataatctctgaaattctgtccattatgttctctgtgctctcctaagtttctgtttctactcttcataggactcgttcttccaaataaatatgattttggaataaggattcaaacatgaatagctgtaaatatataagaacaaatcatgtatgcatgagtgcagcaaatgtctgttcaacacccactacatgtcaaatactgctataagagttaggaatagagttaggaataagatataaatgattccagtttcttggggaaaggcaaacattagatgaacacatacagtaatacaaggatactgtgataaaagaggtataggtaatgatgcaatcgtaccacagaataatttacctagtctggagggatgcattccactgagtggtgggattatcaaggttttcaaaagagtacttacccaaaggaatgccatttgagagatcattaggagacagccaagtgagaaaaaaaagtagaaatacaattattggcagagggaattgtatagtgcagaggactagcggcaagagaatagtgagacatgttactggagagctatttccagtcagccagcagctatttaaatgcatgttgtatgccagccacatggaggcacaggtcattggcaaaggtcatgccatgaaactgtgcaaagaatactggagaataactgaaaatgtttaggtgtggcctgcaatgtggagggtttcacgggctcaagacttgaagcaataccaatctgaggttcagtaatcttgttgaagaatatggtgtcatggactaatagtagctatgaggatggaagaagtgaacaaatttgaagtatcttttggaaattaagtcactatgattgctaatatattggatggaagaggggaaagaaggaatcaaggatattttgatgtcagctttagtaactaatagtttacagtataagtataattcacttggctaggagagtacagaaagcgaggtttgagttgagagtttttcacttttgggttacactgaacttgtggtaccagtgaaatatccaggtggagatgttcaataggcatgggcatttgagtattgagctctccaaagagagagctggcatggagatttagacttatgagtctccaggttattcgtggtaaactgtagaaaggattcagatgtgatgctcagagagagtgaatagagtgagtggagaaccagaggccctgcttttactcctgtttctgctgggaatcctcttctcccacatcttgacacgactggttgtttctcgactttgaggaatcagcttaaatgccaccctctcacagaggctcccctgactatcttatatagttgttacactcccatgacataatcctcttgtaacacataataacatcatctcaaatgatctgctctgtttgcttgtttacatctatttctcctgctaaaatgtgttttccttaagatcttgtgtcttattcatcgtcttatttgctgctatatctctatattctggaatagtgcctagcatgtagttagcatgctaatgaaatatctatttatttgccctgttaaatgaatatttattgaaagcataaagaaaagaatggtgagtggaatgtttaaggaagaatgtatggtcaaaaagaggatttttaagttagtactaaagggaccactgggttcagccacaaggaggtcatgatgatctcatccaaacttaatgctggtgaacacctgtgtgctaaagaagctgggtgtagatccaaatcctaccctattagagtttacagtctagtgtgggcaacagccttagattaagtaattgcaagtttaataaatatgtgaaggacaactagaggatgctatgggagcaggcaactgagagaggtattttttgaaaaagtgatgatttacctagagtagagggacagaagccaggttgctttgagttgaagagctagcccaaaatgaaatacagacagcaagtacttcgctaaagaaatttggccaagaaagggaaagatagagtggttgctgtaggtgaataaggtttaaatttggagagaggggttactttttagaatgaagaacctatttttcaattttgatggaaaaacgcaatatggtgggagggaaagaaggcaatattgacagcataaactctctgagaggggtgcattgagatagaaggattggcctttagtggaagagcactgagaaagggtgaagacaattaaattggtggcagaattcagaagagatttcatatgatgccttctgtctatgaagtggcaggtaaggtcatttgctgagaataaaaggaattgggagagggtatatactatctttagaaaagtaaagaatactgaaaatagcgattgtaaaagaatggagaagagaaaaaactaaagaaacctgagaggcttgccaggcaatttgggggagccaattgaggttgctgtctttgatagtgtaatgttttcttcagcagttcgcagttcagagaagataggcatttgctttaagacattgacttctcttactttagtgaaaataatcttttcactgaggaccaaccccttcctacccctaatctggattaggtacctttctctgttctcccagtacctcaatttttccctgatttatatttacctatctatagtgtttatttgtagtggattttttatggctgttccacaatgcatagtataatacatagtatccatatgttaattctactgagttcaaatatcagttctcccattgataagctgttagacaacaggcaaatcataatcttcctctgacattgtttctcatctgtagaatactgtagcacctttcttgctcagtttccctgaaagttcaaaataatatatatgatatttattacagctgctataagtccttaaaatggaagtttttacttttgttattacatataatatgtattcagaattttgcttattcccacctttagtttggatcatttctttcaatttagacttttctctttcacaagcatgaactgggacttctggttcaaaaagtcatctttaggtagctgggatgcagttccagtaaaaagcccaaaattactattactctgtttatcttcctactgtatgttgatgcccattatgtgcgaagcacaaattaaatattttatacatgcttttatcccatttgcatgcacatataacatttttacaactttttcatatggcttaatatgaaatatttaaaaattcactttatttgggttgttagaatatcagtctttaatttgtccttatgggaatgaagataaaaatctttaagtagaaattattataaatgtttatcctacttaacagctacacttttgaatacaattcatcaatcatagctggagaaagcaattgtgcagttgtctacaattaacaggacaaaaacagttgataaatgtgcatctgaattaaagtactccctgggaccggctgaaattatacactggatcatttaaaggaatctaacaaaggatctttataattaaaacaaagcaaggttaatgggatgtaaaattgcctgtaatatcttggcaataatgattggaatttgaattattaaaatatgcattgaagaataaggcaaataggaagtacttatttaaaatacagaatttgagtgatctttttaaataaattaatcatttgcctgaaataaacctttgtcactcttttaaaagaatatagaatttaatttttgaatattcatcagaaaagaacagataatatttatgtttagcactgaatttaagctagagctctcaagattctgattttttgttttgtcctttagaataggggaaaatatacaccatgcatttcttaggtttttaagaggagaagcatattgcatccaagtataattttttagtgattgtatggcaccaatttgaatgtattctttaatttaacaaatgctagttaatattttaaccaacaagcattggtttgcttgagtttatttctcttatgtctttgatttggcaaaaactgtatttaaaaataaaacaaaccaaaaaaaacttccaaatctgtaaaataagaaactatttcctaaagtagatattctggtttaatttggagccaataatctctggaagctactggaaaacagaagtttcttttccatgtgttttcttataaaatctgacctatgccaggttttctttaacattcttttttaattattattattttctaatattatactttaagttctagatacatgggcagaacatgcaggtttgttacataggtatacacgtgtcatggtggtttactgcacccatctacccgtcatccacattaggtatttctcctaatgctatccctcccctagtcctccaccccccaacaggccccagtgtgtgatgttcccctccctgagtccatgtgttctcattgtcacctcccacttatgagtgagaacatgcagtgtttggttttctgttcctgtgttagtttgctgagaatgatggttcccagcttcatccatgtccctgcaaaggacatgaactcatctttactttatggctgcatagtattccatggtgtatatatgccacattttctttatacagtctatcattgatgggcatttaggttagttccaagtctttgctattgtcaacagtgctgcagtaaacatatgtgtgcatgtgtgtttatagtagaatgatttataatcctttgggtatatacccagtaatgggattgctgggtcaaatggtatttctggttctagatcctagaggaattgccacactgtcttccacagtggtcaaactaatttacactcccaccaacagtgtaacagcgttcctatttctccatatcctctccaggatctgttgtttcctgacttttaaatgattgccattctaaatggtgtgagatggtatctcattgtgattttgatttgcatttctctaatgacgagggatgatgagttttttttcatatacttgttgaccacataaatgacatcctttgagaagtatctgttcatatccttcgccctctttttgatgggtttttttgttttatttcttgtaaatttgtttaagttccttgtagattctggatattagctctttgtcagatggatagattgcaaaaattttctcccatgctgtaggttgcctgttccctgtgatgatagtttcttttgctgtgcagaagctcattagtttccttagatcccatttgtcaattttggcttttgttgccattgcttttggtgttttagtcgtgaagtctttgcccatgcctatgtcctgaaaggcattgcctaggttttcttctagggtttttatggttttacgtttaagtctttaatccatcttgagttaatttttgtataaggtgtaaggaaggggtccagttatagttttctgcctctggctagccagttttcccagcaccatttattaaatggggaatcctttccccattgcttgatttttgacaggtttgtcaaagatcagatagttgtagatgtgtggcattatttctgaggcctctgttctattccgttggtccatatatctgttttggtaccagtaccatgctgttttggttactgtagccttgtagtatagtttgaagtcaggtagcatgatgcctccagcattgttctttttgcttaggattgtcttggctatacgggctcttttttggttccatattaaattgaaagtagttttttctaattatgtgaagaaagttagtggtagcttgatggggatagcactgaatctataaattactttgggcaatatggccattttcacaatattgattcttcctatccatgagcatggagtgtctttccatttgtttctgttctctcttatttccttgagcagtggtttatagttctccttgaagaggtccttcacatcccttgtgagttgtattcctaggtattatcttagtagcagtggtgaatgggagttcactcatgatttggctctctgtttgtctattactggtgtataggaatgcttgagatttttgcacattgattttgtatcctgagactttgctgaagttgcttatcagcttaaggagatttggggctgagacgatggagttttctaaatatataatcatgtcatctgcaaatagaaacgatttgactttctctcttcctatttgaatacgctttatttctttctcttgcctgattgccctggccagaacttctgatactatgttgaagaggagtggtgagagagggcatccttgtcttgtgctggttttcaaaggaaatgcttccagtttttgcccattcggtatgatattggctgtgggtttgtcataaatagctcttattattttgagatacattccatcaatacctagtttgttgagagttttttgcttgaaggggtgttgaattttatcaaaggtctttttgacatctattgagataatcatgtggtttttgtcattgtttctgtttatgtaatggattacatttattgatttgcatgtgttgaaccggcgttgcatcccagagatgaagccaacttgatcgtggtggataagctttttgatgtgctgttggattccgtttgccagtatgttattgaggatttttgcattggtgttcatcagggatattggcctgaaattttcttattttgttgtgtctctgccaggttttggtatcaggatgatgttggcctcataaaatgagttagggaggagtccctctttttctactgtttggaatagtttcagaaggaatggtaccagctcctctttgtacctctggtagaattcggctatgaatccgtctggtcctgggctttttttgttgttgttggtaggctattacggcttcaatttcagaacttgttattggtctattcagggattcgacttcttcctggtttagtcttgggagggtgtatgtgtccaggaatttatccatttcttctagattttctagtttatttgcatagaggtgtttatagtattctctgatggtagttcgtatttctgtgggatcagtgtgatatcctctttatcattttttactgtgtctatttgattcttctctgttttcttttttattattctggctagaggtctgtctattttgttaatcttttcaaaaaccagctcctggattcattgatttttttgaagggttttttgtgtctctatctcctacagttctgctctgatcttatttatttcttgtcttctgctagcttttgaatttgcttttgcttctttagttctttcaattgtgatgttagggcattgattttagatctttcccgctttccattgtgggcatttagtgctataaatttccctctaaacactgctttagctgtgtcccagagattctggtacattgtgtctttgttctcattggtttcaaagaattatttatttcagccttcatttcgttatttacctggtagtcattcaggagcaggtttttcagtttccatgtagttgtgtggttttaagtgagtttcttaatcctgagttctaatttgattgcactgtggtctgagagactgttatgatatccattcttttgcattggctgaggagtattttacttccaattatgcagccaattttagaataagtgcagtgtggtgctgagaaaaatatatattctattcatttgggttggagagttctgtagatgtctattaggtccacttggtccagagctgaatttaagtcctgaacatccttgttaattttctctcgttgatatgtctaatattgacagtggggtgttaaagtctcccactattattgcgtaggagtctaagtctctttgtaagtctctaagaacttgctttatgaatctgggtgctcctgtattgggtgcatatatgtttaggatagttagcttttcttgttgcattgatccctttaccattacataattcccttctttgtctgttttgatctttgttggcttgaagtctgttttatcagggactacgattgcaacctctgcttttttttttgctttccatttgcttggtaaataatcccccatccctttattttgagtctatatgtgactttgcacgtatgatgggtctcctgagtacagcacactgatgggtcgtgactctttatcaactttgccagtctgtgtcttttaattggggcatttagcccatttaacatttaaggttaatattgttatgtgtgaatttgatcctgtcattatgacgctagctggttaatttgcccattagttgatgctgtttcttcatagtgtcgatggactttacaatttggtatattttttgcagtggctggtaccagtttttcttttccatatttactgtttccttcgggagctcttgcaaggcagacctggtggtgacaaaatctctcagcatttgcttttctgtaaaggattttatttctcctttgcttatgaagctgagttcgactggatatgaaattctgagttgaaaattctttactttaagaatgttgaatatttgcctccactctcttctggcttgtagggtttctgctgagagatccgctgttagtctgatggggttccccttggggtaacctgacctttctccctggctgcccttaacattttttccttcatttcaaccttggtgaatctgaagtttatgtgtcttggggttgctcttctcgaggagtatctttgtgatgttctctgtatttcctgaatttgaatattggcctgtcttgctaggttggggaagttctcctggataatatcctgaagagtgttttctaacttggttccgttttccccatcactttcaggtacaccagtcaaacgtaggtttggtcttttcacatggtcccacatttcttggaggctttgttcactgcttttaattctttttctctaatcttgtcttcacactttatttcattaagttgatcttcaatctctcatatccttctgcttgatgtattcggctattgatacttgtgtatgcttcatgaagttctcgtgttgtgtttttcagctgtgtcaggtcatttgtgttcttccctaaaccggttattctagttagcaattcctccaacgtttttttcgagattcttagcttccttgcactgggttagaaaatgctgctttagcttggaggagtttgttattgcccaccttctgaagcctgcttctgtcaatttgtcaaactcattctccatccagtttcgttcccctgctggcgaggagttgtgatcctttggagaagaggcattctggtttttggaattttcagcctttttcagctggtttttcctcatcttcgtggatttatctacctttggtctttaatgttgttgaccttcagttgaggtttttgagtgggcgtcctttttgttgatgtggatgctattcctttctgtttgttagttttccttctaagagtcagacttctctgctgtgggtctgctggagtttgctggaggtccactccagtccctgtttgcctgggtatcaccagcagaggctgcagaacagcaaagattactgcctgttccttcctctggaagctttttcccagagtggcacctgccatatgccagctggagctctcctgtatgaggtgtctcttgacccctgctgggaggtgtttccttcagtcaggaagcactgtggtcagggacccacatgaggaggcactctgtcccttagcagagctggagcactgtgcttggagatctgctgctcttttcagagccagtgggcaggaacatttaagtctgctgaagctgcacccacagccgccccttcccccaggtgctctgtcccaggaagatgggagttttatctataagctcctgactggggctgctgcctttctttcagagatactctgcccagagatgaagaatctagagaggcagtctggctacagtggctttgctgagctgcggagggctccgcccagttgaaacttcccggtggctttgtttacactatgcagggaaaaccacctactcaagcctcagtaatggtggacacccctccctccaccaagctagagggtcccaggttgacttcagactgctgtgctggcagcgagaatttcaagccagtggatcttagcttgctgagctctgttggggtgggatctgatgagctagaccacctggcttcctggcttcagccccctttgcaggggagtgaacggttctgtctcgctggcattccaggcaccactgggatgtgaaaaaaaaactcctgcagctagctcagtgtctgcccaaacggctgtccagttttgtgcttgaaacccagggccctggtgatgtaggcacccaagaaaatctcctggtctgtgggttgcaaacactgtgggaaaagtgtagtatctgggccggagtccaccgttccccatggcacagtccctcacggcttcccttggctagggtagggagttccctgaccccttgtgcttcccaggtgaggcgatgccccaccctgcttcagctcacccaccgtggactgcacccacagtctaaccagtccaatcacccactgcctagtcatcccaatgagatgagctgggtacctcagttggaaatgcagaaatcaaccgccttctgggtttatctcgctaggagctgcagactggagctgttcttattcggcaagatggccagccaacgccccatgctccttttttgccactcttttattcactttatacatctaattagttaataaacatactgagtttcatacgtgaaacatgacttttacaaaattacctgcatacatcttaaatagtatttcttatttatacatataaccttagacattgatgataaataaaatgttatttatctaaaactaaagtcccatttaataatggttagattttaagtaataaggaaatatatttcaaaatttgtgatcataaattgtatttgaattatattttgttttttgagacagggtctcactctgtcatccaggttggagtgcagtggcatgatctcggctcactgcaacctccatttccaaggctcaagcaatcctcccaactcagcctcccaagtagctgggactataggcacgagccaccatgcccagctgcattttgtattttttgtagagatggggttctgccatgttgcccagtctggtctcgaactcctgaaattaagtgatccacctgcctcagcctcccaaagtgctgggattacacgcataagccaccatgcccagcctaaatcacatttttaaccatgtttaaaatatatctacaatttgacccagccatcccattactgggtatatacccaaaggactataaatcatgctgctataaagacacatgcacacgtatgtttactgcggcattattcacaatagcaaagacttggaaccaacccaaatgtccaacaatgatagactggattaagaaaatgtggcacttatacaccatggaatactatgcagccataaaaaaatgatgagttcatgtcctttgtagggacatggatgaaattggaaatcatcattcttagtaaactatcgcaagaacaaaaaaccaaacaccacatattctcactcataggtaggaattgaacaatgagaacacatggacacaggaaggggaacatcacactctggggcctgttgtggggtggggggagggggagggatagcattgggagatatacctaatgctagatgacgagttagtgggtgcagcacaccaacatggcacatgtatacatatgtaactaacctgcacattgtgcacatgtaccctaaaacttaaagtataataataaataaataaataaataaaataaaatatatctacttatgtacacatattattttttctcttctgagcacaagtttaaatatacttttctccttattacattaagaaacataacaatttaaaagtgaatcaatgagaaagttacctattttggtgtattcatttctatgccatatttttccatttcttatttcttagagacacatatcatattttttttgttcttggtttactcattgcatacaaaagccagtcaagatgtacataatctgtgcctttattagaaaacttttatttaatttccataccattctgataggtaagatcaacttggcaatagaggagcctagagttggcctttgcatttgtggctggtgtattgtgacataatggatgcaggtagaagtgaattaacaggggctacactaacaggaaggtatagatgttgtgcacgtagccaaaggatacaccaaaggtgagaagtgaggagataagatgagcaggacagataggacaagaatacaggcatgacctgtgtcatagattttagcctatgcaagagtcccaaaatgccaggagaattagaatattgagttacatggactgattagttcatatgttggtaaaataagaacacgtaactgatttatattcctcatgtcctgttgtacagatcaatatttgaaaaaccagaatatttcttctataacatgtctcttataaagatccagtcccagccaaacaaggattaagaaaaacttattgttactgttttttaattacaaaggtaatataatacatggacatgtattcctgaagttcttagcacttattaattacaatgtatcttaaaaaacaaaacctgaataaatacttagaaaacactcattatgtagttagttttagcagggacataaatacattttgcacatattcctcatctacgagtaactcataattgagaggttaggatttatgtgcagaaaaaaattaaacagttccaaaatattatagtcaatatatgactgttttcaagctaaatgatataaaaatgtcagggactttagaaggagctatttcattgggcaataatgattgcagaaggtttcttttgagagagaggacctaagcaatataagcacaatgtgtggaatccaaacaaacaaacaaaaaatcatccctggcttttttggtgaaaattaaaatttagaacaacagaaaataccttttgagtttcattatctaatgaagcaaatgtggtcctaattttagttggaaaagataaaatctgtctttgaagtttatattatttaaatagtcaaagttttcctgattttttagtgctaaccagtaatttgcttaattcttaatgctgatcgggttttataacattaatctctatatcagaaagagtatgaaaattttacatatttttcttttttaaaagaattactcataaagcagacttcaaaacaatcgattataccaaagtctagatttccgtattcatagaccagtataagaaaaacaatggacttaacttactaaagaactgggttgatgttaaacaataaatatttctttttagttttttaaaatttttaatttttgtgggtacataattgtatgtatacaagatatataagatgttttgatacagggatacaatgcataataatcacatcagggtaaatggggatgaaacattattatttaaagaataaataataccaatatactgaaagtcttccagaaatagaagaggaggtaatgctttatagttccttttatgagatatcgtaatactgataccaacgccagaaaaagacataacaagaaatgaaattacagactcatatccatcataagcataggtgcaataatttttaacaaggtttggcaaatcaaatctagcaatatatgaaaaggattatatcatgaaaaaggtaatgattctccaaaatgcaaagtgtatataacattcaagacgatttatcataaattttttcccaaagctaatgtctagaaaggtatttcctgtgttttctcctaggattcttacattttgagattagatataatttaaatttttaatctttctttagttaatttttatatatggtgaaaggtaggggttcagtttcaactttctctatttggctaggtagctatcctagcaccatttattgaataaggagtcctttctccattgcttattgttgtcaactttgttgacagtcagatgcctgtaggtgtacagctttatctctgggttttttatccccttccattggtttgtatgtgtgttgtaccaacaacaccatgctgttttggttactgttgacttatagtttgaagttgtgtaatgatgcctttggctttgttcttcttgcttagggttgctttggctgttcaggctctcttttagttccatatgaatttcagaataagtttttctaaatctgtgaaaaaatgacattggtagtttgataggaatagtgttgaatctgtagtatggctattttaatgatattcattctcccaatccatgaacattggatgtgtttccatttgtttgtgtcatctatgatttctttcagcagtggtttattgttatccttgtagagatttttcaccaaattagatgtattcctagatatttttgggagggaaaggggaactattataaatgggattgcattttttatttggctcaaaacttgaatgttattggtgtgtagaaatgctactgatttttatatattgatttggtatcctgaaactttactgacattgtttattagttccaggagccttttggcagagtctttagggttttctagtatagattcatattgtcagtaatggtatgatagttaggcttcttctttttctattttggtgccttttatttcattatcttgcctgattgctctggctacaacttccagtactatgtgggatgggaatgttaagagtgagcattcatgtcccgttccagttctcaagtggaattattcccattcagtaagtcctcaaaagcaattacaacaaaaacaaaaattgacaagtgggacaaggttaaactaagagctccagcacagtgaaagtaactgtcaacaaagtaaacagaaaacctacagaatgggagaaaatattcacaaaccatgcatccaaggactaatatccggaatctataaagaacttaaacaaatcaacaataaaaaacaaatagcccaatttaaaaatgggcaagatacatgaacaaacatacaaaaagaagacatacaagcagcaacaaacatgaaaaaatgttcaacatcactaatcatcagaaaaatgcaaatcaaaaccacaatgatataccatttcacacccatgagtaatggatattataaaataaaaaagcagcaggtgctggagaggctgtggagaaaagggaatgcttatacactgttgatggaaatgtaaagtagttcagccactgtggaaagcagtttggagatttcttaaaaagcttaaaacagagctaccatttgacccagcaatcccattactgggtatatatccaaaagaaaataaattgttctaccaagaaaacacatgtacacgtatgttcatcgcagcactattcacaatggcaaagacatagaatcaacctaggtgcccatcagtggtggattggataaagaaaatgtggtatgtacacaccatggaatactatgcagccataaagaggaattaaatcacgttctttgcagcaatatcgatgtagctagatgccattatcctatgcaaattaaagttggaacagaaaacaaagtaccacatgttcttacttataagtgtgagctaaacgttggataaatgtggacataaagatggcaacaatagacactaggtactacttgaggagggagagagagcaggagacaagggcttaaagactatctgttgggcattctcactaccagggtgatgggatctattgtaccccaaacctcaacatcatgcaatatacccaggtaacgatcctgcatcccctgaatctaaaataaaaattgaaattatttgttaaaaggaatatatatcaatgaatattccacatcaacagactgcaaaagagaaaaatatacgatcattgtcatagatgtaggaaaagcatttgaaaaagtcagcatctattcctgatatataaaaaaaaaactctcagcaaactacaaattaagttgaactccctcaatatgagtggcatctgcaaaaaacatatagctaacattttaatgcatggtgacagacaaaatgctttccttgtggatctaaaacaaggcaaggatgttctcaccacttatatcaaacctttgactggagttcttggccagttcattttggcaaatagaagatcttaagatgtatgacagaaggtattagaactaataagtaaatttagcaaagtcacaggatacaggaccaatattcaaaatcagttataataacaaacatgttaacatatataaaacattggaaactgaaataaaataaaccattataatagtatcaaaaataggaagcacttaggggtatactttaaaaatatacaaaagactcatacaataaaacctacaacatatttctgccaaaaaaataaaaataaatacagggggaatggggatggttaacaggtataaaaaaatagaaagaaggaataatgcctagtattcaatggcacaacagggtgactatggccaaagtaattgtacattttgaaataactaaaggagtataattggattgttcgtaacataaaggataaatgctggaggggatggataccccattttgcatgatgtgattatcatgcattgcatgcctggatcaaaatgtctcatgcaccccctaaatatatataccaactatatacccacaaaaattaacatataaatatatttaaaaatgtggagacacggtgttcatggatctgaagacccagcattattaaggtgttagttctttctaaagtgagagacacaacacaaacctaattaaaattccagcagggtttttttttttttggtagaaatttagccagctgatttaaaattttctgtgaaaatacgcagggcctaagatagccaaaacaaattgaaaaggaacaaagctggaagatttataccatttgactttgagacttattctaaaactacaataatcaagacaggatagcactgatataaagatagacagatcaacggaaggaaatagagaatccagaccttacaactcaatgataaaaagatgaactacacaagtaggcaagaaatctgaacagacactacaccaaagaagatatacaaatggccaatcactgtatgaaaaaatgttccaccttattagtcgtttggcaaattcagtttcaaaccacaattagataacattacacacttgctgtaatgggaataaatagattgtcaacaccaagcattggtgaggatgtggagccacgggaacacttataccatggtggtggaagtgcaaaatagtatacccacttggaaaacagttctgtcagtattttacaaggttaaacatatttttaccatatgtcctaataattccaagcctaggtatttgcccaagagaaatgaaaaataagtccacattaagacctgtatgtgaatattcgtagcagttttattcgtaatagccaaggactgaaagtaccccaaatgtacatcaacaggtaaatggttactcattatcatccatcattataaggaaattcaactccacaatttaaaaaatatgagctactgatacacacaataacatgtatggaacttaaaaatgcttatgtgaagtgaaagaagccaaacagcaaagacataccacatgattccatttatgtgacattctataaaagacaaaattatagggacagaaaacagttcaagttcacttgctacagatggcaggaaaaggtaacaaaagaacattttggggtgagggaagtgttcttgatagtggtcttgattagatgaaatatgcatttgtcaaaattaaactgcattttaaagggttaattatattatatgtaaattgtgtcttaaaaaaactacagtagcatttcattacttataaagttcaggctctgtaacactacccagaaggccttcgcttatctggccttctttacttctcacactgaattaggaatctacttcaggttccatgaagtgctcctataccatgcttatattttactgtcatttactaccacaaagaaggttctcagtaaattattgttcagtagatgaatgcctaactctgtaccccttgtctttacttactctctggaaactattagcagccacaccaaactgatagcttttcccgaacaacatagtcacctgtttctgtgcctttgagcaagttacttaatctgtttcagttttttttctttgtgtatagtggggctaattgtgcttaactaataagatatgaagtgaagtaagaatcaaatgagatgataactgtaaagcacttagcctattaagtaatcagttctcaatgtttctggaacataataaagactcaagaaatgtcatttgtttttatcaggatttagttatttaagtggcactttagctggattttgaaggctctggacaatcgtgaggaaaattgaggacctttcacatcccacgcaggagcacagatgggtttcctatctaggggctttcccttaacacttaattccacagggaagggatgggtttcatccagtgttaattcactctcatcaccctgccttctcttttcaatgattctctcctttccatatcaagcccttatgtttcattgtcaagctccagaattattattttggtttctctttattctccctacttctcacccaatcaaaatgatagttcccatagtgaattaatacgtagttaggtctgattgtatttttatataattgttcatataatcaactgacgcaaaggcatgaataattgatagattttatccgtgaggaaagatttctattttgagagaatagcttatcaatttttttctaatagctatatagaggggaaagtctctagtgtcttatttttccatcttgttctacacaaatagaaagtctcaaaatagcctgctacatataccatcattatgcctcagtgttcagatctttgtaattttacagcctatgaaaatgagtaaattggttcatccttcaaaaaaaagtttgattagtagcataattcatagctaatatggcagactacaaatctagattatgaacatgaagaattgatatgaattcccaccacagtctgatatggagcttcataactaaatagcaagatctgccatctctttttctctcttctaaggagcataaagatgaccaatctatcaatgtgtatctttcagaaaaaggaactaccattttcaggtactttttagtgacaccagaaacttcgtgacttacttttgagattttggagccagaggaaattacactgaggtattaaatccccaatcaaagtctgtcttcttcactaagtaaatcaggatcttaaaatctaatcttacagtttgggcatgcactctttcccctagtttgtaggagatctgaaatagtatactcccattctctgatgacaaaaactgaaattaagacatagggaaaattatttgtccaaaattataatgctgctgaacaacagaacgtagatacaaactagttctcccttttgttctgtaatctatatataatgaaaaatgaatttgtctgacctatcctattgccttttctattgatgtatttttcatcaagtaatagaaattgtttatatttaaaatgcaagatctcacagtctgaggtcaaagacatgcatttaaaagataacaaactgcataaagtcagttacttccaagaacatcagaacttgcttgttgacatctattccattttgaataggatactttgttctgttaactgacttcttttttctggtattcatgacaactcttatctgttattaaacagaaaagaataggactggataaactattttctgtttctgtttcctatggaaaataaccttgcattagaaaatgaacatcacttcattcactttctgtgttgtatagatactccaagtaggaaatgttctgtaatagctattcttaaattatctgatgttttatttaccttgttttttccatgttaaatgtactgtacagttttatagctttaacaaaaatgacatgatcattaaaattctatttttcttagtgttcttcttcccacataacatactcatgcattcattcagtcatttatccatttagctgtatactattggtgatttcatacttcatgacaggtaccatgcaaatcatactggatactgagataaatagattttgtacgtcatttactgaattttacagttttagaaagtgaaagactttttaaaagaaaataagaggaaatagccaagctagtgtgataaataaatatccggaacatctgagagattgggagaggtctcttagctctatagggatgagggcgtggcaggggttataagaagaagaaatggcatatataaaggccctgaaatagcatgactcattaaaggaaatacaagggttgttcaaggatatagaataaatatgttaaagtggcagcagagaaggttagagaagtagacagacatctctatatcataataaatttaactgttatcttgtaagttgtgggtagccactggaaaaatttaactttggataacaccaatggaaaagtgaaaaatgtagatgtagacagacatttctatatcataataagtttaactattatcttgtaaattatgggtagccattggagaaatttaactttggataacaccaatggaaaagtgaaaaatgtattagaaggatggaagatttcagggaggcagaaaattatatggctgttgtaatccaagtgagaaaagattaaaatttaaacaaaagcattattacttgaaagaattaatagattaaaagtatattatggaggtaaaattcacaaaccttggtggttcagaatattcacattctacatagagtacactcattgaggcatcatgagtcttaaaagtgttaggactccttcgtggccagcactccccactataaattagtgccccaaggggaaggaattccctcagtatatgcctaaagtaacatgtcattgggattttaaagctgccaccagaagtaaagcagagaatctagcctggaactatcagactaagccaagatccttaagaaaggctgatatgtttctagtggactcttcttgttatcaccagaaacaaaagcaaaccatcatagataaacacttaatgactaaatatatgagaccgaaagccaatatgcatgagaatcatcaagggggaaaaaagattttagatctctaagggctgcaaaggttagaattgtgaaataaaataaagcgcaaaatagaatgaataaaaagagaccattaaaaatgaagaagaatatttggaaaaataaaacttgtagaatttttaaaatacaagttggaaaaaagatgtttattgatgattcatcagattagacaaagatggaggtaattagttaattggatttttaaaattttttatttttgtgcatacatggtagatgtatatatttgtggggtacgagatgttttgatacaagtgtgcaatgcataataatcacatcatggaaaatggggtatccagcgcctcaggcatttatcctttatgttacaaacaatacaattatacttttagttatttttaaatatacaattaaattattattgattatagtcaccctgttgtgctattcaatattaggccttattcattctttctaattaatttttttgtaccattaaccacccctacctctctccaactcctcaataccttttccaacctcttgtaaccatctttctactctctgtctctatgagttcaattgttttgaattttagatttcacaaatgagtgagaacatgctgtttgtctttttctgtgcctgtcctgtttcatttaacataatgacttccagttacatcaatgttgttgcaaatgacagggtctcattcttttttatggctgaatattactccattgtgtacaagtactgcattttctttatcaattcatctgttgttggacatttaggatgcttccaaatcttggctactgttaacagtactgcaacagacgtaagagtgtagataactcttccgtagatcgatttcctttcattggagtatatacccagcactgcgattactagatcaaatggtagatatatttttagttttttgaggaacctccaaagcattcttcttactgggttgtactaatttacattcccacaaacagtgtatgagggttcctttttctccacatcctcgccagcatttgatattgctaaagtttagataaaagccattttaactggcatgagatggtatctcattgtagttgcttgtttgtttgttttgggacagagtctcaccaagtcacccaggctggagtgcaatggcatgatcttagctcactgcaccctccaactcacaggttcaaggaattctcctgcctcagcctcctgagtagctgacattacaggtgcccactaccacgcccagctaatgtttgtatttttaatagagatggggttttaccctgttggccaggctagtctcgaactcctgacctcaggtgatccacccaccttggtgtcccaaagtgctgggattacaggcgtgggccaccatgcccagcctcgttgtagttttggtttgcatttctctgatgatcagtgatgttgaacacctgttgatattcctgtttgccattcgtgtgtcttcttttgaaaaatgtctgttcaaattatttgcccatttctaaatggattattagatttttaccaatagtgttatttgagctccttatatattctggttattaatcccttgtcagataggtagtttggaaatattttctccaatttatggattatctcttcactttgttgactgtttccttcgttgtgaagaagttttttaacttgatgtgatcccatgtgttcatgtttgctttggttgcctgtgcttttggggtagtgctcaagaaatcattggcctgaccagtatcctggagattttccccagtgttttcttctagtagttttatggtttgagtttatggatttaaatctttaatccattttgatttgatttttatatatgatgagggataggggtctagtttcattcttctgcatatggatatccagttttccccacaccatttattaaagagattgtctttctttggcacctttgtcaaaaatgagttcactgtaggtgtgtggatttgtttctgagttctctattctgtttcattgctctatgtatctgtttttatgccagtaacatgctgttttggttactatagctctgtaatataatttgaagtcaagtaatgagatttccccagttttgttatttttgcttaggatagctttggctattctgggtctttggtgattccatgtaaatttgaccattggcttttttctatttctgtgaagaatgtcattggtattttgatggggactgcattgaatctgtagattgctctggatagtatggtcattttaacactgttgattcttccaatccatgaacacagaatatcattccattttttgatgttctctttgatttgtttcatcgatgtattataaatttccttatcaagatctttcacttcttaggttagataagttaggtgtattgaatatattttcaacttacagtattttagacttatgatggttttattaggacacaacttcgtaagtcagaaaacatctgtgtagattaattacacatatattaatgttaattaatgttaattaattaacatcctaggagatgttactgccttaggtaaaagataagagtttaggcaaatagtgcgttaaccaaaagtttgggaggaacagcttggaaataggtacataagggctttgaaaagctctaacatatttatggaagtctaaaaggctattcgcatgccgggggctacatgcatcctctggacagacttaagaaggccttaagctttcaccttctgctggccttgcgacaatatggaaacaggaagtaaatgctaaggtacagttgaaacctgcctggttgattattgaagggctgtccttacacagagttccttaggaaaatctgggaggttttttctatccaggaatttaaggaaatctctattcaattattagctgaccactaaggtaatgaaacacagatttcagtggccacacatgacaaagaatgcaaaccatacaaaattagttaagaaaaatcactcatcagataatgaaaacaccaacaaatcctagggaagagagagaatgagatttcaagaattgccatattataatactcaaaacatcattgcaaggagacaaattaaaaagtacgacccacacacagcaaaaaaccaaatcaatagaaactctgcttgaggatatattgcctagaactttctaaacacagacattaagtttttaaaatatgttccactagtcaaagagatatgcttatacactattggtgggggtgcaaattatttcagctattgcggaaagtagcgtggcacttccttaaagagcttaaaacagaattaccatttaacccagcaatcccattactgggtatatacccaaaggaatataaattgttctaccattaagacacatgcatgcaaatgttcactgcagcatcattcacaatagcagagacatggaatcaacataaatatccatcaatggtagactgggttaagaaaatacggtacatatacactgtattatgaagccttaaaaaaaatgaaaccatgtcctttgcaacaacatggatagagctggaggccattatcctaagcaaactaatacaggaacagaaaaccaaatactgcatattatcttttataagtgggagctaaacaatgaaaacacatgatactaggaggtaaatagcagaccctggggcctacatgagggtagaaggtgggataaaggagaggatcagaaaacatacctatcggctacagtgcttattactcaggtgacaaaattatcgatacaccaaacccctgtgacatgcagtttgcccatataacaaacatgcccatatacccttgaacctaaaagttaaaaagaaataacaagggaaagaaaatgctacactaaaaaatatttagttagtacaaaagaaggcaagaaatggaagaagaaataaataagacatattgaaaacaaatagaaaaatggcagaagtcctttcttatcgataaatcagtaattgcactaaatgtaagtgaaatgaactttccaattaaaacactgagaattgaagaatggattttataaaaaggattcaactgtaagctgtgtacaggaaacagattaatagacacaaacaggctgacagaaaaatgattttaaaacgtattccatacaaatagaactcaaaagaacggatgactatgctaatatcagacaaactatattttaatacaaaaatcattacagtgacaaagacattatataatgttaattatgtaaatccatccataagatatcatagttttaaaaatatatgcacttaacaagagacccctaaaatatatcaagcaaaaacatacagaactaaagggagaaataaataattcaaatatgttacttggagactttagtatcccattttgaataatggatagaacacctagactgaaacaacagtatatgtcacctagacctcccagccgtctatagaatatgtcatttaacagtagcaggcacatgttcttcacaagtgcacatgaaacattctgtaggacagaccatatgtggccaaaaaacaattctcagtaagtttaaaaaggttgaaagcatgcattttatcttctccaaccacaatggattggaatttgaaatcagtaagagaaggaaatttgaaagattcacaaatgtgtggaagttaaacaggaaactactaaataaccaatgggttaaaggataaattacaagagaaatgacataatactttgaagaaatgaaaaaaaatcaaaactgatgggatgcatttaaagtagggctcagaaggaaatttatgactataagtaactacttttaaaaaggggaaataagaaaacattaacataacctccccgcccccaacaggacaaactagaagaagaggagcaaattatttccaaaacaggctgaagaaggaaaaaatagcaattaaaatataaataaagcagagaatttgaaagtaataaagcttaataaaaccaaaagttgatcctttaaaaagaccaacaaaattgaaaaaactttagctagaaaaaaaagaaagaagactcaaatcactaaaatcgggaatgaaagtaggaatattattaatgaccttaatgaaagaaaaaagattataagggaatacttactataaaccattgtgtcaatactagaaaactctacatatgaaatggaaaaatttctggaaacataactaacactaaactaaaactgactgaatatgaaatagaaaatctgagtattgctgtaacagtaaggagtttgagttagtaatttagcaaaacttccaacaaagaaaaattcattaccagatgttttccctggtaatgctatcaaacatttgagacgaaagagaatcaacagcagtccttctcaaactctcccaaaacatagacgaggatgaaacactaactcattttatgaggcgagtattacccttaatgataccaaacccagataaagtcgtttgaaaagtaacaaaccggtatctaccacgctattaagtaaaggttaataaaactacaaatcttatgactatggatgcaaaaatcctgaacaaaatactggcagatctacgtcagcaatatgtaagaaaggattatataccttgattaaatgggatttattccaggaatttatagttggtttaacacatgaaaatcaatcaacgtaatacaccatattgctgaaatgactgggagaaaaacacatgatcacatcttaatagataaaatcatttgacaaaatttaatactgtttaatgataaaaatactcaacatattaggaaaggaaggaagctttctcagtctgataagtgagatttacaaaacaaaacaaagaaccccgcaatgaagtcatgcttatttatgaaagactgaatgtattcaccctaagggaagaagacaacaatggccactaatactagtgctattcaacattatactgcaggttctagctagtgtagttaattaagaaaacaaaataaaaactgtctaaattgaaaacgaagaaacaaaactctctatttgtagaaggtaggacttatatatagcaaaccttaaagaaactaccaaaaaaaaaaggatctgttagagctaataaacaaattcagcaaaatggcaggatatgagaccaatatacaaagatcaattgcatttctatacaccagcaatgaaccatctgaaaataaaattaagaagatggttccattaacaataaagtcaaaaataataaaatgtaacaatgatattaagtaatgctcaacatcagtagtcattatggaaatgcaaatcaaaagtacaataagctaccactgcataaccatttggatgggcactgtagtagtctattcttgcattgctataaagaaatacctgagactggataatttataaagaaaagaggtttaattggctcttctgcaggctgtaaaggaagcataatgctgacatcttcttggcttctgggaggcctcaggaaacaaacaaacaatcgtggcagaaggtgaagtgggggcaggcatgtcttacatggcagaagcaggagcaagagagaggtgggaggtgttacacacttttaacaaccaaagttcatgagatctcacactctatcatgagaacagcagcaagaggatatttctaaaccattcatgagaaaccaccaccatgatccagtcacttcccaccaagccccacctccaccactggaaattacacttcaacatacaatttgggtgtgaacacagatccaaaccatattaggcactatcaaaaaattagaaaataatgagtgttagtaaggacatggagaaactgaaacacttgtacattgttggtgggattgtaaattggagtagtcactatggaaaacagtattgcagatcctaagaaatttaaaaatagaattgccgtattatccagctattccactgctgcttatgttgccaaaagatttaaaagtagggactctaagtagtatttgtgcccctatgttcatagctgcattatttgcagtacttagaaggttaaagcaaccaaaatgcccattgacaagtgaagcataaacagagctctttatacatacaatgggatattattcagccttaaaaaggaatgaaattctaacacattctacaacatggatgctaaataaaataagccagtaataaaaggacaaatactgcatgattccacttgtatgaggtacccagagtagtgaaactcacagagacaaagtgggatgatggtggccaagggctgaggatggaggagcaggtaatggggaattattaatatttctaaataggtaaagaatttagattttacaaaatgaaacaagttctgttaatggatattagtgatagtagcaaaacaatgaaaatgtgtttagtaccacttaactgtacaattaaatgctgtaaattttatattatatgtattttattacaattaaactttttttaaaaaaggaataaatttagccaaagaatgtcaacacttgttcatcaaaaaccacaacattattgaatttctttcaaacattgttgaaagaaattaaagagggtataaataagtggaaatacctcccaggttttaatggattggaaaagttaataattttaagataacagtacttttcaaatttatatataaggtcaatgcactctatcaaaattttagctgtcttttttcagaaatggaaaagctgattctaaaatatggaattgcaagagacataggataaccaaacctatattaaaagaataaatttggaggacttatacttcttaatttcaaaacttaatacaaagctacagtgataaaaacagtgtggtgctagttaaagatagtcttacagacaaatttaatagaattgagagtccacaaagaaacccatatacttatggtcaatttattttcaacaaggttgccaagacttttcaaaatgactgtccttaccattgttgaaaagacggtcacttcaacaatggtgctggaacaactggatatcaacaggccaaagaacaaatctagtctccaaccttacactctatgaaaaaatgaattcaaaatgcatgaaagacccaaatgtgagaactataactattagaaggaaacatagttaaaaatcttcatgaccttgaattacccaatggttttcatagatatgacaccaaaaggacaagcaaaaaaaagtagattgatagtcatcaaaatttaaaacttgtgtgtcaaaagacattcatttacaagatagtgaaaatataacagcagaattgaaatcaatgtttgcaaatcatgtgtctaataaaagtctaatctccagaatataaaagtaacccttacaactcaataataataagacaaatggcccaatttaaaaatgaatagaagatacaagtagacatttctccaaagaagacatacaggtggccaatggacacatgaaaagattctcagaaatgcaaatcaaaaccacagtaagataccacttcatattcattagaatggctataatgtttaaaacagacaacaacaagtgttggccaggattcacagaaattggaaccctcacactttgttggtgagaatgtgaaatagtacagccactgtggaaaagagtttggctgttactcgacaagttaaacatagagttaccatataacccagaatttcatctgtagatacatcctcaagagaattgaaaacatatgttcacaaaaaactattcataatagcataattcctaattgcctgtaagtggaaacaacccaaatgttcatcaactggtgagttggtaaacaaactatgatatatgcataaaatgggatattgttcaccaataaaaaggaataaggtactcatacttgacatggatgaacctggaaaatattgtgctacctgaaagaagccagacacatattgtatgattccatttaaatgaaatgtctagaataggaaaatccatagaaacagaatgtagactagtacttaccagaagaaaggaggaagaggaaattgaaactaactactactaagtataaggatttttgcagaatgataaaaaggatctagacttatatagttcgtggttccacaagatagtgagtatactaaaaaccactacagtgtacatttttaaatggagaggattttgttatgtgaaatatatctcaattttaaaaatactttttaaaaattagcatgaaatgaacttttagcgataaccataattttagatggtttatccccaagagaacagcaactaagaaacttacaatgtatgcatgtcaggacagcataagaaaatctcataatgacaaaactatacaaggagaaaagtatgcaaacaaattggtaaatttgtgtacatctacgtagaaattgtctttataaagggctaatgatatgtaatatgtgagtttgaactggacaatattgggcaatagcttgtaagttagaagggattgttacataatattgttgcagaagaggcttatgatgttatttaacttcatacttatttaagttaactatacctggtaaaagcccaagcatagcaatgaaaagagtagaataaatacatttccaatcagtagggagtaaaaaagatggaattaaaactaaagtttctatccccaacccctccccaccccaataaaaagcattaaaaaactgggaccaatggaagatttttaaagtattgggctagaattaaatacattatatatcaataagcacaataaatataaaaggactatgatttccaattaaaaaccaaatttctcagatatgattaaaactccaggtgagttccatttattaaaggcatacctaaagccaaaagaatgttgaaggtaaaaagatagaaaaatatatcctgggcactaatcaaaaaactaagctgacatagctatattgatattttaaaaaatatttcaagggaaaaattgttagtgaagaactaagttgtatgggtaggaagagctgaattttcttaagtaagatgctaccatcctaaattcatgtatttcaaataaataacctcaaaatgtgtaaagcaaaaattgatgaaacatcagggagaaaatgacaaatctgccatctttgtggaagatttcaacactcctatctcagttatcaaaatatccaggagacaaaaaaattcagtgaatatatacaagatttgaataacataattagcatttgatactattgatatatagaacttttcacccaatcatagacagtacatattattctcaagcaaacatgtaacctgtgtaaaatctgatcacatggttcaggggtccccaatccctgggccacaggctagtaccagtccttggcctgttaggaaccaggcagcacagtagcgggtgaatgacttgcaagagaacaaagcttcatctatatttacagccacttcccattgctggcatcaccgcctgagctccgcctcctgtcagatcagtggcagtattagattatcataggagcatggaccctattgtgaactgtgcatgcaagggatataggttgcatgctccttatgagaatctaatggctgataatctgtcactatctcccatcacccccagatgggaacatttagtcacaggaaaacaagctcagggctcccactgattctacattatggtgagttgtataattatttcattatatattacaatgtaataataataggaataaagtacacaataaatgtacttgaatcatctcgaaaccatccccttccacccacactggcccgtggaaaaattgtcgtccatgaaactagtccctggtgccaaaaaggttgggaactgatgacatagttagatcataacacaagtcttaccagattttaagaattagtgttatcaataccatgatatctgaccagtgtaaatttatatttgaaggcgaggacaaataattatattaaaatattctcattactgctgaagaattttgaacacttaacatatttcaaagaaacataaaaagtatttagactaaacaataatagatatactaaatacaaaaacttgtagaatgtaaggaaaatgaaacatgaagataaatctatttgcgtaaaagcttattacttgagagaaaagcctaaaattaatgaactaaatctctaactgcaaaaaaaaatgtccaagttaggaaaataacagaaccccttcacaaagtagaagaaagctaataataaagaagtttaacagaaatcagcaaaatagaaaaataagatacagtggagaagattaacaaagataaatgtttattcattaactaataataaatgagcaaactcttctaagattgattaagaacaaaataaaacaacacaaatagtgaacatacagaatgaaaaggagacataattataaccaaaactaattagaaaagaaaatgagagtgctatcaaagcattataccattaaaattacaaatttaaatgaaatgagcaatgtcctagaaaatatacagcttcctataactgaaaaagaagaaacaaaaccctaaatagttctttaagtatgaaaggaagttaatcagtaaaatttcttcctgtagagaaaactctaagcccaaatagtttacaggaatagtctaccaaatgttcaagtaaaactctgttccaaacttacaaactcctagagatcagaaacagggaatgttccagattgttcactgaggactgtgtaatcttaattataagagcaaacaaggaaaatcacatgccaatctcccttatgaatatagatctgtaagttctaattaaaatattagcagaactcaattcaactgtgtataaaaagataacatgtgtatgtggggcaaactggaagacggtgatgagggaaatttatcccatgaatgcaggagttgttcatcattttaaaaatttctaaaaatgtcattcatttatcacattaaaagtgaaaacttttatgatcatcttagtaggtgcagacatctagtaaaggtcagtaacgttcatgattagaaagaatactcttagcaaattaagaatagaagagaattttgaactattttaatttaaaaaacaatatctacagaaaacctgcagctttatttataaaactcacaagcaatctgaacaacatattgctttggcatatatacatatgtgagataaaatggtttgttaaggaagcaagagactgataaataccaagtgcagcagagtggtttatttatttatttatatatttacatatactattatttttaagtgagtgagcttaggatagtaaagacattcgtgtcgcctctcaaaacctgagttaaaaacaacttgactgtgaaaaagaaatatagattttatcctcagtgaaaattcattttgttactttccttagcagtctagatgtaagactgagaaaggagaccagtgtgttaacccagggtcacacatctttgactccagtgcagcaggtagatcaggaattaagtgaaggtgttggcaagagagtggttaaaacatggaattgtgggatcccagatggatgcaaaaggaagtgaattattaagcagaagaggaaagagagcagcaaggataggagatcatgatctgagagtagacttaaagcataaagacttgtgaaatgaagctacttatggccattggatttatttgctgaagtaagggagacttgaagatcttttgagttaatcagtcaaagaattgtgagctgctgtgatcaatgttttccatgtggataatggtgtcattcagagtggtgtcaagagtcatggaaagataccttctcttcgtgtaaataaaacatcatagatcagttggcagaactcataagtgcccaagataggggaacagactaaaaaactgatacaatttctttggtgtgtctgaggacaggagtcttttgttacaaagcctccacccccacagccatgctgctttgcttttctaatccactgctttgctcctgggaatgatatgtattagccagccagaccatgtacccttcccttcctgctgtctcctgttaatctatttaagttttgtaatttgcactaatttgcacatattagatttcttcctggctttcttcagccttcagcatgcactagacaaagccattgaacgaaatattctaatatcacatctcttctctcttttgaagcctctctacaaaatgtaggctgataatatgatcaaaagttaataatcagagtttacgtgatgttcttttttagcttcttttaattttccatttccctcagtgattaagactgtatgtttgtttgccctccaacgtcatttacagaggagtttttatcttttttcctaagtattgtcacatctaacagatttccataacctttgtattcttttaataatttgtgttgtggttaacttttagactgaaaactggacaactttcccattagaatgtgtctatgtccccctcaacagattggagagatagctgctccatgcttctaggaaatatctgcagctatcctgctgctatgcaagattttactggtgccgctgtcatattgtcagaaccgttcccactggtcctagagtgacagagtagttatttaacctaaatcttatcaaggagtgattaaatctatatctgagcagacatggattttagacggatttctactgagaactatcttgagttcagtgttgctcagtatttacattaccaccctaaaataaaggaaccattcacctgtcggtttttatggaagatgccacaaagatattgcaagtaatttggtgggaagatattaaaacttcatgttttgtaattcaaccttgatattagaaagaacaaataaatccagtatagtcacactcacctcaaagacatatgtaggcttttaaaattatatttaaacaataaattagaaatatcagaatacataatgatattttgtttcttctgcttatatttatgtatcagtaaagaagaaagtttgccacaggtagacatgatatagtgaagaatataggaggaattactaggacttagtatttagtaagtacagaaattaaaacaaagttaaacctatttccatctgatttatatttatgaaaacttgagcaaaaaaaagttgatatatttcattaatgagcagtgaaaaaaagtaatgctgttattgaagtagtactcctgtttaaaatccccggaaagaaaaactggacaatgaaggaatatgaggattagaatgaaatttaaaaaggacatagacaaaggaactgaaaccacttcttaagcttgccctttaaggaaaacccagaatgacttgaaggtagctttttaaatattattttttttaatatgcagtaattacttaatgcaaaaaaaattgaagaagacacaaaaaggccaaatcattgtttttaattgacacagtgaaaaacaaaatgatattagttattataatcaatattatcttcccctcctcttcctcctcctcctcttcctcctccatctcctccatgatcatcatcatcatgtggcttaaaccagtaatcagtttttttctttcttatgattctcattgcctgggctcagctaagcagttctctctggctccatgtggagttgcctgggtctgcagtgtcctgaatgtgacttactttgggctgagacctcatttaggcctgagagcccgagcaattctgtgctcttcaatgtgctccatgtgatgtgggcttctctcaggggagcaacagactccagaagagagagttcaaaaaaaatcaaaagctgcctggcatcttatgtcctagcctcaggagtcacatagcatcacttctgctgtattctgtggctcacaggaagtcacagggcaagtccagatccacaaggagtagaaaaagtctccattttttgatgacaaagtcacactgcaaaagagcatgtgggatgggaaatgttgttgcagccatctttggaagtaatctctgccacatgttattaaagaagttagaagaagctcactgtgtgtacatgtgaaaagatgtccaagatacatttctatgtgagaaaagctgggtaaagaacagactgtataatgtactaataattatcagtgttaggaagtgtgggaaaagaatatatttgtatttttatttatatattttagaagtctctgaaacacacccaggcataacagtgggtacctgttgaggttgaaaatttggtgactaggggacatagtgagaggcttttcactgtaaaatgttactacacattttaaaaataattcgaatctcctaaataagtaacttctgtagttaaaaaagtcagctatatggttgaactttaactgtagttccatattagaatttggaatctcagcatttaaaagaattttagatgtcatttagtcctatcatctgcattatttaaagtaagaatctacatggtttatctgaaattcaaatttaactgggcatcctatatttttaaaaattttattgaggtacaatataaaaaaataaaaataaagtaagaatctagtctgttgatttcctaaagtgtggtcattgaacttatctgtgaaaaattacctctaagatagtgacttctgttgcataaccatttgaaaacactccaaccaaaattttttatttttgaggaacctatcttaattgaattaactgaattgctgattaacaagacacactatttaacagaggaattggtgcaacagttttatgacatctttctatatttcacattttactgaatcataatttaaaatatattaattttatatctagctttatctaaaacttatgtatatttgaagtactgaaatctgattattgaaaaaaattggactgaccaaagctattaagaataatatttctaaaggtatttttctttttagattactgtgccatgctatgaaggaccatatagtccgtgttgcaaatgaagctgagtttattttgaacagacaaagagccgaggatgtacataaacatgcagagtttgaggtaaggttttgggagtagactaaattctgcctttctattataagccaaaaatcacctatctgtgaccttacataagaaggtttttttaaaaggaaaatttcactgaaggcatttctgttcctgttttttaaaagctttagtaaatgtcaaacagagtactaatatattttcaccccatttacagcatgaaaacattccttctgccctatatatgcctaaccatttggtagactgaagttattctaacctactcaagagtaaatgcaaaaaataatttataatgcaacaattttagttattttaagctagcagagatttacacaccaataggtagatatgagtatatgatacagttatatgaataaactcatataagattcaaaaaaatctttcaatttctgttttatacataacagttatttattatttcagtttattccatttacaagacaaaataggtccgagaaatatttatgtgccctgctgtttggcttagttggacttgaaagtaataaatgactcaccaatttattctcctgatacaacaggctaacaagtatggtgtagctagaaatcagagcccacaattctagttttgatgaggtttttatctcagtaaagcagctctgtgagtcatacaagttgatagactaggtctagtgatctctgacctagctggctgaaaagcatgagacaggaaaatagccactatcgctttcaaacacatgacctttgcttcatttggtcagaagaggcacaagacaagcagccacttgtcttgtgaaattgcaacaaccgtattctgagaaagataccagatattttaaacttcgataaaagtatagtgatctttaagtgtttatcaaagtgaagtttcgtattagtaaagatttggaatctcaactgaattccctgcaggatcagttttgagtctcttgtatttccactaagaaaatcaagataatttgtgaggatataagcagatcaatatttgtcatgtgaaaacatttaaaatagattttcaagtggctagatattagttatgagctttaacatgtttaaccaaggtgacattaagccaagggcagtgtttctcaaccttttttattgttgttattgattccctaaggagtccttttagacattttgcctaattggcctctcatcccaaagaaattttataataccacccataggctgtgtatctgtttttgtacttacatacatttgtgttttatgtactgaaataacaatatttttatcccccacccgacacacaccaatttttcactcttaggaatgagattactctcgttgtgggtcatcttcccaaggtgataagaggtttccaaggaaacatgaagacttagtgttttttagattttataaacataaaatataatattaatgtaaatgtaattttgattatattgccagtgttatttgatgattgtaccttatttttttaacctgaaatgtttatatctctcctttttgggttagagctattgatgtgtgtgtgtgtgtgtgtgtgtgtgtgtgtgtgtgtgtgtgtgtagtttacacaaagatatcccttttaaattgtaaaagattttacaagtcatgacattttgctagaactttttgaggaatttttctatcccccatatcagcctataattaggaagaaaagtatatttgattttagatgggtacttcacagttaagtttttttagttaactactgtagttgttaaggaagaaaaatgaaaatttaattttactctccaatgagctaatgaaatattaacctcattactgaggcagatcgttgtactaattggtgattccctgtacaaaaagataaattggaaaatgaattaatccttcttagattactgtagggttatttctccagaagagattacttgtggtagtagtgtatatcaatagataaatgagaggaatatgttcaagtaccttccatgaaatagatttttgcatagtaatgatgaatgtgaactacttctatttattttatcagatgtatgagacttttttcttcctagttatattacttgtattacacatttattaatgttaaaagttatagtcacaccactctgtatatttattgtagttttctgtataaaaactacaataacaagaatcaaatttataattaaagaaatatttctctttatgtttacattaaatatttttaatacaaaaaatgatccattgatagcagtgttgctaacaaatgtaagaatgaatacatgtcagatagctgacatgacaactgataattatgggaaaaggaaggtaagaataaggtagtagttctcatgaaaccctttgaacacattacattttaagaatatggagggatcatagaaaaaaatcttgtctcagctcctcatttacaaatatgaaactgagtacattaaaatatatggagtttgcatattttgtgaattaaaatctaggtctactgaattcctaaatgaccacattttcttctgtatcacattaccattcatgaaatggaaaatataaattaaatgacagatttttgattcatatgtaattatcaggaacatacctcttattttaagtgagatatactatattggcttgataaacaagtaggtttacatttatagtaaatatttgtgcttctaaaatacatgaaaattagattctcagaattggaagaaaccatgagtctttaattacttcaatattattcaaattattttacatatactttagaaagagcacatttttatatttgaaaggtgactatatgtattctttagaacaaaatatcaaaagattacattatttgagttttaaaaagttgaattcctgttaccgtttaacttaaatgtatatcatccttacttatatgcagtaaaaagtttattattatgcatcatttgtatttctttatagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcataggtgagttataataaattcgagtaaataataattcataggttaattataatagttggtaataaaaatatggctacaaatttaaaagtcatttagaaaatataatttaaaatataaaaaattacttgaaaattttcctgaaatctttaataattcttcatcagaagagtttaagggaaaacctaaactttttatagtagctacagtggaagttatttctactttataataatatgcaacataatacaaaatatggttaggcaagtattttagtctactgtctctcatatgtaacatggatgtttaggtatgagaagtggctctttttaaaaaagaatcttttagagtcaactcttcctacttattaaatttatatcattcttttttatacagaagcatatataagcatatactacagagaaataatatgttcttttaaaaagttttctttcataattttctattcagtcttaccaagggaagattttcatctcaaatatgattgtttatgataatatagtacaactaaaaccaaaatttggttgtttataaatcacaaatgttctccctaaagttttgtggacatacaattattgttgttgttgttgttgttgttatctatacaatgaagttttctggaaaactagaagtgaaacaggtcactatatttagattgctgatgttcttcctttttatattatgttttttgaccccactaaatgtttttattaagtctgtgtttggcagagtttattaaatctgtttgacaaagttggctggtgaaatgtaaacgggatactactaagaagagccttggtaaaaatgattctgttgacctggtgcgatggctcacgcctgtaatcccagcactttgggaggccaaggctgctggatcacctgaggtcaggagtttgagaccagcctggccaacatggtgaaactccatctctactaaaacacaaaaattagccaggcgtggtggcgggcacctgtaatcctagctactcaggaggctgaggcacaagaattgcttgaacccaggaggcagaggttgcagtgagccgagattgtgccacagaactccagcctgggtgacagagtgagactttgtctcaaaaaaaaaagattctgttagagaaaaacacctagaatatgagtaggatggtatttaaccaacttcctgggattatgagtgtaagataggttttttaaaactttattaattttggatttaaggtaaaattataacatgtgtctttaaaatagtcagcatttaatatttatcataataatagcaataacccatggcctctaacatttattatttgttgtgtgcgagggaccatactaagaactttacatggattatttcctttatccttgaacatctttattaagggtgacattgaggtattctccattttaccgggaagaacctaaagctgaaagaggttaaataaaacttacatagtatcacactgcttgtacaaatagaggcagattatatcagtcaggatgctccagagatatttatattcattaactaaatttattttaaggaatttattcattcaatcatgggagctggtaagtctgaaatctgtaggacaggctggcaggctagaaactccggcaagatttctgtgttacagtcttgaggcagaatttcttcttctccgggaaacctcagcttttgctaaggccttcggttgattggatgagcctttcccacattcttgagggtaatatcctttacttaaagttaactgactgtagatgttaatcatatctacaaaatacctccacagcaacagttagactaatgtttgaccaaacaactgggcattatagcctagccaggttgacataaaatttaaccatgaaacacactaacaataacctgagcattttacccatctacagaccttgtctccctttttgtgtcagctgaattgggtttatctattaatacttacttatatgtagtcaggactgtaacattatattgctagtaacgcagctggtatgattcaggatattgccttagctgtataaagcagtacatggtttgggttttaattatttccttatgtaattagaatacagctaaaggacagtgacctccatagcagcagtcatgtggtaacatgtcagatgcgtcctgtgctagctagtcaacaacctttctgacatctcattagactgacagaaagcatggcctgagccctcagaagagcaggtgtcttctttccttgcacattagtttctactgccaactatctgaaaaaaaaaccacaatatttttatgatcatttactaactgtgtcactgaactctaaacctttaagcataggttttgttctgtttaattctccttagtatttgattaactaatagggctcagtcattggacctcttctcttttctatcttattcactctctagacaattttatctagtcccatgatttaaaaatactactaatatgttgataactccaaaatttattattccaagtccagatctctcccgtcgccaggtctgtatattcatctgcccacttggtatcttctaattgattagctgatagtcacctcacacctaacatatgaaaactaagcttctaatattttcttccaaaccagtttctcttatatttttctccatctcagccaaaggcaactccattcttactgtttctgaggccataaatgttgctctgtccttgactactgtttacacatcccacattgagcccttcagcaaatcttactgacactgccacaaaatatatccagcttcgactgcttctcaccattaccttggatcaccttagtccaagccacatcattctcacttgacttattgtaccagcatgatatatagtcttatttttatatttcacttgacttattgtaccagcatgatatatagtctttctttttatatttttcccctgtcctcctaaagtccattctcagcgcaacagcctgagtgactcttattaaaatgtagatccctctgctcctatgcttagaaacctccacagctgtactatgccagactgtaaccactagtcatgtgtggctattcaaatttaattaattaaaatttaatttaatgaaaaacgtgatgcctcagttgcactagccaaatttcaagtactcggtagccacatgtggctggtggctaccatagtagttatcacagaacctttccgtcattgcagaaagttcttttgaacgcttgctgcagaggtttagcattcactgagggggaaaataagatctcatagtgacttattaggccctacatggtttagtctttgtttgttaactcttcaacctcctctgccaatactctccccttggttctttttgttctagtcaccctggcttctttcttgcaggtcatgtttgctctgtttagaatgctttcccaaaaagttcattggtcaaactttttcattttcttcaggccttaattccaaatgataccatctcaaaaaaaaaatcattctctagccactctgtctaaaattttactcttcctccaaatattttatattgcatttccccacttttcaacatctattactttgatactaaaatttcatatattttacttatatattatttttattgttttgttttccaatagcatgtaagcttcataatgtaatagattctttgctcttttatccataattgtatccccagcacctagaataagccctgatgcatagtaggtaccaaaaaatttgtgaataaattaatgaataaacacttggtgtatgcccttttttcagtaatgatacctatcatggaataatagaaaataaactagtccattgggaataattttatattttatttaactttataaaatgccaaaaagtacttatccctgcatgaaaccaaagtgttagagccagcaacactctaaaacaggtgttcacaaatccagtaacattttacatagaaaagtttatatattctaactggagtcacaagttcctcaaaaagacaggaaaatatttcaacagcaaaagttgcttttgaatgctgtttattctgtgaatgttacagatttggtttttgtataaattatcaacttctatatattatacagtgtacgtttctactacagaatgatgctttcaacttgtaaatgcaagaaaaatatgtggccatattttccattgctaatccaatgggattaatacaattgtgcatgtaagaatatttatgtcatacttaggagtaactgaaaaatattcttccatattagagtgaccgttgattttttgtttggagttcatcctactgaacttctaaactgtatttgacagtcttctatgaactctattcttttgatctcttgtgtttcaccattacgtctgacctcacatcctgccatgcatcttctcagcccatggctcactccaccacagccaccctggcctctgtctgttttgtatacaggccaagcacttcctccttttgtatgctgttccttctgcatgatatactcagataggtctttgcacaagtgtttcctcattagagtggatttctctgacctttctatcaaaaattgcacaccacatttttcccttcatcactccctaaattttctaagctttaatcttcatagcacctatcacttggcatataatttactgtttaactatttttttacctgatattatggactttcatttactggtgtgtacccagtgcatagaactctgcatataataattgttcaacacataatttaaaaattcatgaatccatgaaaatttccatacacatgtatcatggcacttgtgtagatagcatgtaagctagttttgatactttccacatagaatttgagctttataatcaacattaagagctcaattacttactagctgtatgacttgtaagctgtgtaatctcgaacagagaggtttttttgtttttcttttttgttgttttttttttaacttttaagttcagtgatacatgtgcaggtttgttacataggaacacgtgtgggggtttgttatatagattatttcatcacccaggaattaagcctagtatctgttagttatttttcctgatcttctccctcctcctaccctccaccctgtcataggccccagtgtgtgttgttcccctctatatgtccatgtgttctcatcatttagctcccacttgtaagtgagaacacgtgggatttggttttctgttcctgtgttagtttgctaaggataatggcccccagctccatccatgtccctgcaaaggaaaggatatcattttttgttatggctgcatagtattccatcatgtatatgtaccatattttctttatagagtctatcatttatggccatttttgttgatttcatgtcttttgaacaaagattttaccttcctgatgttcaccttttctcattcagaaaatgggatgaatagtttctactaaattgagttacgttactatgaaaaattgaaatactgtgtgcaaaatgcttaatataatgtcagacacaatagatatccaatgcttattagtagtctcttcttttttctgttagtctgctctttgcaaagacccttttaaaaatattttctgtctgcttaatcactccttaacttctaatatatagttgtaatatgttgattttatttgttttatcaacagataattctttttttcaattgagatggagtctcacgctgtcacccaggctgaagttcagtggcacgatctcggctcactgcaacctccacctcccgggttcaagtaattctcttgcctcagcctcctgagtagctgggattacaggcacgcaccaccacacccagctaatttttttatatttttggtagaggcggggtttcaccatgttggccaggctggtcttgaactcccgacctcaagtgatctgcccgcctcaacctcccacagtactggggttataggagtgagtcaacacacctggcctcaacaaataattcttgagcttctatttgtgcaaaacagatatactttctccccaactgagcttatagtctagtagaagagattgatattgaattaataattatagaaacaggccaggcaaggtggctcaaacctgtaatcccagcactttgggaggctgaggtgggcagattactttgaggttaggagttcaagatcagcctggccaacatggtgaaaccctgtctctactaaaaatataaaaattagctgggcatggtggcgtgtgcctgtaatcccagctactcgggagtctgaaacaggagaatcacttgaacctgggaggcagaggttgcagtgagccgagattgtgccagtgcactccagcctgggcaacacagcaagactctgtctcaaaaaaaaaaattatggaaataaaagatataaaactttggcaaatgataggatagaaaagtgccaagtactttgaaggagcacataaaacagaggagctttattttagattagggagtgaggaaagacttgtttgaagaagctctgtttaagtaaaaagatgagtagcgcgtctttagcaaagggtggtgtgtgaatcattcagaaaagaaatattacaaagactctgggcttgaaaaacagaatgaacaaaaaggagggtagtttggagcttagtgaatattgggagtagtggcttgagaggaggctggagaataacatgagccagatgatttaaagtcctgttcaatcacgttaaggatttgtgactttatcctaagtagcatgaaaagcaaagaagtatttgaacaggagaataacatgatctgatttatgttttaacaacatcagtctggctgttatgtgaagacacatatgcaggataaataggaaaatatagtcaccttatttatagctgagttcaaatgtcacctttttctatagcatcccttggctttctcttatcttttttaacactgcttccccatattttgttgttgttatctgtattgaaattaactgtgatatatcacttaatgttttatagccatgtgaatgtgcctgtctctttcaacatacttgtagcttcctaagcataggaattgaatactaattgttgttatatccctgttctcaaatatatgttcaatatgaaggaatttcatccctctaattttctacttgctattctaccaaaaaaatagtttagttataacataaaatctcttttacatctatctttggattcagtggtggggtcggttctaacatactttagcatttgaattaataatattgatctttatttctgtgttgaggaaaagctatgagagatcctttaacatgcatatttccagattcagtgttgttaaataatgctcaatgtatatagtttttctttgtttattttagctttttggatatttcctattgcttaaactacgtaagccatacagcctaaatttcagtgaacagggtttaatagccccttgagtttaataggtgtgtgtgtgtgtatgtgtgtgtgtgtgtgtgtgtgtgtgtgagatctcagtttttattattcattttcaaataatcattactattgtttagttttctggtaagatgttgggagcacacctatgtattgacggtaactatgttgatacttccattggaatgtcttattttcatcctaacaactgtaaggaagacattattttttctattttacgggtaaaaaatgtgagattcatagagatcaaatgtcttgccctgtattacacagctaagtaatagagacaggagcaggatttgagtctaggttgatctgacctaaagcttgtagtcatttcaatgactaattactgattattgtattgattataaaaactagccattagaataatgaaatgcaaagaactgtgtaattaagaagaagactgaagacttgcaaatctggagctttaaaaagtattcttaggtttcctaaatccaaggcccaaactgaactgactttggaactgccacccactgaaggcatgaaagaacttgtctgaacctaaaaggttcacctgacttccaaaacaaaaataaacaaacatcctaaagaggaagttaacatgatccagtgtactacaaggtaatattataaatgtccaggatacaatccaaaactactcaatatacaaaggaaaatctcaccgtttctcaaggacagacagttaacagatgccaatcccaagatgactaaaatgttgaaactatcaaagacttaaaagcacctttattatcatcttccatgaagtaaaggtaaatactttttaaatgaatagactgatagatctcagctaggaaataaaaagtatataaaaaaacaaaaaatgaaaaatccatcacctgaaatgaaatattcactggataacctcaatagtagaatgaagatgacagaggaaagagtaaatgattttgaagatagatgaacaaaattttataattgaagaaaagagagaaatcagattgagggaaaaattaacagagcttcaggcacctctgggataatatcacacaaaacgtctaagtttgaacactgaatcatcagaagaagaggagaaagaaattggtacagaaacattatttacagaaaaaatggttgaaaatgtatcaaattaggtggaagatgtcaagttagagactcaagaagctcagagatgacaaacagtataaatacaattatccaattaaggctaaatctagacacatcataattaatcttctgaaaaccaaggtaaagaaaaaatcttgaaagaaaatacaggaaaacacaatatgttacatataataggcaacaattcaaaagataacttttttatcatagttaaatggaggccagaaaaataattggcaacccagaattcagcattcagcaaaaatattctctagaaatgaaggcaaaattaaaacattctcaatgaagtattaagagaagtcttcactaatcaaaatgttatcaaagaaattccagacgacctctttcagatagaaggggaacaaaaacatagaacttgggactttaagaatgcagaagcgttctttgttttgttttgtttttcccacaacagtgcaaaggcaatgtagtggagaaatgataatcttttcagcaaatagtgcaggaacaattgaacatccatgtgcaaaaatcggaacttgacctgcactgcggaccatatacaaaacttaactccaaattgaccatagacttaaatacaaaatgtaacaccataaaacttctaggagaaaacataggagaaaaatcttggtgaccttgcttgttttgggcaaagagttattaaatacagtaccaaaagtctgatccataaaagaaaaaataattaaaaacattttttctgtgaaagactgttgagagaatgccacattccttcagactgggaaaaccatagactgggaaaaaatacttttaaaacttaacaatgagaaacaaatattgtaattaagaaaagcaacctaaatattttaacagatgcttcgttactgtaggcaaacagatcagtggttttcaagggttaacacctgagggaggatttaactagaaagtagccacatgagagagcttttcaggatgatggagctgtcctatatttttactggggtagtggttttatgactgtatgcatttgtcaagatttatacaattgtaagtcagaatgtgaattttactatatgtaaattttaaaatgttttaaaactttaaaaaaatacatggcctgggaaaggttttataggtgattattcagttgtcaacactagtatttgtcacagtctgcattatatatttattgtaaagatttccatcaaatattatttaattgttgttataaagataaataagttacagctcagattatctgttatttctgtgcaaacactattatgttggtcatagagtctcaagaccataaattggattagctttctctatagctatacctataaataggttaatttttactagatgtatttatatatgtgtgtgtatgtgtatatgtgtgttttatataatcctaaattaaatttaccattctctaataaagattatgaattattaagatgagaaaataaacttttcccagcaatttttatataatataaaatgtccaggttttacctagaaatgtgctctacactcaatgaattatagttgttacaagtatattgacagttattgagttagactaaacagtctaccaattgtgatctcagtaacaccgtgagatctaagatgactcacccatgcccaccaaacaaacatgcttaggaaataaatatatttacatcatagattatatttttaatggctataaagcctcacagaaggctatgttatagttttatgagagctatgtaaatgtacataacaggttcaaatgagaacatgtgttctttgatttcagtttgatattctacacttccaaaacaagagttcttaaactcactgtttcaataatttaaagtcaaaataataatttaaataaattagaatgaggattataagcacaaaataataacttaaagtgacataaggtaagcactaaaacaaagtaagcaatgactaggtggaactgtaaagtaaaaattatatgctttttcagcaaattctgggtttagaatattctcatgcagtctattcactttcacttcctggtcccactcctgtttcccttatcttcagaccttcaccgttgccatttatggtggatgtgcactgcaaccaccatactaaggcgtttatttaaatccagtttaatttgctcctagcccctccatggggctggttggtagaaaatgtaataccagttatttatagagccccaaacacatacacactccaggattaggtagaaattttaataattttactggtgtaaagccctgggattcttatttcactctggaatctaggagcgtgtttgatttcttcttaaaggtaggtctgtttctggccaaaatgctacattagtttctatactaaggcaaggagctgtggtacctagggcatggctatatggattcctgccatttcattaaaagtaaatgtaccctatcacttttatgacccctttcttatattaccttcctagccttggaattaactacttgaaccctgattacttcaatttcctcaccccaaagagccttcctgtccatcctcttcttctaggttagttcatctgctaacagttcttatatcttttgagaagataagggaattctcaggtctcctgaattcaagatcctgcttgttctgaaagggttggcataggatgaagtggaaattttgcttatttctctgatccatttggattccctggcttccctttctagaaccatcctaaaacatctatccgattcgaaggtactatataaccatggaacaattttttcttctcccttggatgtttgaacctctgacagttaactcatcatgttctagctaaatgattaattctaactgttctaatgaacagaaaacataaatctcactttaggtggaatcattgtgacttactgattgaataaataggaaagaatcaggaatgttgctgtcatccttcattgggtgaatggtggtgccactcttggaactgacaaatgcagaaggaactggtatacaaaggaatatgattatgttgagtttgccttgcctgtggcatgttctagtggaaatgtctaccaggaagttgaaaatagaaatagctccatgtgacatgaggtcactacttgtgcatgtgataaccttctcaaacatatccaaaacatatttctcttatggccaacaaatttcatctctcccattttcccagtgaagggcatctaggaaacatccttgatttacttctttccttcagccctttctctgcctatacaacccatatacacaaatagtctatcagcaagtccaacaacacatgtagagtatatgctttcttcttccaagcactgaaaatagtttgaagatgggttcttccagggctgtgtcttgctgggtgggttcaccaaggcaaaagaacaaggtaaatattgagacacaagtaaggaagtggttaaaataatagagtgtacttaatctgagatagttaaagaaggtaagtaaagaaagaaggggattgatgagcagaaaattaagaagttaaggaaacaagcatcagtgttttaaaaggatgggacattgtaggatgtttgaatttaagattcagaaatacagcaattaatacaagattgacaactccaaaatgttgtcatgaaagtgattaagggggattgaagatcatggtaatcaggagattatgaaactaaaaggatggaatcttttgttgatttacccaagataaatccaggaaaggaagattgtcagcatcttctaaaagtcttcagtagataagtgaaatggcctgtgaggctgacagataatcccaaatgaggagaggtataagatggtattgcctgatttaacaggagccttaaaagaatcccatctcaaagttcatcttccttaaaacaaaatataatgcaggtgcaaagggagaggagttgaaaatacattacggaataacagagctttaaaagccagtcaaaattctttgaccctgatagaactctaatacaggtcacattggtaagagtaactatttaaaagcacttagtgatgtagatcaataatgattggatgggtcagcaccaaaaatgtctgttatttgacatgaaggaaattaggcagaaacctctatgagccagttcattgccgtcatcatttctgatgcattttttctaaaatatgtagatttttacaaattaagataattagtaagtcagaagtacgatactttgtaaaatgcctaatacatagattagaattacatgaaacaacaaataatgataatgaagaaaatcagcatgtaaatgtaaaataactctcacaaatattaaactactttttcagcaacagaaaagtcattagttttaaaataaaaattagtttttggattccctacattaatgaaactgctccttggcttacaaatggcatgacatttaaaatttttgacccattcgcaacaaacatctgtagttaaagtgaggctatcacagtctcttagtctataacttagctgcttattaaaatatacatctaccaaaccaaaaaatgtttttcaaaaagtaacatctggaatcttgtcagattctaaggcatttttgttgaaatcattgaagatggaacattattaggctagtgagataaatttcttgacacttgctgcgatttttgttttagaagcttgctttttggtttagatatttttatttatatatcatcacattttctaaaacaaaatgttctactcaaaaaatgtttggaaaattatgtaaatatatgttaaaaaggtttagaaatttgaattctgaccgcctttttctctgtaaatatcctttttttataacaacatatatttttgtttttcataagtgaagagtaaattggtttacagtgatattgttctatattatatgcacactcaaattgtatgcattagattgtggagcattttctgatatttgtgctcacaagtaggttagtgtcatttgtcagtaataaggcttgcctgtgtagttggaaagtgccattgccctagagtgctgtattttgaagtcatctgtcatggatacattgtagagagagaagactatttatgtttatggcattttaagtaactgagttaaaaaccctttggaatatagagaagtggcttgtttactgtcatcactgttcacttaatcctacgaccttgacatgatagcattcccataaatctccctgtgggtagatcaataaaacagatgaacatcaaaatgtaatgattgtttcagctttaggaattaactatgtaatggaataaatataagccagtaagcagtattacagaaacattctattataccaacccctttttctaacagataacacttactagaacataaggagttattatatattatattttctgataatgtttgcagtatctaacagattattatatattaaaaaaagaaaatagatacaagtaatatgcatattatgactggatttttaaatagcagtttaaaatttttggtatacctatgattataaaaataatgaagttagggttttttttgcaatgatgttttaatatagctttattttacattgtgtttttattgtattatatctccattgttaattttctctagttcattcattttaattttataattataattcctcaaacataaatttttaactacagtacgttcctctttcccccaatgtaagcagctactcaggtattcaggaaaaaaaaaactgaggaaattggaaaactgaaaaaataattaacacatcacactaggaaaaattaatggatgaaacttaagggaattaacactcagtcctcactatactatattccagagtccatgtccacacacaataggaaaataaaacttagattcaacagcctctgaaaaagtaaatactatgagtactcccattgcttacataatagatctgtaagataaaattattttaaagcaagttacatttgcctcttaccaattttcatatgtaacaaaaaaatggcaatttagtttggtgtagtaagaatctctattctttttgaacgatattttgtactttgcatgataatgatacattctaaatactaaaagtatgctatataatgtgaaatctgtgaaaaatcatagaatttatgctttatataaagattattatagaattattattatagaattatgtctaacataactgtaaagaccgttataagcatttttagtagctacttaggtagaaacctaacaaaatgagggttttgaagcctgtcagtaaagaaaaacaatattactatgatgtataagtccgcagaaaaaaagatggtagaagtatctttactaatttaatcttagaccattaacatcttccatgaagataaggtggatatgtgtcagtaaataaatggtcaactattttactttatgtttagacaattgagccccaggaatattttcttctattttaacaggctttcaagttgatataagtcctaaaaatttgattcgtaatttttctagaagttacaaattgtaatatctccttgtgcatactgttagaagctgttgttgttgttttttttttttccaactggtgttcttttctattaccattattcagtaagtagttaccaaattgtagtcaaacactctattgataaagataccattcagagctagggaatagagtattacacaaatagaatttttatgcctgttttgagtcttaacataagtctaaaaaattaaatacatctggcttttggatgaagaaagacttttgaagtctaggcagtaaaatatgccaaatataaactatcacactggcatttttacaggttgtaaactagacttatccaactgaataagctaagtgttcttatgacactttaatacacattactaagcagtaagttaacatgcatacgaagtggacaactaacaaaataccttgttaactgatttaggatcagtaattaagtccgcaataactgatggattgttaaaattttcacctttcattaaatttgatgtgttatgggcagagttatgtgaatatcggttccaagtattaatgcttccaggggcacttaagcgaagaggattttgtaattattttcttgaaaagaatcctatctgttgatacctactttagtttaaagtaaaatatataaatcaattactactatgtaattcgttatcttatataggtcctttcaatctatattaataataaagctttcttcccaggtaaattccagctatttctaatttactatcactcacattattttacattaaacttcaactgtggtcaacccaaatttgatcaataaaatagtaatcatcttataaagaaacctaaatatactcctgtctcagcctttttgtgactggtctgtgctattctgattttggtgtataatacaggacataaaggaataaaatacctgtcagatttgtcacttttcattgtttgaatttcttctctatctctattctgtcccacttgagatcatgccaataaaatattttttattttgaaattgcaatctcatccatcttcacacaatcaaaaattatttgtttttatttcatttattataaatatctttactattattgatactactattgttcgtttgttacttcttgaaacaatctatactccagatattttaagtggctgtctgaacgatttttaacatttaacaagactattatttttaatacacagtacctgccacttaggcttgaagattaaaaacatgcaaatgtaagtaggtgttagttattattatgtcattccttgttacgtatttaccaaatgaggcaatttgttaatgatataaaaatattaaaatatctaaattatacctaaaatctaatatatattaactcagttcagtatatttttttctttcagatgctaaggttagaaagtgtggctaacaagaatcctctattctagcctctgaccaattaacaaatacaaccaaaccatctaaggcacacatcagtgctccgaagtgtttgcctgcattttcttgtagtcattttatagctttgggttttaacatttaggcctttaatacatctttagttcctttttttatatagtgagagataggagtccggtttcatgctgcagatggatattctgttgtgccagcaccattttttttttttttttttgaagagagtgtgtgtttgtgacactgtttttgaaaatcagttggctgtaagtacatggatttgtttctgggtttcctattctgttccattggtctatgcatctgtttttataccaataccatgctcttttgaagttaggtagtgtgatgcctgcagctttgtcctttttctgtaggatttgcttaatctattcaagctcttttagggttccatatgaattttaggactttttgtctattgctgtgaaaaatgacattggtgttttgatagggattgctttgaatctgtagattgctttgaataatatgatgatattaacaatgttaattttttcaatcagtgagcattggatgtctttccctctggttatattttattcagttttgttcatcaatgttttgtagttttccttatagaggttgttcacctctttggttacattgtgaataggattaccttcttgagtttttactcagctagttcatcattcctgtatataaacactactgattttttatgttgattttatagcctgcaactttactgaatttatcagatcgaagaggtttttggtggagtctttaggtttttctagatataagattatgtcatctgtaaagaaggatggtttgatttcttcttttcgaatttggatgcccattactttttctcttgcctgattgctctgttcaggacttccagtactgtgttgagtagaagtgatgaaaatagtcatccttgtcttgttgagacttattttgtgtcataacatatagtcagtcttggagaatgttccatgtactgatcaagaagaatgcatattccatagctattggatgaaatattctataaatgtctgttagacccatttggtctaaaatacagtttaaattcaattttttgttgttgttgttaattttctgtctagatgatctaacactgatgtagggtgttgaaattcctaactgttactcaactggagtctatcgctccctttagatagaataatttaataatagttgctttatatatctaggtgctcctgtgctgagtgcatatatgtttagaattgttattttctcttgctgagttggtccctttatcataatgaccttctttgtcttttgtttttattgcttttgacttaaagtctgttttatctgatataagtatggctactcctgcttatttttggttttcctttacatggaatattgtttcccattcctttatttttagtctgtatgtgtctttgcagatgagatgagattcctgtaagcagcatatagttgagtcatgtttttaaaccattcagccaatatatatattttaagtggaatgtgtaatctgtttacattcaaggttgttattgatacatgaggacttatttctgtcattatattaatgtacttttggttgttttgtatatcctttgttcctttctctcttttattgtttatcattgtggtttggtggtattctatagtggtaacatttgagttctttctctttcttatttgtgtgtttagtctaccagtggattttatactttcaggtattttcatgattggagatagcattcttttgcttccaagtataggactcccttaagtatttcttgtgaagctggtctagaggtgatgaatttcctcagcttttgcttgtctgggaaagactttatttctcctccatttataaagaataactttgctgggtaaagtgtcctcagttggcagttttttttttctttgaatatgacatctcattctccactagcctataatgttcatgctgagaaatcccttactagtctgattggggtttccatataagtagttagatgtttttcttttgctgttttttgaattctttctttgtctttaacttttgacaattggactttaatgtgccttggagaagaccttttgaaattgtatctctttagggatctctgagcttcctgtatcaggatgtctaaatcacttactagacttgggaaatatccagctattattttcttaaataggttttctgtctcttttgttttcctgtcatcttcagtgacactaaaaattcaaatatttagtagctttgtgatgtgtgttgtgttatgaggactttgtttattatattcttttttctttattattttcttactgggttatttcaaaatatctttcttcaggttctgaaattctttcttctgcttgagctggtctattgttgaagctttctaatgtattttttatttcattccatgaattcttcagtttcaggattcctgtttgtttgtttgttatgatacctctttagtaaatttctcattcatattctgaattggttttgtgatttatttgtattatctgaattctctcatatcttactgagtttcttgaatatcattttgaattctttctctaggatttcataaatttctttttctttggaatttcctgctagaccataattttgtttctttggagatgtcgtatttgcttgctttcttcatggttcctatatccttatgttgatatctgcacatctggtataattgatgctacttctaattttttgaatttgcttttgcagtggaggatacttttatgaagatatgtctgtggtgtttgttgggtagggcactttggcctgattctgggtgcatgcagtagtgtactctctatataatttcttaagctttaaacagcatcagttgtatccatgatttcctcagcagcttagggtgtagttgtttgtggaggctgtagtaaagttttgttggagatagagatgccaggtgggccagtcctttgggctctgtggtggcaatggtgggccaagtctgcctgtctttggacccctatctggcataggctagtaccagttgtagcaagtccaggcataccaatttttgagtttccaggtggctttcttgggtgccagcagtggcagcagagggccaggtgggtagatgggcagattggctggtctttggttccctgggcagtgggcgtggtatgagtgatggtaataataatggcaggacaaccctccggctcccaagttgtctatgctagcattggcggtggctgtgacaggctgggtaggcctgtcccaggcctgcagatggtatattggaatgggtgctagctgtggtggtagtggcaaattgggtgggcccatccttaggcccccatgggaagtactcaggtggcaacagtggtggacagggcagagtgatctccaggcctccagagagtgtccttgggcactggggagggcagatccaggccagcaggacctgtcctcaagtatcctggtgatacatgcatatgctggctgaggtagacagggaggggtttttccgcagccccccagtgaattgcttggatagggatagcaacaactgcactgtggcctttctgctggggagggagtggttgctttcaatgtgcagcacccataagcagggagctggggagtgtgcacttcagcccaggtagcagcttcgtgtggtggtgtctatccttagcacacataaaaatgtgcagtggcaccatttctgggggcagtggggatgctaccagtggcttgtgcttcaactctgttggcagcagccaacagcatggcagctgtgggtgagggatgtcagtggaagcccaaggatgtagagatgcaggggctgttgggccacagggcaggatgtagtctaatggagactgggctctcaaaatggtgccttgatgtagctgcttaggcctcaggggtatgtgggatcagtttgagctccttttctctggcagtgtaatcacattgtttctaggcagcttcttgttttattatcagagcctccaagggccaagggactcgcctgaatctaggactgcaggagtccatggtgggaatgtgagccactgggggtctctcacccttttcccatactgggaagcctttccaggctcccagctgatctcagctgagtgggctgcctcacatccctctccttccttgccttaggtgtttcctgtcacctctctattgaattccagtgttctctcttagatgatctgttggaagtgtgattatctacctgctattttggttcttctttgtggagggggcaagtaccagatgcctctagtcagccatgttaaagccccacataacacatattttaatgttatatgtgttatatactgtattcttacaagaaagtaagttacagaaaatgtaatgttattaaggaagtaatggccaggcacggtggcttacacctgtaatcccagcactttgggagatcgaggcaggcaattgcttgagtccaggagtttgagaccagcctgggtgacaggacaaaaccccatctctataaaaaatacaaaaattagccgggcatggtggtgcatgcctgtagtcccagctattcaggaggctgaggtgggaggatcacttgagcccaggaggaagaggttgcagtgagatgtgatggcgccactgcactccagcctgggtgacagagggagacactgtctcaaaaataataataataataataataacaaaaacctaagaaagagaaaatatatttattacaaattaagtggaagtggatcatcataaaggtcttaatttgtatcatcttcatgttgagtaggctgaggaggaggaagaagcaaaggggttggtcttgctgtctcaggggtcttttttgcagaggtggaagaaaacccatgtataagtgaatatgaacagttcaaacccatgttattccagagttaactctacttgaatatcttagttattgtagcctccttcatcagtgatctgagctagatcttctgaataacttgctgcagcttctacgtcagcacttgtttgttttacctttatggtatggaagcagcctttgacatgccttcctcactaaacttaatcatttctagcttttgactttaaatgaaagacaccactttttttcactggaacagttagatgccattagttggggttattaattggcctgatttcagtattttttgcctcaggtaatggggaggcccaagaagaaggagaaacaaggcgaacagctggttctggagcaatcagaacacacattcattggttgagttcacagttagatatgggcaacattcatggcaccccaaaacaattacagtagtagcatcaaagatcactaatcacagattaccataacagatattttagaaagttttaaatattggaagaattacgaaaatgtgacccagagacattaaatgagcacgtggcaccaagagagttgcttgatacagggttgtcacagactttaaatttggaaaaatacagttatctgtgaagtataataaagctaagtgcagtagaacaaggtgtgttgtacctcataggtttgtggagcatatgttagaaaacaaaatcctgcagttttatgaaatttgtattaaataaatggatatttcaaattggtaataaatttaaaaggaaacctaaataataacatcaacacttactgtcttatttttctagtttaaatatatacagtattatatttaatcatcagaatagtcaccagcatatttcaaactaataaaatttacacaagtttaaaagtatctttactgttctgatttttaaccatttacttacggttttcctttatttttctcactgttataacagtgagaaatttatcaatgcattgtacttttacaaatacacaggaatgcatgctagactatttactagaaataactttcctaaataaaactgtgtcagagcattgttcatttgtaaatgttttccaagagaaacaataccaacttcaataccataaggcagaaattcacctttggctttaaaattcactggcagtatttttttatttattaaaattagaatgtgcataagactgcttttcatctctcagtatttaattataattagtcactttcgcactgctttccttcctttcaaagcagtacacacacaacttttgaacgcttctactagttttcgtgtttatttgctcaattaaaatcaagatttaaaattcatggtagacattcatttcttttggtatttaagtgaagcctaaaacatctattttattcaagaacttttagccacgccgtctcaacgtaaggtcatctcatacatcatattcgtgtgctccattttcaacaactttttgatacattggtaaaatgaaatttaagaaggtaacaatgtttttctgatttcaaaagggggaaatcttagaaaatctcctacttattcaaaaaataatattatatcaatcctcaatttttgactctggtttttccccttccaccttaactgaattatgattaaacatacatatttacagattttattctttacttccactacataaaagacttgcaactattttttatgtaatacagagaaagggacatgcatgattatgtcatagttttgcaaaaatccagcaaggtgacaagttaacttgtgtttctagaaaccatacatgaaatcatagcatttgtgatgctgaaatttattgtaaatgacagacatttgtctttgcagcagaacaacaagtgatcttaaatataatgagtcagaaatattagggaatttattaaaacattagacgtaatttctcagttactttctaaaattcatagttacctgaattaatatgactgttatttacagttaatagataaattgtttctacctaaatatttgaaatgtaatgcctttgtgttaaatattttctcctcagaagtatttatgaggggaaattgtctaggatacagttgtcagggactaattggataccctataaaacaaaagacttcattttatatatttattattattattctttacttttgcttttggtcaagaaggcaattggaaaagaacaaggacctgttatttccatgatctaaaggtttttactgcaacaactgagcagctcacttttattcaatgctacattaacttttccattacgggtgctgttgtcaagtacagagcctttgcacattatgaagttgctgtctggtatttgttcattgatatgatttccttatttgaatgtttcaagtaattctggagtgaaagccttcatcactttttaagattgttgtctctttcattttaaatttagttaaatttaattgcactgctatagtttaagggtctgtaaatgttttcataagcctgaattctctcattttttcttacttagaactactgtcacttaaactaaaatataattatagtgttactattattcataaaatctagtgttcagtgacaactcttatttcagcaagaaagagaaatactttggtgtcatgatgcccctttattcatttttcttcttttgcttcttttcattcgttctataaattattccagttgtctacaattgctcaagagccaaggaatattctctaggaggccggagtcttagggtgaaactgataggaggaggaataggattcccccattctggattagactgtgaggtgattagtctagaatggaggaggtggttagactgttgaaggagaaggagatttagagtagtagagtgtttaggaaaaggggttttgaagttgtgggcacatgctgtaatacagggaggctgcagaaaagtttctgtaagcctgcctccggttgaccatgtggtaccccactgagcagactggtgaacttacctattgagaggccctgtcccacattcctagcaaattttcagacctccttccatactggtaaaaggataaattctgtggtgatgaaaagcctattatagttacataccctttgttttcatgattccttgaagagctaagacatagagaaatagatcattaaaatgaagtttgtgttctgcaatattttatttgatgataggttggttagttttaaaattttgaccaaaataaaaaaagtgaagagaagaaacagatgtctccaccaactgtgggagtaagctacagtggtggcagtgtgattgatgttcatcaaaaacagtattaatctaataaacagcaaggagcagcagcagcaatggtgaaacacagggctgggaaggaagctaatttgaacactgtctagggattgcaaagggagatgtggcagaatacagttccctgccaatgaaggactacatagtcaatttaggttgaactgttgaggctggccatgagaaggaactatcctttggagattagggtctgatgggatatccctttcttgtatagcaataatcttgattcactgtagtttgatagttaatgtctcccaaatacttaatgcttccaaacttttactgctgaaacatgtcattgtcttaaagcagcaaggtgctatctcttattccataaccttgttaagtttacctgttccattgaataagcctctagctcagatctcagtgattggtacctatctatccctgatatttagccttccagttccctctaattttaaattgctttctcagcccactgttttaccataccttaacatcttggaagcatttgactcttgccttccagtaacttcaccataaattatgatactttctaccagtgtagtcctatctttgtgacccctgttatccctgtctctcatttctccaatcaaaacaaatagaccataaacatatacacaggtacataagcttactccctgcctgaaacaaaaacactgatttgtgtcttttcattgaagtttcttatttattattttgatctttatgagctcttcagtaattactttaagacagcagctcaaaatagagccctgtcttagtatttttacaaataaattatagttattctgattacaatatagctttaggaatggaagaacaaaataaaatgttatcatcaaatattactgtcttggggagaaacaggaatacttacgtgtatgtatgtgtttgtgtgtatccaggaataggcccatagaaataaagtctgtttttgcttcattcttcctcacatttcaaatatctttgcttctagaaatctctttggcccagctggctggcctggcctctgaagacaaacaccctgtctgtgcctcacaaaaataagtctattttgctagtagattctaagagacagagaaaaattcataactcaggaatgaacacctgtggtcaaatttcagaaaataaaataggtcattcaaaacatattttggttttgtcctggtatctttaaggtatatcatgacattggctggccacttagccactgcttataaagttagccttatactttatttttatttgttggtaaagaatccaagttagagccttttaggtcttgggtaagtgttattttacaagtaaatcaagttgatggatttgaatttcaaatacacgttgaaatggactatagatcaccacaggatatttaaaaaggcaaagaggcatgactgatttttttcctttatattaaagtatacatacatacagaagagtacatatgtcataattgaacagctccatgaattttcaaaaactgaaggcacctatgcacttaccacactagatgaagacacagacaattaccaacaccctatatgagcccttcttgtattcctcaccctgctaaggtaactgctatcctaaattctaagagcatttatttattttgtttacccttacatttataaatgtagatggaatcatatagtataaacgtttttgtctagtatcttttgcccaatattacatttgtgacattcattgatattatttcatacagtttattctcattgctatatagtagtccattgtgttaatgtaactgaatatatttattgtacagattttaactattatgaataatgttgctctgaacattctggtacatatttgtttttttttttatgaatagagttctgttgagcatatacctaggattggaattgctgagtcatagtgtagacttgtgtttaactttactgctgaacagttttccaaagtattcagttgctctgcattctctcctatactttacattttctgtgattttcattttagctatttaggtgggagtatgatgtattgccttatagtgttagtgcattttcctgaggttgagtgcctttcatcatggccaaaaaaggtcacttccctatcttcttttgtcaaatgtttatataagcctttggtccattgttctattggattgtctttttattcttactgatttgtaagaattcagtatatattttggatctgaggcatttgtttgatatatatattgcaaatatcctactctgggttgccttttgctttcttatttttagttcttctaatctatcattttatcttttatgattagtgatttctgttttttgtttaaagcatctttgcctagtgtggcatcacaaagatgttctcttaggttttcttccaaaagctttcttgctttgatttttactttcagatttgaaaaccatttggaattgtatatggcatgaggcagaagtcaggattactttttttttttttgcatggatattcagtcaaagtgttatttattgaaaagaccatactttttcttactgtagttaagatgtttgtttctggactctctctacagttcttttggtcagtttgtctatttttagaccaatctcacactgtcttaattaccatatctctataaatagatctttatacctggtagtgtaagccctttagctttgtggttctcacaaattgacttggctattcttggcctttgcattttcatattaattttttgaatcagcatgccaatttctgcaaataagtgttaggattttgattgggattgcattgaaggtagagaacaagttggagggaagtgacacctttgcacttttgatatgcaaatggcatcatttattgatatatgcctttctgtataggtcatctgtgatttctcttggtaatactttgtagttttggccgggcacggtggctcacacctgtaatcccagcactttggaaggctgaggcaggtgaatcacctgaggtcaggagctcaagaccagcctcgccaacatggtgaaaccctatccctactacaaatacaaaaattagcctggtgtgatggtgggcatctgtgatcccagctactctggaggctgagacaggagaatcacttgaacttgggaggccgaggctgcagtgagccaagatcacgccactgcactccagcctgggcaagacagagtgagactcttgtctcaaaaaatataataataataataataatttgtagttttcagtgtggaggtgttacagatatttcatcagatttatttgtaggtgttagatattttttgaagctgctgtaaaaaatatcatttttaaaatttgactatgaacttgagactgataaagaatttgttttcctgcatatacttttatctaataaccttgccaaatttgcttactagttataatagtttgtacattttatttgattttatatattttattagattatgagcacagtcatttgcaaatgctgtcagttttctttttcagtttgtgtagctttgatttgtttttctactttctgtaatgactgcggtctccagtacactgcagtatgataatgagaatccttgtcttgcttctaatgacagagaaagttttaaatattttgccacaattgtgatattagtcataggttgtttgtttcgttttgcttttttatagatactttttaccaaattaatgaaatttccttcctgtcctatttgttaaaagtttttatcctaaattggtatagaattttttaatatgctttttctttatcataattgccatatgatttttctttttttctacgaatggtagtgattgaattgaatgtggttataatattaagctatcaaaaggtaattattaaactctataatgacttttcagactgtaaacttcttgacagtttaagtacctaccctctggcaatgtttttggtacctaagtagtagtttttgttagctaactggtagttcaattaatatgtcatttgggggaatatatactttctttcatccaaattagtgccattaaacaactattctgtaatatgtcacagcagactactatgctgtacactttgtaaaatggaaagatatataagaatcagtcccagcctcaatgagctatagtctcatttgtgagagcataccaattcttaggtaattataatattaatacaaagcaatatttagtaatatttgagtgaggcattaactaacctgtatgctttataaagacatacatgaatatccagacttctattcccgagtagcatgggatgaaaccgccaggcttctttgagaaacattaagttatttaaaataaagtatgagagcaatagtagttgaagataagactgcaactctactgcaaagtagagtccaaattcaatcaaggaggatcttgaatgcccagctaaagattagacctggttctacctggttctgtaagcaactcaattttacaaataaggaaatatatcttgagaggtcctgacctgcctttggtgataataaatcagaactgggagttcataataaaaagaaggtaatcaccttaatccttaatgaaattcttcaccttcaccaaaccagtttatgtgactgattattataccggtgttgctttatactcataaaaataatttgtttattgtccatttttaattatcttcttctatttctaattatatttcttagttgtaaaactaaattgatgaagaatggaaaacaacaattattctctagccatgacagatataataggcattcatgtcatatgatactaaatgttataatgaggtcacagggcactggagaaaaggaaacaagccatatagtacctctgagtgatgaatgtgaggggaaacatcttatatagggcactagccaggatatttatcatttagtactgaaaacctgatgacatgataacaaggattttctatggtagtcatgatagcagaatcccatagactctcttcatgatgtctttatccctttagcccagcacttgcttaaacaagaggcaaatggccacagatttcatttgaaatgataaaaatacctttatcatttcctttttggctgttgttttagttatcttaatattcagaacaaataatgtaattctattttatttaacatatacttaagcaccagaaggctagcctttgtagttggaaggaaggtaaaaggagaaacacaagccatatagatgagaaactcattaacagttttgttgttttggggagtatactgcatttggagtagtaaatgctgtcttttagaaaacattaattgcacataacaattatcaataaataattgtgaaatgaattaatgcaaaaagggagtgaattgttatcatttctacataagcctatatgcacagtgttaatctcttctcattcacttgttttttaaatcacaactttttaataggtttacattttccaaaaagtgtatttatattattcactttaatagtaaaaatgcctgtattttgcaacatgataaaaaatttcataagctaatttgaactaaaagtggttaatttggtagcaagggaaactttagttcatcttaagcccctagtttagacttttatgggctgtatttcaaattcaaacttttgctacaaacaaaggaagagtaatcattctggtgtgaacagtgccactgaaggacataattctctcataccatctgtctttatataacctttagaccagcaggcactaattgataatacagttgcttttccctctgtccttaaatgcattaatactggccagatacacatctcactatacactgattatacataccagtaccttatagatttgaggaaatttgaattgtaagagaattcatggaagagaaatttagacataggctttagtggaggtaaatcatcaaaactgcccatctagaaagactccgaatttggtaagttaggtgacctcaaactgagggaggttagatgacttggtagaatttttaagagcattcagaattgagaatagaaggacgtatattatctaaagtcagaaaataaaataatatcagccaggaccaagatatgcctaatcaatatattaactgtcaatagcattatttaagggggagagtgaacagatggaatagggattgttcatgtaacatagttcagtctaattcagagagctatagggttttgcatacccaggggaatgattgtcaatgtgtagctggaaataatgcttttaagtgaacttttagatcaactcaaggcagagataatccaaaatacagcttttagattgagaagaaaagcaatgagagaccattgtgggtgagagggtcaggcatagccaagcgatgtgactggtcctcgtgcaggcatcctcctagcccagagacaacagtcactacacaggatctattggacgtagctgtactgctgagaaagacatggaaggatatagtatataatacagaagttaggaaaatgaacaataactaaaattattcatgaaatttgacctcgatgacaggaataatgttggtaaaatttttatcagtatttttaaagacaaggaaaagaatttcaggaaaaaatacaaatttgtgtgtatgagcatgtttaaacatatttttatgtttaaggtaaatgtatagtttcttctatgtttggcatagtgatgaaaaagccaagcagataggtattggcatatgactggctggccaaaagagagtcaatctggaaagatgaatccagtatagaggcacaagtgatttctagaactaattgaaagaaaaattgaaaaggaaagagattctaataccaaggcccagtcacacccatactgagtgaggtagcatgcggaagtcactaagacaccaaggaaaaggttagaaaactggaagaaaaacatgaacaacatgaatattaattttcagatgctaatattatatcagtgttctgttactgaatcagttgtaatgttctaaagagtatttacttatcctaagcttttatacctaaatggattctctctacctttagtaaaaattgctaaccagtaaattacatctctgagacattaagtagaacctttgaagtatgtgagagtaatacatctccaaaagtacgttatatgtaatcagaggagtgattatttcttcagtggattaaagccttctcttgtcaaagctgtcttacttaggcttttctacaaagcagtttttaaaatgcatcccatcagcatctagaaccttgaataatcttttttttttttttttttttttgagagggagtctcgctctgtcatccaggctggagtgcagtggtgcgatcttggctcactgcaacctccgcctcccaggttcaggcgattcttgtgcttctgcctcctgagtagctagaattacaagcacctgccatcatgccgggctaatttttctatttgttgtagagacggggtttcaccatgttggccaagctggtcttgaactcctgacctctggtgatccacccacctcggcctcccaaagtggtaggattataggcgtgagccaccgcgcccggcctgttttttaattacttattttcaatcatcttcattttgcaagtggactactttttctggaaagattatgatattgcaccattcccattgttaattacaagttcagctgaggatcaccaaacaggattcagtctgaaaatattatctactttttgatgttacctttctctttcgaaagtatactcctgctactgttggctcagatgtcctgtgttttaaacactgcatttatagtattacattttttccttctactggtgatagttttattcttcaagtaaatcttttttagtctctgctgcattaaaattttaataagttctaaaatagttcagcttttttagacttcagtaagttaaggttggcttgagtttctgtatgtattacttgtagagtactttgttttgattattctatgaggtaaaggttttaaaatttttgttttaaaattacagttttttataattagttttttgccttgcttttttctttttaagcattttgcttccacctggttgaacaatataaatcatacatttctcaatttacaacattaagaaattaatattttattttatttaacatactagttgggccaggaatggtggcacatgcctgtaattccaaagctttgggagtgcagagtggacaatcactggaagccagaagttctaaaccagcctgggcaacatagcaaggcccttgtctctgcaaaaaataaaatgaaaattagtcaggtgtggtggtgtgttcctgtagtaccagctacttgggaggctgatgcaggagacttgcctgggcccaggagtacgaggctgcagtgagccatgatcacatcgctgcactccagcctaggtgacaaagaaagatcctgtctctaaaaataataataaaaaaataaaaataaaacatgttaactggaaatgttttgtctttggtatgtgcctaatgcaataaaatctctattgctgttctctgtttcatactgactgaacagggattggctttatataaggctcaccacagtgccatgcacatgtggaaggtggagcttaataaataacatttaccatcactgatttacattgtttccccatcccatccattttcttgtaatgttttatataatttcctagagagattcacagtaaatataatggtatttcaggtaattacattaatgtgccaggttttaattaaaatacacattttctgaatatataatagaaaacctacaatgtttataaatagataaaataaatatgttaaaaataaaatatataatttgaagttgaatgctgtcaatttggaagatttttttaaaggccatgattattccataactgtttattttctctagattcttaatggtactcacaattaaatactaatagtgtggcaacaaatacttacactttgtttgcaaaatatattgatgttctactttaaactctccagtacattatggatgacttgagcaaaattcctattaacagaattttcatccgtacatttgtgaattaagaaacaattaagtgttctctgtccccaaaatatttctactacatagtctgaaattcttgcaaaatgctttattaatgcttaatgccacttttagctgttagttaacaaatggaggtactttgtatgttacataataattcactgactctaaaatttttctctttttaattctaaatatttacaatagctcattataaaataactataggcttatctaatcctgtaagataatgttgacctagttaaaaattgagaacaggcaaaatgaaaaagtaatagttatttcccaaagtattttttaaaattcaatgttttggttaactagatttaacaattagtttgtaaccatgattgaccatcaaggcaaacaaacctgaatttcatttgatcattttattttctaaacctctgtttaaaaatatattgagttttttatggttgttgataaatgtggctgccctaagcttatagcagaagatcaatgttttaaaaattgaaacagtataggtttgtattgattaatgtggctaaatcaaaacgagaggttttgtaacagctttcttagacaggctgctccccagtaatggcaacctatcaattttagctttccactgataaatcagcttgaaaattggatgtcaaaatttttttcactgaagtagtgattttttcatgccctttaaccttttctgatatattagattggtttataagactaagctctatcttatagaaagtagttgtcaaattgacatttggatagatttttaaatgattgtaacaactatttttatccctgtatataaaatacctgtgtgtataatcatatatattctacctccctaactagaaggattgtttatcatgagaaaaattcaatttcgcattacaaaattatagatgtgctgtttatgggtcttggatattcaaagaaggtcagagcctcaactggaaggttaagacacatggttccagaagtattttagttttcattgagtagggacattgattttttttccttgcgaattgattttttttccctttttttctttttatttccttgaaaattactaatggattaattaatggcacctattctatgttgttatatggtcaatagtaacttgatatgctttattaccaaaaacaacgaaaacaaaaaactgacaacactttcttatttatcaggaaccagtattgaggatttgaaataacactagaaaagatttgattaacagcacaggaaaacaggcttaatttggatttaatggggtagacttcagtgacagctgacagtaccataccttcatgcctacatagccgactttaagttagcctgaaaaggtattgattgtgaagttcctgttgtataattactttttgctaggaaaaaaaaatgcatggtgtattgatctagatgggagcatttgagtagcagtttcccttggctaacagtgagtgtcatctttcagccatgataaatggtaacgctctggctcagcataattactttgtggtgaaatgaacctcctatccccttcgccttttccctgcaaggagatatagtaatcatcatcgtctgaaagccatgatttactgaactaatcatcctcttaatagaggaaaatctttccccccagagtgtgtccagtttttgctaactgaaacagaaatgcattatgaaatgatagaatttttttaaatttccgaatccacaaatacacatctttttaatcaactatcaattattcctgacctatgcttctcccctctgtctattccctacctactaggtaacctttgatcttaacatcgaatataaataaaaagagaaaagagagatggccaaatcttatgtactcattttgacgataggtggaataattatgtaaagaaatttattacatttggcaaaaataggaatttatttagttaaaatatgtcttggaaagccttctgggtgtaacactttttcatacaatttttagtgttaagcaacattattattttttagtttctgtgatggttctctacattaagaggcaaataagatgcctttaatgtggaaaccatacattccccccaattctaaaaaactaagataatttatattgtatgctagcttttttgacaaagatatttaatatgttatctattttttattaagcctgtgttatattttgctgaaaatagatctgtatttacttgccagtactttaatatttcccctgggtaatgacttttagttaagtaatgttatttaaagaatatctggcagtcattttagatcattttaagactgctgtgaagggtttggataaaggtcattttcagtgattgtgcttagttaaataaatgtgaaaggtttcacaaagggaatcttgcttttcagtgtgctgtcataaatttcctcttagcacatctgggaataccaagtaaaatgtagttgtttctgccttgaaggcattatattttatattttccttctctttgtttattttctcctcataattctatttattcccacaactgagcacagaggtttcattttgtcataaattagatcctccacttttgacagtttgtggaaacccctacctatatttctctaaacgtttacgaagagtagatttttttgctaagacttcttgaaaagtctggcgggtttctttttttttttttttcttttggtaaacaattcctccctgaatgtaaccctggttcacagtttgctcccactctgaccacagctggcctcttgctgttcacagccgaaaagtgaaatcaattcttggtctaacaaaatgccaaatgcagatgaaagccattctgatcattcatagtcatttcccgtaattgtatcagcctgtggtacttatatgatctctggaaagcattgtttattcaagtaaattcagtcccagcttctttgttgagtgttgctgtcttctaggaaaataatacttccttaaacccataagcattgtgaatactcatcattatgcagttttctaaaataaccgttgctttttccccctaaggaaatattacatgtctaatcaaatcctttattatttaaattctagaaatttgtattctaggcaaagatgtctctctatttcttactgttaacaaaatttaaaattctgaaaccaaaaaaatgctaaaatacctcaatccaaatgatcattgatctagtattttcttaaaattttttaaatgagattagatagaaagctgtattattatagctgaatgcttcaaaggtcacagaacaactgtgagtttgatggaaaacagcttttctccttcctattttaaatggttcctactttgattgcaagcatttattataattatcaagagattagtctgctgtgatagaatccttgtaatggaaccatttaaaaggaatataatggcagtttattggattctgcaaaagaaaggagcacagataaagtggtccttttataaatggctcaactgctagctgagtatactaattttattattctctcttagttccctcactttagtagtttttgtggttaagattacagtttttttctaatatataacctgtcctctggtcatttctatggtttatgtcttttgtagagtgtgtgtgtgtgtgtgtgtgtgtgtgtgtgtgtactcagtactctctgatatatcgtttttgttttagaacatatatttgtataatattttttctaagattattttgaatatttacattttgatttttgaaacttataggcatattagatgagtccattcatcacttctcattcatgtgtacttattctctaggtacaataaagcaatccctcccagtgcagtaaatacccaggaagtgggacttaagacctattccgtgctaataccttttctataaaaattaatgcagttgacactcagggtagatatatttggattctttctaatttctcaaaggcaaaaataagggctttaacactttctttttctttggagactttaatccatttggaaccagacacaagacaatacaaggacaaaatttttgaagaacctaaattcagtaaactagatattcctgttctttcccaaactggaaactagtagaattgcaatgtttgctaaaatacttgaataaacaattagagaatcgatgcctgcagagaaaaggcactaaatgttatctgtcagaggtgtcagggctaggtagaagactcaagttcatccaaacagattcttgtgaagtgggggactggaatggggaaacttaaataatgctaaaataaggctattttagagattatacactttctgaaaacaaaaatcagctagtaagtaccttgcactaataggtatcttgagcataataggtcttcaagaatattttttggaaaattttgtttttattaaagtagtaaaggaaacatcactttttaaatcttaaattttatatttctttgaagaatttcaaattgtattatctccttttttatattttgtgttatcagtgtacatgttgttattttcttaatattgctgctatacaaaaatgcctgattgaagaggagtaatggttttatttcttcatacttacctgaaaattcttaaatcagttgtcctatgccataagaaggccttgcattccaggtgcagtggctcatgcctgtaatcccaacactttgggaggccaagactcgcagatcacttgaggtcaaaagttcaagaccagcctggccaacatggtgaaaccctgtctctactaaaaatataaaaatttgctgggcttgatggcacgcacctgtgatccctgctcctggggatgctgaggcaggagaatcacttgaacccaggaggcagaggttgcagtgagttgagactgtgccactgcattccagcctgggtgacatagccagacttgatctcaaaaaaaaaaaaaaagaagaagaagaagagggccatatagcttaaaggtttctagagataataactcactgtaagagtatacctagttttcttttcttcattacttgagtttcatgttgtacacatagaagaatttgaaattgtagttatgcaactgttattatagatataaaagaagttatttaaaagagagacatagttcagaaagactgaataatgaagatggttaaagatttacaaatttgttgtacattctacaagtttaccttgctttgctatttagttgcatacttaagctttgcttaaaagaatgttatacatgtgtgttaatatttacatggatgtttttaggtaaataatcattgtagatgcatgaagtatgtgtatataaataaataagaatattggaaacatggaacataaaagtaattcagaagggtaatttctgtgcacttgattcttatgagcactacacaaaatatctaaacaagtgaaataaggaaatttacatgtattaattgaaaactatctctggcattgattgtcaaaccaagtcatcagaaagttatttcttactaacttttcctcagatataattatatctgttaattttgcaaatgagttttctatacaactgaatttagtttttgcttctatctctgttgtaagcaataccacacatatagtgctactttcattaatatgagtttgatcaatagtggagctaaacttatatataggggagacgtaagaataattgcagtccgcttggtagaaggtatcacaagcacgctgtttctcttagattttatattataagtgaataaaaataaacttttctacaaatatcatatttgtattttgtatgcaatatttttattaattttatttagaagaattcagggagactggtaagatcatcctttaatcatttatgaaaatgaaagcaaaagaaaagatttatgtttacttgctagtactgtaataaggcaactgagaaatattattgaaaataaattaaggaattgtggcatttattcaagcacttggaccaaaaagggagaagagttttacttttaggaattgttacagatctccaatccctttaaaagccctgaagtatgtaaattttgtaatatgcctataggaaacatctggtggtaaaacctaacttgagccagtatgtgtgtgtgtggttttgttttttttgttttttttttttgcctttatcccacttagagtcaatattcatacatttctttgcagaaatattaatttatttgattacagagtagtaatctaaatgctactaggaatgatatataatacaaagtagctgcaccatactgatcttctaacatgagaaaaactatgatttgcaaaacatactcaatcccaagggttgtgcataagaaccgtgctaacggtacaaatggcagatcaaagctgccgtgagacctggagcaatcagaaaggaaaagttgaagtcaggtctttgaataaatgggactttttttgccctagataatttcaaattaagaatggtatcgtgcctagaccaaagatgttttgaggtgcagaagttaaaaactcagttgagttagcagtattcaaaaggaaggtccaaataggacacattgtggttattaatgacctcccaggtcacagttgaacattccattgggaattatttcctgttatagttgtatttgttggctatccagagctagcactttcggagtcctattcagtaattatgatctacattctttctgagaagctgtttttttacaacctctctagactaaccctaccaatatgactggtttgaaattgtatttaatcaatataatttgtccagttaccctaaagtgaaagatagcaattgtaatagattatttttccccgtacaacaccttaaacagttaacttggagcagtaatggaagctgcctctcaaaacacattttagcacattaaaaaaatgattttttaaattctcctggtagacaactaaatgtaaaattgtagagcatccactagagttttgctttcatcccagctgagattaattataagaagtacaatactccaaaaattaggataattctatggcatagaataaatagaaaatgataacttagctttcattgccaaacatttaaattaatatcctttggtatgcttttttctttaaagtgttttatttggtgaaaattggaatccaaaacatcatttgaaacactcatttatttcagaaaattttctgattattttattgagattatttaaatttagagtccttttttgtttttcagtttcaaacatttatggaaaattcaggtaccattaaaacatcctttttcttatttgaaatttctgtatgtaaatggtaccaatgatatccaaatttgcaactatgaagtagctaaaacactaagacaattagaaatacaattttagtgtatggttttccaagttaaaggaaagaagtatgaaatacattgtctatctttgctgtctcccttccatttagatttgtatttgattagacagagcaaacctaggcttaagttatgtaccttattagagaagttattctctaattagaagttattctctaataggcttattttccctggggatatgtgttaaacagtataactactacttttgctgccaggagctgtatcctagagatcaacagcccattctaggtattcttttataatatgcagcataccaagatgactaaggctcaccttcctgtttgaactattttatatcattgtatagacacagatgtactaagtgtgggaaaatagcatatccttcccttccagaaaagcagagactttatttagcttatctatacttctttttgctcccaatcattgatggattagcctatctgcaccacgcacttcagctgaacactgtacagatctgaaaggcttacttctgggaacagacgtttatgtatttctttacctagaaggaaaggattgtcttttcaaaacacaagggaaagtgcattttgtaattctctcctttcttccctcactcccttacttttccctcttgccttttttcctccctttttggtgttagagtagagcttcaagtatatatgtgatcattgatgaaaacttaagtgttacagtaaagctgtaatgtttagaaacatttttaagtagttgtaaagattttccaaatcaaataaaaagtggttcaatttcgatttacccacaaatacaaagaattaatataaatgtatttttcttgctacatgagcaaactcgctggaaaaaaaaatgagacatttcatgcattctagatcttggtatctcctccacataacatatgcatatatacaaacacagaacatgaactcacttccctgggacatttccaaaactatgctagacatggatccagctaaatttgcaaattctctaccagataattccttgtggtttcttctctcatccttattattttctttttctacttatattaggcttactttgttttgttttgtttttttctaattttttgaggtacaagcttaagtcattggttttagatctttctactttttaaaaaatataaatatttaaagctgtaagtttccttctacacactgccttaactgcatcccacaatttttatctgttttacttcctttgttgagtttcaaatgcttcctacatttaaatttcttttgtaacccatgtattatttagaagtatgttgtttaagtttccgatatttggagtgttcatagagatcttgttattgatttatacttcaactccattgtaatcagagaacatactccatgtaatttcagttcttttaaatttgaagattgttttaggacacattatatatgacatatcttgtcaaacataatgatatggtttggatctgtgtccctgcccaaatctaatgttgaattataatccccagtgttggaggttgggctcggtgggaggtaattggatcacaggggtggatttccccctttggtgctattcctctgatagaattctcatgagatctgcttgtttaaaagtgtatagcaccttctccttctctctcttccttctgctctggttatgtaagacgtgtctgcttccccttcgccttctgccatgattttaagtttcctgaggcctcaccagaaggagaagctgctatatttcctatatagcctacagaactgtgagctacttaaacctcttttcttcataaattacccagtctcaggtatttctttacagtagtgcaagaatggactaatacacataccatgttcactggaaaataatgtacatttttcactcattgaacatagtgttctataaatttaaattaggtcaacatggttgatagtgtgtttcagactgtttctttactaatatgtttgtctactcattctccctattaaaagagagatgttaaaatattctaatatgattgtgagattatttattcctatgattctgtcaattttgcatcatatattttaggctctgttattgactaagtacacatttgtgaatattatgtttcttcaataattgaactctttctcattattaaatatccctccttatttctggtaatggtacttgttttaaagcaaactttgtctgataataatatacatagctactctggcatcttatgcttattatttatatgcttttctattcatttattttccactcatctgtgtctatgttttttagtgcattttgtgaacacacaacatatagttgagtattgctttcttttttgagacagggtcttgctatggtgcccagtctggcctcagactcctgggctgagatgaacctcctgcctcagcctcccaagtagctggggttgtaggtgcatgccactgcacctagtgggtattgctttttaatctgttttgatctctgccttccaattagaatgtttagtttattagtgttgattataattattgatgtgattggatttagctctaaaattttaatatttatttgtttctgtgtgtctactctgtttatttctgctttgtgctctattctccctttcattctttttttgaattatatgaatatttttagaatttcattttaatttatatattacatttttcctatgtatttttgcagcatatttttagttgttgtctagggattattttatacatccttaaatttcagtttacatagagttaatagtgtatcactttatgtaaaacatagaaaccttgaaaccatatagattcatttgtagcttatcagacagggtcttagtcaccttgcgccattgctagggactgcagttgaactcaatccaaatgctcagaaatgggtaactcaccaattcctccaaattttcctcacctccaaaatgattctatttttgtttactcccagaacactcacattgttgtaacctctattttgttcagattttataattgctatctgttagagattcaatttatgaggcgtttactcctccaaaccggaagtagaactcgaactaggagtaatttttcattcattcctgtcctttaccactcctccagtaaccttccctgtgcccctgtattacatcagatagtcctgttggctctatcagtgaaagatattccatttctgacctcatctcttcattttcaatgctatgcactaccagtgtcttcatcctggacttctacactatcttgctaacctgcctttcagcttccactttaacactaccattgttttcctcacactgaagccaaagtaagataaagtaaaaatttaattttattactaccccttccttaaaaccttcaaagactccttcaagaccccaaatgaatttgtccctgcctaccttttagaacacatttgatccccttattcactaggcttaagccatactaacattctttctgttaaacacaccaggcttatatccaacttaatgccttccctgcaggctgtctctactgtcagtgcttttacctttaatctttgggtggctggatccttttcatcattgagctgtcagctcatatgtcaacttctcatagaggctttccccaaccatactgtatataatatttctagtccatctctatctcatgactaagctttattctattcataatacttaaccttatccacaagtattttgtttacatactctgcttaactacaggagaatgtaaactccatgagggcagagacttttttttactcttgatcagtgctgtatcctcagctcctagaaatagtgcctgttatagaatagccattaaataggtatatttttattgaatacacacatacatcagagatactgtgggttcagttccagaccactacaatacagtgaacatcacaataaagcaagtcacatgaattttttggtttccgagtttacactatacagaagtctgttaagtgtgcaatagcattatgtcaaagaaatgaaaacactttaatttaaaaatactttattgctaaaatgttaatgatcatgtgaaacttcagcaagttataatctttttgctgatgaagggtcttaccttgatgttgatggctgctgaaggttggagtgtctgtagcaatctcttaaaacaagaaaacaatgaagttttgccacatcagttgactcttcccttcacaaaagattactcagcagtatgtgatgctgtttgatagcattttcccatagaacttctttcaaaattggagtcagtcctctcaaaccctgcagctgctttatcaattaagtttgtggaatattctgaatgctttgttgtcatttcaataatgttcacagcatcttcaccaggaggaaattccatctcaagaaaccgttttctttgttcataagaagcaactcctcatcctcaaaagttttattatgagattgtaacaattgctattgctatttccactatatctgcagtgatttcctccactgaaatctttaattcctgaaagtcatccatgaaggttgaaattagcttctcccaaactcctgttaatgttgatattttgacatccttccatgaatcacaaatgttcttaatggcattgagaatgttgaatcctttccagaaggtttttgattgattttgcccagatccatcagagaaatcactagctatagcattacaaaatgtgtttcttaaataacaaaattgaaagttgaaataactccttgatgcatgggctacagaatggctgttgtgtttgcaggcatgaaaacaatattcatctccttgtacatctccaatcaaagcccctcggtgaccaagtgccttgtcaatgggcagtaatattttgaaaatctttttttctgagtagtaggtctcaatagtgggcttaaaatattcagctaaccatgctgtaaacaaatatgctgtcactaggcttgattgttccatttttagagcacaggcagactagatttagcataacacttaagggccctagaattttttgaatggtcaatgagctttggcttcaacttcaagttgtcagctgcattagcccccagtaagagagttagcatgccctttgaagctttaaagccaagcattgacttttctctagcaatgaaagtcctaggtgacattttctccctatataaggctgtttcatctacattgaaaatctgttgcttagtgtagccaccttcatcagtgatcttagctagatcattatataacttgctgcagcttctacatcagtacttgctgctttgcttcatcttgcacttttacagtatggagatggcttctttctttaaatctcatgaaataacctcttctagcttcaaactcttcttctaggcttcatggaattgaagagatagggctttgctctggattaggctttggcttaaggaaatgttgtgactgttgtgatctatcgaggccactcaaactttttccatatcagcaataaggctattttgcttttgtattagtgttttcacactgttttaaagatagtgccagagactgggtaatttattaaaggaaagaggtttaattgactcacagtttgcatggctggggaggcctgagaaaacttacagtcatggtggaaggggaagcaagcaccttcttcacaaggcagcaggagagagagaaatgaaggaggaacttccaaacacttataaaaccatcaggtttcatgagaactcacttgctgtcaggataacaacatggggtaaactgcacccataatccagtcattacaggtccctccctcggcacatggggattacaattggagatgagatttaagtgggaacacaaagccaaaccatataagctttcttatcattcatgtgttcactggagaagaacatttaatttccttcaagaactttttctttgcattcacaacttggctaaccatttggagaaagagacctcgcttttggcctgtttcagctttcaacatgtcttcctcactaagcttaatcatttctgccttttgatttaaagtcaaagacgtgagcctcttcctttctcctgaacagttagaggccattgtagggtaattcattggcctaatgtcagtactgttgtgtctcagggaatagggaagcccaaagggagggagagggacaggggaacaaccagttggtgtagcagtcagaaagcacaatatttattgtttaaatttaccaacttatatgggtgcagtttatggcaccctaaaacagttgtagtaacatcaaaggtgatggctgacaaataaccataacatataataagaatgaaaaagtttgaaatatcacaagaattactaaaatgtgacagagacacagtgagcatatgctgttgggactatgtcacggatagatttgctagatgcagggttgccacaactcttcaatttgtaaaaaaaaaaaaaaaaaaaaaaaaaaaagtatctgtgagtacattaaagtaaagagcaataaaacaagatatggctatgcttaatttgccagctggacttggtatatgatttattgagcctcctttccttatctatgaaatttgggtattaaaacatatatcatagaactattgtaagaattatatgtttaagggatataatgtagtgcctggctcacatttgttactcagaaaaattatcttattgagaatcacaaaaaagaaaggagacatctaatatgtcctactttttctcagagcaagaaaaattatatatattttttgaggattataccacaaccttgagagaaaaagtgagaggaaagaaccttagagctcatattatccaagatgatagaaaaatactttaagcaagcctgggagctctataaaatctgattcaaccctccctccccttactgcctcaatccacaatgaattttatattattccatttgtagtctggaatttataatctggaaagttctctggaaatgttggaatgggattcagactatgggatgatcaaggctatcacaatctcaagcaaaattcatttatccatttgtggagcactcctatgttaggagaaaaggagaaaatcactgataaaccttttttttttaatgggagttgatggtttttaggctcattctttttcagagtggctgtactccgaggttaagtagccctgctttcctcgtccacatggcacatccctctttatcattaaaggctcatttctaacatcatctgtctctttttgccccagcagaattcataattccttcacatgtgccctcaaagcactttattcaaacattgattatattatattgtaattatttatctatttgttctcctttccacattactgtaagattttaagtagaaaatactccttactaatatttattgtattaactcctagcacagttactagagcatggtagttcactcaaaaacagacgctgtagcaagcactatttctgagcaatgggaatagagcaatgataagacagaaaagacatctgccttcatgagcaagtaggaggtggcatgactgagctaacgtgcttaacatcccctgcctcatagtaaatgatatttttaagtgaagaatcaccatctccctgacaacacattacaaagtataaatcaaagggctatcaataagtgttacttaaataaaatagtgtgtggtcaaatgaatttaggaaatgttgagtacccaaacagtaaacagttttgtttacttcagatttccactattgtggaaaacttcaccaggttccctaaagttagttaatcaagtcttcctaagtgtattctaaaacatttgttacaccctctgttgctctatcttaagacatctgtaagagaaaatcttctagctcttttacaaagggtcattgccatctttaaatagttcagaatcaataagatccgtctattgctttgaaaagaatgtgcttttagagaaggcagaggtcatttattatcagctaaatgtacatcattttatgttcattatttatatttagaattagaaaaaaacttccattaaaggttaaatcaatggattatggattagtgagttgtgaagtgtgtgctgagttttctagtcatgatatatgccattgttttaaatacataaacctcctttatgtgaaagaggaaataatgaaattgattacgagtgcagctgtccatctgtaattataggttgtgtaacctgtgtacaaaatcttgggtttttattaacatgttatcgttattaattttacatgaactatttaaattttggatattgagtcaaaataagcaaaattctgataattacctaaattggggaaatagtttaaaaccacttcaaaaggtgaacaagaaaatatttcagacattttaatataaaatttaaatataattgcaataacagatataaatctcgaagtaaatacttaaaaagtttaaattatataaatacatctgttatgctgatctttagaaaaatattttatacctgaatagtaaaaatgagttcaaaattaaatgttatctttaaatatcaattttaaataagtacaaaatcatttctgtattgtgaatgccatttttaaaaatatttatccacattaatgagaatttggaagaaaaaatataatgaaagattgccatatggatgctgaactagcagttctttttcttgttcttttattattataatactcttaatgtggcaaatataagtcagggagagaaaattactttgagatggcttacagttttaaggactgacatgtgtaggaaaagaaccgaaccacacagtgtggagagtttgattgttttctgaatgggcacaaaagtgaaaacttcagccaagttaagagcttttgtaaataggaagttaattgtaaaactaacaagtacactttttaattagtttaaaagcagatgtgtttgataactttttggtgggatggaaacatttttctttggcatgtctcataaatatcagaaagaatcaaatacaaataggccggattgcatttaattactgagatgattgcatagcctaaagcagacttcacgaaggcagactaaattgtcaccatgttcttaatttactatgttgtattttcctttttgggctaaaagtgttattggcaaataattccctcctacaaaagaacaataagcttcttaaaaagtgatgcttttagttccattatcagtagtttcataactacttccacctcacttagtggagaagcaaaataggacatacatgattttgttaaaatccataagcatgtttaacacttaggagctttcctctgcctttgaagactattctgtgtcataactttgttttaaaatttatgtctacttttattgcatgaaaaaactgtgagacagcaatcacattaacaaataataaataaaaaattaattaaaataaattacttaaaattgtatttaaatattttctttgaaatagttattaatgttaatatgattaataacaaatattaataatagctgcctattatttgcaaacactattataagtactatagggttgcaaagctgcatgaggtgaatatcccgatctcttgttgcttacaatctagtaagagtgtcaaggtataaatgcatgaggcattaaattaacagttgagatccaaaaaaagaacaatacagaaataacgccgcatgtctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattagagacttaaacattagacctaaaaccataaagtccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaaaaggcaacctacaaaatgggagaaaattttcgcgacctactcatctgacaaagggctaatatccagaatctacaaagaactcaaacaaatttacaagaaaaaaacaacaccatcaaaaagtgggcgaaggacatcaacagacacttctcaaaagaagacatttatgcagccaaaaacacatgaaaaaatgctcatcatcactggccatcagagaaatgcaaatcaaaaccacaatgagataccatctcacaccagttagaatggcgatcattaaatcaagtcaggaaacaacaggtgctggagaggatgtggagaaataggaacacttttacactgttggtgggactgtaaactagttcaaccattgtggaagtcagcgtggcgattcctcagggatctagaactagaaataccatttgacccagccatcccattactgggtatatacccaaaggactataaatcatgttgctataaagacacatgcacacgtatgtttattgtggcactattcataatagcaaagacttggaaccaacccagatgtccaacaatgatagactggattaagaaaatgtggcacatatacaccatggaatactatgcagccataaaaaaggatgagttcatgtcctttgtagggacatggatgaaattggaaaccatcattctcagtaaactatcacaagaacaaaaaaccaaacaccgcatattcttactcataggtgggaattgaacaatgagaacacatggacacaggaaggggaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacatgtaccctaaaacttaaagtataataataataaaatttaaaaaaaagaacaatacaatgattaattgccaaatttacaagcaagagtattttagagagaggaatgtcatgtgatacgaaataaatattagaaacatagcaaagaagaatacacaattaattgccaattcgataagcattaaaattttaatgagaagaatagcatagaacttggaatgaacacgattggaggaaacagtcagaagggagtaaagattctaaataatgcagtaagagagatgatactggaaagggcacactctgtggaccctgagaagcagcataggaaatttacttcaatatttctgtcatttcagtaagtattgcattaaaaattgttatgtttgaaaagaaacaaatctggattttttgaaaacatattgttgtagaaatagaaatgcaaaaatacatgcactttagtctgtgtaacagttgatgtaattactatttattggtggactcatggcaggcactaggaaaagagcattataagaactgttacatccatatgaatgagaaacgaatactcagagaagctgtcatttacctagtaggtggcagggctgggatttgaacccatatcttagtagactgtctcatgctgctgctgctgctactgctgctttcttatatgtgctaggcactgggctaaacactttacatatattccttctatcagttttacaaaatcgatttaatttatcccaattttgtgaatgaaagaactgaggtttagataattgcagtagtaaaaatcatgaacttaataattttaataccaggcttgtaaatgtgacatagctaataagacatctttaatataaaatattttatgagatttaaaaaacattgattttgctgtgatagacgtagtttcaaaaacaattgacaattgtacaatttagcatttaaggatattcctcaaagtaagtccttttctgtgggatttctaacagtaatcaaatgttgaagtcttatggggaagaatttttaattataatttctaaaaataattgaataagcctattccatatagcagtaattattaagatgaaagaatgcctactttcttccaagtgtggtaattgctcagtagaattagctatttcacaagtaattttacagttttgttaattaagattaaagtaattatcttggccctaagattgctttaaattgagagtctagctctactggcagaaaagaaaaagagtgtataagagctctaaaaaggtttgtatgctattcctgccccctccatctccagaaaaaaaaggctgagtcagaaaaagagcttgttaaagacgcgaagagtgaaaatgcaattccacatttgtggtaatagagagcttattgaataaagctaaaaacaaatcatttctctctttttactctccagccctgccttcttgtttaatatttggagtcacttttttccttcatgttaataaagtgaaaaaatatactcattatactaaatttttcctcaatggcttcacctttaaaaccttccattgacctcagccaaatcttttttttttttttcatttatttcaataggttttggggggaaaagatggtgtttggttacatgaataagttctttagtggtgattttcgagattttggtgtacccatcaccggagcagtgtacactgtacccaatttgtagcgttttatccctcatcccctcccaccctttctttgagtccccaagtccattgtatcattcttatgcctttgcatcctcatagctcgtctcccacttacgagtgagaacatatgaggtttggttttccattcctgagttacttcacttagaataatggtctccaattccatccgggtttcagtcaaatcttttatgtaggatcacacctggtgacctttaagaaattgaaccatcacaagaaatcagttggcagtgttctactggggtggctcttcctctttagtcatagattaaggaaagctcaagaaccacaactctactgctctgtctgaacactcaattgttaattttgttcctcttcttttagctgaaattcagattttataaatattgtgaataaatattttgtgagagttgagctcaatttcctggacaacacacttaaaatacttgctcttatgtcttacagttgcatacagaacctgaccagatgtttatgggtttttttttcttttttctttgctctttttttttttttttagacagagtctcactctgttgcccagaatggagagcagtggtgcaatctcagctcacggcaccctctgcctcccaggttcaagcaattctcctgcctcagcctcccaggtggctgggagtacaggcacccgccaccacacctggctaatttttgtgtttttttttcagtagagacagggtttcaccatgttggccaggctggtctcgaactcctgacctccagggatccacctgcctcagcctcccaaagtgctgggattacaggcatgaaccactgcacccggcctattttttttcatctgtggttatcacattgaaattatcccttaaagactataaaaccactttattccttcagataccagaaaattaggcttatagggaatgataaccaagagacaaaaagcaacagctaaattttttttgttcttaaaaaaactgcttttcctgaagaaagtaaaataaaataaagcccagattaaagaatcaaatataaagacatctaatactcttatcagaagacctttctgcatcatttcaaaaaaaaaaaaaaaggctgtaagcctctgataagattattttaaggacagaatgaagatttcctcttgaatgatttgctctgccctttatcaaaaagacatgtgtctgtccactttaacatttctggtataaatataccttgtcctttaaaaattactgcataacattaaaatcacgagcattgctatacatcatcaacagtcaagccagagagccaaatcaggaatgaactcccattcacaattgccacaaaaagaatcaagtacctaggaatacagctaactagggaggtgaaagatctctatgaggagacctacaaaccactgctcaaagaaatgagaaatgacacaaataattggaaaaacattccatgctcatggataggaagaatcaatatcattaaaatggccatactgaccaaagcaatttatagttttaatgctattcctattaacctaccattgagattcttcacagaactagaaaaaactattttaaaattcatataggaccaaaaatagcccaaatagccaatgcaatcataagcaaaaataataaagctggaggcatcacactgtccaacttcaaaatatactacagggctacagtaaccaaaacagcatggtgggtacaaaaacagacacatagaccaatggaacagaatacagaacccagaaataaaaccagatacataccactatttgatctttgatgaacctgacaaaagcaagcaatggagaaaggatttcttattcaataaatttagtgctaagataagtggctagccatatgcagaagattgaaactggaccccttccttataccatacacaaaaataaactcaagatggattacagacttaaatgtaaaacccaaaactataaaaaccttggaagatagcctaggcaataccattcaggacgtaggcatgggcaaagatttcatgacgaagacaccaaagcaattccaacaaaagcaaatattgacaaatgggatctgtttaaagagcttctgcacagcagaagaaaatatcaatagactaaacagacaacttacagaatggaagaaaatttttgcaaactatgcatctgacaaaggtctcatccagtatcttttaggaacttaaacaaatttacaagcaagaaacaaacaacccaattaaaaatgggaaagaacatgaacacttttcaaaagaagacatatatgtagccaataatcatatgaaaaaaagttcaacatcactgatcttaggagaaatgcaaatcaataccacaatgagacaccatctcacacccgtcagaatatggctataattaaaaagtcaaaaacaacagatgctggtgaggtagtggagaaaaaggaacacttgtacattgtgggagtgtaagtcagttcaaccattgtggaaggcagtgtggcaattcctgaaaaacctgaagacagaaataccattagatccagcaatcccattactgggtatatacccaaaggaaataaatcattctgttataaagacacatgcatgtgtatgttcattgcagcactattcacaataggaaagatacggaatcaacctaaatacccatcaatgatagcctggataaagaaaatgtggtacatatacaccatggagtactgtgcttccatgaaaaagaatgagatcctgtccttcacggggacttcgatagagctggaggccattatcctaagcaaactaacaggcacacaaaatgaaacaccacgtgttctcacttgtaaatggaagctaaatgatgagaacacatgacacatagagggaaatgacacacactggggcctatatgagagtggagggtgggagaacagagagaatcaggaaaaataactggtgggtactaggcttaatacttggatgatgaaataatctgtacaacaaacccccatgatacaagtttacctatgtaacaaacctgcacaagtacccctgaacttaaaagttaaaaaaaactactgtgtaacattaacatgatatttcaaagttcactgtaagtgaagagtttacttgcatagtgtattttatgcctagatgttttatttttcatattatgtaactaataataagttatcatactttaaccaaatggttctacctgtttctctttctgataaataagtaaatttggagtaaaagtgatgccaagaagtaaaatatattgctgcagtgagcaatacaggggaaaaggaaggcagaaggtagcagaaactacaaagggggaagtgtagagagggccgcagcttaacaaagtagtagctcagtaaaagaaacacatactggaattaaaattttagacaaaatgttactttcctatccactttcttttttcatgtctttatttgatttggttgataacaaacttttctaattattaagtataggttataccatctaacctatactttaattatattcatgcttttttgcctaaagtttcattattattagtgggggatctttttgatttgatactggcatttattactgtcttcctctagttgaatccaaaatgtttcagagaatttatcaagaatcatcattaataataactatatcctactgatatgcatggaaataaatggggatataaacaaaaagttgaaatgcatctcagtgatgtatttacaattctgattataaaatcctatctttccttccatgtttagcaatcacatggagaaggcacaaattagtctggctttaaaacattgaactaaaaactaggatttgactatctgagccatagctttacagtgtcagaatatgagagtatacttcgtaaaggcaggaaggatgcatttttcaagaacttcaccaattaatttgcaatgtaaattgatataataaccagataataatacacaaccctaggtaagggggaatggaagagtgtcagagaaagaagaccctgaaataatacataggcaagagtcagaatagtagtaatggcttaagatatatatcagatgtaagaggggacttcaaaaggttcacagaaaaatggaattaaaagataggaataaagacatataaactttatccctcaacataaataccatcaagttcaggacacttttgtaagtgataccagccatttagtccatccctaaagaactgagggtcttggaatttaacatgtcagtacagtttttttacattattaactgaagaaaagggtaccctttacaaactttttaagattaggaaacaaaaagaagttacaaggagccaaatcaagactgcatgatgcactcctgctgatttcccatagaaactctgaaaattgcacttgtttgataaggggaatgagcaggaacattatcaagtcagaggactctctgatgaagctttcctgggcatttttgtgctaaagctttagcggactttctcaacacactctcataataagcagatattatcgttctttggttctccagaaagtcagcaagcataatgccttgagcatcccacaaaactgttaccatgacctttgctcttgaccagttctcttttgctttgactggaccacttctacctcttggtagccatttttttgattgtgctttgtttttaggatagttaagttttatctcctgttacagttgttcaaagaaatacttaaaggtctttatcctacttgtttaaaatttctgttgaaagctctgctctcatatgcagccaatatgggtgcattgattttggcacccatccagtggaaagtttgcttaactttaatttctcagttagaatttgtaagccgaaccagttgagatttctacagtattggttattatgtccaattggtcctcttcaattagcgtacaagcaagattaatttttttgatgaattgttgtagatgatttgcctctgcctctgcaggcttcatcttcaacactgtcttgtctcttcttttttttttttgagacagagttgtactctgttgcccaggctggagtgcagtggtgcaaacacacctcattgtaaaccttgacctcctgggcacaagctatcctcctgcctcacctcctgaatagctgggaccacagacatgtgccaccatgccctgctaatgtttttcttttttgttttttgttttgttgttgttgttgttgttgtttagtttttgtagataaagggtcataccatgttatccaggctgatcttgaactcttgggctcaagcaatcctcccatctcagcctcccaaagtgcaaggattacaggcatgagccaccacatttggcttgtctctttaaaaagtcatccatcaacacctgtgaaaagaagggggacaatacaagttttttatttgtaaacttctgatttctttaattcttcccatgtttttttaaccatcaatgattttatcattcttccaccgaaactttaccataaatttggtacttgttcttagttcagttgtagcagcacttaacgttgctctgagagggttttgttcaaactgatgtcttacccttcttagtgccttaaactatatcctgttcagacatgtagcaagttagtacaagtttattttggtgcaaaaaatttgaaatccatgcataatgttttcataatacacattttccatgaactttttgaagtctgctagtatgtgtatagatatatattataggtaagagattttgtgtgtgtgcacacatgcatgcacaaacccacagcattgcggtactatatatcactgagaatacatccaacaggacacaagacatgttaactaaaagggcgctgacctttcttatggtggagaacagtgccagtaaatatagactgtgtcttttcaacatattttgtaatcatgtttcattagtgatttctcatatatatacttatacattcacctgtgcggcaagtgggttcccccattttcattactttgtctcacctctttccttcaatttggcaaaaattttaactataagtttgtttttattatgaaatagactgaaagctgcacaaaggctagaatcatgctgatatttacctagtatgcatacctcgtatttagtctgtggcttggctcatagatttgtacagtaagtgtttgttctaatgaatgaacatagacattacacatacagtactctatgtatatcatagttatcactgtttatccagagtatttagtactggttttagagaggcaggaaacagctatgctggtgctgtcaatgtagtattcttaagatagtccattttcttggttgcttttcttgcagttagaagcggtgcagcataagcaaggaagtcagactgcctgaggacacattctgccaccagctagttgtatgatcttgggcacattacttaaccactctgtgcttccatttcttcatctgtacaatgaattaataatagtacctatctcaaagggattaatgaaaagtagttgagtagtgagtagatatgtgtacaatatttagaaaggtacctaaacacaataagctctcagtaaatattggcctattttcttgatcactaaagtggtaggaagggaatattactaattatatactagctcttaaagtttttgtctggaaatgtctcacttctgctcacattttattagctggaggaggtcacatcaacatgattaagttcaaagtgatagaaaagtacaattttaaaatgtgtattgaaggagaggataaccatttgtaactctcagtacttatgtttttgtttaatcttggtaggattagaattcatgcacagaagtcctgacctcaatgattaccacttaactcttgtagccaaagggaaattctgtttcttatgtattttttgtgtgtatttagtaaaatattcctttgtttacttcactctttcctctgttccattggatagtttttgttactacgtattaaataatcaattaattttcagtagtgcttcaccaggtaaattcaggttcctctgtagcttttaaaggggaaccattcctgaggggccaggaggctttaaggaaaatcaagtacatgctcataagctgaaaatgcaattatcaaaaattttattgaggaaactatgagtacctaaaccctatttatctaaaaataacaccaagttccagctaatgaacatcattatatcaatagtaatattaattatcataatacaacctaactggaaatcttcccttcattaattattgattgttcatatgttcttttcttgcagtagtacactgttctcgtatagccacactcatgaacaaaatatacatatgatgctcaatgtttctgtataatttagtcattaatggcacaaagatataaagaacaaaaaataaacaaatgaaaagaaagcatatgataccacactcaccttcctagtgttgacactggaggtatcatacatgagataataaaagtataagctagcaaatccaaacagacttcggtgtagcatgagtacccatgcaactgtggagacagtagcataagtggctcctgtctgttcaactgggtactctccaaatacaggaaatctaaattagcccttcttcatgaaaagaaatgcttttatataccaaactgaggacattcgttgaaactcttagagcagtcagaatatactgactaaataggcatatcataggataacatgaagttttgatcatgcttacaaattattaataatagtcacatctacagttactcttttttttattatactttaagttctggggtacatgtgcacaacgtgcaggtttggtacatatgtatacatgcgccatgttggtgtgctgcactcgttaactcgtcatttacattaggtatatctcctaatgctatccctcctccctccccccacctcacgacaggccccagtgtgtgatggtccccaccctgtgtctaactgttgtcattgtttaattcccacctatgagtgagaacatgtggtggttggttttcggtccttgcgatagtttgctcagaatgatggtttccagcttcatccatgtccctacaaaggacatgaactcatccttttctatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggaatatgcccagtaatgggatggctgggtcaaatggtatttctagttctagatccctgaggaatcgccacactgtcttccacaatggttgaactagtttacagtcctaccaacagtgtaaaagtgttcctatttctccacatcctctccagcacctgttgtttcctgacttgattcaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttgtcttgtaaatttgtttaagttctttgtagattctggatattagccctttgtcagatgagtagattgcagaaattttctcccattctgtaggttgcctgttcactctgatggtagtttcttgtgctgtgcagaagctctttagtttaattagatcccatttgtcaattttggcttttgttgccattgcttttggtgttttagtcatgaagtccttgcccatgcctatgtcctgaatggtattgcctaggttttcttctggggtttttatggttttaggtctaacatttaagtctttaatccatcttgaattaatttttgtataagatgtgaggaagggatccagtttcagctttctacatatggttagccagttttcccagcaccatttattaaatagggaatcctttccccatttcttgtttttgtcagatttgtcaaagatcagatagttgtagatgtatggtattatttccaggggctctattctgttccattggtctatgtctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaaaaaagtcattggtagcttgatggggatggcattgaatctataaattaccttgggcagtatggccattttcacgatactgattcttcctatccatgagcatggaatgttcttccattcgtttgtgtcctcttttatttcattgagcagtggtttgtagttctccttgaagagatccttcacatcccttgtaagttggattcctaggcattttattctctttgaagcaattgtgaatgggagttcactcatgatttggctccctgtttgtttgttattggtgtataggaatgcttgtgatttttgcagattgattttgtatcctgagactttgctgaagttgcttatcagcttaagaagattttgggctgagatgatggggttttctaaatatacaatgatgtcatctgcaaacagggacaatttgacttcctcttttcctaattgaataccctttatttctttctcttgcctgattgccctggccagaacttctaatactatatcgaataggaatggtgagagagcgcatccctgtcttgtgccagttttcaaaggaagtgcttccagtttttgcccattcagtatgatagtgagtgctcttattattttgaaacacatcataaattgctctaattttgagacacgtcccatcaatacctactttagtgagagtttttagctgttgaattttgtcaaaggccttttcagcatctattgagataatcatgtggtttttgtctttggttctgtttatatgatggattacatttattgatttgggtatgttgaaccagccttgcatcccagggatgaagccaacttgatcgtggtggataagctttttgatgtgctgctggatttggcttgccagtattttattgaggatttttgcatcaatgttcatcaaggatattggtctaaaattctctcttttttgttgtgtgtctgccaggctttagtatcaggatgatgttggcctcataaaatgaattagggaggattccctctttttctattgattggaatagtttcagaaagaatattaccagctcctctttgtacctctagtagaattcagctgtgaatctgtctggtcctggacttttttggttggtaggctattaattattgcctcaatttcagaacctgttattggtctattcagggattgaacttcttcctggtttagtcttgggagggtgtatgtgttcaggaatttatccgtttcttctagattttctagtttatttgtgtagaggtgtttacagtattctctgatggtagtttgtatttctgtggaaacggtggtgatgtcccctttatcattttttattgcatctatttgattcttctctcttttcttctttattagtcttgctagcagtctatcaattttgttgatcttttcaaaaaaccagctcctggattcattaattttttgaagggttttttgtgtctctatttccttcagttctgctctgatcttagttatttcttccttctgctagcttttgaatgtgtttgctcttgcttctctagttcttttaattgtgttgttagggtgtcaattttagatctttcctgctttctcttgtgggcatttggtgctataaatttccctctacacaccgctttaaatgtgtccccgagattctgctatgttgtgtctttgttctcattggtttcaaagaacatctttgtttctgccttcattttgttatgtacccagtagtcattcaggagcaggttgttcagtttcgtgtagttgagtggttttgagtgagtttctttactcctgagttctagtttgattgcactgtggtctgagagatagtttgttttaatttctgttcttttacatttgctgaggagtgctttacttccaactatgtgatcaattttggaataggtgtgatgtggtgctgagaagaatgcatattctgttgatgtggggtggaggttctgtagatgtctattaggtcctcttggtgcagagctgagttcaattcctggatatccttgttaactttctgtcgcgttgatctgtctaatgttgacagtggggtgttaaaatctcccattattattgtgtgggattttaagtctctttgtaggtctctaaggacttgctttatgaacctgggtgctcctcttttggatgcagtgcatatatatttaggatagttagctcttcttgttgaattgatccctttaccattatgtaatgaccttctttgtctcttttgatctttgttggtttaaagtctgttttatcagagactaggattgcaacccctgctttgttttgttttccatttgcttggtagatctttctccatccctttattttgagcctatgtgtgtgtctgcatgtgagatgtgtctcctgaatacagcacactgatgggtcttgactgtttatccagtttgccagtctgtgtcttttaattggaacatttagcccatttacatttaaagttaatattgttatgtgttactcttaaagacattattattagagtattttctattgttttttctatagtgactcatttgcagaagaaaatggcagaagaataacttattatgttgaaatactaaatagaaggagtgatgcaggaggagtttagctaaataaacagaagaaactatgtgcttgtatagtgatgaatttcagtaggaaaacagagtgaagaacatatgagaatgaaaggaaaggaaatgcatgatgttgttttaccacaagaatatatgctcagcactgagaatattgcctaacacaaaatagatgctcagtaaatatatttttgaatgagaaccatagaaagaaggatggaaagaaatagacaagaaggagtttgaacagaaaacagatgatgatatcctagattggtaacctggcacagatgccaaatataatggtgttggaacataagccttttttgaacatattattctacagtagaaaaacgtctcatgattcatgacttggtggtaaacaatattatcagaaaaatgagaatataaggagagtattatttgtatactctatgttttagttcgttgaggctgctataacaaattacaggctaagtattccttatatgaaacgcttggggccagagtgttttgaatttaggatttttttcagattttggaatatttgcatgtacataatgagatatcttggggatgggacccaagtttaaaaacaattgtctatgtttcatatatataccttatacacatagcctgaagattttatacaatatttttaataattttgtacatgaaacatggtttgtgttaagtacttatatgtggaattttccacttatggcatcatgtcagcactcaaaaagttttgggttttggaacattttggattttcagattagagatgcttaacctgttccataaactaggtagcttatgaacaacagaaatttatttcttgcagttctagaagtgagaagtccaggatcaaaataccagtagatttggtgtttcgtgagggccccacctcctggttcatagaacagtgccttctccctgtgtcctcacatgatggaagtgacgaacaggctcccttgagcctattttataagggcactaatcccattcacaagcgcttttctttcatgacctaattactttcccaaaagccccagcacatcataccatcaccttggaggtaaggatttcaacatatgaattttggacagaaaccatactaatgacagtgtttctgaacatttctttattagaaactgcttttggaaaaatgtaataaaactctagacttctccctcaaaaatacgtatgtacatataccataaaattttgtagaccatttcaggagttttgtgaatctgtaaaactcatccattggttaatgatgagtgccacatttttaaataatgtgaatgttgggttaatatctacccccaccccccgaaaaacatgaaaagaagagcacagaagtgccaaggaacaacacaaagctctgagatagatatcagaaggaccaaaacccagaataacctgaggtgcagtctaaaaaagtaatagaactcctccatcaggtcccacagtatagtagggtatagcccattatctttccatttagtgattataattttttgtgtccacatattcactgctagtatatagaaatacaattattatttgtgtgtctatcttgcatctcgtgaccttgcttaactcagtccttagttctaggagtgtttgacagattttgcatgattttttacatagacagtcatgttatctgcatatagggacaattttatttcctctttttctatttatattcctcttatttcctctcttttgccttactgcattggctagaaatttcagtactctgttgagtaagagtggtaacagcagacatctttgccttattcccagttttaggtggagaacattcagtctttcactcttaagtataaagttagctaaagttttttgtagacacttttatcgagttgaagaaattgccttttattcctgttttcctgaacttttctaaaattgtgaatcgttgctaaattttgtcaaatatcttttataatgactaatatgatcatgtgatttttcttcttcagctgttaatgtaatgcactacattgattcttaaggatttttttgtctatataaaggatggatattggtctgtagttttctttttttgtactgtttttggtttttgtatcagggtgatgttagctataataattattgagaaatatttcttcctattctgttttctggaagagattatgtataattggagttaattcttctttaaatgtttaataaaattcttcagtgaaactatctaggcctggagatttggggaaagaggagtaaacatcttaaatttctttaattgttacagagttgttcatattatctttttcacattgggtgagttgtggtcattcatgttttttggtccatttcttctaagctgccaaatttatgtgtgtagagtctttcacagtatccactccttcttttgatgtcttcagagtcactagtgatatcccctttttcattcctgatattggtaatttgtgtctactcttttttactttgtcagtctttttagaggtgtgtcagtgttattgatttttttcaaagaaacagctctttgtttttgttaatttttctctgttgtttttctgttttcagtttcactgatttttattgatttctgcttttttattgtttcctttcttctacttgccttttatgtgttcttaaggtgagaatttaggttactgattttaaatgtttcttcttttctaatatatgcatttagtactatagattaccctctcagttctactttacttgtgtccaacaagtgttgatattttttattgtgattttcattcagttctgtattcttttggttttccctcgagaattcttttttaaatcaagggttatttattttttctgccttcctgtgggtgacttggtcattttttagaattctgttttgatttatctatgtttcttagtatatccctttgtgtagcttttttagtgtttgctctaagtattacattttttgtgcatagccttatcagtctactggtgctaacattctgtcagtccatgtgaaatatagacactatgtcctttcacatccctttgccttcccccatttataatatagttatcttaaatattaccagtaaatatacttagaaccacatcagtgttacaatttttgtttcaacagtaaaacataatttagaaaactcaggaggaaaaggaaagcctattatagatagtcatgttttgcttattgtgttctttcttcctaatgtttcagtgtttcttctattacttctctcatgtttacaggactgcctatagcctttcttttagactagctctgatggcaataaatattctgttttttacttcatctaaagatgtcttcacttgttatttctggaggtctcatcactggctataggatttggggttgacggttcttctcttttagcacctaaaaaatattttgccactttctctggtcatcattgtttctgatgtaaaatatattgtcattctgttttacttctgcagatgagatgccacttttctctggctgctctttagactttctttgccctcagttttcagaaatttaattatgatgtgtcttagcatggacttccatggatttatcatgtttagagttcagtaagctacttaaatctgtacatttatgtttttgccaaatttagaaagttttccgccatttttttgtttgtttgtttttttttttttttagattcttcgttctttcacatgcagagcatcttttttttttaattttattattattatactttcagttttagggtacatgtgcacaacgtgcaggtttgttacatatgtatacacgtgccatgttggtatgctgcacccattaactcgtcatttagcatcaggtatacctcctaatgctatccttcccccctccccccaccccacaacagtccccagtgtgtgatgttccccttcctgtgtccatgtgttctcattgttcagttcccacctatgagtgagaacatgcggtgtttggttttttgtccttgcgatagtctgctgcgaatgatggtttccagtttcatccatgtccctacaaaggacatgaactcatccttttttatggctgcatagtattccatggtgtatatgtgccacattttcttaatccagtctatcgttgttggacatttgggttggttccaagtctttgctattgtgaatagtgccacaattaacatatgtgtgcatgtgtctttatagcagcatgatttatagtcctttgggtatatacccagtaatggggtggctgggtcaaatggtatttctagttctagatacctgaggaatcgccacactgtcttccacaatggttgaactagtttacagtcccaccaacgtgtaaaagtgttcctatttctccacatcctctccagcatctgttgtttcctgactttttaatgatcgccattctaactggtgtgaaatggtatctcattgtggttttgatttgcatttctctgatggccagtgatgatgagcattttttcatgtgtcttttggctgcataaatgtcttcttttgagaagtgtctgttcatatccttcgcccatttgttgatggggttgtttgtttttttcttgtaaatttgtttaagttctttgtagattctggatattagccctttgtcagatgagtaggttgcaaaaattttctcccattctgtaggttgtctgttcactctgatggtagtttcttgtgctgtgcagaagctctttagtttaattagatcccatttgtcaattttggcttttgttgccattgcttttgatgttttagacatgaattccttgcccatgcctatgttcctgaatggtattgcctaggttttcttttagggattttatggttttaggtctaacatttaagtctttaatccatcttgaattaatttttgtataaggtgtaaggaagggatccagtttcagctttctacatatggttagccagttttcccagcaccatttattaaatagggaatcctttccccatttcttgtttttgtcagatttgtcaaagatcagatagttgtagatatgcgtcattatttctgagggctctgttctgttccattgttctatatctctgttttggtaccagtaccatgctgttttgtttactgtagccttgtagtatagtttgaagtcaggtagcgtgatgcctccagctttgttcttttggcttaggattgacttggcgatgtgggctcttttttggttccatatgaactttaaagtagttttttccaattctgtgaaaaaagttattggtagcttgatggggatggcattgaatctataaattaccttgggcagtatggccattttcacgatattggttcttcctacccatgagcatggaatgttcttccatttgtttgtatcctcttttatttcattgagcagtggtttgtagttctccttgaagaggtccttcatatccgttgtaagttggattcctaggtattttattctctttgaagcaattgtgaatgcgagttcactcatgatttggctctctgtttgtctgttattggtgtgtaagaatgcttgtgatttctgcagattgattttgtatcctgagactttgctgaagttgcttatcagcttaaggagattttgggctgagaccatggggttttctagatatacaatcatgtcatctacaaacagggacaatttgacttcctcttttcctaatcggatacctttatttccttctcctgcctgattgccctggccagaacttccaacacattgttgaataggagtggtgagagagggcatccctgtcttgtgccagttttcaaagggaatgcttccagtttttgcccattcagtatgatattggctgtgggtttgtcttagatagctcttattattttgagatacgtcccatcaatacctaatttattgagagtttttagcatgaaggttattgaattttgtcaaaggccttttcttcatctattgagataatcatttggtttttgtctttggttctgtttatatgctggattacatttattgatttgcgtatgttgaaccagccttctatcccagggatgaagcgcacttgatcatgggggataagcttattgatgtgctgctggattcggtttgccagtattttattgaggatttttgcatcaatgttcatcaaggatattggtctaaaattctctttttcagttgggtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggacttttttttcgttggtaagctattgattattgcctcaatttcagagcctgttgtaggtctattcagagattcaacttcttcctgttttagtcttgggaggatgtatgtgtcgaggaatttatccattttctagattttctagtttatttgcatagaggtgtttatagtattctctgatggtagtttgtattctgtgggatcggtggtgatataccctttatcattttttattgcatctatttgattcttctctattttcttctttattagtcttgctagcagtctatcaattttgttgatcttttcagaaaaccagctcctggattcattaattttttgaagggttttttgtgtctctatttccttcagttctgctctaatcttagttatttcttccttctgctagcttttgaatgtgtttgctcttgcttctctagttcttttaattgtgatgttagggtgtcaattttaaatctttcctgctttctcttgtgggcatttagtgctataaatttccctctacacactgctttgaatgtgtcccagagattctgctatgttgtgtctttgttctcattggtttcaaagaacatctttatttctgccttcattttgttatgtacccagtagtcattcaggagcaggttgttcagtttccatgtagttgagcggttttgagtgagtttcttaatcctgagttctagtttgattgcactgcggtctgagagacagtttgttataatttctgttcttttacatttgctgaggagtgctttacttccaactatgtgatcaattttggaataggtgtggtgtggtgctgaaaagaatgtatattccgttgatttggggtggacagttctgtagatgtctattaggtcctcttgatgcagagctgagttcaattcctgggcatccttgttaactttctgtctcattgatctgtctaatgttgacagtggggtgtgaaagtctcccattattattgtgtgggagtctgagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagaccaggattgcaacccctggctttttctgttttccatttgcttggtagatctttctccatccctttattttgagcctatgtgtgtctctgcacatgagatgggttttctgaatacagcacactgatgggtcttgactctttatccaatttgccagtctgtttcttttaattggagcatttagcccatttacattcaaagttaatatcgttatgtgtgaatttgatcctgtcattatgatgtcagctggctattttgctcgttagttgatgcagtttcttcctagcctcgatgttcgttacaatttggcatgtttttgcagtggctgctgccggttgttcctttccatgtttagtgcttccttcaggagctcttttagggcaggcctggtagtgacaaaatctctcagcatttgcttgtttgtaaagttttttatttctccttcacttatgaagcttagtttggctggatatgaaattctgggttgaaaattcttttctttaagaatgttgaattggcccccactctcttctggcttgtagagtttctgccaagagatcagctgttagtctgatgggcttccctttgtgggtaacccgacctttctctctggctgcccttaacgttttttccttcatttcaactttggtgaatctgacaattatgtgtcttggagttgctcttctcgaggagtatctttgtggcggtctctgtatttcctgaatttgaatgttggcctgccttgctaggttggggaagttctcctggataatatcctgcagagtgttttccaacttggttccattctccccatcactttcaggtacaccaatcagacatagatttggtcttttcacatagtcccatatttcttggaggctttgttcgtttctttttattcttttttctctaaacttctcgcttcatttcattcattttatcttccatcgctttcttccagttgatcgcatcggctactgaggcttctgcattcgtcacgtagttcttgtgccatggttttcagctccatcaggtcctttaaggacttctctgcattggttattctagttagccattcatctaattttttttcaaagtctttaacttctttgctattggttagaacttcctcctgtagctcagagtagtttgatcatctgaagccttcttctctcaactcgtcaaagtcattctccatccagctttgttccgttgctggtgaggagctgcgttcctttggaggaggagaggcactctgatttttagagtttccagtttttctgctctgttttttccccatctttgtggttttatctacctttggtctttgatgatggtgacgtacagatgggtttttggtgtggatgtccttcctgtttgttagttttccttctaacagacaggaccctcagctgcaggtctgttggagtttgctagaggtccaccccagaccctgtttgcctgggtatcagcagcggtggctgcagaacagcagatattggtgaactgcaaatgctgctgccgaatcgttcctctggaagttttgtctcagaggagtacccggccgtgtgaggtgtcagtccgcccctactggggggtgcctcccagttaggctactcgggggtcagggacccacttgaggaggcagtctgcccgttctcagatctcaatctgtgtgctgggagaaccactactctcttcaaagctgtcagacagggacatttaagtctgcagaggttactgctgtctttttgtttgtctgtgccctgcctgcagaagtggagcctacagaggcaggcaggcctccttgagctgtggtgggctccacccagtttgagcttccccgctgctttgtttacctaatcaattctcagcaatggcgggcgccccttccccagtctcactgccaccttgcaatttgatctcagactgctgtgctagcaatgagcgagactctatgggcgtaggaccctctgagccatgtgcgggatataatctcctcgtgtgccgtttttcaagcccattgggaaagcgcagtattagggtgggagtgacctgattttccaggtgccatctgtcacccatttctttgactaggaaagggaattccctgaccccttgcacttcccaggtgaggcaatgcctcgccctgctttggctcgcacacgatccgctgcacccactgtcctgcacccactgtctggcacaccccagtgagatgaagccggtacctcagtttgaaatgcagaaatcacccatcttctgcgttgctcacgctgggagctgtagaccggagctgttcctattcggccatcttggctcctcccccacccgccattatttttttggacattgtttcagctctgccgactttctcctctccttctaggattccagtgacacaaatgctaaatgttgtgctccacagatccctaaggctctgttcactttttcctctatttccttctgttattcagtttgcataatttctattatcctgtcttccaattaagtgattcctccctctgttccttctgttctgctgttgagcacaactactgagcttttattttggttattatatttgtcagttcaaaaacttctgtttggttcttctttacatcttctgtttcttttctgagagtttctatttctttgctaagtgtatttttttcattcatttcaagcattttcataattgcttattgaagtatattttcaatcatggctcttttaaattctctgccatttcgatgttggcattttagggtgatctttttacattcccttggatattttccaggttcttgatatgacaagtgattttagattgaaacctggaccttttcttatttttttctgagataatttattttatttaaaccttctatttagacttcctgtaacattgcttcatctggaagtggggacactgccttatatctgctagatggtggtagaaatctaagttcttcacttggcctccattgaaacccagtgagtcggaggctcttctttactgcttgatgggggtgggagttccctgtccccatgtgatgtccactggtgggctggcctcattgctgtttgtcagcagtgaaagtcctgactctgcagtaggcttactctgacacttccccagtggggagggggagggatgccccattactgtccaatgggaggtggaaatccaacctctccacatggtctccactgactccatgtgagtggggcaccttgttaccagccagcagagatgaagtcctggctgtcgacttggtgttctctgataccacccagcaagggtgttgggtgtctcattacaccttcatgagggtacatgtctgggtttcacacccatcctttgctggtgtaggtcaggtggggacacaatttttctgtgatgtttggctggagtatagcagttgtctgaaagttttctatcttgctaaactgctgtttttttttgatcttttgactagagggagcaggcttttgctggggctttttgtttgtttgtttgtactcattggtctatctgggctgttggcctctttgcctccaagtgtgggatatatgaaacaaaaacaactcatcaatatgttgttccttaggtcctggggtccttagccagtctgccttttctcacctttcagagtcttctcttttttaaaatctattttaataggtttctggggaacaggcagtatttggttatgtgaataagttatttaagtggtgacttctgagattttggtgcacccatcacctgagcagtgtaccctatacccaatgtgtagtcttttatttctcacccacctcccaccctttcccctgagtccccaacgtgtgtgtgtgtgtgtgtgtgtgtgtgtgtgtgtacacacattttctttatccactcactgattgatgggtatttgggctggttttgtatttttgcaattgcaaattgtgctgctataaacatgcatgtgcaagtttcttttttgtataatgacttcttttcctctgagtagatacccaggagtggcattgctggatcaaatggtagctctacttttagttcttgaaggaatctccacactgtttttcattgtgggtataccactttacattcccaccaacagtgtaaaatgtttacattctcaccacatccacaccaacattttttttttgaattttttgattatgttcattcttggaggagcgtggtggtattgcattgtggttttaatttgcatttctctgataattaatgatattgagcattctttcataggtttgttggccatttgtcaatcttattttgaaaattgtctattcatgtccttagcccacttttcgatgggattggttgttttgttcttgctgatttgtctggattcctgttgcccaatgtatagattatgaaaattttctcccattttatgggttgtctgtttactctactgattatttcttttgctgtgcaaaaggaagctttttagtttaattaagtcccatctatttatccttctttttgttgcacttacttctgggttcttggtcatgaagtctttgcctaagccaatgtctagaagagtttttccagtgttatcttctagaatttgtatggggtttcaggtcttcagagtcttcttatgtttgttttacatactctttccagaactgttcagctgcccttacagaagaatagggaagagtatgtctatggttagaaattttagataacattagctctctgaccacttttggtgaattttgacttaattttaacataatcttaatgaaaatcaatatagcatgattttagcatggtcttccttaaattactgggattagtttgtatttgtaaggacagaaatcatcctattttaaattagggaggtatactatttattactattattcatcaagtaatcattatttaacagaagaattaagttgtaattatgatgtacaggaaaaataagtgcattaaagcatacttcaaagacttacaattttagttctttttatatgccctttatactattgggtttttataatgaagttatagataacaaaattatatagccataaaatctaaaatgcttttcaaaatgaaattatttttctcaatggccatacattgaaaaaatccatagcttttttttgaaattaaaaaaacgttttcattaatacaatgaatatttagtaaaaacatactgtgggcgagacattgtgctagaaatataatgatgagcaaaacatacataggtcctgccttaatcagacttaaagtgttcttctacagtaaaatatcaaaataatgaaatgaaatcttctaggaaagtattttatatgtttttatgaatagtgctgctctggaaaattagaatattatctttcgagtgtattactccactactagatgcagaaaaattgacgtcttaagcagtggtatttattactaatgtttattgaaaataaattgaaaacaaaaattatatgatgaaatgtttcattggctatataatgggctatttccatcatttctgaaatatctcttggatttttagtattggtttagagtataaaagacagtgatggccaatgttggccgtggctattaatggtttatattagttgaaagctgtagaatcatccaagaactctattagcattagagtaacaatttaccaagacaattaccacatactggaaatttttgcagctctaattcagtattattaataatggataaaattgcatttttctcaggttgctgtgggcagcggggaattatttcaatgaatatttcagcacattattttaatcatttttccaccaaatccaagtgggcaatattttatacttcttaattcagcctactaagaaaccatggtcattaaattgtaaactatttgtagtgaggtctattccgtgatttacaacccttgttaaaaacagtgtaaaagaaagcaaactgtaccattactacggtgtaatttgatgttgcctttgttactaaactccacatgattaatgcttttagtagaaagaagaaagttttaaaaaataaaaagcagagctgagtggtataatacctgaaatatgagaatgttattattttaagtctttttcacttgtagaggaaatatatatatatatgtatatatatacacaaatacaagtgtaaaatataagtatctccaaaattatcttaatttttcaatgagaccaacaaaataacttcaattttatagaaaaatgtatttccagctatgcattgttattaatagggattactttttttccctctactcttagccaattgcatgatttctggcgtttggattactgggaagatgatcttcgtcgaaggagacgatttgttcgcaatgcatttggctccactcatgctgaagcattgctgaaagctgcaatagaatatggttagtaccaatgcttcttccacaaaaatacttctggatgtgaggtgactccttgtgtttgagaattccttctttttttttcgctagtatttaatgttctccatgtcttgagtcagaaatattttgttctgctttatccttcagcatcatttaggttactgttaatcaacccaatatttctcagattagatatatttttgtagccttcaacttatttttaagagctaaatggacttcacatagttagttattaactaacagtcctttcatatatcctaacacaagaataaaatcaatttctttctcggtgtctttcaaactttgatgaccaagacccatagtaaatactgtgatcctgtactcagacttagatattttatgtataaatttgtttctgtgtacatacttatatatactgcattaatatacatatacacatgtaatatatatacatatgtatactgtgagtatatgtttatgtatgcatatacatattgtatatattaaaaaagttttatttataacctctttatatgatattttgttttaatcccacctattcctttcagcttaataaaatagaatttaaaatcttgttataagctgccaatttaaatttccagtcctccaatgcactacaaatgaagtttgaaaaagatggtctcctacttacagtatcattaattatcacactacagtagaactataccctaaattgttctttataaactgtacaatcacaaataccaaaatatttttgtagtttaataaaaatgctgctactttagattgttttctgctaagaagtatcttaggaacatttggtctacttgcccatttttaaatgctgtaacaagttaaagtgtgatggggtatatcagaattttacaaaccacattcactaaggaaataccagtaatgaacactgtccatgtgtttgttatccacttttgttcttcaattacttgtattttattatattaattttcttttatttgggagtactaagtgagccatctgtttttaaaatttaaaaacagttgataaatagtattatatcaaatcatagtttatgtcatgtaaaaccattcatgttcttaatgaattgaacagggaagtaataaaaagacaaaatgtgtaaagcttttaaaatttcttttcccagtaagctatgaattgctataacttaataagcatcaaaatatcattaaaaatagataaggatttcatatgaaactgttatacctaagataaaagttatacagtaactttatatagtaaaagtaactatggaaaaaatatgctggaaaaaaattatagtttgtcttctttgaataactaaaaatagcacctaaggataatagccctctaaggatttgataccaactcaaaatgagttatcattatgatcttgtaggagagaatcttagaaatatctgcctacctagtagtggcatgctttataatatgatcttaaaattattaaaccttcatttcatttaaccaataatttagactttttcaccaattaatcctgaatttatctcatttgaaagtggaaacatataaagacaatttgtaacagagtttatactacagtgatatcattagtaatactgagttgccaaagctttaattgtacagaattcatattatattacattccacaatctacagattacttttaagcaaggctttttttagaaaaatgtttgtatttcttcttaaaagtgaatactttgtgtgtttaatttgtaaaataatttctaataaaccagtgtcaaagcctataagaaacaaaatttaaaatctttgaataaaatctttttcaaactgatagtcatattttaataaaatagtaactattgttaatgaacctaaagtaaaaaataataccgtaattttgaaataggtaagaggtgtgatactaaatattctttatatgtactatattttaaaatacagtatttatgaattttcaatctggatcataagcaacgttcagaacccattatctatccctcttgagttgtgttctgttataaaagaaaagaggagtatgtttttattatacctattaagaacaaagatgacacatctacacagtaaaatattcagggaatcgacatggtactattggagttactccatggtcattctaaggtcagggagtggaagactaaagagaactaaaacaattttatctccaaaaacaattatcctctaaccttcctcacagttcacaagtctatggactttaggactgagtggagagttgggagtaaatacagaggatgtagagaaggtgagtgggaagctctccctggagtgatctatacgtagaagtagagggaagaatcacaaattgacgagagaaatttagtattgtgccttcttcctacctcttaatgtgcactctaacctatatagaaaatatctcttcagaagaaataggaagtacatgtcaataattattacaaagcacttaatccagtaaatgttgaaaaacttaattcaaaacagattttgtactgccaaggacccaaaagataaggaaagactgagaaaatattccaaactggagaagaccaaaaaagataagatagattattacagcacatttgtttgtttgtttttgtttgtttgtttgttgtgacggaatttcactcttgttgcccaggctggagtgcaatggcgcgatctcagctcacttcaaccttcacctcctgggttcaagcgattcttctgctgggattacaggcgcctgccaccacacccggctaactcttttgaatttttagtagagacagggtttcactgtgttggccaggctggtctcgaactcctgacctcaggtgatccacccacctcggtctcccaaagtgctgggattacaggcgtgagccactgcgctcggccttacagcacatttttctagatgattgcagttggtaaaatttgactggggtccatgatctggatggcagtattgttatcaatgctaacttccagagttggagggttgatggtacttagacaggaatgttcttgttttgagaaatacaacggagtagttaggggtaatagggtgccatacctgcaacttctcaaaaagttttcaaaagattagtgataatggatatgtgcaggagtggggtggggggggcgtgtagatgtttgttaatattgggaaaacctggataaggataaaaatgggagttttgtactatatttgaaatgtttctgttagtttgaaattatttcagatattgtttaaattttatccctgcaagttgaattaaaagaaaaagcaatttaaaaaagtatagaataaatcatttatccactgtaaatgagcttagaaacctttttcttgtaatattaggtattagtgggtttgcagtaaaaaataaaaagaatctcatatacgttgctgaaacaatgtaaatgaggattgctggaaacaaatcctttgcaaaacattttgccaatgcacatcaagagtctcaaaaatgctgataatctttgacccaacaattccctatctaggaacttgacccaaggaaatgacttaaaagacaggggaaaaaaagctatttcaaattattcgccacagttttctttggaaaatctgaaaagcaatataatattgtgggaagactggtttcaaaaaaaaaaagaatggactcaaaaaaaagaaaacagatttcatatttttaaagaaagattttgtatatacaaattgccaggacgtccatgtaaaagttaaaaaaaaatagcctgacgtctgaatattccatctgccgttaaacatttaaatgtgtttaagtattttgaagtctggcattgtatagactaacatccaaatgacttaatgttttggagttgtatagatgtagattaagagtatattgatagcacaaacctgcaaattctgactaaactactagaataaattgaaattcaactgatctcttcctctgtgttaaataatgacactatttcaatttccctgttgttaaattctactgtgaaggccgggcgcagtggctcacgcctgtaatcccagcactttgggaggctgaggcgggtggatcacgaggtcaggagatcaagaccatcctggctaacatggtgaaaccctgtctctactaaaaatacaaaaaattagccaggcatggtggcgggcacctgtagtcccagctactcgggaggctgaggcaggagaatggcatgagcccgggagacggagcttgcagtgagcctagatcgcgccaatgcactccagcctgggcgacagggagactccgtctcaaaaaaaaaaaaaaaaaaaatctgctttgaaagttaagtgctaactgtgtagaatttctgctgaaaactttggtcaaaaaattttatattgatccacatggtagcaacaaaaaagattttaggtacaaaagaacattttatagatggaactttcagaatgtctagaagtatttgaattagttatcaaagttttcagaattttcaacatgttgtctacactgggagaacaagcttaaattacttagaaagaaaatttttacatgaccatcaaagcaatccctgggatttgaaccattgatttcgtcttatctattaatgtagtaagtatactgtagttcaagaatataagcctttattagtgtaatagaagtgaaactgattttgcagacttcatgttttaataaaaatatcttgagtcatttgattttttctaatatcctaaattcaactaaacattttaaattacagttgcattttcatgtgatgggaaggaacatttagccatcatttggatttcatgacattattttcaggcaatttatttggtgcctcaaatatattaataatatattggcaatgctttcttttaaatgagcaaacaatcagaattggatataatttcaaggaaataaaggaaaataattttatttcatatttactttgaaaagctttcccttcaatttcattattaaaacttggttgacctttttcagttggaaaatatcctttatactgatggagtttttcatgcttttttagtaatactaatgagttgaataatttatgaggttgtcatgtgcaaaagattttgtgtgatttgatatactttcagcctctggtgttggaatgtgattaatgaaaacctagaggcaggtaattttttccctgctggttagtgttctaattttgcgtgtatttaatgtgttatttaggtgttttctaatagtaaaatctcatacaagtgaaaatttaattgattaccatgaattttatggaccatagcaatggaacagtataaggaaaatattttaaaactcataaactcaccttctgatctgcagaattctttttcttttgagcaaatgagctaatagggaaatgattgaaaaaggagggttttgtatattgtttatatattaaaataaaacctagactagtcaaattctggtgcatttctagcatgtcaatattgtagttgtcgaagaatggtacaaaatcttaagtttgattgtctttgttgactgtcaattattatttaggcctctgttgccctttcataaaattacagtggaacaatgtttcatcaaaacctaagactgcaagcacctccatgtctgtgatcaaagacagcatcttaaataggtctgatcaggcatcgtagaagagagcagactgcttcagcctgaggaaaaaaaaaacatggagcaaaaatgacaaagttaatcagtcatttctttggcaataaataataagatatgctgagaactgcaaatgagaacattcttatgttcctcagagatgtgtctgcttaacacctgatttatctaagcttgtgaagccatcaagttatgaccttgatgaataaaaagcagctctgtaatgaatctggaattaaattagttttgatggtatatgcatggctactgtaatgtgctattttcagccatcaagaataagaaaggcagtgagaatagaaaaatactaagacagctatacaattgttgagaaagaagctatcaagtaatctgacttcatttttcaagactttatagttcttacaacatgtgagagagatgacttgattttgtaaaacctaataacctattggttgtattatgtagagactctagtaaacatcttcattattgttcattgataactccattttagttggtgtattattaattggatctccttatttgaaatgaaataggtaatctggttatggtttaaataatttattgaaagttaatgatgtaaatttttagaaagagagagagaaagacatgcaggaagtgtctgtcagctctttttggtgtcagtgtcatattttagtatcatagccttgtcttcaccctatggtttttacagtctcttaaaataatttcaatgggttatataaaggctaagttacaaaatattcttataaaatacatttgacagatattatgtagcattttcatattaataaatgttctaagaggccacttagttttctgttgaaggttcagattgtagattttaaacagactcagaggacttgtgtaactttattaatttaaaagcagttattgaataacttctacatactatgcacgtgctacctgctggatttggagactgagacaatcagtttcttccatctaacagcacatagtttactgtagtgattcccaacaggggcaggggtaggagtgcactgctggcatctaattggtagaaaccaggaatgctgcctaaaatatcctaccacatacaggagagctccccacaacaatgacaacagcaaaattccagcacgaaatatcaatagtaccgaagtttgaataaccctagtccagtggaaaggaataaagaaaataaacagttatcatagagggatgtagtagttcctaaaggggcacagggagagacagtgacttactgagtctggttggagtaggcttcgtacaagtaaaggcttatgaattgtctcaagacttgattatgaatttgccaggttatcggggagtaaaggcagaggtcataacagaaattaccatggcatggagacataaacgacccttactcctttgaatggccttaatatttggcatttgatgacaagtcacttcataaaggtttcagaaggtatttttattttagatgtctcatattcctagataaaacaaaaaccatttgaggataagatatatctaatgtaaatggcaagttaatgggtgcagcacaccaacatggcacatgtatacatatgtaacaaacctgcacgttgtgcacatgtatcctagaacttaaagtataataaaaaataaataaataattgaatttgcattttagaaaaaaaaagaatcagatcttctatcagttctatttggaacattcacattaatacaattctttgtgcttattactcagttgctatttttttatttaatttatacttgattgattttttttgtttttgtttttgagacggagtttcactcttgttgcccaggctggagtgcaatggtgcgatcttggctcactgcaaccgccacctcccaggttcaagcgattctcccacctcagcctcctgagtagctgagattacaggcatgcgccaccacgcgcagctaatttttgtatttttagtagagacagggtttcaccatgttggccaggctggtctcgaactcttgaccttaggtgatccacccgtcttggcctcccaaagtgctggggttacaggcatgagctaccatgcccagcccgataactgattaattttaaggtatacaaacagattttaaccacaccattcatcactttgggtaacaacattgaaggatggattttctataaactaggtctagaaggatggtatttccaaatcatttctgactgtcatggaactaatttagatcattgttcagaatcttgcttcttttagactaatttttggtaaagtgtacacacaatcacatttacaagtgattataatatacaattgtaatattttcatcaaagtatattaaaaatgttatgggagctcagtaaagagggtcgcctaactgaagaaatatattttagctggagtcgaaaggatgaatggaagtcttcccaagccaatgagtgggagagtggcattgtggaaaaagggagcacataatacaacataatgtattcaaggaatggaaaatggtactaaatgatggaacacaggatagtgtggggaaatggtatgaagatgaggctgaaacacagttgtggccctgctgtgaaggggattgtcgttaaacaatttttatttggaaaatgacaaaccatagaaattaggggacatgctaaataataagtgatagatagagctaaaactcaacccaaataccagtctcttactctacagtgtgttgtagtaaatacatttggaatttccttaactatgagggcattaccgaacatttccctgctgtaaagtttacctgctaatatttggttggcgcttacagcctatcgtctgtaaagatacatcagaacagatgaacttagtatcattcccaggatatgtattctatgccatttagaaaaacatttttaaatgttttggtgttttaaaaagtgcttttagataatctgtatcagcaccatcacttatgtatttcattttttaataattaaagagacttttaaaattttctcttccttccatgtctctgggccaattgtttgcctgtctcaaaaatctcctacccccattttccatcatctcacacttttaaagtgaattgtccacattggactttgtgatatacttaaaagaagacaccaagcctctcatggaaaaccagcccatatttattgtctccatttattttccttaaattgtctgtacaaacatgattttctccctcacatttttaaaattcttactataaattctccattgaaaattctaatctatagtaatctgatttctggttgttaatgctgtgtagagcaaaaccaccattcatttttggcataatgtaattaaaatacaatataaatgctaacttgcatgacctatcaaagcctatatgtttgggatatgccatatcccaaatgaaggccatgttgtcattaatgccaccttaattctttgacttcttgctggttccttcccctaccttcatgacccaggccaccttcacaaaaattgctgctccatcagtgatcaattagggaattgtcaggtttataaatttactaaatgtgccatggggataccaaaatcactaaatgattggattgagatcaaaaactgagaatattgtcttagtgcatatgctatctgcaagatggaaaaataaacttgtctcctatttgaaaatacatggaatggaaaaaggttaaaactctagtaaacaaggaatgctagatgtgaaaaaaaaaaaaaaaagaagacactgaggtaatgtcacttactgtgcaagaaagtctccccaccctgtcagcccactctcaagttgtccagttaatcttttttttcattctaatagttgccaaactttctaattcacattctgctgctcactagccatctacccgtattggtacatgatgcaggttcctttcctttgtgcctccctccctgcctccctcctttccttgctttctttcagaaaaacatatgctcattataggaaataccaacaaaagtgccaaaaaaatttgaagaagtcatccacataaagataactgtctttatcattttcatgtatttatttcatgttagtctttttctgtgtgtattttatcatagggaccaaacgctatgcaatgtactcatatagtcacaaagatgaatagtgcatcatctctgctctttatgatatttagagagttccaaaaagacgcaagttttctatatgttttattacgtttttttacaagtaaaatgtgccctgcgatttttagtataatgaaatctcattttaaataattaaaaatcttaacttcatggctaatcaaaatcctgtcgagtaatatcccgtctaaaatgtggagagagtctgcgtttaccgtcacgtatattcttaaaatatggtttatcaaattttctttagaaagcatagaaggcagttttctacgttgactccattaagaagattattaagttaacatttcatacttatatagtgcttcacttaaattcaataatattttcttgcacttttttaattgcatttctctgtttaaaaatactgtttatgaatttcccgtttgttggtctgctctaaaaaatattgcttacctatgaatattttgaattaggaataaatgaaattccgtttttgctgtcagaaccaaattgtaaaaatgaattgcatgactttgaaaatcagtatactctattagcaggcctgtcaatataaaaagtgcattccatttccacctcttgctctaataaccttttctctgttactctgaggcagttcacataatcagagtatattgtcagcttactggagttggggaagcatgaaatgaaaatcacgttagtattgatccaattcttttgcttgcaagtatccttgatgtccttttccagtgagcaataactgttggtgttaggtagccattttcttctcttctttcttaaattccaatcaattgtttacaagcataactaatctgaataaaaatttaacacttggaataatttccatgtgttaattcccagattgctaatgctgcacatttactataccactgaactgttttcccccagcttttcaaaacacagcctacctaaagacgtaatatttatatgtagtttaaaacaaaagtctgtacaagttcctttttggtaaaattacgtaagatgctgtactctgacttttatgtaatatagtcatgtgctaaaatggaccataagtgccatgaattactgatccacgtaaggaatagcatttttgaaccaagtttattataaatttgaagctggtgtcttgggtttttaattttatagtggtatagataatatctattttggattattcaatatattctctgtcaacaaaattaaattgaagtgggaatcatggttagatccaactcattcaaactaaaatatccacaactaagaaaggaggaattggatggttgaactatccagactttatatctgtatttattaaatttgcttagtaaatactcagatttttacctaaaatgtatttggaacaacaaatagaaagtctatttcatgtgtagaaatacttgctttcataaaataattttatattgataaagtgaggcttctgactcagtatcaggtataaaagattgagaaaatgcttgagatttctggtcattctttctaatttagtgtttttattcagtatcactaacagttttgccattgggatttttctattgaaagacctgttttcttctcctttttaaaaaaatgctattttataaagaagatgatttaattttttgtcattaatcttcgttagaaaagtgatctttcctattatcgtaatttgtttcttaaggaaggacgcacttaataaagtcaaacacaaaattaaaattggaatttagatgatttacaaagaaaaatatttacttattaggaaatgattgttacagtagactgttctagtgtgtatctattacttttatctcacagatacactaaggtaagcataaaatgttttcgaacaataggttcctcagtataagaaaaagcattctttcaggtttttttgaaatgttcaaaattgtaaacttcccagtaatagattgattcatacatattattgcacaagattgtgtcatcatatctattgtaattttctgagaggtatatttatcttaaatctttttccttttagtggaaattaaacagcaccatttagagttactaaaagcactggtctgaaaaggtatttgttgctcagacttaagttttaatgagaaaaagtaatctttaaaatttctcaaagtattcatgtaattaatgcactttaaaaagtatttaggtttggaaatgaattgcaacattttattctactaaaagagtggtagacttcgtcaaaatacattgaacaagctaaaaaaatattgagaaatggcgtataatgaaaagaatttcttctttgaaaaagaatgccatcctgttcaacagattcctgaatgtttagaaacagaattacctgataatacatttaggtaaaaataaaattagaccagatttctattctgccagtgtcctcccaaagatctttttccaaagatgaaaagaagcctatattaaatgcattatctcttcttgagaaagcagttcttttccttcaaatatccaagatactaaacatatttatataattaaatatctgtatgcaaaatcagaagtacatgtcaaatacattggtgctttatgtaattttatttaatatctttaaatgaataaaatagttatggaaaacctacattacatttaaaatgtaagctatttatactacattcaatttccaaagtacttcctaacacctgtacttcatgctatcattcctgtcttcagggagcatccaatctagtggaggagctgaaggctcattcacattttaatgaatacgaacactgttataacagcatggtggaaggaagaatagtaactccaactgaaggaaaggaaactatcacttgttgaatacctgatgttggataggcattgtgccaagaccatagactcatgctttatcttgagttttttaatcctcagataagccagctttttttccccctctttacgtaaatcttatgcaacactattataagcaataaagcattaactatgttctttttcagttttaattatgtattcagtatactttttatcctcttgttttatttattttatcaaaattttaataaacatttttgaaagcttactatgtaaataatctccacacatttccattgtctcattttaactttgcaataatcctgtgaaagaaaatgtggaaaatacttaatattactcttctacaaatttggaaactgaaattaagagattggtctgaatttttttaatgtttctaatggatattagtggggaacaataacttatgaatggcaaatcaaatagtccaactctcccacttatgaggaaactgtaaagtacatgaaaagtaacttaactaatgtgcatgtaaaatgactaatatgtgaagtgtgtttatgtgttttcatttactcaacaaacatttgttaccattttgacatgtgaaattaaagtccagtagagaatccctaaaataaaaacactccaaaattgaacaatgataagatatgatgacttaattctaagatataaatgtttatatatatatatatatatatatatatatatatatgtatatatatatattatatttgaagttctagggtacatgtgcacagcgtgcaggtttgttacatatgtatacatgtgccatgttggtgtgctgcacccattaactggtcatttacattaggtatatctcctaatgctatccctcccccctctccccaccccacaacaggccccagtgtgtgatgttccccttcctgtgtccaagtgttctcattgttcaattcccacctatgagtgagaacatgtggtgtttggttttttgtccttacgatagtttgctgagaatgatggtttccggcttcatccatgtccctacaaaggacatgaactcatccttttttatggctgcatagtattccatggtgtatatgtgccacattttcttaatccagtctatcattgatggacatttgggttggttccaagtctttgctattgtgtatagtgccacaataaacatacgtgtgcatgtgtctttatagcagcatgatttataatcctttgggtatatacccagtaatgggatggctgggtcaaatggtatttctagttctagatccctgaggaattgcctcactgtcttccacaatggttgaactagtttacagtcccaccaacagtgtaaaagtgttcctatttctccacatcctctccagcacctgttgtttctaagatataaatgttatacagagatggaaataatcaacctgactgaatcctgaaggaataggcatgtaagagattttatgtaaaagaaattacataggtcggacttaaagatttgagacaatgtggcatgtatgcagacaaaaacattcagcttttagagaatatgaggtgcaaagaggccaaatcagtaaaatagtgaggttaaataagcagaagctagatcatgagctttaaaccatatgtttaaatggtacaaataaaataacattgaaaatgtattattccattgttgatatacattagatagatacacatatatacctatatatctatataaatatacctatatatataacttttcaataaatgaaaaccccattgttccacagtcaatataaataataatagcataagctggtgaaaagctgagtctacattaaaactggcttattatgtggttatatctcttttctttgtgtgttagccacacatatgatttatagctaacctattgttgtgaattacttttttctttattagtatagatgttttagagttgattataggaggatttcttaaacagaaataaaatactgtatttttcttacattaattgtttatatttatcaatagaaaagaacataaagggcacatgaactaatttctttgccttgatcctgtggccattccaggtagacatattctttgatgtcgttaggaggagttcatgtctccagtttgtcatttctgtgttttaacttatgcttatttaaaataacaacaaaactttaaaatggaaatttaaactatatcaataagagtaacaataatactggaatatagtaacaatactagaaacattttagttctgctgttacttcacctttaaaatataccttttttcacatggattcttggttattaatagaaattttatgaaaaaggaactttagatttctgcaatgcaatattctgtattacataacattttcatatacagagctttatatatatatatatttactaagaagtcagtctatggagtgctttcatgggttatttctcacatgatgtagaaaataacataagtgcggttttggatttagcttccttgagctataattcagtggcattttttctcctgaaacttttaaattttgtggtattttaatgttttcataggcaatagcatatatgtctatcctacccagctttacacataatatacattttcagatccaaggcgttctggtagtttgtggtattcgcttgttaatttcttgatgaatggctaaagaggccaaaaagtgcactcagtccaacatgtcttctgaagatagatgatctcaaataaattctcttcccaatcagattttgatttgttgggtgttaaaccaattctttctaaggacagtgtttacaagccttgtaatgagacagccctttgagaccttccctctttttgcctgtaattttgatgaatgaaactctaattcataaaggatattgtgattgaaaagcacctttagatctcatacactttaatttagataaatgtttggtgcagtaccatgaaatcaggaagtttgctgagctgcaaactgataacacttcaacaaggatgataagcttagtgtgttgatatggattagtttactatatatcttttaaagtcatgattgttttactgctttaaaaccagaggggataaaattgaaagcttgatatacatttcagagctcacctttcttctactacattttcttctttggtaaatttttattttggtaatacaaaagtaacataaagcttttttactgacaaagattacccatgatttttatataaggaaaaacttgctttattagattactcacacttaaaggcttttttgactttattgtaaaaaaccaagttacttttcatgtaaatacatatattctccggcttgccccaaactaaaggcaaatcactgagattctgagataccctgggaacttcagactttgaaatatgcaggggtaactgtaatgtctgagtttatacatttattcaggatttatgagggcttgctctgtgctaggcagtgtgctaagtactgagaataccaagacaaaaacatgtttccagtcatgaaggaacttggaggcttttgtggagttaaataagcaagcagttacaatatctataaattatgcagtagcagggtttacgaggtatggtggaagcataagggaaagagtacacaagtgctcttaagaaatcagagaagggaatggggtggtggggtgaacttgaacttcagttcagcacatgtttgtggcagaactgctgggcaccaggcactgaagctacagaaatgggactgaggacagacacatagtaggtaacacctatacagtgcagttgaattatgtgtaagctgttaacgtgcagtagggtttgttaggaaaggcaactgaaggaagtgagtttttaagggcaagtagcaattagccaggccaaggaggaaaggtaggaacataccctgcagagggaataacattagcatgggtaaagaggtatgtgaaagcatgacatattttggaagctataagtggtccaatattgctgaggaaggtgtggtgaaaacacagaactggtaatgagaggataaaaggccttggtaagccatgctaagaagtttggattttatcctccagtctaagtcttgcattaggtgttcttgactgggaggagttaatgaataattttaataggaaaatgtcctcaatttatttgtgttttataaaaatcactctgacaaaagtatggaaggcggtgtgagtcaggcagctgttgacaccctctagaccaaaaacagtgatggcctgaactagggcagtggcagtcaccatgcaggatgaattcctaggtttctgctaaagtacatggttggccaaaataggaggaggagaaggagcaagagacaattagctcagtaagagaaatgttcagttaatagtattcaggcaaagtccagaaatatagctgagaagacctcaggagagatttctgaattattaatcattgggtttccctcttttgttctcaaatgatgcaagctctatatttctgtttgccaagaagcaaacaagttataaagatagctaccctcagaagattactcttgggctggctttatatcaccaaaaatcaaatagaattaagataaggttctgaagcattcagtgatctatccctaatcttttattccagaaataataattatctatgggccagtggaagaaaaatacacatggaacccatttaattcccctcccctccaatgtagcattgatttgtcataatactatttgtctctgaagtatttatcaaaatatatgtctaacaatctatttatacatttaaggtacgcattaaccatgtgctctaaatgtggttatgtagtaggagctaggatgacagactatacctcttagccagtgatactctgtaatggtattgtgatgtgactatgttcctcaacatgtgtttttactctggcagccttttgagtccattttttcatattttagcaaacagaattagcctatattcactgagaaaaagaagtatacaaactgcaaagagaaaaaggaaaaaagccaactattttacaatgcaagttgtatgacagccagatgtacttgcaagaaaatggttgaggctgggcacagtggctcatgcgtataatcccagcactttggaaggccaaggtgggaggatcgcttgagctcaggagttcaagcccagcctgagaatatagtaagagcccatccctacaaaaaaaaaaaaataacaataaaaaaaatagccaggcattgtggtatacatctgtggtcccacctactcaggaagctgaggcagaatgattgcttgagcctgggaggtcgatgctgcagtgagctgtgatcatgccactgtactccagcctgggtgacagaatgagaccctgtctcaaacaacaacaacaaaatggttgagcaaacatcaataggcagtaatggactgttggaagttctatggtctgggcctgggtgaattgaccaaaagtattgtacactttcgaccaaaggcatgacatcatttggagagccattgtttatggtccgacaccataatgtcccctaaaaatataatacaacaccatataggactgatttataaggctcccatttccaggaatatatccaccaccccaaatgagatatgaagacattttcctagttaatgctgctccttgaaggctatatcctaatacagaacacagtatatgacaatgctttcttctaaattgaatttcagcttcaagtgatatagaagtatttcatgtctgtggtgtttgtgtgggtgtaggtggtgtatgcatgtataaaatttgctttcagttcagataattttatattaattgacacctgccaaagcagatgtttgaatgtaaatatgaaaacatttattaagcagtcaaattcttgagggattcagatgcattcgtttctaacttaacgcattaatgccaggtcaaatcttgcaatatttccagtatttcagtttttctgcttattttcatgtgttttggttttggctttttgtgtttttgtttgtttgtttgttgagagggagtctcactctgtcgcccaggctggagtgcagtggcgcgatctcggctcactgcaagctccgcctcccgggttcacgccattctcctgcctgggcctcccgggtagctgggaccacaggcttttggctccacgcccgtctaattttttgcgtttttagtagagacggggtttcaccgtgttaaccaggatggtctcatctcctgacctcgtgatccgcccacctcggcctcccaaagtgctgggattacaggcgtgagccactgcgcccaaccagctttttgtgttattatatatagcaaaataaggctatcatttcagaaaaaccagtatttatttcactaattgctaaagaaatagctattgtgaagaagcttttatgtctccatcatttctaactccgcctttctgtaactttccaatgatcatttttcccctcacatgtgaatggtttctcgtttgctgcatacttatccactttcaaaaatgatcttctaattagctaattagcaattgattagctaattaagacaaagtataattatgtaaaatagtgtgattttaagaaaataagtttggggtgaagtacagactttttgtgcaacatgcactgatcttagagccctaagacatggatcttcgagtccttagacatggtagagttcgtttctctaccactagcaactgctaggttcctccaaaatgcatgtagcttcctctgcctgtttcctcatctttaaaataagggtagatcattacagctccgcacaccccatgtttctcacagaaaaccaaacaagataaagaaggttaaaatgttctgtaattgtaaagtaatatgtaaatgcagcatataatttaataaagcaatcaattatttataatacctactataagcagaaacaatcataataacctaaatgattatatttttgttgtgattaggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggtaaattttaaaatatatttttcctatttgttgtaaataaacacaaagctactgaattcaaaatctgtctcctagtaaataaatgtgtgccaatggttgtaacaatgctcaatcacatgaatgttaaaactctactttatctcatttctaatattgaagagagaaccccaaagaaatgtgtattttattggcaataaatgaatatcatcaaatttctaggtaatgaagagcaattttttatatagaaggaataatacacagtatcagttattcacatcttacggcctatattataattgggaggtgggacagaatgacagtttcattgatttacgtgtatctccaacatgctaagagccaaggtccttttcccaggtgccaattgaatttgccatttcctcccatttgtcactctaaagaatgtctctctccactcctgttttgttctgtagcctcatattgctaagccactagcagatattctttcccctaccacctcagttttaccttgtcatgatatatgtctgagatcaattctggatgtgattctacagtgagcagatggggtatagatatcttagtgtattcacccacaaccttttttgggttttaagccactttgagaatctgatgaaagcaaatggcttcatgaagaggcacatacaattctgtacacaatgtcatagtggtcactgacctccagaaaccagtccatggaatcatatcctcaacctcaccttaaaaatgcctgcttcagagtctcaaaaagtagctgagtcttagttctatacttgcagcccacacaaggttgaggtggcaggtggcaatagagaggtggacttatatttataattcttgatacaacataacacttgttgcaaggaacatactgaaaattatctggcatggctttatgaaagtctctagtgatttctttctactggttagagagttctcttttcatcttcaaagagatgttactgttaattataaactggagatagcacattattctcccttttctagattaagaaagaaaatatttaataagtttattctaatgctagttcctagatatttctatattattcacatttctgtattataaaaactattttttcgatttaaatgtactcttaagtctgtgaccaaatgtttgcctcaaattcttaagtaaatgttcaagttttgctttcgttgtttttgtggtttgttttagtagctcagagattttatatgaggccatttggaaatttaagctaatgaaggtcattgattctgtttgcccacagatgtgttttcttttctgctggtctcattcttcatcttaaagaatacagaaaattcacaaatgttatttctgacccttttagattatgtgttgtctttcctattcatatatgctagcagagatgtttaataattgtacagttcaaattagactccctggtcctttgttcctactgaagataattaattagttagtatagatttgcatagtcccttaaagtttattataagactgcccagtaatgccagtggcacaattcaacaaagactaataacctttttatatttctcttctttaatggtagctaattattaatattaatttatttttataagaaaacatcccccaaaaaagttaagttcaaacacctaaagaacagtgaaaatatgcttgaaataaactttttaaaatcaaattatatggctcctgaccaattcactgaatcaagactcctctaatttctgtcttttaatggatttgtcattgagcatacctgttcctatccataatatacctggtcctaactcatactcttctagcgggatccttgtgtgttacagctgtcctaaagtattgatcctctgcctactctgtagagttcattttaaaaacagcagtctacaaatatactctgaaccttgaatacagtggaaaagaagtaagggatgggtgttttatgaagggccacagaaatatgctgcataggttataagaatagatttattttgtaaatgctgaagcctattaatctagactaacataatagttacaatgttacataaaattcatttttagaactttgttacaagccagaattcttaggtttaagaaatcagctattggttaaagatgcagattacatcaatacgtaactgtttttgccctaagcaattattgtccaaatcatggttatctctgttgcagaaattaaaatttgtttaataataatgtctgtcttactcataacatgtcattctaagtagcctgacagagctgtactgcctaaagaaaatgtcacccttacaggagacttaaattcaaattaaaacccaggccaggagtggttgctcacacctgtaatcccatcactttgggaggccgaggtaggcagatcacaaggtcaggagatgaagaccatcctggctaacatggtgaaaccccgtctctactaaaaatacaaaaaattagccaggcatggtggcgggcacctgtagtcccagctactcgggaggctgaggcaggagaatggcatgaacccgggaggcagagctcgcagtgagccaagatcgcaccactgcactccagcctgggcgacagaatgagactccgtctcaacaaaataaataaaaaataaataaaaataaaaaataaaaaaacaggaaatcctaaaatcggtgtacaatattaatataatcttatatttatttgctatctcagaaatattatataaagtaaaaagtgcctatttcaatctctgagataaaaatcacaggtttatcttttcatgacaacttaatgaaatggcttgcatattattagtatgagaaatgtactttcaaatatataaaagtaattagagttcttagattttagaatatatatgaaagaatacatcatttttataattgtaaaggtaaacctaaacctgctgattagcatactacattttcctgttatttacaaaaccccgttttgctgacataggcatagagataagcagatatgcagtataatttgccaatatgtaataagttaaattcaaatagaagaaagtatgctaattagtacagaaaacttagagaaagtactaatttagttaagattaattctgttcttattttaattcaaaagatagatcaatttctgtttataaaaaaaaaaaaaagaagaagagaaagaagaatatctggcatgaagtactaggagccagacatcaaaaccagcttttttcgacatataaatgatgctgctattatagatttaacattttctgtaaaaggaaaatctgtattttctgcctgttgagaactgtttaatagcagttactcttcagtacatttacattttcatgtttttaaaactattttccttatagctgaaaatattgacaaatggatatggtgagcttctctaaataaaaaagagttcggcttagggttagggttagtgttcagacagctttgtgtgcagtaacccatttaatctaaacaacaacccaataaggtaaaaattattaccaccaattttggaaataaagataaagaggtcaagagattaagtaacttgcctaaggttaagaagtaggcaaaataatatatttccttgcaaatacatagtatatggtttgaactaaaatataccaaatagtacatttaaatgtgtgtatgtgagtgtgtttgtaggtatatatcattaaagactcttctaaaatgatgtgaaaatgacatcttctgtttataactcaatttttacactggttccattacattagaagtatatgaatatgtataataattaattttagttttgcttatagatagtctatgtgtggtccaaatcaatctggtaagttaaaaactatgataaatagaatgcttttagtacaattttacttaatgttggccttttcttatgtttcctccattttgtctggagttttctagttttaataaagataaaatgttccacaaaattctatagctttaaatgtcatacaattttatgtttcacttttagttccctttcttcccaagctgttcgtctcaagaggcaagttaaatgtgtgtgactactaattacccaatttattatgtattgtagcaaatggctaatatgattataatatagaagtatgccaatcaataaagtaattattatattaataaaacctaacttaatttactttaattgcatttttagtttgtagtgattcaccaaagtgaattagtacctaaatcccatatgtgactaaagatttcaatttactaattttattttttactgaaaacattgagattggtataattcaatgaattttaatataaaatcttgattacctattttaatttgaaatttagcaagttgtttcttcaaataactattgagtaactgaaattcaagattaactcaaatttatataaattggtaagtgaaggatttaattaaattgaaaaaatggcatcccaccaatgaaacgtatttcatttcttttagaatggtagttctgtcacatatgctgagtgataatagaaatattttacatagtgtaattggaatgtatataggttccttattatttcttccaaaagttagtaattttactaatttagggaattgtgagttaatgataatgatggttctttatgctttgttaacagttctgtaaattgtaataattttttttgtttgcatatatatttgctgttagcaataacaacatacgtatattgttattagtttatatatatatagatatatagatatagatatatatgtttttattaccaacagtccacccatgttaatgtctactaacttaaaaatttcacaggcccaaactaatgtccacacttcttcacctgcaatatccttcctatttctctgttccactccctctcccatctcctcctgttaaaaaccctacccatttttaagacccatttaaaacacttatgaaatattcactggccagtcatatcatctccataatattttgtgttagcatttttttttggaaatagcattattgagatgtaattcacatatcatataattgacctgtttacagtgtacaatttagtgattttttggtatattcattcacagagttatgcaactgttaccgaaatcaattttaaaatatttcattactccagatagaaaccttgttatcatttgcctttcttcaccaattttcctgttccctctttcgcaatcctggacaaccgctaatctactttctgtctctatagatttgcttattctggacattgcatacaaatggaatcatagatagactttagtgtctgccttctttcacttagcatggtgtcatcaagccctttccatattttgacatgtagtccctttttttgttttttgagatagagtccctttccatcacccaggctggactgcagtggcgagatctcggttcactgcaagctctgcctcccgggttcacgccattctcctgcctcagcctcccgagtagctgggaccacaggcacccgccaccacgcccagctaattttttgtatctccagcagagatggggtttcaccgtgttagccgtatggtctcaatctcctgacctcgtgatccgcccaccttggcttcccaaagtgctgggatcacaggcgtgagccaccgcgcccagccgcatgtagtcctttttatggcagttattccattgtatggatacaccacattttatttatcagttcattagttgatggacattcaagttgtttccaccttttcactactatgaataattctgctgtgaacattttacaaaatttcatgtggacatatgttttcatttatcttaggtatattcttaggaggggaattggtgggtcaaataataactccacgtttaacttttagactatttaccgaagaggctgcaccattttgaattctcatcagcggcatgtgagggtttcaatttctccatatcctctccaagacatgttattatctgtcttcctttattatagccgccccaccacattttgattgtatcattcttaagacacataccacataaagccttgcattgtagctgttcttccatgttttctctgtccttttagactagatcgcttaaagacagcattcatatactgtgtagctttgaaccatgaagaaatctcctaacgcaattatttgccctcaaaggttcccacttaaaaatgttatgtaggtaaactggaaagctgagataattattgagttagtttatatcaaaagacaaaacaaaacttacgagctgttgaaataaatatttgggggctcaaattatcagactatctgctcatactaactgaattattcaaataatttcaatagctcataataagttttgttttgtcttttgttttttggtataacttaattataccaaaagctgaatttcaattcagctcatcacttgaattttccaggataggaacagctaaagttaagctaatctttattgcatttccacttctggtaaacgtgtcattttaactaaatgtctctgtaagttccaatttataaggtcaaaataccgcacctactgttactgtaaaaaaaatttagcaaatagaaaagctgttctatatccaatggattgtaatgctactttgatattttttaagtaattagtacagggagatagcaacacaaggaagaagtattcaaatgtaagtgttggattttttttaatttgggtttttcataatggtaagtttatatttctttaccaccgcccccccccccccacacacacacacacacacacttaccaagttaagaatccaaaattcagaaaagtaattatgtaaattaagaatgagaaaaatacagaaggaggagatctactaaaaggctctctgaagtgccagtcatctccttcatgacccactttgttgcccatgacacttcccagttgtaccttccctgatttttagagggcaatatattttcaagctgtttttcttcttgtaaactggttaggttgtatacatattccatagctattgttctactagttcaaaacaaaatcaggtatccagtggtgaaaacagggctggtaggtggaagagggggcattatgtagaatttttcttaaggctgaccatttctgccttcctaaatgtctttttgaatgcattcacttgctcatttacttaaccattaacatcttttgaatatctactaaatatatagaacattggtactcagattgtgatagaaaaaaaaaaaagtcctcaagagaattagctctgctaccactacctctgggtaactcaaataaccaggaagttatggcagataatgtatcttccctaagaaatgaaagtagacagttgaaataatcagcttggcagttagaccttcagtgtcctaacttcaaatatccagataccacaggcaaagttgtttatatataaattgaatgttttctacaaactgagctagatatgagaataaaacaaaaatgtagagcatgtgggaagacgaaagaattcaagattctggggaaacataattaaaataaactacagaattctaaaagctaagagtttgtctaagaatatgttctttaaaaaagaataatagtataagccagtggcacagaaaattttgttgtaactgttgactggaatacttactatgggagagagcatgttcagtgcagatagactcaaatccatctgcttaagcctaactctgtgcattgcaattctgatatggtgaatgtaacattctgtctccaacaaaactagtattttttaaagattcctccatatttagttttatttcatttttagttacagagtctaactagaagttattcaacctgatacttgtatttagggggaaaatatctcttaaacattctggattctctaaaatgcgttttgctcagaattttccccgtattttttaaacccatgtgtattttaagggaaatttaatccatatgtccctgactcactcacacttaactcatcaaaatgttgtttagtgaaagctatttgatgttcaaaaagccttatgagtctttatgagtcttttttctctctttgaatgaggaagttgctttgccagtcataaatagtatacccaaaggattcacattcagcttcaaacacagaattcacaaagctcttagagacaacattaatacatgcctatttcttataaaagctaaagtatttaaatttctaacttaatttttatatcagttaaggtgttataaaaataaataaaagcttcatcttgaatattgagcctctttgcctcttttcattattttcaaaaagtctacaggtccttttagaatgtgcaaacattttactgtaatccatatttatttccataaacatatgtccccttcaaccatgattccatcatctatgaaacactataaggtactcttaattgtaacaacatccttgataaccaaactgtgtaaattaaaaatataataaaaagacacaattcaaccatgcttattagacattgtcttagttcattttctgttgtttataacaggatacctgaaactggacaacttataagaaaagaaacttattttatacagtcatggagactgagaagtccaaggtcaaagggctgcatgtggtgagggccttcttgctggtagggactctctgcagagtcctgaggccgtacccggcatcacatgtgaggggctgagggaactcacatgctatctcaggtctctctttttcttcttataaagtcaccagttctactcccatgataacccattaattcattaatccacaaatggattaattcactcacaaggacagggccctaatgacccagtcacctcttaaaggcaccacttctcaatactgccacattgagggttaaatttcaacctgagttttggaggggacaaacaaacatatttacacaacagtaggcatcaaccataaatcatatataatttgcattttttgttaattttaagaataaaagccaccctttgttatggtcaggtgtttcacaaaccgtactcataagatctgttctttcttaatacagtgtaatagttgaaacccattttgattttctacttttttctctgtatggagaatttatcataaactaattcctctacaaatttatagtcatactgtctaccaatctggagaatggggcaataaataactaacttaccaggaaaccatatttttctatatggaggtgactaagctttcatggttgtttttaagcatgtgaatgaggatattgatcacctactgaaaatatgtgggtcatcttgttagatcacatttgagggaaaatgcaagataacaaaacaattttcctagtatcaaattatggatgttagcaacttggaaaggaggaagagtgagctcttcattatcttgtcactgccatacctaagagtgtcctggtcctctccctgaaagactttgccgcttactcaaacataaagttaaaaagagattttgccactacagttagaatagtgctatacagaaggatcaataagtctttctgcatactgaaaatattttgtttaattagtttatttccatggcttgatgttgcagagccagaatagcagctatagaaatacttaaacaattagccctaaggacaagtatttacatggcaattaatttacaaatagctagtccagtagaatatgttctatcagttcaagtcatcagtccaataaaaacaagtcaattgttttctcttagaatagaatctgattagaatagaaaatgtcaagattcacacaaagtagggacaagacctggaaggacctgttggacccttattctctgatgctagatcgaaacttcactcgggtgaatgtggttgtcccaccaaaacaaatataagtatcggatatcaactctatgtaagacataatggtgagtgcttagagtaaaaagacacatatgatcaaaattctgccctccaggaagttatagaggagaagagataatgaaaaaaatagttaacctagatatagaaaggaaaccattctaacagaaaacacgatcctagaataacatggattctggaaagcctttattagaatgggtatttcctttcttgagtcttgaaaaataagttaaacatttagagagttgttgcagatggcgggaaatgtatactaaaacattaacttctgtgtgaaactacagtagttctaaattacttaggtagaaagcatgagtcagggagtctctgaagttgagactgacaagcgcttggggagggagctttatgtgccttaaggaaccttgtttttatcctgaaggccactgtgagactgtgaaagattttaagtatgacagtgatgaatttttttaaaaaaatcactctggcccttgtgtagaatatgcttttaggatgcccagacttgaggtaagagcttgacaggaggctgttttccaaagcagcagtgatgagagcctcaagtaaattggcagcaggcaggagaaaggagaatgggacagctaccaaaaagaaaaaaaattagaaggtaatttgtggaggactgtaataactgactagtgcagggagtaagaatgaggggaatcaggcctgagaggagaggtggtctagaagctattaactgtgtgtgggaatgtgcagatgcaaggtcttctgtgggtgggagatgaagatgcgtgatctgttgggcctccaaaattttcaaaagaatagaagtttgaaatttgagagccaagttgggcatggagttcataatggaaaccagtgagatcacctaaggaaagtaagaaaataaagagagaagtagtaggccaaaatcagatgccctgtggcacaaggtttaaagggcagccaatgaaggagagcccataataggataccaagcaggaagtaaagtagtaagagaaaaggaaagaatcctatgcttacgagtcaggaactctggctcagcatttttcaaactaatgctccttgtaacacaggtcttttgaaagatgctaatgagaaaaaagaaactctatagttaaatatgtttggaaaattgtgagtttaaaaataagttgcaggccaggtgcggtggctcatgcctataatcccagcacttttggagggtgaggcgggaggatcgcttaagctcaggagttcgagatcagcctgggcaacatggtgaaaccccatccgtacgaaaaaatttaaaaaattagccaggtgtggtggtgcgagtctgtggtcccaagtactcaggaggctgatgtgggaggatcccttgagactgggaggcagaggttactgtgtgatggcgccactgcactccagcctgggtgacacagtgagactccgtcgcaaaaaaaaacaaaccagaaaaagttgcagactttttaaattgatggactttttcaagcctttaacttactaattaatgagtatttcccaaacatcttggcctaagtagaggttggactgaaactaaaggagagaataggagtgaggaactaagaaatggaaactcatgtctagagcttaacaaagaagggaagaaaggagatagaaataagagagcagagggggcaggggagggtaggactagtagcacagatagagggggtaactacctcaaacaagaggaaagatatatttccagaaactgctgaaaaacagtttaggataaatgcagacagagacagttaaggataaatgcagacagagacagttagggataaatgcagatgtagaaaaatctgtagatagaggaagacaaatgaaaaaaatttaatttttttccaaaatatgaattcttcatttattatataatcaggatgaacaaatatataggtgaacttttctagaaaaaaaaatccgtatatttaaccatcttctcgggagaatgtgtgacccagaaaaagggtaaaccccagtgctctgcactataatttctgagctctaatctttgattccttaacctacaaagtctgacattcaagtatatgtatgatttttccgtttcatctcacactgctttcccttacacatcctcatctctggccaaacttatttactgctcatttacacctacaactgtgtttttgtccaaactattcccccttgctcacaatgctctcgaagaccacaacttgtccaaatttctacccatccatcacagctcactacagatgtcactgccatcattctatcccaactgctcacttccccaccaaaaataggccggaaatcatgattgttctgtgaatgtccagaatttttttctgtccctttcttgataggaggcagcgtatataacaaataccctgactttcgaatcagatcaccaattttgaatcctatctctcatttactagttgtatgacctctaaattactccaacccagagtctcattttcttatctgtaaaatggagatgatagtagtgctatcacacagggatgttaagagaaataaatcacataaagtgccttacacagttcttagtttaaccctttcttccttatgtcataattattcttgtgtattctttaccttatactataagctctttgtgggtaaaatgtatgtcttatacactgctgtattctctccttatatgcaaaaacaatatactactcattaattttcgttgactacgtgaatgaatgaatgaatgctgaattaaatatgtctctacacatttaattacaaagagcaagcaagttatacactaggaaaaatacgatagtcataaaattatgccatttaaaaccataatagtatgcatgtaatataactagaatgatcaattacattataactctcattggttttcagtatatttttaaatttatattttctctaaaatacagttatcttttatatttataaagaaaaatttgaaatcaatttcagaaaaacataaaagatgtaatatattaatttaagtgggcttttactatgacatataaatgcaacactggtatatatcattttctatattcaattccacaaacacagattgcatactatatgacagatactgtaataggtgaacaagataataacccctgtcttcaattagcttgtgccaaatgggagaaacagacttttaaacacatatatttaatatattttaagtgccataaagatatggctaggaaactatggaaatataaaggcaagctacttaatccaacctaggggtgcaaagatttaaatcatatcctctggtttattcactcctctagtctagtagaaatttactcttcccgatcattaaatgatatcccagtgccgtaaaagagtcaatactcttccagaaggtgaaaaatgtattccatatgttgaactaaatgtaatataactggaaacagaaatctcagctggctcacttattaaatcaaaaggcagagcaaattttcacactgaacattgaaactatcactgttgtttagtactttttgtattagaaaataactccgtgctattttacttatagtatatatgctttgtaagctttttcttctaggaaatcacacattgcctttgcagaaaatgcagcagttttttttttttcttttttggttccttgtaacataaagaattacctgctctacaataaattggtaaacataaatagtaggttaaagttagagcatataagagtctttctcagtactttttaaaattatgtattataaatacattaaggtgggattttagataatagtgtaaaaatagatgatctactatgatgaacaaataatatgctaaatttcagtattcagttgctcatataagagggctccattccttccatgtctgttttagactgtgctaagttgagtttttcagatgtaggtttactctcatctcaaaacacctaatatgtgttcttcatctgtctcattttatacaataataatctaaggaaactatgatctgtggggataattagttattgttaatcttagtgttaaggatagattatgctcaagaagtcacctagcagcatcaagaggccaattcctgaaaacagtgagcttttgtgtaaaatttgagtttatagaatatttataatggatagtttaggggagagtacattgtgtctttgtgaatatgttggggaggaagtagtactgaagtttaacttcataacccttaaggcattgtattctatgagttgttaaagtatttttattttattcaagcaaaaacatcctgtaactatttccatgcaaaaaaagttcagggctggagtgcagtgtcactgtcatagctccctgcagccttgacttccagggctcaagggatcctcccacctcagcttcctaggtagccaggacaataggcatgtgctaccaaacccagctaattttttaaatttttcatagagatgagatctcgctatattgcccaggctggtctcaatctcctggcctcaagcagtcctcccgcctcagcctgccaaagtgctgggattacaagtgtgagccaccatgcccagccctaaaaaaaaagtttgaaaatttcaaaataccattgctctgaaattttatctggacagctatcaatattatttgtatataaataaaacagtcactatctgtagactttgctactatgatttttttttatttccttaagatacttcagtcacctgaaacccagagaaccatcctggatatctaaaatttgggaatctaaaattttttacagtattttttctagaacttcccccctccatgcacatacacaaatacctccatttttataatgcccaaagctttcctaggattccaaaacaaagttacaactttattatattcttcagtaatttgttttgagattaaaacatcttattatttatttctatgggggagaatgttttagggaaactgactgtaccatacttaaaaataatgagtctatggccaggtgcggtggctcagacctgtaatcccagcactgtgggaggccaaggcgggcggatcacaaggtcaggagttcaagaccagcctggccaacatggtgaaacaccatctctactaaaaatacaaaaattagctgggcatggtggtatgcacctgtaatcccagctccttgggaggccgaggcaggagaatcgcttaaaccgggaggcggagcttgcagtgagccagagatcatgccactgcactccagcctgggtgacagagcaagactccatctaaaaaaaataaaagagtccaaagcagtgacagatattttagatatgttcagtcactcatgctatgaattatttccctacaatgtataccactttataaaaataattgtaaaaatttactcccttattatatttttgtcctgatttctttggaataatattattttacattgaacataaagaatttcagattagttttagttcttctaaataatgtcaggattttaagtttaataattctactaagattagtcaatgtttattatcccaaaataacaatattttacatgttctaaaagcaaactgagcatgtagtttccaagtaattgaagctgaagaaaatccatatagctaatacaacttttaacaatattaaactaaggttaggaaatattcaagtgattctaaaatacattataattttatgtaccctaaatatagtttaccaattgaaagtcatcaaatacttctaacaattccaattttaattaaactccaactcttttttttccatacgtagtctttgctgtgctttacattgaaagttgtaaagaagcttagcattacttggaaatttaatagccatcgttgccttttaatcactagaatgcagtgtaccccctcctgaaaatgatttacaccccccccccactcccctcccctgaaaatgattaatccctgcaattgagaaaaagaaaaagcagcctctgacctctgggaactggcctgcctatatctaagcctcattctttttgagaactgtcctggagctcacagctaggccatggcgttctcttgttggacataaacaacctcacagagcaccaacttcatacagggttgtgtgatgatgatgtgagacaaaaaacaactttataattttgactaagcacagacaaaagcaagatcactgtgcataccacaaaaataccagacattcccctcttttggctaatatgagtgactgctacatctcttcaattagagctttagcatacatacatttagtcttccttccctctagataagattgattgaaatacttaatcattgaattatttctgatgcctgacagagcccaatccagagcaaagccctgctttcctgaactcttcccaaaatcacttaagtaaaatccagatcctacaatgagtcttttaacacccctaagtcaccccatggtacttattgttgtcagtttctctcactgcaatgagtaataaaacccacttgttcaactacagatgtgttcttggtggtctttggcaagaaagcattgacacatccaataacttaaaatttgtgaatattggactattagttctgtaaaaatataaaagagttttgtggccgtgcacagcggctcatgcctgtaatcccagcattttgggatgccaagccaggtggatcaactgaggttaggagttcaagactagtctggccaacatggtgaatccctgtctctactaaaaatacaaaaattagctgggcacagtggtgcgtgcctgtactcccagctactcaggaggctgaggcaggagaatcgcttgagctcggggggcagaagttgcagtgagccagagattgagccattgcactccagcctgggtgacagagcaagactctatctcaaaaaaaaaaaaaaaaaaaaagaattttgtaaagttttaccaaaatgtcagcatattattaagatttctgtgcttgaaatttttattttcatcaagataatctaaacccacaagtatttaacattctacttttaaaatatatttgataaattgtttcttttttaatataaaatgtgtactttctactgtaggtccatgatgaggtttaccatctcaattggttaaagatcttacagctctaaagagaagttattattttaaagattcattatgcttgggcggtttttgttctagttcagattttaaattagataaatgggaagtaatacccctatacttctttcaaaaatagtaatggatcagtattttttaagcattatattgccagttgtaaaaagtaaataacatttatattttccttttaattaccactttagatggtggaattttaaattattatatgcatcaatgcaataggaagaggtttgtcttatccatttgtttaacatttaatatcaatatttctatgtgtgccgaggacattataatttattcttttattgctatagtagtgattgggatgaatatatttacagtcattcctcaactcactacaccaagcaaagtttaggaggttaaatgtgtagttacttaagttatcttctagaacagaatcagctagatcaccatctcaccatcattcagagatgctattctttgtaaactatttttatttggaaagggatccgaggttttcaaataaccaagtactgtatggaagatgtgctggcttgtgattgtgccttatgtaaacattttaatatcggatccctaaaatccaaaggctcccccaaaggggattaaaacataatcccctctctctattctgtagtggattaactctgtattctctctgcggctggtttgctccctgaagactacaacaaaaagattcagtgctccttaaacatgctatggaattggaagttgtaattggagatttccaaaggacgagggtaaaaatgacacactattaatgctgaatatttcatgatggtctttcttaaagaaagaccagttcgaagcccttttataaatgcccagaaaatctcctcaacagaaggatattggagtaaaatccaaaggaagccgtcccctttcagaaacacagagaagtagagaagatatgctccccacggaaagttcacggatgtgtacttaaaatttgtaatgtatttcaataaatcaatgggtatggttttgatgtttcacgatcttttttttttcatgttctcaatttggatacgttaaattactttttaagagaaagaagtaattcaccatttttagtgtttttgaccattatttgtctccaaatgccagaaacctctgttaaactataaatcttgatagtcctctgtctttagaatggagacttttttgaggtttttagcaatgcccaacaatgtacaactttgtttccagtgtgaaccaaatcacctttctcaccttgccccaagcaagagtaaaccgcatagatttcttcagagagaagataggaaaagtggcatccaagggagcgtcctggttgcttaagggttaagggagcggttcgaaccggcccgagcgttgggggattcggaggagggcgcgggaggcaggaggcgccgccaagcgcgcgcacagaccctccaataaacacaaaggagggcctggggaatagaaacccaaatccacttgtaatcgtacaagagattcgggcgtaattacttgagcaatctagattaagattgatgatcctttaaagtggtgcttcagatcgactgcctctccctttccaaagaaaaaccttgtgcaaccgaggtggaccccgactcggctgggcagaggccgaggcccagagtccgcgagccccgggggctcatcgggggatcgagagcagtgaaatgaaagacagggctgtgcgtgggtctggcccgggcagtcccgacagggctgaaagctgacactgtcacagtttgctccttagccacccccttgtaatcgcgacagaagccagcccagccctctgtgttcccgcagcctcgggaacggcccggcattgtgcaggacggtcgcagattgggtgtgtgctgcgccagggaaagccaacttggccgcctctcccgagcccggcccggcgggggccgagggcggtgtcggcgcgagggctctccgcccggagggccgaggcctagcggccgcggggaacctaactttttattgcctttctccgactgttattgtgacgcatctgactgtatgcatttgagagaagtggaagggattatgatgcgcccttgctacctacaaatgaatagttacatccgatccccacgttatgtataacgttatatcgtgtttcgaatccaggattgcgaagaatggctccctttggggagactttacagaaaacatttaggtaatatcccatttgaattcatattccatacgcgtaattcgtgattttcaaccttaacagattgagggaattcgaagcaagcaccctggcaggcacttctagtgaagctgtttctgtagtttcaaaagttgagaagtagcactttcgcacggttttttgagaaccgttttgttcaagcgtcttacattttcatcacttttgatatattctctgtaagaaaatgactaagattttcgttcttttctacgtaagaactttatgtaatgtccgtatgcacgcgtatgtatgtgtgtgtagcgcgccttaggagaccgatattagattaatcttcctgcaagaggcaaaccgctctgaacagcggaatttatcatttagatccttgcccccttctcgtcctctcgcctctccttggggagcgccgctgctgagtggaacggcttcgcgcgatggctggtcttgggggcagtgctgactgcctagggtctctggaaaagccagtgatactcaatggagaattggggcatttgtccgttctgcacttttaagtaagttaatggcagccccttaccaaccatgtaggatttctaggtggaaattgagcgttattcggtatcctgacctcctgggttttcataccattttttctctctagtctcgttataaggtaatgtataaaagctaagtagtccttatcttacgtgaaaaaagagtttgccgcataatacaggcaccattttttctagtgcatccttaccaataaaaacctctggtacctttctgggagggagcaggaagggccacaggggctcagcctgactccccttgtccttgccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagtgagttaaagcgattccatgtacagtattggtggctttgtggcaggaagtggttttcaattttgtttggttttacctgacagtggaggaggggagcacattctcctctttctcatagaaaataaaatgaatgaaatagcatgttctctttatggaattgaagaatatattaatgaatttaaatcctgtattaccagagcatgcacattttaacagtctttctatgagtgcctttgtttgcatttgggcagatttggtagttaagccaattgcttccaagtccctggggcccagaatctcaggctctgaggctgactttgaaaggtcttgagaaatttcttattaagatcacttttaattttcaaaactttatattgtaatgtgattattgaaaagttataaggaaactggggggagagcatttagatataaattaatctccattagtacacccattttgtccatctcctgaaataagaatgggttttatatgtggatttaagagaaaagcaactgattctctgagctttgattttaaatatatatgctagcactcagatgtttaaatattgtattctttggatataatgccagaaaatacaaatttggaccatttaaatgcatatttattaaatgttattgtgtagattttaaacaccagagtattagagtagctctttctcagcattttctgagatctgttctaatgttttaactttcatgttactgtgcaatttgcaaacttctattctggggttaagaattcaacagcatgaagtgtcatgctagaaattctagcatcattttgcaaagatcttcctttattttcagaggcagttattctaaaatagtcaaagacaaatgctcccacagatccagaactttattgtttttaatttagatattgaaataaaatgttataaaatagtatttgtagactagagctgaaatccaaaaatttaccatcacctgaattaactaacttaaggcccataggtgatcagccttttcagcacttgttgactactaaactcttccaaaggagagccatgggacttcttttacttctagctgcaaatgtagtttttaaaatgagcttgaatgcactgtattttattttaaaataacttaaattttgtgttcatccttttattagcttgccctatgaagtcaaaaagaaatgttgaatttctaatgaatttattctgctaatggaacccttattacataaaataaggtttgacataaaatatattggtcagaaaggatcgttttattagttttcatacataattttcgaagtttcattatgactttgttaagttcatttcctctgaattagtcagatttttaactcagtcatctctactgtcatgatagactttttttcttatattatcaaaaatgctacaagaagagcaagctttcaaaggtagatttaaattgtttctgttgtagaaaggaattgtcttacaagtaagttagagactgagagtagattgttatcttatggacctatacagaaagagcttttctccaatgttttatttttaaggatttcattagcatatttctcaaaatatttaagatattcaagtgggtttgattttcaaaatgcatcattacatcttgtgataggaaacaatttaaagtgagacacaacaacttttattttacttcatttattaccatctaattaaataaaaaccagcaacaaattaaaatctaaatcacaaaagtaattatccagtgtatttcaagtgcatttttcaaatatataattcagatattcaagcgttattatataagctgaattcaaatttctttgaatatatttaaataacatttcaagtatatttatggaatgttagaaatagaacaagcaatatttgaaacaaaatgtaaactttttaaagttcagacactttcaaagacagataaaagtaccaggaagaaatctacctttaaatgatatctttgttagtggaaaatgtctggaagtatccagaatggcaatttaagttctgttcaccaaatcacaaaacaccaacatccacactttcaaagacaatgtgagatcacaatatttgttacaaatcaaaatatacattacagtttctttcagatggcatatccaaatcgtgtttactcacagacagatgcacctaaatcaccaggattgctataatcctttgatagttaggcagagtgttcgtctcggtctggcgttacagctgggctgtttacggagtgttacggtgtacttttcaagggagataggaaatcgtgtggaaagaagtcttctaatactagtggctttgggtttttctccatccgcttcccctactttttctccccttgtgggggtgggtgagatgatgtttaaatattgtattattattcctttttaaaggaagagattgtttgcactgcggagtggaatattaggaattgaacagaagtttacacttaataaggactttgagaagggtaataatttcggctcttgattaaatcatcctctaaagtttttccaaacttttcgggttggtcaggatctctcttgccagtcgccacgtttgtttggcagcgttttccagagctgagtgaggtttgccttgaaacagatctaagttcggtagaaagtagtggggacaccgccggcactgcaggcaggagataagttgcagcaaaatcccgttcagccgatcacccaggcaagactcgtcccagtccgactctcggggatgcttttcacactcgtaggaaaccagagtcttcatatggtaattgttcaagggctggcccggcagttcaaggtgacgatcccttaaggttttgaggatggagaggcacttctttctgcagccccccatctgcagtctgttctctgcctccgcgaactgcagcacccaggcgtcgctctccgccgagctctgcttgccggccaaggagtggcactccttggacaagagattgaaaccttccgccttgacctccgccacccggttgggtcccggccaggggatgtggggaagtggccagtgggcagcactcctcggccagatcccggtgcatttaaaggccggcgtgatctgcaccacgtacctatctcggattctcagtttcacttcgctggtgtctgccaccatctttaccacatcccggtagctacatttgtctaccgcttgagccaccagcgtctgaaacctggaccggattttgcgcgccgagaggtagccggaggcggtaatgaattccacccagagggacatgctcctcttgcgcccgtcgctcaacttcagcaccgcgcagccgggcagtgagccatcgtccacgaagttgaacacccccatttggttgagataaagcaccacttcaaattcggtgggggagatgacctcgaggccctcgtagcgattgtccatctcgttgagagagctgatgaaccgcggctcctgcacttccacttccttcagtacgtcggaaactactttgcagacttcccggatagttttggcaatggcagctttcctggcttggcatttttcgttgtagtatttattcagatggtagaccagcttggcctgggccgcaatcatgttggggcagagatccggattgtacaccggagtctcgcagtaagctgtgggatccaatgcggctgctagagctggagccaacttcggtggagaaacgggccgcaacactcagaaatggatcaaaaatgcctttcggaagtgctgcagcgttggtttccctgctgctgctgctgctgctgctgctgctgctgctgctgctgctgctgctgctgctgcttttcccttccttttatctttgagcccagccgttcttaaagtgaaagactgtcctcccccctctgcttgtctctcttcctcttttaaagaatccttgtgtgagagaaccgcatggagagatcaccttctcaggaataaaaaacaaaagttgcgctgagacccagcaaagctcttccagtagtcaaaataagcacccctttccgtatttatttgcgctttcccgtaatcattgtgtgtgcagcactgttaatcaaatggaggaaaagtgtgctgagtgtgtgtccggggtgagtgtgcgtgtgtatatgtcagaagaagctgctgttggtttgtctaagagcccagatgcactcgtgtggaaattataaaggcagggccaggcaggcgggcggccaatcgccactgggctcgtcacgacagcctccttcagctccaacccggctaattaatccccactcatggatataggcacacaaactaaaggtaggaggctgctgccggcggaaaaccactcaggccacctagacagtttggaaatcaagaggaatctctcagctttggtattacttgaagcatattgacgttttgaaaagacttggcaaagcggctctcttctgtgccgaaaacctgcttgtcttttaccgctgaaatgcaaatacaggtgtattaatgggcatccatcaattagtgatcttgacggggttttctaaaacaaaatcactaacttgcatttagagtaagataattaacgtctgttaatccttggggtcttcttaaatgcaggttgaaagtttgttctttcatgcagactactggcatatggaagttggctttagatggaggagtacctgtgtaattttctcattctggatgttcctatatgttaaaatgattttttgaaacgttatggaggtagtatgctctttttttacttatgtttttttcttttctccatttgttgaatctgaaaattattgctgagtgtgtgagatgttctacccctgtttaagttaggatatttaaaaaatatttcgtacatccctctgccccagcagatgcagtctttgcactttggtggacttgcccagcattacaagcaggacacaacgctatatatgcacttatagaaacatttgaaaaataaattgtctgtgggatggacagagtactttagcgttatttcatagtgacctgtattttagtacataaaattcaggtgagatcatagagatcaagcttcctcacagataactatcccgaaaaattgaaggtttggggtatctggcttgtttacagatgtataattaaggatatatctcctgtcttaagtgtccttaagtggtgacctggcagtagacttctaattttatactatttcgtgtgatttaattaagggaaaatggttaacatttgcaaagaaaattaacttgcagttatctggggggttttttggatttaaacatcattttgaaaacaaaaatgaaataaatcatttcatttctgaattttggaacctggaaacaggaggaggaatttttttttctagttggtggtccagttgtgtcctcaaagtacaggaaactaaagaaatactacttagtggttacgttgtggtttttaaaactaggtggatttttttaattgtctacctttaatttagatgccacgtctttccaattaagaatatttcccgtcaaatcctataactcccggtaacatgtttgtagacactttcagagtcacttttaacaagatattcttcagggctcccacttgctacttaagcttttgatttttgtttgtgtgttttgttttgcacaggcacagcatcacaaaaccacctattatttaatttctccttatccaacagtgatagattccaatttagctgaaaatagtatacattggggtgcgtggcacccagctactctatttcccaagaaccttccatccccttaagagcagggtctgggaacacccaaaaaacccctccccactttgccgtcatcgcgggtgaatgcaccactaccttttggcagttggaggggagacccatcagagccggagaacctgcagccacgacggcgaggatgtgcagtggtctctggggaaacgccgccttctgccctcacccggcgcgtgtggccctgtgccgtccgctcgccgcctctctctcgctgctccgcattcccgtgccctcttactttcctctctgggctcaagatcgctacgctttatttctgcgtgagcttatttgaaaaccttacttggtgtcccggcttactctccacgtctgctccagaccacggtctgcccacgcacccctcagcctgcaccgcccacgtccggcccaggtgtggtcgcagccaagccccagccgcgggcccctgcgccctgcgctctctcccttgggttcaggccagagatgcttgccccaagacctcgccccttgccttcttgggccacctgcagaacacccttggttgtcaaggacgtgagacagccgaggacggggaggccccagggctgttcgggggaccttaagtgggtccaacgggaaggacgcgggcctgcgagggatgccggtcgggcctggctggagccaggcgcgcaggtggcgcatcttcggggctcactgtgcagcttaattgggttaaagcgaagctaaacaccgaagcactttgtgcaaactaattggtgcaaccagcgccttttcactaacgatttgcactttgagaaagaaaaatggatggtgagaaaaggtatactaggaaactcattagatctagagtgttcaggaaagtgaagtcatttagtttaaaggacgccaggactgtgttttctaagctgcttccttaagcacccctcacacaaggagctgaaggtgatttacataacataggattcaccggtccgcgattatcactgtgggtgaactgggcgccctggaatgaataatactctagtgcaagtactgcttgttgctgcaacacagtgattttctattacactgaacacgtgaaatgaattgccttctgtagctgaatcctttcagtgatcgtagacgcccctcattgttgaagcgagaattaagctattcggagaagcgtgttttccatccccgaaatttttttatggaaatgacctatagagagggattgcaaataacagtacatttttgtgcagttcagccgattttaatctaggcttgggggatatatttattttatgggagtaatatatttaactatttttcagtgaattttaaaaaaatatcatttgacctattaaactagttatgtcaaatgattatgtagtacatagagatggcttaatatacatttatgtattaatgtgaaaagtttttttaaaaaactccagttataccagtcttgcaatattttttgttgtaaatatactcagtgctactagaataaaattgtgtgtgtgtcatgctttaggatgtaaatacttaattgttttcagtggtaggcatgcagacatctttgacatgagctaataatagaatgataattgaggaaaactggcctaattgaaggaaaaaaatctcaagaatctcatgatttaatgatagtttgaaatgcttatattgaatggtatttagaattttaatgcctaactgacttttacattgcatttacttagtttatgaggcaggctcgatttaaaatgtaccagttaggaaaaaaaaaaaaaaaagcaataaggacatagcacaccattatcataaatgttagtagtattagtgaatataaaataattaaatattgtgatccttaacacttcgaagcgttcgaaataacagtggcaaaacaactttgcctcaagtagtatttcctaaataacttgtctccacttctgcagacctgcttacttatatgggatatacaaagtaattcataaatagtgtcattattaagcttaaagaaaaaccctgttatgttgagaaatacaagaatgcaatatttctttgttttcgaaaaaaacctgatttaaatttgaattgcatgttcacaaatctcagtaattgtaacctttcatctggaaaaaaggtatctgttaaaggatatgcacatacatgttaagtgcttatatagatattgtttggtgttttttcattatctgctagctgctagtctattcacaagtattaatgaatttaaagttttatttttttaatatgtgcttattacgctggggagataaaaagaatatgaagttgagtttattacattatttatccctactgctggagtggctttgaaggctcattgtagccatctgatttctttcccccttctttttttttaaatgcacccaggctatttcaagtgtttcattctgccagacacaatatatttctttttttacactagagaaattaaagacagatatttgtgcagggttttctttatgtgtcacattaaataaagtaaaatagagagagtttttctggtaacctaatttgatggcatctatacctttcttcctgtgtgattcctggtataagaacacttgagacaaaaaatagcttgaaacctttcaaggtttcagtgatttcttaaagtaattatttcatcttttaatatcagatttatttcaaagtcaagcagaggattgaggtcactgtttgcacaatttagaccctattttatttcttcaactagaacattttgagaatcgtggttaattttttagaattgtttattcttcacttgactgataaaggcctttgcctcagttttcttcatcaccctagttcacaatcatatagtcacatttgtagtgaagagtactttttttctctacagtgttgcttaataagcttgatattggtattaataggtttttgaaaagaaaattttgagattaaaaatggaagttgggagtatacttgtaagaattgaccaccgctgcttgatttgcagacttgaagtaatactggataactagccaaaacttttcttttggtagaaaaagaaatttaaagcctggcttattttcataattgtctctgtttcctcacttcatttgcatatgtacacagaggtacaggatgttttcagttgtatctgtaaactgaaaaaaaaatggggaaagggaggttatcaacctaaagaattttttattgttcagcataaattgtgatctctaaccttttccaaacatttaaggacaatgaagttagtcattcatttattgaatactgtgtaggaaatatggattccaatagtctaatttctcacaaacccttcagaaagttactattatctttctaataaaactaaaatctttttgttagatatcagcttataattttcttgtgatattatagaaatattcagacaggataaatgggctcacatgattcttttctatataatgtatgaaaattaggtatttcctaacctacaacatatacacaaatgtatgtatgattttacatacatgaatttacgtacatttgtgtatatggctacatttttagtactcttaatatgctatctttttattgcatttagagaaaacaaaggaatcagaatcgattagtgtctgttaatccctacatctgtactaggtcatccaggactgcattgctctcattactgtttcatactgtatgtgattaagccactggaaatattcaacatgaccttgagactagaatatggtacatagataatcaacttccagtgattacatgtctaaaataacctttcctatttttaatttatagttttggagcttattttttaatgagcaaagtaattcttctaaagtaagatttattttttttaatgattagtaactggagtaataatttaaaaggataattacataaaatagaaaacgattaccttttatcatgtatattatgtgcagtaaaataaatggtttacagaaaaagaaggaaattagtttataaatataaattttctttatatctttacatataagtatagagataactatctgagaatataatacctatataatatttcatttccagttacatttcaatattttcactattgtaataatatacattttagtacaccaatatgtactatttcttgaaagcacactttttcatataatgatttgtcaaaaatatcaattctaaagtaatactaatgaatagttaatacttttacattcacatatccttatccattttattatctaaaatcccaatcaaattagaagcatgaacagcatagtttgtaagatgtagtggtgttcctgattaaaaaaaaaaaagtgggaacctagtgaaataaaatgtatagctttgtttttctgtgaaatttattttttttaagttagatatgtctgtgaaatttatttttttaagttagatatgtcgatgtgtactttgcatacagtagtattccatgatttttccatatgattgtgccattctatgaattctgacaaatatataccatcatagaagctctaccacacatgtagatagaacatttctattaccacaaaaatgtttcttcatgccctgatttcattatttttatttggaaattttatgattaatgtataaatgtctggctgttttagttttatatcaaaagatctttagactgtaacaccgttatttatttcccctagagtttactattttgtcatgcttctaattaaagacaagttttaatcaaaaaacactgacacaggcaaagtgtaaaataatatttcagatatataagcaatatgtttataatttttattttatgtaaagtttaattttcatgtatgtgacaaattaatacttggtagaagattgatttttcaaagaaactcctaatatttagtagctaacatgaatatatgtgttagatttatgaatctgatttacagcttacacatcaaaatatgcaagtaagaatgggtttctcatataagttagcaacatttgaggcatatttgtaatgtttctagctttatggcactagagaaagaaatgtcaagatttctcaatatttttactttacattttcagtaaattaaccttccctttgagtggtaggaattgaggctaaagagtttattagatctaatattacttaatatatgcacattcttgggacatgtgtataaatatacattatcctaattttgtataaatatacattattatgtaaatgtagatggttacaaatactctaaaccaagaattattaaattataggagtgaagacattgataatgatgctctttcaaatattttgtctttttacaacttggaatagtacaactagtcttttatttcttcccccaagatatacaaattatttaaatgctttctgttttgtatttttattttgcagttacaatagaaattttaatgttatgcatgcttacaggcctattaagaaagaagttattgctttcttaataatctcaaaccatctttaggaaatacactctttttatggtttgcaaaatagcccatgcatgcatgcaggctgtgtacagacacacacacacacaaaaacaccagtgtttaagatagcaaaagattgaattggcctctatacattttccgtattcatctgttaaaaggaaacaaccactaaatattggaatcttgttgccaccaggaagtaatatccacatccacaagtttgtctcataataacccttaacagtttttgataatacctgaagagactgtacctaaatggatttttaaaataacacgggaaattccaacagcatgtattcagtcacatatactacgtcaactttgaatgtcataagcttttaattatgaaattgagaagtttattgctagccattttgtccatagaaaaaatttacttaaatatttacctacattaatatgtgtgtgtgtgtgtgtgtgtgtgtgtgtgtgtgtgtgtgtatatatatatatatatatgtagaccctcactaatttaaaattgttttttacttttttgcaacagaccaagtttaaattttttgcaaccttaacctgcatttgataaacaaaatgtataactcttcagggggaaaaatgtgggatgttttgttttttgttttttactggcaatttcagttcttcatttgttttgctctccacgctgcattagcacagttttcccctgtgtgcatctgccagtgtacaatttagccacgggcatctgtagaccttgtggtgatcagtattgcaggcaaaagccatatgtgtttaaataaaaaaaaaatctctttatttcatttgctgttttaactggatggataacttttgtgcctcaagacagaaaaagaaaaaatacagaaataattaattgcctctattcttgaggcagtttcatttcccctccaatatggaatgcttgtcagctttcctgataaatgactgcatgtatttgcatagattttacattaacacaaaaattagttttatttgtggaaaactagtttacataataatataaaacccctgttattgattatgtttccaagcattgatgactttagaggggtggtagtattctaaattttcaaaagtctgatcaacctgtataatttaaactttcttttgataaatagttttacattaagatctaaaagacatatttataacattttaaagttttaaaacttcttttctagatatacttaccacaactgtttcagactcatagtagcacccatttggtaagaagattttgattttgaacttttgccaaggaatatttttaaatacatattaccaattacgtacacttcagccaattggaagactgcatctatatgaattactttaattttcatattcatattatgaaaaaagatgggtgctatattggatgtgtacagtttagctaattcttgggaagttatgtattatttacaaccaaatttaaaatatatctgagaactgtcctctccatctttaacctatttccttcaatatacttaattaatcacccagccctgaaaaaaccactctgctggagctgttagggtactgaaaacaattctacctctctaagtggcaggcagtagatgtttattcatactataatctggcatcttgttgtctagaggcaacctgctaattatgtgctatcgttgtattatccatgttatggaaaattcaaatatgttcactactgttagttacatcgcaaagcttttcgtaaaatatacttgatcctcaagaaacctactatacttaatggcaacctaaaccaagagtgtctctgccacttcttgattctgggacaccctgggtgccagctgtcacagctcagctaatgatgacaaatgcccctctctatgcagattgcagagcttgcaggctgctgtgaaaggcaaccagattacctttcttcagatagtaacttaacctttaaaactcatgtcagaatgaaatgatcagctgtgatagtttcaatatctgtatctttaaaaacaaaaatcagaataatatcaaataatgcttttaaaagtttccagtatttgtatgatttacagtgttttacccttgaatgctgtaatattcttaaataagaaactctgggtaagacatacttcacaaccactttagagtgtgtatttgaactctgcgtataaatcaggtaataggtaattgagaaaattctccagattgtttagtctaaaaaataggctgatgaaattttgagggaaaatatgttcttctcttcacctgaatgaatggtaaagcctcaattctcccactgcttgtacaagcctagcctgtcccaagccaatagttatattatgtcattaaaacttagttattccaaaatgatttagagaataattgttgctaatgattgttttctctgggtattttcaaatatgatcttttaagttattaatttgttctatagaaatttatcatattacagaacctatacttacatggattattcaaaacaataatgaacaccattaaccataatgtaattcagagggataaattacctattaaatgagataatgctttacaattgcaacattcttttcaatttacaaaggatttatatccattaattcatttgatacttaaaataattctgagctgggaaagatgggtgacaaggaacagggaccaatatttaatgagtatttaatctcatttaatcttcacaacaaatattagctcccatttacaaataaagagactgaggtttagaaaggttgcatcttaccagggtcacacaggtaattgcagagccaggtctgtctgactgtggctgccatcagcattacagtttctagactacatatgtccatagccagatataattcatagaaactgctactaggcttgcatttacataaacaacataattgatgagttttaaagataggttctttataggatgcttttaaataggtaaatactgagatacttttatgttataaattttaattttataaggataatgtattgatctatcacattgggagaaactatttaggaaagatatgtactgtttactgaatatcaaattggactaattcacctagataaccacttcattgtaaaacttaagattaatgggatatacctttataaatgtgatgaggagaagcaattatttcaataattacttgagtgaaatatttatatacttttcttttataaaggtttatccatatcatagttttactatgtaatatcagtgagctataccacccacaatattgtttttcagctcaagacacattgaaaacttcctttgatcatgaatttaagtgcagtcatttccaagaaagctatgccaatgccagttgtatttattctgtagtaaattattctttggtatagatactaaaatgtgaggaaattttttcaatgatacatatgattatattattatataaagactattttatgtactgattagtagaattatattagtacttatatagaattagtacttatagttactaatcagtacttatgctcaatttgtatttcactctacataaaaattaaaacttacagtgaaaattttactaaaatgtgtcatgcagttagtatcagggaaaaaagtaattctgccgcataagtcagacattttatatcagggcaggaaagaactctggaggataatgcaatgtaaccctcttcataactgtctgaatcttctctacaccattaccagccatggtaacaaccatagccagaggtggttatctaacctctacttttacctccatgaatgagaaacttactacctactcagatagttaattgcacttacaacagttctagtggttagaacgctcttcctaatattgaaccaaaatatttccccttgaaactttcaccttctggcccctactttcccttctgaatagtattatccctttaacaaatatatgctttttaaattcagcatttcagataccaagttgaacatactccagtctttcagctattacacctttggcatcttttaagtcacctcactgttcaggagccattctggtacatgattttcttcaagtacggtgcctagaaagtattactcctagaatggattggtacatgtaaagtggagaataatagcgaaacatgggtcacatgagctttttgggcatatccatacccacgcagataaatgctgtatgtcaacaaatatcttatttgtttaaacatattattaccgaggtcctaagtacatgacttttgtattcatccaactcatatcttgctatttttaggtattttttccgtgacttgacttataataataagttatacatcattattttaagaatcaataggcataacagttctttctaaaaatgtgttcataagctacacatagaatattcagagcaaaacaatctaactttaatgaatttaatgtttttgctcagtttaagtgtagaaggaagctaatccacttaataagacctcaggatacattgaatttactaaatactccacagccttcgtatagttttttttccaaatatttaaaatcctaatattagtttttcatagctttatcgaaatgtgtaactaagaagcctcatttgggataaagtatatactttatgtattttggcatttatcaattttgctttgtcaataaattttgtatctacaaatgaaatctgcaggtttcccacatgcttgatcaatgactagcaaactaataaactttcaatgcaaatagatgtgcttctaggacttgtagactgttataggaatcaccaacatattgatctacatattttaaccttttgacaataacaagagtttctaaataatttagcatgagcagaggtaaatacttttaaaaagtgatatttttaataacttgaagccaatgtgaaaatttgtaaattaaaccaaagtagtcacaagacccattatgctcagttgttttcttcaagtgcagtgcctagaactgaatattcagtatcacagagtgaactggtgaatgtagggcaaagaggcctcccttaagtattaaatacattgttggaaaaaacgtattctgagaattctcaaaacacatttgagaagcagtagtaaaatacaaaatgcattttaatatatattaattaagtaatttgtaaaatacaaaatacatttatgtctgtatgggtggcaaaaaaattgcattaacttttttgtgttaaagccttgaatttctttaagtgcaggcgcatgtttttatttgccaagttttttttttaatgaggatgtttcattactactttatttattactgctgtgacatctaggcaataaaagacaaagacagcctgcctgaaatttggctttcttgcagtttgtatcttgaatggggaataaagaagtccagtgcgtttacaacagaaacattctcaagtgaagagctgccccatctgtttcatctggtggcttatgcaataagaggtgttatcacatgaatctaaatgcacaagcggtcgttttatgaactctttctgtgctttgaggagtttataagttgcctactctattgtgtatcagtcccagctgacccaagtgcattctgctgggcatatttgggggataattagaactaatgaagcctggaatacagctaattctctaagtgatttattcttatgctcttctctgatccctaagaattctccaaatcataatctatgccacttattttttcctagcattgtgttgatacagctactttatgcttagctgatggacatcaaaagtaaattcggtatttgaaaggctgagaaacatgtttcaaagtaaaactttacgttacttattagtccccaggcttgagaagaatgccagttcttcaacattttatgtttttgtttaaatctcaaaatgtttatggcacttgcaagtagataatagcatagaaaatataaagcaataaaagctcattaaaaaatgtaccactgggaaatcaaacctacaagtaaaataattgaaaattattaatggaagtttcctatttcttaattaggtttcccaaggaaatctgaagtttaaaaaaaactttatgaatagctttcatgttccaaagctgtttcattaacctggcttcactgtcctagcagtgttgaaaatgatgtttctttacgtgccctcaccaagtagtcagtgattcagtggcctgtaacgctgtaaatcccatcaacttgctttcctttcctgttataactgtttcaatgagtggcacttttgttgtgcgggttcagatctggtagcttactgagggcacactagaatgaggacagacacaaatgccaacaaaagaaggctataactttattaaagccttatactcagtaaataagatagtggagccacttcagctaagtagttttataagctatgtcctatttgatcttctgttgtctagaaactatagtagaatttattaagaattgttagttttacctattgattccagtgtttaatatttaccatattctagagcccagataacaaaacccttaagggcaagtaccactttattagttagacatactgaaatacctgtactaatgtagatcaccaactagactgattatcaaccaaaggaccagttggagattcctgaatctcattacaggatacctaatccagcctcagataaattctagtcttaattgtataccctgacgtaagaagttactgtttctcatattttaccttctgcctaaaagtcagctaaacactcgaaaacatgtcttaggaacttgatgaaaagttgcaggtcatttttttaagaacatttttacatctttaaacaagacaaagaacaaattggtaaaattggctaaaactgagtttttgttatttgcaagttattctgctaggtgctttatctatattactgtatgtaccttcatcttctcaacactatgaagtagaaacttctggcctcatttcattgttaagaatctgaaacacagagaattcaagtaactcttccaagttcacaaagctaggagttagcagagttaagattttcatctatgccatctggccccaggctccagagtgtgctttcttagtcatcatatagaacctctctaagtttgtcttgtcatctgtagaacagggataattctgtgtcatagggttgttgcacaggttaaataaattaatacacataaaagtttatgtgttttaaaaagaatatttttaaacttatattacccaagaccacacagtaactagcaaagataggactcaaacccagctttttctatctccagacttctgagtttatgtagcatcatgcttaggtatgtttgttgaatgaataattaaatgaatatcatctgttctgtacttcccagtggaagattttgttaattttgctggttattttgatagcatatagcaggtactcagtgcctgaatgagtgaaggatttttcaaacaatactcgccaatataatatgttctatacattgatcactcttaaatttatatctctagccaagacctctccccttaatttcaagctggtatgttcagtggtcttctccacatcatctcacatatataagatgcatttcaaacttagattcccaattgagcacctgcttctccatcagtcatctgtacctcagtaaactgcagtgccttttttccggtttcttaggccaacaacatggctgtcatctttgactcctcgcttgcttgtgtacccaatatccagagtgtcaacaaatcctccagactctgcccatctctcaccaactttacagcttccatccttgcaagccaccatcatctcttaatttatttttggtgcccattatcctgtatgtgtactactggttatctgaggcaatatagaatgagaaaaagtacaaggaattatgctagggaacatagcttctcactaatattcctctgtgaggaatatgatccaataggaataaatgagaaggaatgttcagaaaagtaaggcggaaaactaacagatatgactatcttaaatgccaaacacaagagagttgtaataaaaagttagtggacaacagttcagctaccacatagagttcaaataacataaaaagttctttgtctttccacatccgtatcaatggaattgtagagacagaagcagatcacaataggattgaagagtaaatcggaggtggaaagtgaggtagacaatacactttcaagaaaagtaggattgaagactattctaagtgaagtaactcaggaatggaaaaccaaacattgtatgttctcactcataagtgggagctaagctttgaggatgcaaaggcataacaatgacacagtggagtttgggaactcagggggaaagggtcagaagggaatgagggataaaagactatgaattgggtttaatgtatactgctcaagagatgggtgcaccaaaatctcacactaaagaacttactcatgtaaccaaataccacctgttccccaaaaacctatggaaataaacaatttttaaaaagtagaaataaaggaaatgcaagagatagtatggtaattatgaagtgatgcaagaaaaaattttaaaggtatttgaacatatttagggcatagagaaagaagccatagaggagaggttaaagttaaaatgaaggactaaatcatggaggtctctctatctccaagatcagtagaaggaaatggtatcattgtcttgaggctacaatgagagatggcttttttccttgaagataaactctacacaattattaatattgcattttattttattccatatgtatttgtaacagtggagggtgagatgttgggtttaggataaacaggtggagatctgaaaatgtagcaggaagaaactgttgcattgtggaagataaatttgtagatggtggtttttaaagttggtggattatacaactaggcctcagttttctcttggcacttaaagcactgggactgaggtaagcttcaagaagggacttagatgtttaaactgtcactaaaaggaatgggagataacgatgctgaatcctgctttacctggcaaccctagatgaaggagaaaagtagatgtagtaaaatttctaaatagataagtgactgagatagcttaaacataggcagaatagtttactaagcggaatatggacacaggcatagactgctgaaatacaaagaaatcaaagaattttaagattaaggtacagaatagattgtctatatgaatactgaattctctaaaagtgattataagattctgggtggagagggaaagaattttggggaaagaagacccatgaagagtagaatgaatgctgttaagtgaatggaacaggagacaatctgagtcaccagagcctgcacaaaacaaacaaatgggcctaagaggggttgctgggattttggaagccaaaagataacttgatgaaatcctttgtagcctaatgctttgaatacttttgagagatttgataagcagttttatcatcaacaactaatgatatgggagtttatttaaatttattcctggagccagggaattcatagactcttattttaaaagaccctaacattccatatgaaagtgttttttaggtgtctgcccaagtgataatccactttagtatatctgtttccaatactaccaaagtgtccatcaggatattttggtaggacctagtcatatgttttatttgaagtatgtaaaactgccaaagatactttactcttaagtgttttcatatcatataactttctttagtttcccagtagagtgaggaagccctccattaggaaccagaaagcttgggttttagagcttgctcctttttgaatagaatatacaatctttattaatgagcttagtttcctgccctgtgtgatgaaggcattggagtagatgatttcccttctaaaattcattcagttctctgtattatttaactttgagatgagtacaaaatagcagcagttttacctttaaaggtgtatctcgtcatgtgcaacatataccttcctgaaaagttagcatatttttattatttgaattatatttaaatatatctgtgaatttattcttcaaaggatccttacaataaatcttttaaaaatgaattcattttataaatttaatgatttctttataatgtataatttcaaatttaaatctttagttattaaatatttttaaaaacaactctatatatttgtctttatgtaactttataaagggtataatgaatatgaatataaggaatacaaaaccaatgataagtaagaaaatagtaagaaagtaattaatcactttaaatgaattcatgacttcagggtactaacagaatttggaggtttgattgaaggaccaatcattgttgaggaattacagagacagtgagatatgtcagaagactagatgagagcaaaatattagagaattttgcttggcaccttctgatcaacaatggtaacaaaaatgtgattaagacttaagggaaaaagtcaagtctgcctcaaatcctgtgggtaagcaaataagatctaaatttttgaaaaataaatctgtagtctgataaattaagatgtattaggttggtgcaaaagaatcgtggtttttcccattacttttcatggcaaaaactgcaattacttttgcatcaacctaatatattgtaagccctagagccatcgctaataaaataactaaatagatgtagttaaaaaacaagtgaaggaatggcaaaagaaggcagtaaaggaggaagaggtgaacaaaaaagatatgaaagatacagaaaacgaaaagcaaaatatcagatgtaaatccaaccatatcaataatagcattaaatgtaaatggattaaacagtccaataaaaaatcagagacaggtgcagtggctccgtaatttcagctctttgagaggctgggatggatggatcacttgagcacaggagtttgagaccagcctgggcaacatggcaaaactccatctctacaaaaaatagaaaaattagctggatatagtggcacattcctgtagtcccagatactgaggaggcttaggtggaaggatcacctgagcccatagagattgaagccgcagtgagctgtgaccacaccactgtgctccagactggacaacagagtgagactctgtcaaaaaaaaagaaaagaaaagaaaaaaaaatcagagactgtcgactgaattaaaataaaaataagatccaactctgtgctctctacatacaaccagatgctgttaactatgtgttttgacccagtttaggttcaaagatacagataggttgaaaataaaaagataaaaaaagatatgcacacaaacagcaaccataaaagacctagagatggctacaataatatcagataaaatagacttttacactaaataaagccactacatacaaagagaaacactttgtaatcaaaaaagattagcttataggggagttataacaattataaatatatttgcacctaacaacaaagcccaatgtccataaagcgaaaacagatagaattgaaaaaagaaatattaaattatccaataatagttggaaacttcaataccccgctttcaataatgaagacaataactagatgtaagattgacaaggacatatgctcctcaatttacaagggtgttgcatcctgacaaacccatcataaattgaggagtgtattttatatgtatcatttttgcaccactgtaaagtcaaaaaatcataagtcaaaccatcataagtcagggcacatctgtaaatagaagactcaaacaacactataaaccaaccagacctaatacacatctgcagaacactcccaagaacagcaaaatttcttagtgcacatggaacattctccaggataaaccatatgtcaggccataacacaagcctcaataaatttaaaaggattaaaataatacaaagattttttgacacaatggaattaaaaatctttctacagttgacaaactgaacagcaaatactttggatgataggcaagattcataaatgatatagaaaccatgccatgtgacttgaaagaactgaggctagtgtacccaactaaggagtctaatttggatggtagagatggggatgaagtaggatataatagtttcctctaagaagcctgtcgtttatagcaaggagaatattaatatgtatacatgaccttccagaggacacaagtaagataattgggtggaagttacagcacaaaataaggaagaatattataactgtacttttcagttcagtaagatataggcagtattgtacttccctttttaaaaaaacaaggtctcattatgttgcccaggcctgacacaaactcctgggtttaagggatcctcccacctcagcctcccaagtagttgagagtgactagagtcacatgccactgtgcctggctctactttcatatattgtgttccttaaattggatttttaaagtcctatgtagaaaagccaaacaaggccaggtgtgggggctcactcatataatcccaatactttgattggctgaggcaggaggttagcttgagcccaggggtttgagacccgcctgagcaacatggtgagatcttgtctctaaaaaaatgaaaaccttagccaggcatagtggtgcacacctgtggtcccagctattcagtaggctaaggtggaaggatcacttgagcccagaaggttgaggctgcagtgagcgatattgtcaccactgcactccagcctgggttacagagtgagattctgtcaaaaaaaaaaaaaaaaaaagaatagaaaagaaaagaaaaagaaaagtcaaacagtggtttttaatagctgttcttctagcaaggataagtttaattcctgcaatatgtcttttctcaaaaagtcaaggagaagccttaataactggagcagcttggtgtgcaggcacctctaccgctcccaggactggagctagaacttagatattgaatcaggacatctcatgtctttctcaacaaaataatgctcccttcccccaaacaaatttaccaaactctaaatatattattgcacaacttccttatggtttggaaggaactttttcctaactttatcaaatctaaagaaccatgaagcaactctttctcctaagtctatgcttcagtcataagcactgtgaattacgcaaatagcttagttagatatgtagatgagttaaaaatagaatctgcaaaacaaaatgcagattgtacaaaaattaaggatatgatcaccagtccaggatcacctccaataggttatctcataagctgtgaacattgccacttaaagtgattcactcagggcctaaggaaccttctgtaggagaaattgaggaagtgcttatactctgtatgatttcatatacacatacaaaaaagtggactgaaaaatataaatctattttgccagatgttcttaacatttatatttatctgcattaaaacaatgtttttgttactggagagtggaattttcaataagattttaataagaaaaattatttcatttgctatattctctcagaacataaattacactgtagcagtaagttagactttctttcatactctggaagtacattttagcatattattcttccagtaaactacctgatatctatagagtgctgaagaagttagcagccagattatttggtttacctacaagagattaatttgcatatcagcaaggtctgcataaatctgggtgcagtatctttcagtcttttctctgttttgtaacacttgacccatcaatttagatagtaccttgcctgaagtacaaaaatgaggaagacatgtatattatctcttttaatgataggcaaatgaggaatcaactcttacaggtgtctgggagatttcagactatgtatttataatcttatttaatattatataaccaaatatttttatgcctttccactaattttctaccaaatgcttaaagagagtctatttagaataaaaaccacttgaatggattatttatattaagagcttactaaacattctttgtaatattggctattattttttaccttgaatgtgttgcttaaatttggactttttctcaaacactattggtattttagtggcaaaattatttaatggtagatgtttaacattggagatcttagcatgtattgatttgcacaaaaattctattctttaaaggtcatatgtaccaaatttcataaaggaaatgcattggagatgcttagtagacattttcttaggcactaagtattacttgcttataaggatattttactgtttatgtataggttaaatacttcacttgtaatgtccatcttgtaaagaaagtcctctctgtgttgaaaatctctcattgctaatcttgtttttttatatgtccagtaagagttaccaatatatctttcatgagctatggcaaatcattgataattactgttcaatttattcctccctaggcaaatgggttcctttgtagtacctaggacaagggatccacaggcaggagtcctctggcattgatgactgatggaataagccatagtgacacatagctactataccacatgagagcatcatgatttgtttattttagaactggttgtagcaatattagaggatgaaatgattttcttaaagcactaggagagtggggactacatcatcaggataacttaaagaaaagctgctcaaaaacaaagtgtcccagtctcttcaataaattgtattctctccttgactatttaatttatgcaaatgcacaatgaaaatatttttgcttcatatctgaatcttcataagaaaatgtatatttaaaaataataaaatcatatttttcagttatctacattaaatcttttattcatgttatagtttaattacatgatatctgtcttcaccaatggaaatgtaatgtgctaaatgctccattaattttttccccttataccttatgctcagttatgcctggtacaaacgacatatacttttctgatattattgatgaggtgttcatgacctttctgttgagatttgtgtggtggtgctgtttaaagaaagagtacttagtggaatttgtgtgaccacaccaggcaattgaagaataggtattatttctggccttggttctataacccaagttaattataatcactttaagaagaaaacagtcttgctatagcaagctgttttgggttttctttttctaaatgagagaaaattgatgtgatgctttttacattgcattttacagcaaagcataagatctgtttacctggttgaaattcaaattgttttattatggtgtcaattctttggttttggcagcacttctaaagtgtctattcacaaaaagactcccatagtgaatgaatgctagtgttgacaccacctaacaagcagggattatgtgtttacagaagaagtaatatgataggtcaagtataagaggcacttctcaagagcacttcagcacataatgagtgactgactagaaagtgcggagctgccactctttggcttggagtccgtgttgatgcctgcctctcttctccaaagctctcttgatcatgttcagctgctctgttctcatgtggggaataatagtagagtaaagctgcttttctgtctcatttttcttgctaatttacacattcaagccattttttgtttgctacccttatttgctattcccttttgtccaggcactgttctcttttttgcctcaggcctaagaactaatttgagcttctataattacttcatgttttacacctgtctgcgtatcatgcacccgcttgtctctgtacttaagctgtatatttccttgcagaaaagctagttttcatatacaaggactcctaagtttctcccctcagactgcctacagaagaaacacaattaaactgttgcgatatcctcagccatgcagctgacctttgcagttcatgaaggacaaatgaacgctgtctgctcagacagtttgtgttaagacattgttgagcagagagcctgagctttgttcctcatgaatgaagcaatggttgtagtcattttaaaatcattaagactctgaatgcacagtctcattctacagtgtttgctctacagctgctcttctgctttaatagcagcttattaaatttgggtcaagcgtactctgaagagtatcacaatgaagaaactgttctaaaagttacctgtttaaaaaaaggcaattgattagatttttaacttaagtgacagctgcaattcattgcctattctttgtgatgtcctgcagcccaagcagccttttgtaatttgggcttcattttgcaagagctttcctgaacaatccagggttgctttccactcggagcctgcttcaatccaattaggagtttaacaagggtcaaattaaagagactttacacttcatgtttgcatcattagccataagactgttatgtgagtgcatgactgtgtgtcagggaagagggggaaaggctgcaggatgggacagacacaaagctgtcatccaccgtgtggtgtgctcctttactgatggaggctcagcaggctagcaacaacatttccagttgtcttttggggttgctgccttgtcaaatcagctggtatatagttgtttggaggttacaggtgctagctggggctgataaagaagagtgttttttgcctactcttttctcttctggtagtctgttgtgattggacaaacgactgggaagacatgaagttgaaacctcttgagcattcattatttttgatgagatgacaactatctaggttcatgttctcactcctcgtgctctttcctggctcttcttttttttttttttttgaaaacataattgttggttctgtaaaatattatcataggaaatggaaactaatttttaggagaatagttagaggctttgcaaagaccagttacctgttattcaggaaaacagagttcactatagtattttcagaattgtgttacgtagaatagcattttgctccactttgtccataccatcaagatatatttatatttagccatattatgttactgtttaaagaaaatgacctgtttctaaaaagaagagacaatagaattctgctaatcagcagttccatgcgtgggatatcgctagagaactgttgctgtgccccttgagcaaagctttgtgctgctacacacaaagtaaagatttatctaaaataacactttcattgttcctttcttacctcctcaacccattaataggtactttagtatcatgagagttttcatagtttaatcccctttcaaaagcttttcagaataaaagctctaaatggtcctcagtattaatttgatgtgacttctgtacaatatggtttaaaactctcagaagcacatttttactgcttaccctttttcatcagagcaacgtgtggaaaataccagctaaatgtttagtggagtctctattgtgagccactgttgttgctttctgataacatagattttcaattaaaaaattattgtcattgtgatatatatgactgttaatcctcaagaatatttgggctctccatttttaaaaatgtaaatgtcttcttgttatttttcaaagctgtagttttataaagtctctgatttgcaaagaattgagagtgagtaataaagtcagcctggtaaatagtaatcaggcttgattatatgcactcagttacatctttgtttatatgtagaccacagtagcttcaaacacaagagcttccagcactaataaataacctacctcaccttttttatgtgatgcttttgaatacacatttatctttcttaaaacagttaatatatggtaaatgtaattcttgctgtctgtaaagcatttgatgatggaactatacattccatgccaagttccatttcctcgactcctcctgcaactgcaaagcctccaatatgacgggggcggggaacccctattaatccttttaaattccagatcccctctctgatttttttccacattgtcagaggggatgtatgtatgtgtgtgtgcatacatgtgtatatacacacgtgaacatccttccacagagaaaaaggtatttatttctaaaaatatttttgaagcacctgctagtgctagggactgagccagtgaaacagcagagagagctcaaacaataccaccttgcctgccggggctttagtggagtggagagatggacagaaatcacaggaaacaatgtaaacttacgactgtgaatgtgctcttattggggaatgtgatctggtcagcaagttcagagacagttttcctaagcaagtgaccttaggctaaccttttgaaaacatcatgctataaaaaatttttgtttattttctttccaaagaactgaaaatatttctgcatatgcttcgaactcaacaaatttacaaacataatgaaatttgtgctggtaatatattaggtaaaagaacatgtagaaaagggcatctggaaggagatataaataattataatttctaaggaaagttttaggctcagttttaagttacatttatggacaggaatgagcaagtgacttctaaaactattcctttttcttcattatattttccctgggtttttttttttcttttctttcttccacaaagttttttccatgatttatctgcttaccgtgtggaagcagattggaatcttccactagtgaatgaacagtgtgctgggaccagatcctctgggggtttgtgggtctgtacattcagtgacctcactatggtagcttgaaatctgcttatgacagtaggatctatacaacagaaattggtaaaccctgcaaattctcctcccctccctgcaccagcttgtttagcagcacatccgtgcttatgtctgatacagtacgtgggatttgggcctgcaaatagatttgggaaaaagagtccataacacagcttccctccatagctccaaaggagctataaatggaaactagaaagcttaaaatcaagttttggattttttttattaattaagttttatgagttttaaaatttagccaattatatcatttatcttttaagataatagccacaactcctccccatggattaagtgatgattacttttttaaatgattgtcttttgcatgtaaatgtttactagtttccagtgtaatcacaggcaatataaattcgaaggtatatttttaaactgcacactaatgacctttatcaatcagtctttatttttttccttataatgaattaaatgttgttgtgctttcaaaaccaatgtactcattggttttttctaatataaaagtaatacttgctaaatacttaaatattatagtgtagtcaatatataatagtataaaaaataaaattaaaattactgataatcaaacagcccagagataagaatttaaaatactatacattttcaatgtatctgtctacatataggtagatatataatttttatagatcatagtataaagattattttgtaacccacattattcacacaaaaatataatatgaacatatttctatatcaataagtattgatctacattatttcttttagtagctacataacagttcattgtatgaataccatatattaataataactaatcacctacaggtaaacattttttgatattttctctattttaaatactgtataattttgtaaatactcttttgtatacttgttcatttaccaggatacatttcttaaggtagcattgctggtattgagaattcatggtttgtttcattttgtttttgaggcatctatacaaattgcttccaaatttcccttcagaaattttgtactaatatgtaaaatagcatattggattatttatgttattgctcctttgtcaatataggtattattattcttatttatttttgttaacctgattaactgatcatcacactggttttaaagaatctaattttaaaactatttcttcgtgctctatagcttgtaagcttaaaattgacttcagtatattaaatgttattgtattatttttcaattttgattattccctaagagaaaggaacaaatacatgatttgaagtgtgcaaaatttatgtaaaaatatgagaatacagttttacatgaaagacctgataaaatatatattatgctatctaggaagagaagcaattatgaatattcatttacagttggatatttgagatatttcacattcttcacatccattcatgagtgaatatttgttttagaggaaacattttggattttaaaaccagaatgtggagtatccctttgtagaatgttgccagctaattgaagttacaaacaacaaaacaaccaaaaacactgcaatccaagcaaagcgtatctgaagcaaaatttggcctaaagcctgccagtttacaaactctgcgttttgtggctttcttcctatgtaatataatacacatctaaccagttcttaactaaaactgtttctcttcctttccctgaaaccttagtaacacctacctgtttagattgagcatgcccaacttggaggctgccacagttgagaccgttttgtctcatctcacacccatcccacttcactcttggacttcacttgactttatctgcagttgctgtttttgagtatgtaaagataaaagataaaaatcttttcatttacttatttttctttttttctgatattgttaatatttaagtattttatattgtaggtaggagggaactttttttttcctcttttgatacacggtctcactctgttgctcaagctagagtgcactggcacaattatggctcactgtagccttgacctcctgggatcaatcatagctgggattataggcgtgcccccatgccaggctaattttcttatttttttgtagagacagaggtcttactatgttgtccaggctagtctcgaactcctgggctcaccaaacagtcctccccgcttggcctcccaaagtgctgggattacaggcgtgagccactgtacccagccaatatgtttttcatgtttaaatgcaatgttgcttattttttggtataaaataaaaatgctacgattatcggaacctcatttgtatctcagtaaattactggcttgtattaatttactgcttaaagtaaatattataaaatatatattattttaaagaatgtgggcagaaatcagaattcaaaataacatttttaaaagaggctatgccattagcatacatactgagatatgcatttatttaaaacatacctatacttgtttggaatcatgcttactatgttcatatgaatccaacattgaggtaaaaactggctttttaaaaaaaattagttgacaatagacatatagagtttgagtttagacctataaatagctaactattatttcaatgatacgtatttggcctttgacctttgttgcttaaagactagctcacgatgctccgcagttaatgtaaaacttagttaaaccatggcgacctattccggagtatgagaattggaagtgagaaatggaagtaagaattctgaactgggagtgtaatcagctgtcactgtttaaatagtccagttttattatttctccttcaactcttcattttttcatgtaatgagcgtaaatacggactttttaactgttatattagggatacatctatgcctaagctgaagcctgaagctatattttaaatttgtgattccatcttagaaggaataaccagagtacaattttgaagaaataggttaaaaatgcattcccttaataactacagttttctcctcgaaaaggttaatgtagtaaaataaatactatgagaggtatccatgagttttaatatctggaaatcttttgtgtgtgggacattttaaaagttctttgtgttttaatgaatattcaattaattgattttaaattaattagatttaaagacagaaagcattctactttagtctgcatgttcaacttacagatttgattttactcataaatattttgcatataaaaacaccatttactttcaattaatcttcaattcaaatttaaataactgataggtttgagaaatcaaattcctttaatcacttaacaccagatccatactaattcatcagattctcttatatatttccaacttcatctattaaatttatttatttattttattttttgagacatgttctcactctgtcacctgagctggagtgtggtggcacgatcttagcttactgcagccttaaactcctgggcacaagtgatcctccagcctcagccttcagagtagctgggactacaggcacgtgccagcacactcagctaatatatatatattttatttttgtagagaataggtctggctttgttgcccaggctagtcttgaactcgtggcctcaagtgatcctcgtgccttggcctctcatagaactgagattacaagcgtgagccacctcaaccagacccatccattaaatgtataaatctgatttgttactatttacggcagtagtttaaatacttagaattttttttttaggtttataagtctgccttatgttttttaagtgtttgagaaatcaaatgtattgattcagcaagagtaatttgaaattcttacaaagaactgtgatagcaaaatgctatagttaaaacagcccaggggtcaggtgggttcgtgttctgtccgtccctcactcattcccaacaacacagtcaaaagataaatcctaagtaaattaccccacaaatttttgagttagaatttgtgataaattatttcattgcaatttttcaaaataaataaagcctcaacatgatttgtcacaagtcatagagccagttagaagaactcaacctagggctcgtttgattcctaggtccatgttcttaactccaaaccatttctcaaattatagaaccattgccatagagtttgaaggtattttctaagtcatctggtctaattctacattataggactcctttcttgaacatcccttttaatatccatccattttgaatgtttatagcaataaggacctcctgttaatttttccccttctggctactgtcccccttgtcccccttaaagctatctccaatgacttctttctttctttgtcttaaaaccacttaacataggctttgcttccaacacttctctgaaaatgcttttgttaaggtcaccaatgacctcccttttacaaaatccataggccaatctctattctatttacataatttatcataccctcatcctgaattgaaactgaccttcccttccaggatgccctactcctgttctacctcactcgcttctccttttcagtcttctttgccaaaattctctccttttcttcaaccacctaatgttggagtgtcccaaagctcagttcttggacctttttttttctttttacaattactctcctggtaatcttatggcttaaatatcctccatatactgaaaactccaaaatttctatttctagcctgactctctttcttgaacttcaggctcttatattcaaatgcctacctggcatttctgcttgagagtccaatagataaaccaaacttactttgtctagttttgaactcctattttcttttccactgcccttcccaattcccaaaatattgctgtacctacagtctttcttatcacagttcctttcagctctttcaatccagttgttcgagccaaaaccttggagttaatttgacttctctctttctctcacacccaacatatacagtctcttagcaagtcacattatctctacttcaaaatatatccagaatttaacttgtcaccatctccatggctaccatgtagataagcctcttctgggtattctttaattttgaatgcaccccgtacaatgaaatactcagaaatggcctgattgaacgtgttgcaatggaattgctctatcccttttccatcatcataattcattctaggattgtaaggatcattttagtagtcatgtcatggtgttgactggagtcaaccaaagttccagtatttcttttatattaattgctgctagataggtatcaccatctaaaataattaagtgactatcacttgtggagcacctacatatgcaactttgtttcattattacccttaaagataggaattattatctcaattggtagatgaagaaatagagactcagaaaagctaagtaatttgcttaagatcacagggctagaaattggtagaaacggtagtagaatccagacctgtttcactttaaagccaatccttggaccatcacatatgaagggctgcagatgagaaagaacatgatacactcaaggatttgaaaaacatgcaatatattgggaaagtataagggacagaatgctggcaagaatcagaccagagagggaagtgctcagttttgagggatattataagccatatttgaggagtttacattttactgacaaacattgggaaggtactattaaggtatttcaagcagatttacttttctaattaatgattactctaatgttagcatgaagaatgaattggatgacaacaatgctgagttttaatggcctaaactagagtagtagcagtgaaaaaaacagaaattgatagatcaggtggatttcaggagtaaagtggataacatttgtgaactgactggatgtgggaggtgagagagaggatgactgccaggtttctggctgagtggttgataacattcattcagaatgaccattggaggaaaggaaggtagtgctggaatgggtataggagatgtgataactttacttttggaaatagtaaaaggaatctaggagacatttcagtggtaatacccagatgacatctgatctaggatctaggggagtggaggtctcagctgcaggtaaatctgtgaggtaaatctgtgagacatcagaacatgggtggtaactgaagtcacagaactggatgagttgaatggcggattgtttggagattccatggctaaactggggctccaatatcagagtgtctagcaatcatgccctaatgggaaaggaaggggagctggacatgagtgtctactgtgtgcctttcaatggatatgccttttacctgcagatggcctgatgccttattgtccagccctgaccaggagtccctcccatgggtaactgtttataatggcggatgccattgtgtctcttgtctgacctgtgtctggcgtatgcctgcctgaccgtggctatggttctgcaaacccaaccttgtggttcccccttgcatcctagggaaaagccagctggtagctggctggtagctggttcttctaatgaaaggcacaaattcgatacaccgccacaacaggaaataagttcagaaagctgttacttatagatcctgggcagggaaggcaccatgagtcaggagggaagttctctgtcccaggtcatgtgaggcaggtgtgtagagtcagagagagagagagagagagtgagcgagtgagtgcttgcatggaaactagcagtatatgtaagggaatgggggcaggagagtcactttaagttcgtgggcaaatgtatgaatggtccatttgaaggaaatggcaaaaaagctaagagcccagtctgctaggccagagagaggcctctaagtttttgtatttggccaccggcttaagccatttgtggtgttctacttctagtacctaggcagcaacctttgctgtgttgtttccattacaaagatgccagtcttttaaagataggaaggagttgtttgcaaatggcatttaaagaatagatagagagttagtgggaaaaaattaggagagtggtagtggaagtcaagaaaagcgtttcaagaaggatggactgaccggcgaacagtgccaaatctgaaggggtcagctagatagggactgaaaatagccattgaattgaataaggcgacagtcactatgaaaagggttgtttcagcagattgtcaagggcttaaggatattaagtatttttcatttttcaagctaaaaggggagctcatttcagtttattaaatttcatcttgcagacttcaagctaacttctacttcatgattttgaatgtcaatagatctgatctgaatatgaaattctgaggaagatttttccttatagccactaactgtttattaattattctcaacatacttttgaaaacatttgaaatgggtttgtatcagaggtgactccagaatttctgtgtagaggagattaagactgtgagcgtttgaatggagaattgaaagaacaatccatggaacttgtgtgtttccatggcctatattacaaatcaagaaaaacagtgaggtgttctagagaggtttttattcacaacttaaataagtttaaggaaggacacatgcagcctcatacaaccgctctttcttctgtcattcttgacatagttttgcatttttgtagcatccatgacatgaaaataatattaaataccttagtgtccatttatattttgacttaatttttcagctctgttgttctgacctatctgggtaaaagtaatctgccttgtgttgtaagtgttaacactaagggcctgccatgcaccagccacctcgctgggatgtgtgaggatgatgtttagatagttcttgcaccagattttttaccgtattacacgttactgtctgttttttgactcagaaaaataaaatcaacttgcaaaggaataaaaaagaaggaagaaagggaaagcaaggtgggaaagaaggtaaaagagggaagaaggaagtatttactgagcatctgactaggtaccaaacattatgctagaaactttcatgtatagtatctcatttagtccttacaattttgttaggcactcattttacagtggagaaaactagagtttgagaaagtccagtaagatttattaacttatctaaaagctatgtaggaagtaagaaataaagctgagatcttattaatgtccagaatgcttgccaccacacatcatgccatcttacctggaaaattcattttcctcattttaatattttagtcctattatgacttcttaatggattttcagataacataataataagtagaaaacatgaaaataataaaatatggtggattataagtacatcattcaagtttgctattgaaggaaatgtatgtttcttttaaaataatgtgatccatttaaatatcagcaatcccaagtaaaaactcaaataaatactcaagtaaaagcttgggctattcctgaaaatcattgttagttttgagatatatttattcacatagtcagcctgcaattgtcaagcaatatagcacaggaagcattgttcaagttgctgtggaatacctattttattctctgcttacaatgactggactttaaagaatttttaaccacataaggacttttaaaataatgtatttattggtgattatcaatatataacagtatgttgcatatataacatacaactcagaacacgtaagtactttaaagttgacttaaacctacaatgaaatattaagtacagaacctattacagatttttcgagcaaggaacccatttgacaaagaaagaaaaaataatcactagcataattattactggatttgttatccacacatccagtatctctcaaccctcatcaggtgttgattgcaatgtatatttttactctaaagtattctatgcaagtagatatctctctatatatgcagttagcaaagatagtcaaatatactgctattagtaaggcagcattacactgtatcatattacctatgttaatacactcttcaaagaagttatataatgttttaattttttaacttctacaaatattttttaaattatcccatatcttgttatttgtaatataagaagttaggtattgtgtattgttaatatagcagttacctcatttatttacctgagagtactgtttgcaaataattaggagaatgacaaaaaagtatggttggaaattgtattatctgtcagtacctctactgaaagttgtttttaatgtccagtggagatgttttgatatttataattgactctactttgtttgcttaaagtatgttttgactaagctatgcagtgactatttgaagatagatattctattcaggaatttttaaaacctcaatgtctaaaagaactcatcaaactcacccgtcttgaactgtcagtgaaagcacatgcttttaatttctaacacacattagttgtgtttgcactacaggtacacaacaggaagtaaaatcgtgaacccatagcttcccagtatcaattaaaatcttggctgcatgaaacagtattttttgaggattacctgatggttgaagggttcattcattcctaaatattctgtatcctgggattaaacctgaatagcagaaactgtcaacctggactttcatgttggcccctgttctggttaaaatctttggttgcatggaataggcttcattcaagttacctcaagcaatagatgctataggtatatatggtctggaatttaaaaatggaatagctgagtcagctttagggaccaactgctctgtttgtctttcataaaccatttggtctgctaatctctgagcgttcttttcttcttctcaacagataatcttcctgtgcttactcaaacagctttggttccttgtactttcagcttgcctgagtcttatcttggctccctggcctctcagtacattgtgatatttcagcttcagttcctactgccacacagttctttctgcatttcctttttctagctctctacagaaagaatctgactcattctactcctattttttagtcaggccaaaccacggactattggcaaacctctggattagctgtcgttgattcagcctagaggaggtaccttgcggtcctcataggtcgacctccttccacaaaaactgtggctgagcccatttctctcagaaggcagctgcaggctgtcttgtactacctcatggtaggattgatttttctaagttgtgctttgggaaatattgtaagccttgaaactcagtgtaaggttattgttgaagacattattgattatactatacaggtttttttaaaactcttggcataaatttatttctagctttagtattaggaaataattgtgcaattattcctgaactcgtttgtttttatcttcattacctttgtggtgaaattattacttttttcttttttttttttttaagatggagtcttgctctgtcacccaggctggaatgcagtggcgcaacctcggctcgctgcaacctccacctcccaggttcaagcgattctcctgcctcagcctcccgagtagctggaattacaggcgcctgccaccacacctggcaattttttttttttttttttttttttttttagtagagatggggtttcaccatgttggccaggctggttttgaactcctggcctcaagggatccacctgcctcagcctctcaaagtgctaggattacaggcatgagccaccgtgcctggcctattacttctttttcaacattgcctgttgggagttcacaaatttgtgccccaaacacaggaagtttaaatgattctgtggtatgcttttttagtcttattatccaacttacacctgaattcattttctgtttttcacctttttttaaatatatttctaatttgaattataatttatatattcctgtaagtcactttatatcttttcagaagtgaggtatagatgtaaagtatataaattataacacattcaggaacatgttcatgtttccagctagtttttagttaaatgtgagcaaattttaaagaaatggacaaagtattggaaaataatagtatgtgacatttttctgtatttaagtaattttaaatcatccagctacttttttaaaaaaacctaaaattcccattgggtttagaactatctttcaaatataatttgagattagaaaatctattttattacacattaatcattttttgtcataactatttgtaacatattctttgtcatggagaaggtagtagaagtgtaataaaattaatatacattttaaattatttctacataaacccgtttctaaaacagcagcctctagccctccaacaataacatactcctaaaattatttttccccagactctacttcttggctactcctttagaaaaaaaaaaaagaaactgacatcaattttatataaaagaagcccttgaggtggaaagttgggaagactgcatgagtttatagcggacaaaatgtcgcttacattttgctgctcagtagtttgatatactcatttgctgatgtgaaatgacgagggcttacaaaacagggttttgttttttagctgcctgtagacctagtggggcctaacagaacccagtcagcaggtcattaactctggagaaaacagcttgcattaatatgctctaatccggtataattagtcaaattactgcacgccgaccagcttgtcatgtgttgtcagacttggcatgtacgctgggttgcctgggtccctctggaatgccaccctcaatcagaaaaaactgctcatttgtagtgggtcttgaactcttgatgcaaaagcctactaaaatagtggtcatagaggaatttttattaatttttgagaaaaaaatattttcatcaaaaataatttagtactttggtgattgaaatggaatctgttcatttttgctgttttctgtaccatatctatgtaatactccaagaaaaattaacattagtgcaaacaaaaaagaggtcgaaaataaataattaccggttgatcatttatcattccaatatatggcagtgtgcatttgtaggtgtttgtgtatgtgtgggtctttttccagtagggtaagaggttattaaactctaaaagggctacattagcataaatttacaagagctcttgttctggcggcatgacaaaaacctgtgttacctttgcattaacactgaattgcttgttgtgcttttggcaatgacagataagtccgtgtaattccccattgcaacagaaatgatgctccagattccaaacgcatcctgaagatgtcactgacaataatcttcaaagaacgggcagtgaaagtgggctgtatgtttgtaggatgatatactgcaaatgacaggaagaattatgtgagtgaagacgaatctgtaacatattattaagcaatttcacgagaataacagggataaaaggataatggatgagggtgtcattattaccttcatgtagagggaaagcaaaagcaaaggtagagagacaagattaattgaggaagggtgaagcattcattgctcatcagctcttttgtactctttgctcctgaaattccagactgaggaggggaaaaggtgctcagagctgcattttaatgcatctggcaaagagtaggatactgacaaggcactttttagccacctccctttttatcaaaatacacataatgactgttaccttttgaatgttccaaaatcacagcaaaaattcagcagaaggttttattctttgtgtatatatgtatgtgtgtttggcagctttgattattaattaagcttttaaaacccaaaattataaaataccaaaatggttttttccatgcattgccaaaaaattgctattttcaatttagagaatcacgttctgtgatgaaacatttcaaaatccattatattattattttgattagtctgaggacattgtgttaaaaaggcaatatattttataagcagtttttactctccattttctaagtacatttccctttcatgtagtaactggttttttttttttaaatttaaatatattttctctttgttaaatgaagggtgtgagtaattaaaagcttaaaatactaaattctccatttatatcttttttaattacctgtttcttataacttctcattgggccaattactccaaagcacatattatatcacacacaataagatgcaattataacatagcaaccactatccttctggttgcagaatggtggtaacacaggtgttttgctgtaatctaagaaaccttttggggcatgaaatcccttctgattataatttactcatgatacggagttaaccttaaacattgtagaaactttaaattatatatatgtttctgtgtgctggactagtagaaaaataaaatgatcatattacaagcttaaatatgtatccaatggagatactcactcaaagattaatttgggaacaagaagcctacatttcatccttgtctacatagcaagttcctatattcaggaaaggtaacaaaggattaagattcaggagtcagtcagaattgagacccatgcaaggctgatagccagataataatcaagagtgtaatgtgtatcatacacagacatgcatagcagtaatgctattaaatgctacacgtatataccatctagtaatgctatattttattgcatactgtctctctgtatgcctataatgttttatccttgtcattttctgattagcagaactagaatttccattttagttctataaatgggaaatttgaggagcagaaaattaaatgagtctacccaggtaattttatagtaaatgatgcttctaagaataaaaccatcttcagatacctcatccaatctacattccatttgctgtttgattttttaatttgttattcatgccacattctgttttttgatattttgctagttttgatatgtgtcttttaaattatcttaaatgtttcttcactaaaggagcatcctctgccttatcttttctgtagagtaagggaaaagaaactaacatttcccaagtacttaatatgtgtcagacactgttctaggcactttgtatatattatctaacttaacatagttataatagctaagtgagttagatatcattatcactgttttacaaaggacaagcaaattcagagatgtccagttatttctccaagctcacaactgggaagtgttagggattcaaatctaaattttcctggttccaaagatcatgttctttcaattactacatactcacttactcttgtctatcctatatcttaacatatacagtcaaaattatactgtctttttacatctatcccatgttttagatctccaaatgtctgtattcagtggcctttttctgcccacatattccttgatttctgcataacatttgacactgagcttccgaaatcctaaacatgcttccttgccaagtcctccgctccccttccctggccactcttccgtcggcctcgccctcaatattctcccatccccaaaggtatgtcctttcagtcacctccattctctgccatagagatctaattccttttcgtgctttaaactttcactgtgtacagataatcccaaaggtacttctctagtcttgtcttccttctacagctctatattcttagctgcctgctctgttgattagctcttagtatgctttgattatctcaaccaagctcataattttccttttttctaatttccttttaacttcccaattttaaaagatgtcgtgattctaatcacccaggccttattgcccatttgaattacttagaaattctttagctcagcatcagaagcctctcccacctctttagcctattggagtttatctcccatctccatctttggcagatcaaccatccttcaaggcccattatcagatatcatctttagtaagaggctcgccccaaaccaatcaaacgtgtgtatttctcacatctttgaatctccaatcaatttgtaccttctactatatattttattgtagtttgtcttttattatttctatagttgtctactcacttccttagacagtaaacatcttgaaggcaggaaccattgtatcttatacacatagtacttggaataaccttacaagatacttaataaatatttgttgaattgagttaaataaaattatctgacagtctcaatcaagtatttttaaaatattttttcttttacatgaaaaagcctttactatgttgaaatttaatattaaccttttgattatttgacactcttgaatgtattttctttcctaatttacatttatacattgcaatttattatcataatagttaccatttaatgagcatgtacttcccttggtactttgttaattccggatatatggaggtgagcaagtccctaccttcatgaaggtcactatttccttgagaagatactgctcttttcatatgacatttcataccaacagtcctttgtagttatatgtatgatatatggaaaaaattaaaaagagaaattagagcactttattatatatttagatatatcttaatcttaattatattaaatccttataacaactataaaatgtaggtactatttatccccatttaacaaatatggaagcagactctgagagtcaaaggtactttttccaaatcacaaaagcagtaaaatggcagagccggaaatggaattaaagatggtttaaagccaaagtctgtggttttccactgtgccacatggctctgcatatccttgtcttagcaaagagatgttacatgacaggagctcttaactgtaactcctgtatttgcctcaaactagaggaggcagggaacattagtcataattatgccagacgatggttagaatggtattacttgttaaacttagggaaagcataccccctgcagttttataaaaggaaggaaaatatctttctacttttgtgcaaaatgcccaatcaggttgagcacacatggttgccctacttgctagcagcagtcacaagatcccaattattgatataatttgggtcagagagaatgttttctgcatcctaccgagctttgatttggggcggtgtggggggaaggttgcaggatacctcatagaggctgacactttccactgcatgtgctgctgtgcagatgattataagagagcaattcttcattcaccataagtccaaatcaaacgtagaacatgacaaatagaattagttcctctcttccctttgcattaagcaaatttgatgcttcgttgtgaaaggaaaaagcaagcaaacatcaacagattgactaatacaattctacttagcctttcaagcaatctctcagactgcctcttatgcctacgtgtctctttatttattcttttcttcttgttttttaactccaaacttcctttatcaagacttcttttgtcttcctttcctgtaagctgtttttaaatgtattctttgttttggggaaaagtaaaaattttctgttggtttcacattacccaaatttcaaaattctagtccacatactcatacaaaaaaatgatactcctaagttttagataagttaggatttctttattcaatttcttgcatctattagatgattctaattttatgtttcaacttataaacttttaaaggtgggatcatacaagtccctttcattgaccttattactacccatcatggtgacatacccaaatgttcatatactagtgcttttgattataaagattttctttttattttcagattttctaggcattcatgaaatattagtttcatttattttttaacatagttttggccttgtaaatagcattcagtgtaatgtagacatgaatatttcttacagaagaaatgaagagtataattcatttattttttttaaattttaaagggatacataataattatgcctatttatggggtacatgtgatattttgatacatgtatacaatgtgtaatgatcaaatctgaataactgggatattacctgaagcatttatcatttcttgtattgggaacattttgaatattctacctattttgaaatatacaatacattgttattaactatagttactctgctgtgctattgaacactagaacttattccttctatctaactgtatgtttgtacccattaaccaaactctctttatccccacacctccttcccatcctctggtaactattactctactttcttcttctttacagcagtccccaacctttttggcaccagggatgggtttcatggaagatcattcttccatggacccagggcatgggtggggatggtttcaggatgaaactgttccacctcagctcatcaagtattagattttcataaagagcatccaacctagatccctcacatgcgcagttcacaacagggtttgcgcctgctggcccatggctcacctcctgctgtaaagcccagtaccagcccatggcctggaggttggggactcttgctctataagatcaactgttgtatatttgtctttctgtgactggatttgaagagcataatttaacctggtgatttgattaggtagaagccaagcctaaggtgcctactatcctagtatcactatagtcaccatgtataataatacttcagttaaaaaatgccttgagataaggcaaccatgtctcttcctataccagcgagattctaacatttcctctcattagcactgagaaagtttttataggataagggactggagagaggttgagaaggaagatgtgccagtgctgatgctagcgaggaaaaggttagagtatccagggttacaggagcatggtgccaaggacgtcatgccacagaaactctgagggacaccaaccaagtgaccagtgatctctctctcttttttccaactagcttcaggaattgattcccctatttctctcttccagtactattatagattactttcacccagggtttcttttccttttgacctcaaagaggaaaagaacacagtcttctggcgtctcacaactgtcctctccctttagccctcagactcctttaaacttctattggaaaattctaagtctttatatcacttcattttgagagcttcttcttgaaacttatgtatgacatactataaatgaaacttttttcggacatatctttactgatgaggaaaatttttcattgaggaaaaaatcttttattccctcacatgccttctttgtccatagagaagaaaattccactcaagcttttgttgttcttcccatgggaaggaaatttctgctctcattttccagagcattttcattgctgggtgttggaggccttgttttggtttcaaatcacactgaattgatcaagtcttcccaggataaccttgcaataagggaggataatattagatattaattttattaatatttatgaataattactatttaatattatagtcattactattaatttttatgaaaagttcctagttttacatctggttattgttcccctgatgtacatttccttagtcaaaaaccctgcaggaaaaggcaaaatgcgataggctttaagcagcaaaatttcacccacaggttctaattctgattccattattattacaagtatgaatattcaggaatcatttggttgcaagaaatagaactcaaactagcttaatgtaaaagatcatttattttaagcaataggagtagctcatgaaatcccatgacaagaacaggcagaacctgaggagagactggaactgaggattggaaagccatttgtctggatgtctccccttctgggccacgtggttctttgtctctgcttctgcttcatcgttgtttctcctcacagataagatgtccctggatctccccgctagaaacccaaaagtcactgcagggacattacagagactgcaattcactgctgctccattaccaactaaagttccactttcaaattccaaggagagggaatttggttggtttgcctcggcaacaaatgttcaccctggtctaaatcagctctggtcagaaagaagtagggacacacctctgagagtatgggaaagcttttttgagaaagggggcatggttggtacatacattccaaaaagtctctcccctttaactattttggttcctcctttcctcagtatactattcagaaagaagaatgcgcaacccagtttggagaaagataggaagattcttaaatatgaacccatcaacagggagtcagacagagaggagcaggacattccatacagatagaaggaacagtgagtgcaaaagtacagagaggcgaaccacttctgagaacagcagggattcaaggggatgtagagcagtggtatgaggggaacccagagatggatgctgatactcagcagcagcatttgctataggatgctgggggtggttggctgggcacggtggctcatgcctgtaatcccagcagtttgggaggccaaagagggtggatcacctgaggatcacctgaggtcaggagatcgagaccagcctggccaatatgatgaaaccctgtctctactaaaaatacaaaaattagccaggtatggtggcgcatgcctgtaatcccagctacttgggcagctgaggcaggagaatcacttgaacccgggaggcagaggttggagtgagccaagatcacaccactgcactccacactccagcctgggcaacaaagcaagataccatctccaaaaaaaaaaaaaaaaaaaaaaaaaaaaaaatggatgctggggatgggagtcagagtctggaggcaggggcattggtaagggttgccggaggttagaaaaccactaagatggggtccccaccctcccctgcgacggtaccagtctatggccttttaggaaccagggcacccagcaggaggtgagcagcaggcaaggaagcactgctgcctgagctccacctcctgtcagatcagcggcagcatgagattctcataggatcgtgaaccctattgtgaactgtgcattggagggatctagggtgcacactccctatgagaatctaatgcctgatgatccgaggtggaacagtttaatccccagaccaccccaccccctcaccccctggtccgtgaaagattgtcttccgtggaacgggttcctggtgccagaaaggttgaggactgctgctaagagacttacacagctttatcagtgaaaataaaaagaacagatgtgagaaatactgtggagctggaatcaacaggattagccaccagttggacgtagaaaggaaatgacaagaatatttacagatgagtcccaaatgtttagtttgatggctttatgaatagtgttgccatccactaagataatgacaaaaacttactattattatagtgaccaccctttctgagtacccattatatacaaaatactgtgccagaaacctttccatccactatttaatcactctattgtccccatgattgatattattttcactgttttatatataagaaatgaaagtcttcaagaatttaggtatgttgcctacattcatgtaactcaaggtacagagttaattctcatgcccatttctgacatcagaaccaccgtgcacttgggtttgtttttcttaagaaagaagaacagattttaaggaaaatagaagttcagtttggacttactacattgtgtttcctgtgagacattcagctggagaggtctagtggacatttgactatgggtctgcaacttatgagcagtctgggctggacccttcgatttgagagacagcagcttaaagtgggaattatgagagtggcagaaatcactcaggaggaggaagctgcccaatgagttactatgtaaagcatacgcctgcctctcctgggggttgtttgacatcataaatacactgacatacaatttttcaaggcattcactttcaattttaggaatcccttctatatcagttattatagccctgctttttagatttgtactttttctctctcttttcaaaaatatttgccagggatttgtcttttctgagaaccagtttttagacttcttaaattttcacttttaaattttctaatgatttttctatttattttagctatatttccctctgcttttttcctttgattttttttctgcttttttaagatttaaattgaattccaaattcatgaagttttctttatagttgtaagcatttaaaagtaaaaacttacattggctttctattttcatcacatttcatggtaatgttttaaatattcaccatttcctaaatgctctattactgtgttcatgcctaagacaatgacattaacccaaatgaatctaattggtaggatatctttggtaataaggtctttcttggggcactggaaagaggataatgtaaagcctcacattgctccctctagattctataccacatgttacccactcaactcagaatccataaggaagagctgtgctacagactcaaagaaaaagaaaaagattcatcctctcttttcgagtatgtttcaaaacaccaagtcaaatcttttggttaagttccaaaggaaaaagtcagcaatgaacattgtgatctgagtgaggataggagctcggggagtgcctccaagcccttgtactgcctttcccatctgtttttcactttctcccattcccccaagtacttagtagagttttccattaagctccactgaactgagccattctcagcaaaataactccacaggttatttattgcggttcaaataagttccaaatcaaattctgtgtcattgaatatcatttttaaattccttcaagtcagattggtatattacattgagtttgtcatatttaaccaacaaactaaagctaaacattttccaaaggaaaaaaacaaatgctgaaatacaccacttggattttatttaatattatttaaaataacattaaactagaacatgtggacataaattctataactaaacttactgatttatgtatcatagaaaagtaataaaacaactctcttctaaataaaggcttatttacacaatgttaaatggtcagaaatacagcacttaccaggatgttccttgtcagcacacaaggtattgcaagaatagattacctggatgaatgattcagaagccttttatctagagagtcaatataataaagataggacatagtgtattctggtccccattgtggatcctttttttaatttagagaactaaattgatgtcatttacttagaagaatgctcaataacaaaatgtattactttatccttttaaatgtcctaccatttttcagagaatatttaaagcaaactaatgcatatcagaaataagttatcttgttactgtcaaaggatattaaatgtagttgcttaatatatttacttaccttgctttagtgcctggtatatcaaaccattgaatgtcaatcaagatatgcattaaatcattatagagattagtggtaaatattactatattattaaaataaatttgaggccaggtgcggtggctcacgcctgtaatcctagcactttgggaggccgaggtgggtggaccacctgaggtcaggagtttgagaccagcctggccaacatggcaaaaccccatctccactaaaaatacaaaaaattagccagtcgtggtggcgcatgcctgtaatctcagctactcaggaggctgaggaaggagaatcacttgaacccagaaggcagaggttgcaggaagccaagatcgcgccactgcactccagcctgcatgacaggagcaagattccatctcaataaataaataaataaataaataacaaataaaaaacaaaaaaacttgagaaaacattcccatatttagagggaagtgtactctatatgggaactctgaggcaggatacttggtatcttagtcttttggggtcactataacaaaataccttagatcaagttatttatagacaacagaattttattgcttatagttgtggaggctgggaagtctaagaacaaggcaccagcacttttggtgtctggtggaggctctctgccttatacatggtgccttgttgctgtgtcttcacatggtggaaggggaagagggtttcccaagcctcttctataagggtactaattccttcccaaaggccccacctcttagggattacagattaggttttagcatatgaatttcagagggaagggagagacacgaacgttcggaccatagcacttggattccagtctcagctctcccagcatttagactttttgtgaccttgatgaaataagttaacagttctaagtctttccttcctcgttggtaaaatggggatacaaattcttgtccagcctatcaaaaagtgattttgtgatgcttaaagttgaatatttgaaaaatgtgtggtatgtatatagttatatattaagaacttctacattttgttttgtagatattttaaattattttgctatgaaacggtccaatcagtagaaaaaccaaccaatgtcatgtactcaactgcccaactttaacatttcataaaatttgatatatttgcttctgatcgtttttacaaaataaaacattaaaaaaatacaagtttttggccagtggcccatgattgtaatctcagcactttaggaggtcgaggcccgtggatcacttgaatccaggagctcaagaccagcttgggcaacatggtgaaaacccgtctctactaaaaatataaaaattttggtgatgcacgcctctggtcccagctactcaggaggctgaggcaggagaatcacttgaacccagtgtccttggagtgtcacttttccagctggaaacctctgtggcctatggtgccttttcccaagttttgcttgggcccactgggcttgttctgcccactcagcctggcaggctatgctaagcttgcactactggcccagatcccatgcctgccaagggcgagccaggcacagagtggtgaagaatgtgtgagcgagtgcatggtccggccaccgtgcacagccaggtgtgctggctgtggcagggcaggcagctccaggcactggcacaggtgctggctctgtatgagactaaggctggaacaggcatactgcaagtggcttcaatgatgggcaccgggaaatgcagtggcgacaagaagctggtagacaccaggaaccacagagccccaaagagagtatcacaaccatggctcagggagcccctaggtctgggctccctgaagggccccagctcttctcttcctctctccttctctcttctctccttcttatctcccacaacatggcaagcaggggccatgtttcagccctgtttgtgttaacagctctttcggtcatccagactaatgtccagcccttagcagagaggagacccataagaagtgtggctgagtcaggttattttatgggctcagacgggaggaagtacatggtgattggtccatgggtgaacgtgggcatgcctggaaaatgcaccatctgatcggccgaacggtcatcaatgaagtcttccctctgggttgtggatttcacccggaagtggcagtcaagcctcccggcttcaggccattcctggcttgaaggtggggtttcaccagggactctcccctttctgcccaggaacccgtctgcctcctgccatcagcatgccatccacagcacccaagctgtttatgctgagaggtgcctgcaggtgcatgtcgggttgccttcagctacccccagcctccctcctgagctcctgggtgcccaaagtccagacggggccccaaggcggcggagggctggcatgtcattgccaccccaagtacacacacacacccggctgggtcacagcagtgcccaggctcagccacagccttgtactgtaccagaacgtgctgggagccaggagaggccagggaatgggaacaggcacttctgagcctgcgggagctagggcttccagggcccctgagaacatagggatgcccaggtccagagccacagctgggcggctgtagctcagtaggaggcggggctcccacctgttcctggctcctgctgcattgccgaacacacaacttcatccgcaccttccgcgcatcagccggaggcttcccagcagctgttctagtcaggctgcctctgccatcactgggaggtgaaagttgcagtgagctgagatcatgccattgctctccagcctgggtgacaaagcaagaccctgtctcaaaaaataaaaaaaatataagttttaccccacaatggttccattttgttccctctttccctagaaactccacattattatatggatgcattatcctaatatgatcatgttcaatttaggcttcctactcaattttcagtttttcatatatgcaacaattttaccccaagcataagtacatccattatgatgacatttaatagaagggccaggccactcacatagattttcagaaacactgaatttagtcatcatcaagaaaatctgtaatcaaactctgtttgtctttttttgttctctttctgtgtgttgatgccaaacagaaataaagaagacattcgtttaagtgcatttacactgtaagaaagattgctcattgaaaatattgatttttaattatatctttgagataggtaaattaagaaccagaagcaattccacaacttgataaaaactacaattgtaggcaaatttggatgacaaatatgaatatttactgtattgggaataaggttaatattttaaaacaaggttgacaggagaaaaattgtcttagtttgcaaaaggaaatttgtttctttaagtgaaaattggggtcagtaggccacagctcttcttgcttttacatgcctgaaatgaattaaataatgcagtagcaaagcagtactgagcagactaatgacaaaattatacattaaggctcaaaatcattatacactagaaatacatattttatataagaaaacatgaaattttaaatgcattcccacttcacctccattatcttaagagagaaaaactaagtcatatcttcttatgttcattaaggaactcatggtctttttctagggagcaagggtggttactggattctgtttgctgattgtgatttcaatgtgattaaagacttattcttcatacagtagatgcagtatccagccccatatgctattcaaagtgagtatggtattattttatagagggtaaatctaattttgagttgtttacccttctttggattcctttatgtgaaataatgatagtaaataactttgttaaacatgtacttactatgttctaggaattgtgctaggtaccctacacccactctctgattcacaataccctttgaggcagacatgattttcaccattttatagatgaggacacaggctcagacaggttaaataagttgaccaaagtaaccaggctagtaagtggcagttattagatgctaacttcatattttcagtagtgacattttcaggaatgtattgcaaatatattaatattcaatccactatcaaatttcatgatttatgacttttaaagtaagtgtgagtgggagtctatttttagaaatcaaaatgaatagcactttaagtacactatgcacttgtgtacacttatacacatggagcattgtgtttggctcttttggtttcagtgccaatgccagtagttaccctatggaaaatgttagtgaaaaacactaaagtgtagtagaaagtacattttattatataagtaccgttttatatgtgggcatatagtaaacaatcaacctatgcatattacatataactttactttgaaagacatgtaaatagaacagagtcatactgtgacatatctatatgatgctcaaataaccatctgattcagagaagttatttcattagaatgtggtttttattacaacctttcactctttagtccctcgtgtcaagttgtatagacagggcccaagctgtcatgtcctcagtgggttgtatttatttataatggtacatttttcccagcatcacaaaaggcagaaaatttgttattgccatgtgaaaatactcattttgtaccattattctctttacacatatttgtcctcagaatatgggaaataaaattagcactactgctacccggtaatctttacaagaggattgtttttgaagataaggaattcaaatatcaataagctgaactgaaaacaatattaaatttccaatgtgatgtggcttctgtttggatagagatggagctggtctatgtttctttactctgtgttcatagtatcaaagtaagctttgtatctgtttttctgtaatgatgacatttacacttggttgcattaatatgaagtaacatggattgcgtgtgttagtaggttctttttaattactgtgtaaaaataatatgtaattgaaacaaaaagcattgtttccaatcctaattttttttcctcaagtccatcctgtcaagctgcaagcgtgaaagttattttctggtggtgtgattagattggggctgaaccctccagctggcaggcctgtctgtgactggcggcggcctgtccccagtgcttgtcatttcctgacatgcctgacaggatggggacagccgccccagacaggttcattagatggtgttttctacagctgggctaaaaataaataaataaataaaaagtctgtgctttgtaaaagcccaagctgtaggggcccttcttgttggtttaaaccagggccttgttttgacaaattttgatctgtgcagtttttagattttctgacacatttttgtttccttcccctttggcctgcactttgtgctctctgccttgttgctgcttcaaaatcctaacatagtcttcccaagagaaaaagaaccaccgttattgagggcttaaaagaaacaatagtgtaatacttcataaaatagcaatacttaatctatttccatggtgatctgcacaatggaggaaaaacaatcttgggacttgtgataagccaattacaagaaaggttaagagtttttttagtgccagaaacatgccatctacatgaaaacataggatcattactaacagtctacactgtcaaatacactgctctttagaactgccagaaatttaagctgtcttcatttttgagcttttaggaagctgacagagttttctgcctgtgttcataggcttcgacgtcagaaagagaaattacggaagactgtagaatacttgctaattaaaaccagaaataaattcaaaaatcagatttagaaatatgcttctttgtcaatgatagggcccctttaagactaacgatttgccaaaaatggagtgcatttgaaacatacatttctacagagtcatgatttatcattctcaaccccaaattcaaacttttagaactgcagaattggaaagaaaaaaaaaaatcttcagccaagaaattattattctgggttgcacctgtaattaaaaagtagctattgacatctgtgccttagagacttgccgtagtcttcctactatcatagttgctgatagctgctttccattaagagaaacattttatcttaatttttagtagatagaacatgcccaaatagaacatatctgaccatatttgtctaaataatcttagtgttgctgttagctatatttcctttcacatgtaaagatacaaaatataataatgtttgtatctcatatgctttgtcattggtgtaataagtagtgttgctgaaaaaaaatcaaattcctcattcacagaaatcctagcccttacctttcctttgtattgttagctttcactgctttagttccccgtctctatgacaactgtttaaattgggatgggcaactgtcatctggagtattactgagagaaaagtgttagtgagcacacagttcccatagatagagcatttcaatataatccaattttaattgagctccagagactttgatgtgctgcagaaggttgggagagagctattccagggagaaattaaagcagcccagcaaggcttccctactccagactgtcaccattttaagtaagcattagcatcagacttaacctgcccctatggaacatctcacttcttttttcagcttttcactgatttattttgccatatgtaaaagcaaagcactttcatctttttatatatgtttttacacccatttgattaggcttgaaaagcttgtactggacctgagattcatcttatgctgtctgttggactttgctttggcggctcataaaagacatagaaagtagagtagggattagcttcaaattgtcagctattatatattaaactttcttttttaatgctgctttgtaagaccctattttggagctaaaaagttgaaggaagtgtaatttgtatttagcttcgatttgtcattgaatttcattttaatgcttagattcatggtcatttattagtggctacgatttttatttcaaaatgcattaaaatatcttttcctcatcacatgaaaagtacctttcagggaaagctggttcagagcagctgaatacagatacatcaatccttaatagagaaaccattaaccctttattttttttaatggagagaaaaaggggtatttttccatatatattcaaagagccttttaaatattttgaaatataatgttgaacatgcattaaatatgctagtaataataaaaatgacatcaaatcacaatgttaattataattaaataagtactaaatactttgattgtgcagtcaaaaagctttgttacaggtatgataaacttaaggaaattatctatttgtgacatacttgacatttctgatctatattggcaccttaaagaaaaacacgtatttagaagttaagtaaaatatgacaataattagaaattagtttgagtctatgcatcattctagatacttctagtaccagaagtagattgactgtaaagctaatgaatcttcagccagggccccttactcttcaggccttggggatgatgggagttgctgataatggtacagtggtttcagtttactaagttgcattaaaagatctcagaagaatagaacctaatttctaaggcactagtaatttgttgagttttttttttctaattctaaatattcatgtgcatagcttattataaacaatgttgcagtgagtgatctggtacatatttcatcttgcttttctaggagtatattcacagcataaattcatagaaataaaatcaccaagtcaaagggtatatacaaatacaattttgatagatgctgccaaaattttcttgatatgttttattatttgtgcgcccactagcaatgtagtgagaacttgtttttctcacagtaagctcagtattagcaaacttttggatttttaccaatctgatagattaaaaatatagcattttcatataatgttctttctccaacaatgaatcaatttaatcatgttttcagtcaaggaaagccatttttactattttctgtgatttatctatttgagcttttttaaaaggaaaatgtcaccctctcaatgtctgtgggaggggattattgataaatagtatggtttgtctcatgcatgttatttttccatattagttaacataaaaatttataatacgtataatgaaaattatatgcacatataggtatgtccctttctccctgctcccaacctaagttaatttctcattcctcaatggaatttcctcctaaatattagtgtcatttgttctgaggataagaattttttttaatttacctgcatacccaagaagaatttttctgctctagcatagatcaactgccctattacctcaaattctagcttattacttataatacagttagctaaatatattaacactctgtttgctacataaaattctaaaccagaagggctgcatcctttataaattagttagccaatgtggatgtctctagtatatatttttatttatttactaaacatgcatattggagaagcatacactggcactccaggcagctgcattcattgagtacttgctgtgtgccacacactatactgagcaccagggaaaacattccacattaaggtggggttttgactgaaacacagaaataacctctatatatggagaaaataatattaggtttatttatgttatcagtggagagcaaagttttaataacactagatattttaatttatattttattcactggttatcattcctttaaagttgtcaggtgtagataggttaattgtttttattggtaacacattttctttgtggaagttcatgtttatgtgagtgataacaaacagagtgattgccgtatctaaagtctggactgaacttcttttctttttcataatactcgtaaatctgccagtaatcctaaacctaggaaatggcagaaaactcctagccactggagccagaaacccttgagactcctttcatacctttacctcagcacaaaacaaaacactctagccctatctgtctcagaactgtctgttcttccttccctcttcctacctgctgcaactctcttaagtcagacttcctctacttcctactggcttcattcagatttctagtttagcctcattccaagtcattctccatactgcttccagagtgctctttgcaaatgcagttttaatcttataaccaccttcctccagtgctctcaatggcatcacattcctcattagagctgccatctattgagggctaagttaaaatccccattccagttcatcctttctgcagtgagtgctctggacagcctcttgcctgtagacatgtgacctctgtacttggagtggaaacacctgagataagaactttacataccgtagctcatttaattctttcaacaacccagtaaaatagaatcatcctatcaatcttacagataaagacacaaatagaaaagctgggctccatgaaaggaggggccgtctctgtcttgttcacaatgtgtcccatcacctagcacaatatctggatcctagtacatgccgactgaattttttttgatgaacaaattatgtgttatgccaacaggctttgcctaggatcagagaacttgctcatgatattcaaatgaaacaaataaaaggcaaattttcagcaaactagtattttgcttcaaatagctttacaaaaaaagaataaaaactcagcagaagagaaaaaaataatcctggggcattccagaaatgcagaagaaactttttggttatatttaaccctggaaatactgttttcgttgcctgcaagtcgggtaatctctaaatcctctttttacccaattatagatatttgtgaaaggtactcatttgccagcaagggccatttactgggctatttacagttaaactgagttgcatttcttgaagagctaattttcctgtaatgtagaaaactggcggcagaagcaaaaacaccatgggaaattcagtaggtgcattgtgtagttgaagcatgaaggtgctttaaggtgttttttgtttagttttgttttgttttgttttttatgttaaacttcaaatgcagaagacagaacacgcaaaaccgtttagtaagtggtaaataagaacaaattccaggaaataatcagagctgattggagcaatgtgacacacagaaccagagactggatcagagaataaagtacactgaaaaggatctgggctggggtcaaggcagagactgctcccatcactcctgactgagggttcactaaggtctgggtaggggaggatcgtgaattcatttgttcaacacatctatgtagcacagcctttctgctaacctccccacttgatacttgctgtgttatttcatttaatactcacagcaaccctgcaaagtagatgtaatttgtcccattttatataagggaaactgtcacaagtgtattgggaaacttgcctgaagttatacaaactttagagtctgtgtgtcatcctccaagtccaagttctttccactacagcatggcatacagatatataaaaaattactttagtctacaaaactaagtgctagtaaagtacatacttattgctacatactggtaggatgagggaatgtggcaagggtaacattcatactgccttaggtagatacacagtaaaatagacccaatcaaaaggacttccaaaatgcaagtttgcctgcatgaggttatgtttcattctaccacttctcttcaggagacggtgatgctgagggagctgtagctttaagagaaagaaaaataaattctcatgaaccccaagcatgcacctgtgaatacccaggggcacttgggttttcaagtgaaaatatgcttcacaaactcggaacccatattttatgatagctttcagttgctaattgtcactgaaaaagaaaagtctttaaaacctgaaaaataattcacattcatcttttctttctggtccctgatgagcctactacctacctggcagatacttgataaatggtaaatattttttgaataaatgcttttttgagcagtaagtttttaatatatcatagaaatttaccaggtagacaaggaggagaagttattctagaacataaagtgtggaaatgtttgatatctgcatttgtttttttttaatttcaatagactttacttttttagaacagtttaagtttacagaaaattgaacagctaatacagagagttcctatatatgtgtgtgtattggtcctgtttttttccttcttcaaagaacagagacatgaaagtaacatctgataataacactttatattagaaaattgtcagctgcaagtaacagacactgtaaactggcttcgtaaaaaatagatagatgatagatagatagatagatagatagacagacagacagacagtcagtcctggattctggtggtctccaaggttgattcagctagtcgtggatgctgtcaaaaacccaggtgcattgcctgtctttactcagtgatccttggtttgtcctaattcttacgctgatagcaatgtggctccaacacttcaaaaaatcaacataagctcagaaatattcaaaggaatgagagagcatctcttccattggctccctcacagcatgtggaaacttttctaaatccgatatacccctggaactggccagggggtcagtgtgtcctggcttggaagtgatgtaagagaagtcaatacctgaacatgattggagttgtgtcaatcagggaaatggggcagggggatagggttggaataggaggagtggaatggtttctgagtaagtaagcagtagtgtctactatagagtttcttttaagaaagcataataaaatacaaatggtaaattttgatcaggccttctgaaaaactggaatttttttcagctccaataaaccacattttttctgtctccctcaatcatagacacccattgacatagcaccaattactctgtttatacttctgctactagagaataactatatatagaccctgtatatatacagggtctcctagcttaatcattaatagaagttaatcagaagaacaaaatcagaaatcagactctatatataccctttaattcaatcattcaacagattttttactgagtttcgacaacataccaggcattgtgctaagtaatagagatacagtaatgagaagaaaaaaaatggtcaaaaagcttatagtctagtggaggagattacattaaaaatgaaattatacaatgaatttgcaaaattacatttgcggtaagtgctgtgaagagaacttgtctcataggtgctatgagagcgtaagatagggtgattttacctagctagggaggtcagtggcaaaaatagaagcaaaaagagaccttgaagatgagtagaagtgaacttggcaaataggggagggaagatatttccagagagggaagaatatgtgcattggctctgtgacaggaaacaacatggtaggtaacaagggactgaacaaaggccagtgtggcttgacctcaagggcaaagtggaacctgattcatctggagcaggagacctgttgtgtgcaccactaaccccatcccatctcttttgttgttggctctgcttcctcagaacttctgctgccttatgatttctgttgactgctttctcgctgtgttctagcttcttcccactgtcctcttcaggccgtctctgaatatcttgaattcagatcattaagagagatcctctgattggaccagccagccaaattcatgatagcatggctctgatggttttaacaaccacagactgtagctaccctacttagataaccgcaggtggagtatcccttgtcgcaaatgcttgggatcagaagtgtttcaaattttgaattttttcacattttggatatatataatgagacatcctggggatgggatccaggtctgaaaatgaaatttgtttatgtttcatatataccttatacatgtagcctgagggtaattgtatacaatatatttgaaatacttttgtgcatgaaacaaagtttgtgcattgaactatcagaaagcaaaggtgtcactacctcagccacccatgtggacagtctgtggttatttggcatcattatcattcttcacactgaatttatacgctactgataagcaatcattttcttacacttattcatacataagtacataacagtaaaaaaaaagacacactgttaacaccgtgtaaaaacaatgtgttcagtgtaactaagcggcacagcagcatcacagaatacctggatcagctgttaaacagcagcaacaacagtcaatgcaggctttcagtctctacctaccatgctgggttttgattagaaggtaggaggttgtacagtaacccccgtgaggacactgaataaacagtgcgtcacatacctgcgttatgactgtgacctgtcacgtgaggtgggatgtggaattttctacctgtggcctcatgttagcactcaaaaagtttctgatttttgaacattttggattttgtgttcccacattagagatgctcaaggtgtacttttaatattagtactcatcgtggttcaatccagggtggtggcataattggtaataaacatggtacaaaggaacttttcagaagagggtgtcacccatgttccatctagtccataacaaattgggaatcactctggaatgttttaatatagctggttttaatcattatagaccatgtagattaataattcttttgcatatgtttcttattaaataaaaatcaagaaaagtattcataattcattagtgtgttaaattactgccatgtgctaggctctgtgctaagtatgaagaatgcagagacatacagaattcctgccctcagtgagtcaataggttagtgggagacaccaagaagtcaaccaacaattatagtttggtaagtattataaaaaggtgggtacagggttcccagtgggagcagcaggatctcctagcttaatcattagtagaagttaatcagaagaacaaaatcagaagggatctgccagtcagaagaaatatcatttgcaggggcacaaaagtgtgacagaacacggcacactggggagcagagaagtgttcaggatggttagaatttaagagctaggaagaatgcacattgtggctaaataggggattttatactactattaataataacatttgccactttttaaatacctactatgtaccatagtatatatgcttcatatgcataaattgtactatgattttgattttcatgacattaggatgcaaatttttaaaaaatgtttgaagctataatggattaaaattaaaaagtgcactagggccgggcggggtggctcacgcctgtaataccagcactttgggaggctgaggcgggcggatcacgaggtcaggagatcgagaccatcctggctaacacggtgaaaccccgtctctactaaaaatacaaaaaattagccgggcgtggtggcgggcgcctgtagtcccagctactccggaggctgaggcaggagaatggcgtgaacccgggaggcggagcttgcagggagccgagatcctgccactgcactccagcctgggcgacagagcaagactccgtctcaaaaaaaaaaaaaaaaaaaaaaaaaaagtgcactagtatttgtaatacatgcagttttcttcaggttaacataaagaaatgttaactagagaaaaaaatatttttaattaagtcatatttgactattgctacaatcattactgcaactctaccctgtaatcttgtttcattctggctgtatctaaaattttaatatgaaatacttttaaaaagagaaaataatttgtctcgacaatttataatatttgtaaaatcagaccctattacctaattagttaaaacaaaaacctctaacccagaaatccaaatgatctgaaacagaagaaaataaataagtctatagagagaagacatataaatataactagtttaaaaaattagcaatatgcagaataatacatagagaagttaatgtattcagtatagaaatgaaagtaaatactggaaactagaaattcgtttattttcagtagtatagagttctggtctccccacctcatccctttgtaaaataatagcagagagaaaaataaaagattttagactatgccaaatttgagaaaatgaggaaacatagccaaagatacaatatttacacaagaacattcatgagtaggacaaaaatgaagcaactgtgccagtatcatttttaattttgagagttttaccatgatttgagagtatgtgtttgaagatgaagtagacacagaggactccagctgcaactcagtttgtttgtaaattaaattttaaaatattttgctcaacaaaaattgagttccttctctgtgcaagttctataaggaatacaaaaatagagtacaactcagtctctatcctcattaagtccattttttaggggatgtatataataagatagatcaatttaaaaggacctgccacaatgtaagagatgctattggagaaatacaaataatgctcttttgagtagttcctggttctttactaatgaatataaaatacaattcacatagatttgaaacagtattgcacttctctagtccaaatagcgtctaccttgcagccacagcagtgatttctaaagtgccagtttcattgtctcacctctttctttgttaaaaatcttatagcagctctccattattctcagaccagagtccaaactctaatgtgagttatgagatctcgccccacatcctgctgcccactcaccctttgttgttctaattttatttttcacctctctgcttcttacaatatatgcacacacagtctgtgtccgttgcccccccacccccagcactgtgtttatgtatctttacatacatgtttacatatgtgttgttccttctgcttggtacttcctttttccccactcccctgccttttcccattatttgtgattttccaccaaactgtgaactcctagagatcagggactctgcttctcctgttcaccattggttcctaatggtcagctgataaatatttgttaaattaaaggaacggaagaaaaataaaattgataaaccatgaggacacttggtagaaaagagctgacctaattatgggctgtttataaaataggaagccttcttgcagtttatcactgcttatagtgagactggtagctggtgtcccaaatagttgggcttcgtagttaagagttaagtgctatgattccaataatgtctaggatacaaactaccactaaagaaacaataaatgtggcttttagttcagtaaaaggctatgtgctgtggtccagattttctacatctgttttggtgatgtcatcaacaaagattagaaccagaggtctgcatgggtgtgtgtgtgtgtgtgtgtgtgtgtgtgtgtgtgtatgtgtttgtgtctgtacacatgcacaaaaaggtagggagtaattgcagtagtaggctgacatttgttaagcatttcctgtgtgccaggcactgtgctgagcattttttgaaaagagctattaatatctcattcaatcgcacaatgaccccatgaagttaggtaccattatttctccccatctttagataagaaaaccaaaacatcaaaaatcaatgaacttgcctgaggtctcacagctagtaagagaggcagacccaggggaagccttaagtctaaggtaagcaggtccataaattgatgaattagagaaaaaaaatcaagattattaaatcaaaagttctctacggatgggctgcctatatttcccccaattgtaggatgttttgacaccccccccccaccgcatacccatatgcccatgtaccaataatggctgtgtttataatggcatataataacattcctaaacacagccattatagcaacattgtttaattttcattgaggatgtattttctggaaagcttcatttttccagcttcatttcttgatcatttttgtttgcctcacagttaagccatttccaatttttcccgttttcagttttatattactgaattattttcatcaggattaattcttttccatgtaagttttatggagtgacttggttctgtgatcaatcttttggtccatattacattttactgactatagtgcctgcccttgacaattttattttgatgatagtattcattattaattgaataaaaggctaaagtgaaactcttctaccagatatttgaagatttctttattgtgtaggagtggtctatagcagttgttctctaactttttttcaccaattttattataaaagaattttataaagctctataccacattgcacatgtttaaattaacagttacaattttccataattttaaatattttaaaaagacgtgatatccagtatgttctaaatattactattttaaaataaaattgttatattacttttcagatatatccagtagaataaaataagtagagtagtgattgattactattatcatctgttttaagatgtacaaataagctcttttttcaaatgaacattttatataatttctctctttgaactcatacttcctttcaattccttcccccaaatttacctaatctaaaatatttgtgcttgtgagtcttttttgatcactatgttatactactctgcaaaaagtgtatatacttactgattaaagctttagttttttaggttcctaagaccataacattctaagtatttaaattttttattctgaaataaattgttacaaatattattagcatacagtcatacaacagcataaatatattgtgaactttgaaaaataattaagcataaaaaatgaaattatattagaaattcatctcttaatgggatgaatagttaacacatgcacatatgaatattacttattgctacaataatacaggaatcaatattagagctacttataactttcttttttatagaggtgttgaaaaatcttgttcacataagtaaacagcatgtcgaagttgtattatagacagtgttattcagtgttttctactctttccaagttgtgtgctaaaaatcacataaggatctattgtcagaagttatttttaattatctctcaattgacagcccatttagatccaacttctcctctttgaaagtaaagaattgggaaaacatctgacttgcaaaaggatttttttttcagtccagtcactgggaacattcactttccaatgcctccatcaggtatttcgaatcatccaatttgatgctcctacccctcaacagatcttatactccagtcaatacaccatagagaaataccattttttattttattttttaagtgggagaatggcaatgtgtttttcccatctcctttttggagatgggaaagagaacctgtactatcttatgtttctccatttctttggtagggaaatagcatcaccaagacatgtggtgagaggtgggaagggagtgttccatagctgctccccacatcctcactgcatgtgccacacagcaggtatcagtcagacatggtcttccaggtggtcattttggaagtcaagcctctcccagtttgtagatcgactttccttcagggccttggaatcttctccattcagctgacagtttaaaaagagcatggatgatctcatatgagtgtggacctgaaatttcttttgaactattcttcttgaatatatttgctgtaatcctgagccattgccacaaattccaaatttatatgaaattataaaagtaatagggatttgtaactttaaattgcaccacaacaagctctttaattaaactgttgaggctgcaagtgtggattgaacgcgacaaccttaggaactctaaaaagggtttgcccagccttctgcagcattttcaacaattcgtaacaggaaattcaactggaaacaaaatttagatttttttcgtattcaaagaaaaaaaatttgtaatacttgtgctaatatatgcattagatgatttgagatcagcaaagctatcactaaacaagtatttttttaagttgcacaatatttagcttccttaaaaagaaaaaaaggtgaaacttttttcatctgtgatttgacagtcatttacatgtttctgacaacatatacatgtccgatacgcatgagtgcacagcagccttgtatttttcaacatgatcatcagataatatgtggtaagcacatatttgagtaggtggtttacaagggatttctatgacatttgtattgtattactttctatgtaccttactttctatgtgctttctatgtactttagttcataagtgaactaaaattcataagtgaatggggcagacttcagggtatgagcctgacatgaactttctcccttcacttcttttggatattaagcagttagctcagtatagttcagtggtcacttaagaaaatcacaaagttccataagatttggggtcaagatgctttaatattcttgcttatgatctgtatgatgtatcaaaaattatgtttattcagttctcaaaaatgaaactggatgggatagtatttgttgattagatttcattgtatattaaatactttgaagaaacaggcaggcacaagctagatgatatgggaagcttggcttaagaaagaaaacaaaaccacaaacctcaagtatacatgaaagtacttaaatgacagaaaaatatcttggactataataaaaagcaaactgaaagaattattatagaatgtccttaaacttatagaaaattatgtaaccagtaaaggtataaataaagaagacgattttatagtatcaggccatatttcaggcctgagcttgatgcccagatttttatagaaatgtaccataaactcagtattcaactgactgtgattgatattcctttacatttatgaaagttatacagattgattaactcatcacttgcctgaagcagcatcccctccggtcattctgcccccatcccactgcattccactctatcctccacatgcctccctagcgctgtgcctcaaatctcactctgccaccttcctgctaagcttcaggactttcccagtgcctgtgagcagagcagggtaacagagccctggggtatagtccaaggaagccacagtaatcacatgtatctgagtaccagtgttttatcttaacaattcattcatatttgcagtattttccagcctgtgctaattttactacaaaactgttttaaattgcttaccagaaataaaattgatgctcaagaaggggttccaaatgatattctttgacataccttagtatacattttcccatgtgagaggcgtaagtccataatatcaagtcaaaattgcttagcctaaagcccttccataactcctctggagtcaaggaatcctttcattgtaaaggtagtgtcttctcagaatggatctaatccagtcgaaagttccatggtagtgcaaattaaactactaaaaaagagaaaccagctgtatttagattactgttttggttcttgattaaagtcagcagggttgtttggtggactataccattaggacataaacatgagaagtctgaaggccacattggagagagcttcttctggtttagcaaaggagtcaaaatgcacatactctgtacaatttctttagaaccttccccatatgtactatttctatcagtttcccattgtgatttattaaacaaacatatatggagcacatatgtgccagacactattttaggcactgtgtatcgaacagtaaataggatagatgagagttctattctcctatttgatgtcacagggaggggacagacaaaaaacaagtaagaaaattaatcattttcatgtgcagaattaaacagtgataagataggctgtgtgttgggatcacttgaggtcaggcattcaagaccagcctggtcaatgtggcaaaaccctgtctctactaaaaatacaaaaattagctggttttggtggcacacgcctgtagttccagctactcagaaggctgaggtgggagaatcgctcgaacccaggaggtggaggttgcatgagaggagatggcattgttgcactccagcatggctgacagaatgagactccatctcaaaaaaaaaaaaagagatagagttacatgataactcttaaattgtgtgtcagaaaaggcagctgagaggagtagatctaaaattattattaatttttttttttttttgagacggaatcttgctctgtcacccaggctggagtgcagtggcatgatctcggctcactacaacctctgcctcccggattcaagcaattctcctgccgcagcctcccaagtagctgggattacaggcatgtgcaaccatgaccggctaatttttttgtatttttagcagagatgaggtttcgccatattggccaggctggtctcgaactcctgaccttgtgatccacccacctcaacctcccaaagtgctgggattacaggcgtgagccaccgctcccggcctaaaatttttttaaataaaaatgtattatggaatgaaactctttttaaataaagaaattgtaggatcatcttattccgtgatcagtcttgaaggtaacaagcagggaaagcaggaggtggtttgctataaaaaaaagaaaagaaaagaaaatgaccctaggctctatcaggttttcctagcagggaattatggctagctcagaacatcgtctttcatcagcccttttaggatttcagatgcttaaatataacatgggttattgtaaagtaattaggtaggttttttgaaaagcatataagaacatacataaaaataatttttcttcccatgtcccctttggtaagggctgaacacttatttaaatgatgttgccattgttcaaaatagctttggacctttggatctgtctttcagaatttgcttcctaagccatttagaagctactagcaaaatcattttcttttaattttgttatctctccttgtcctctttgcatttaagctttactgatcttaggttccttttttcttgctgcagagggtccctaaggaccattatgctcccaggctgtagctaagagaatggtgataggaaaactgagtttgtgtattagctgggatccagtcaggggagaggaatcagagtgcaatttagataggaaaagtgtgatacaattatcatataaattatgccaggagattgagtaacaagggactggctagtaagaaataaagataactctaaagaatattggccaggcgtggtggctcacacctgtaatcccagcactttgggaggccgagtcaggtggatcatttgagatcaggagttcgagaccagcctggccaacatggtgaaaccccatctctactaaaaatacaaaaattagccggatggtaatggcacgcatctgtaattccagctacttgagaggctgaagcaggagaatcgcttgaacacaggaggtggaggtcgcagtgagccaagataacgccactgcactccagtctgggtaacagagtgaaaccctgtctcaaaagaaaaaaaaaagggaattgatgaagccatttatgggaggtgtcccaacagaaacactctgctacagaacggctcggggtgagggaagtactgagaaaactgctggtcactgggtgctgggagcatcatgcgtcccagagccaagtgctggagaacaggcgcctgccaagtgagaacaccagaacagagaagaaaaaacacccttcctcctgtgtggtctcttcagtgccctttcctgacaaagtttaatgctatgacaggtagcaaaggaaaaatattttaaggacacaggttcgttttcacagagcaagcaattaagggtgaatttgcacatggaaggccataaatgaataattggcacagtttataaaatacagttttacatggtgcacttaaggagtcaaactaacatactttttggagctatctgcttgctataactaacgtaaaaactgataacatgcttaatggaaataaatgcttggtcaaattttcattacaccatagctccagaaggaaaaaataagtcaaaatatgactctgtgtgtgtatacacatgtgagatattaatatatctggacctagaaatatagatacaggtatctttctgacataatgctatgggtataagggtgccaacacagctttcatgggaagatctatcattttttctgatattatattcactttactgtttgggttttcaaatggccatagtatttttagtaccttagtgaaataattattatagttgaagatagattttgttgttgtggctgttttgtcttaaaatgtttcctacttgacaaaaaaaagagaattaatcctgtatcactatccctttcctttttaaaaatcatactggtctatgaaaatcaaatatggaaaccattatagccaactaacaatttataaatataaattgtggcaagtcactataacccttttgtgaaatgtacaagaagaagttttgcatttagaaatcaaaaaccaattgtcacctgatgctcaacaacaaggagacataaattcatcaatggaacttaatagccagggtcatgtactttatgttctttgtctctgcttaaactaaccatttccaggtatcattatcactgtttttcagatgacaaaaaccagatggagttaaataattgtttttcaaaatactgtagttggtaaatagcagagccaagagttaagtaggagtctgaatggctccaaaatgtttcagatttaaatagacgtctgactgcctccaaaaacctttcaatgtctagagaaagacaaaaactgaattaagggttacaaaatgggattttcaaaaaataaagaccaaaagattatacacttacatattttatgtatatttcctagagaaaggaagtgtaaaaaggaacttcataacttgttttcaaatgtatatatgaatataatgcatgtaaaatgaatataatgtatgtaaaactcagtaactgttttcatttccaccaaagcaaatataagtgcggtagagtataccacagcaagtagaaaagtccctctgaattgttaatacacgttggtgtatcaggaaggaatgtgcttgttgtagatttgaggacagtagcttaatcaaatatagattatatacatggtaaccagaagtccagatgtggatgcttgctgtgattgtttcagtagctcagtattagagccaaccttggccttcctctcatagttacacaattgctgctacagtttcagctatcatatctccattcaagcaggaagggcaaagtggtatgccagctatatatgactcatttcatcagcttttctcaaacatcctcaactgcttttggttttgatctcattaaccagtgcttggcctaatgtccttccacaaagttacaagggaatttggggaagcagggaataacattgtcaggactggcttagaccatgggtcagccaaactctgccctgggggccaaattcagctcatacttgttgtaaataaaattttgttggaatacttccatacccctttatttacacattgtctatggctcctttcatgttacaatggcaaaactgagtagttgcaactgagaccatatagcctgcaaagcctaaatatatttactctctggccttttacagaaaagtttgctgacacctggattaaaccaatcatgatcctttgcctggggttgaccatatggacactttgggggtagctgggcttccattaagcaaggaaggggagaaaggatattggaaagaaccaacaatatatgtctcacaggtggtcacctggtccaattaattatatacaagacccaaaagtgataatatattttcggttttaagtcacagagtctccttgaatatgtttttctactccttcttttcctcaagacccaactaagacactttagaaaggcagaaattttgcaaatacacagtatcaaattattgacaatgttgtgacagacagtgaattcatttctagttttctgacttttactaagttactgtcagagtagatcttaaatccatattttattgattgacacttccctttaaactgtttattttaggttcttgcatacactgagggacttcacggaaaatggatgttcagcgagatacgagctgtattttcaagacgttaccttctacaaaacactgctttggaagtatttatggcaaaccgaagtaagtccccttaatattttgaaagaaaatgtgctcatatttacatattattcatttacatggtatgataatgtcttgatttttcctactgtatttctgatgtgctctagcttaaacaaacagaaattctttttaaaaaataaaaaaagaatgaatttgtttgaaatgttagccctaggtttctcatggataaagttatactgaaagctgatttttcatgaagattcattagctttacaaataaatcatgataggcacttgaagatgacttgtaaaattgatggctaacttatcctgcggttttctaaactctgttttttttcttcttaccacagcctcagttatgtttaatttccctgatcaagcaacagtaaaaaaagttgtctatagcttgcctcgggttggagtagggaccagctatggtctgccacaagccaggtaattatatcatattacatattatctatggcttgttaacatatttcaatctcaatattacagcaatgtaaatgtggttataacattataattatttcagagaccaaagaattttctttctctgaaggttatttgtagggatagagattatgaaaatagctattttgagaatgacagaatggttagggcagatttttatttaatacatataaataacaaagtaaaaaacttgattgcttatcacatagctagcatataattaagacattcttgcttgttaaaatcttacaggaaacataccaaaagcctgaagatcataaatgattaattgctatgtaatagcatataaataatgtttttataaatgccatatataaatgcttcttaattaaaacaataaaaccctgagagtttattaagggtaatagtcattaattatggtatagttgtaaccacatttcctagattttcatcttggtattttagaagaatcattttgaaatcttatattattaaaagatactaatgtaagtagaaaacataatcagtagttacttatattgctgatatcagtttgtcgtttttggctcgaaataactgaataccttactaaaagtggcttaaactataggggtgtgtgtgtttaatataaaagatctggagttaaggtgctgccagtattggttcagaggttcagtgatgtcagaaccctgttggctttgtattcacaaaatcaccgctacttcttcagctactacatcttcacacaactgcattacagtaggaaaaagacacaaaggatttctctttaagcttctctgttttaggaagaatgtatttctcagaagcctaaagcaatctttatcttaagtccctttggccagaatacagtcaccttcccattcctaaaacaatcactgccaaaaaggtgtgagttctgttggcttagcccaatcattccctaggttttatggaaaaagatacctctgattctttgccagctcctacatgaacaaaagaggatttccgttgatgaagaacaaagggagattgactttaggtagatacaacaatgtctaccacatagactgttatgtccttgagaattattacacagcactgtatggatggaaaggaaaactaatctttgtctatcctcccttaaataggctacagacaactgaaagacagggactgtgttttatttatcctttaatctacaggacctaacacagtgcctaattgcagcagtgctttttaagtgctgtttagctggggttaccttgtattgcaacttatctattctctttaagcttacagtgtaagaccaattcactgacacgtatacacatgctcaagatatttgctagtagaatgacaagattaaactaagatattagtagataatgaagcacttatataaaatacaggtcaaagaaaaatgcatttcatctatcaaagaaaatgaggttagttctgcaagacttgttcttattgaatctaagctgactcataataatcattacttcctttcccaagtgcttacatactatttgtttaatcatcaattcaagaatttactcaggaattgacattaagaacttacgaatgggcctaactttttcctatttaagaataatctcctgtcttctggcatatttctcaatgaccatgattcctgaaagattactaatagaggtttctatatggcatgtataatttccctcagtattctttgacttgtctggaccggaattcatttaaaacaatcagaagctcttttattttatttcttacctatgatgagtattgtttcccttttaaccacatttggtctctttttgacgtttggaagatcattcttttttttttctttgagacaaggtctcactctgtcacccaggctggagtgcagtggcgtgatctcagctcaccgcagccttgatgtccccaggctcaggagatcctcccacctcagtttcccaagtagctgggaatacagacatgtgccaccatgcccagctaatttttgtattgtttatagagatggggtttcaccatgttgcccaggctggtctcgaactcctggactcaagcaatccacccacttaagcctcccgaagtgctgggattacaggcaacagtcaccatgcccagctggaagatgattctttataagaaaactgaaaacaaaaggcagctcagtagttttggtctctctgtaattcataatgccattctatcttcaaacgtccttttgttgtccttggcttattttcccccaaaaagctcaactaattattagtttcctaataatattcttacagactcagttttatgtacttccctagatatacatccttagaagtaccaagtggcaatggggaaacactgcatctaggcttaaacctgtcacttagctgggtaacaataagcaagcctcacacttagtagcaattcaataaatattggtggaaagaatgaataacactactcaagcagaatgacattcttatctaccataaaatggggaaaatatctttacaagagatattctgccagagatattttgcaagatatctttgcaagagatattttgataatcttttgtgctatgtacaagacaatgcctattaagattccatgtgaatactcatgttaataatccatgagtaacagaaatagccttaagtctgttgttcccaaactaaacacgaaggagtcctgcgatatcacagtgaattctcaggggtgctgcaggtcattttttaattttttagggaaaaacagcaacatttgtcagataccacacaaactatttgctcgagttagttccaagtttcaacttagaatgattagatagggctgcatctttttcagtgacacctctgagaaactggtgtttggtggctactgtcttcaaaaacaagagccatatgaaaaatcagtgtggaacaggaaatgagtgtggtggtgtcagatctgattccaaggtttcagaagctgtgcagtttccaacagacatacacaccccattagtaaatgtggttatttaagaatgaaatataaatatttctctttaagtttatgagtattgtattttcaaatagctactcagttgttaagatgttaaatatttattgagttgttagagctaactacttaataaacagaattgtaagatatttctcttggtcaaggagcactatgaaaaattatggagatactaagggtgccatgaattgaaaaagtttgagaacctctgtcaatcagtttaaaaacccagtagctttatcatacttttctaaatacaactgcttttgttatttttagatgaacacattgaacctggaaagtttcataatttggaccaatgatcatggtttattcccttaggctgttcctatgtcccttcttctggacccatgcattttttcaaagttcccagttgtttatattttacaccattgcagggatagatattgtacgggcagaggctgtgcatgtgtacacactctgtgtgtgtgaaggcaagtcgaagaagttcattgatagacattaagtcaaatgcatgtaaacaggtacctgactacctacctacctacctaattaacatggagcagatttgctgtattgtttaaaagctacttgatttatcttaagtatagttttactttttttcttgtggatttgtgactcatttgcagctgtgatttgacaaataaggttgctttcaaattgttttatcctgagtaattaagtgtatcttctctataatagaattctcaaatattgctaatttctacaattaaaatatattttctaattcatctaagaaggataaaccataaattattttaagttgattatcaaagcaatatattagttaatattggattttttaaagttatgaattaaagagactatgtttgttatgctgtgcttaattgctaggaggatatcattggccactcctcgacagctttataaatcttccaatatgactcagcgctggcaaagaagggaaatttcaaacttcgaatatttgatgttccttaatactattgcaggtaagatgtctcattctttaatctaataatatgtttatgttcatcaaaatcatggtaatgtagcctgatataatacatttttctctttggaattcaaatgcatcattagagtaaattttgaagcactcacattaaattttatcagaaactgtgcaagctcataccaaacttttagatgcatttattgttgaagaggcttttccttgctttccttctgccatttcctttgctgacagctttgtctgaaggtttattagagtcaacaaaccattgccagagtgtctggaaataataatgggaaaagtaatttcactactttgtcattctcagcaatagcagctagacaggagaataacaacaggattctgcctagtacagatgtcacctggaatatggcatgattaggttacagcatctttttttcttaaaatcttcaaataaaaatacaaaatcagattacattttctaaattatgagtaactgccatcaacctttgcagtaccatgcttgcaaatcaaaaggaggtagtggctttgttttctgctaaatcagtggttgtcagtggttaaacatgtctatgagatttaagtacttcatcttttttcttaagttaagctccaaaagcccttattcatgatgaattacaaagagtttacttctataaaccaggctctacaaaaagtttttgcaattagatgaattcaaataaccacataaataaaggtgcttaccataattattgttttgttatgaatgaatgctcacaaccgtgtatttagagctgtgtacttctctgaatcattactttaaaaatataactatgtaatattactcttttttaatctatcatacataagtgtgactaaagatactataggtatatattaaatgcgggtaatatagatatgtattaaatagacaaaacttgatttgtccacaaaagggaataaagctatttgatatattaaaatgctttttcactttaatcccaatacattcatgtatatatatgttcatatatacatgcatttattcatatgtgtagtacatacacatatatatcttgaataaacctgtttactccctcaaagataaaagaaatgtgttatactatttaattagcacattatttataaatagaatgaatttaaacatctgaaatgtaaagaacttaatttcatgagcatatttaagtaaatagcatggtgtagcagaaagaacacaactttcaacaccaaagagaagagggagagaatcccagatctgccaactttctgtcctggagcataagttgaattttaacttttaactctatcgtggacttttaatattttaatagcaatatttaatatgtttacatctgttttaataactggtatgtttggtcttatatcatcttgtcttatacttttttttaatgtcctcttgctttttatattgtttgttctctggctttacgaatgcttttttgctcagtgctcttgtgatttaaaatgtaagcaccttgttattaattcccctagagatattacatttttaaaagccttataaactatttttcttaatttgaactcaaaaatcaattaacatttttaaatcatacctaagacaaaaacttcaactcaattttatttctcattcattgcttatattcgcaaatataaattactagccagaatccagattattattaacttcacactctggggtctacgtctttttgcaaattaagaaagatttcaaactattgaaattatgtgttcatgcagtatattattttcagctatatggatctttacctgatttttcgggatgatattctctgtacgttcttgtgtaacagttttccatattccctgtattaggtttttatattatctgctcttgagagacctatcaagacagtatcattagacaccattaggtgattttttttcccttggctgtgctagctatttggagctgttggatataaaactggagggcagggtgatatacctcacttgtagttcagtttccaatgtagcaggcattcatattaaatggttttcctattctaaaatgagattttctccaggctctggatggaatgttttctagttcattgttttaaaggtctcttctagtctccatcccttcccactgcattttactcatgtaaggtcagtttcccacagtgtggtacagtaccacctataactaccacccacttcatgcctgttactttctgggagtctctttatctgtccaactctggaaaggttgctgtgtctaaatctggatagagataacattgtcatgccttctaaaagttacacctgagcagtatagagcctaatatgcttttttctatttgggacaatctttgggtttctgagccagagcatgcagactctggtgggaatttaaaagcatcttgctattattgtttgaatcgttgaagtctgttttatttataacatgaagattatatgggccactgatttttttcaaaaattactgggtacttcctttgcaattattatgactaaacatgaaagcctgactattgtaagcaatgggataaaaattaacaatagggactaggcacacagaacacttacagtctagatgaataagtgaaatacacgtaaataagacattttaagatggctgatagtaaatgctgaatcattgctatcgtgaatgctgcatgagcttagcagaggggaggcattttaaaatgtgtttggggagaaaaaaagagaagagcttcacaaatttctgctagttgtatatatatggtgtattcagtggacagaattatcataccttctgtggagtagagaattatatataatattggagccttagagaagagccagattataaagaggcttttaggagtcagtatagtgttagagtagaagggaatgcgatgtggagttttagaaaaattaaactgataattatgtatggcataaatcaaaattgagattccttagcattagtgctataaggggagtagtaatagtaaattgttactgaatatttactatgtaccacatattctatttttccctgactacagaagcaagtaaagtatggtttctgcctttgaaaagatcgtaatatagtgaggaagcagacgtataccagtaattccactaaaaagtattggaatgtataaaattgtgtacaattttataatgtataaaaaagtattataatgggagtatatgtgaagccatttgaggtagtcaaatctaggagccattatttataactaagagagcagaaaaagcttcccataggtgacatttaaattgggaattgaaatatgattaagagttcactagaaagtaggcagagggcattccaagaagaaaatgtgaggtgaagattttggatgagcatatggcagcaggtatggcaaaaagagagtaaatgacactttgtacaatatcattatacaaaaaagtttcactgtcatttgttctagttcagtggttatcaaagtgtagtcccctgacctgcactattaccttggagacctgttagagatttctgatcctcagactcctcctcaagcctacagaatcagaagccggcaacctgcctttcagcaagccctctagttggttctgatacaaaaagtttgagcacaattgcattagccatttaagacctaattatcagggcaagatttgcatataaaacatttaaaacatagaagaaagtacaggattaagtgccattcagtgtaataaaagtttagagaagtgagagattaatatgaaatagtctactcgaggaaaccttggaaaagatgagctttaaatgaactctttaaggattttgtcagatgtagatgactatccaggcaaaataaaccgtaataagtagaatgacaattgaaaaaaattatgaatatgaatatcctgaggtactctccctggatatattcctattaatttaattcttcctttgctatcatcctgaaattttaaataggagtgccagtttaaactgagcaccagcattaaagacatgggtgatggttttcttagagaagcttcagtaatgccatgactgaatacttgttagggcagcaattagatttgcctgttttcctgattggtggacagtgtgtatccattcatctcttcttatcaaatcacccttcagagttctcttatgatcctaaaataaagggtgctctaaagatgttaagttgtaccagtatcactttaacgaacacgggtcctaaaaataatcatactattttataacactgttttagggatacggttattgttcaggaagtatttatttcatttgattgattgaaacttaagatttatcatttctagataggatgttagtcttctttttgacaaatgtaatttcttaggtaatctaaagccaagacatggttggcttatattttgtcataatatgttttaaacatttttatttgatatcaagattcagaaaaaaaatagtattgttattatgtctttctttcatttttcctattgaaacattccttggccgggcgcagtggctcacgcctgtaatcccagcactttgggaggccgaggcaggtggatcacgaggtcaggagatggagaccatcctggctaacacggtgaaaccccgtctctactaaaaatacaaaaaaattagctgggcgtggtagcgggcgcctgtagtcccagctactcggaaggctgaggcaggagaagctgaagcaagagaatggcctgaacccgggaggcggagcttgcagggagccgagatcccaccactggactccagcctgggcgacagagcgagactccgtctcaaaaaaaaaaaaaaaaaaagaaacatttctttgttaataataagaactcagaaaaaatagtaaataatagtttatgactattgaataatttataatgtgccaaacattgttctaaggactttatatatatttgctcatttaatcctcacaatagccccatgagttaggttctgttcttatccccattttacagagatgaggtagagagtagctaaataacttggcccaagtcatagggctaataagtgacacagtcgggattcaaacctaggcagtttagctccagagtcttcattcagttactacagcgtactgttccaggatattcctggtaccatacaacttcacctccagtcaccagctttaacttattagctgcttttaaaacctaaataattaatgatttaaaacaattttgtaattttcttttacatttcatcaaattaaccctttgaaatttatttactgtcatgacttttgtagatactgatattctagtactagatctgggcctggaattactatctttaatgtagaagctggcactgttttcagttaagctttagatcaagagaaaaagactctgagacagagatttgcttgaggatttttattgaaaagcccttgggatcaacatctgtgggggagtgaagaagttagaactgggcagaaggaggattcagacctcagtgcagttgtgacaaaggcttcagtagatcccacagggtgcctggggctggggtaaccgttcaaagttgtcttggcttgaggcaagggagccaggtcttcattacctccactctgcaatcattggatgcagactcctgggaaggagacatgactggattgggggctttcttctaatggtagcaattcttcgagatggacatagctgaacaccaccagccatgaacaccaccagccatcattgctcccagcatccaccataccagcagttctcagacttcagtgtatccaaagcaggattgctaaaaccctgatctttggttccctactgccataagttctgattcagtaggcttggattgagccgcaagaagctgcatttctaagaactccccatttgatgctgatgccattgatctagggaccacactttgagaattactgccctatatctatatctttaaaagacatacctaaaaataattttattaatcttcatatagcaccgtcagtatcacacatgatgactcttatgatagggcatccttagcattttatgtgcattttatcttcccaatgagaaaaaaagttttgctcagtaaatacccatgaaattaagttacttaatatttatttttgtaaatatttgcaggatgttgtgatctattatgtaaattcactagaattactggacgagggattctttaaacgtcttggattaaagagaagtgttacagaattggaatctggttgacaagatgaaacaatcttttctggcttcacatgtttaaaaatataggtcaatgtgacctaataaatttcatattttctataaatattatccacaaatattctataaataattctaagacttagattaaaacagtaccaaactgtacattattattacactctcagatttatcttttttcccaaaaatattattttagtatgaaatgcaaagtacattttatgacccatttcttaaaagtgtctcatacttgaccaatttcacttttctcctttctagatgcttttaaaaataagattctgtataaagcacatggtctcagtatcatagtattaatgcattatgcagactttttacaccctcctgtggtatgtgtacatgtgcataattgcatataaataaacacacatttactgtatgtaagttttgtaaagatactttacatagaagtatcttgccaaaagaagcttgccaaatatcccggaaacgtatttaaaagacatctaaaatcccataaatgtgttcttaggctttgttttattctatttataaatttaatgaatgttcattatagaaaattggaaatacaaaaaatggtaattttaaaaattaaaccactcaaaagtctaaccgtaaatatcacagttgacatttgggtgatttttctgtttttcattctctgtgtgtggtgtgtcattgggaacctgtaatgtatacaggtttgctttctactttttccatttcactaaatattctttgaaggcatgacttttaaaactacatgagagtccaacctagaaatatggcaaaatttctttaactatttttgaaacacttgatttttttcaaagaacattaaattttagatgattgtgtaaaataatcttaatgatacttagagttctactaaaaatgtggtttcaactttcagttcccaaattgacctgatttctgtttgttttctgaaaaatacaacctatgccttattttataccttgttagataatattatgcaaaagatattaaagcctgtaattcttgcattttaaaaaataggagagtaaccgctaacacggctttgtgtaaatgatcccctgttaaacttgagaattttttttaaggattttgagttgtttttcatatgatcagctaatgaattcagcacaacttctccaaccccaacctttttctcctgtttagcattttccacttttttactctgtgatgaacaagccctccctggttaattatgtatatatttagcaactgcatgtgttgggcttattattgtcatctaattagatgtaacttgaactgcttgcttctagaaaaatcattaaaaattctttcctaatgacctagagatgacaaaatgtctgtaaagtgtgaagaagcagacaagcacaggaacatcgctcttaaagagtgttaatccagatgctgccatcatctaattaaacaatattttgctgtcattaacattttcaccaaggaattgcagttataatttctttgtcagctgtctctagatcactttaccttcaaaaccaaagtgccatataaaaacattaaattggatggtttaattaaaaagtttttttaatgaagaaacatatccagtgtttctgagatctcatttactgtttcacttttattatttgagtagattagtgtcataggcttgcggtatttaatattcatcttccaagataaattcttataagcatagttagcaaaataaagtgtatgtgtgtgtgtgtgtggagatagatagatagatagatagatagatagatagatagatagataatctccacacacacaaatatatatatttacttaccactgctggaaaaggaaaggaccctaccaattatagcaccagtgtatttactaaatatcaactatcctaaagaaaaaacaaaacaattagtaattaaacatctaggtatgccagagcctcatgagtattactttggaaataactcattttttggatgatttaatgaacagtattttttttcatttcacaaaggtgttcagtaaaataattaaaggagtaatactaattcatgattaaaacatatcaatgcaaaaccccaaagtgccacttcatcactctttttttccatgtaacattaaatacattgtgcatttttaattcaaatcaaatacatatatgactgtccattttacaaggctcttatgcagaaatttttattaaaaacaagcattaatgtcatatttatttataaagtttattatatttattagaattaaaataatgctataaatctctgctaatttaaaaattactaaaattttctttttagcacttattttcaaaggacctctcaaagattattgaaagtgaattacaaaaaaaaatgcaggacagaataatagacatgaaatatggctattggcatcattcattttgtgtatacgtgtgtgtgtatttttaaataatgcttttcttctttgtatttttttcctaaaatagcattattttttttttaacttttattttaggttcaaggagtacatgtgcagattttttatagagataaattacatgtcatgggtgtttggtgtacagattactttgtcacccaggtgataagcatagtacccaataggtagtttttggatccttaccttcctccttccctctaccctcaagcagtatccttttctttcttagaaaatcatttctattaaaaaggctggtgtcttcaaatatagtctacatttttatgctgtttgcattgacacagtacatttaaatactgtgtttatgtaaattggctttttaacagttttccttaatatataaattataaaacttcatcagaaattattttaacaattgtggttatctgattttcatctatcaattaatttatttaagtaatatatgttatatctagataggtagcatcagcattattctattaaaaaaatatacactggaatacttgcttttcattaaaatctacagatttttaagtagaacagctcccccaagaaaatggaagagctctaaactctgccatggacccatttaggatcccagaaatagctctgtctagccaatctgtactctttgtatatatacatataaaaaaagtactgagccctatcaggtgtcctaggttagcatacatatgaactattagtaataaattttcaagtttagaattgtacagcttttattttacaatattggtactgttttagcagattattgtcatgtcaaaagactttaatatggctccgaactcttgtttaatctcatcattagtattattcaccatagacttaaacacaagcaggttcattgattgcttgagctacctagctgtagatgttttcttctcgtttaatgtagacattcacaatatcattctctctcatatatacctctacgcctttgcataatcctcgtcttctaaagataatgttctgcagttttcctttacttgacttatatttgttcatcttctgaaatttgggtcattttattccatttttatcacatgcatatccattccatcaacaaacatttattgggcagatggcatatgccaacacacagagattaaaacaaacaaacaaacaacccagccctgacatttatgagtttacagactggtggagaggcagagaagtaaacagcaatgtatatcaggtgtaatagaggtctgtatgagaactgtggtgaggcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttgtaaaatgcaaagcttcatataataaacagataaaatagtcatcaataaagtgttttctaaatatattaattaatttggtttggtgcttgcaattacagattttggttcttactcagattgtagttctttttttttctatttcacagttatgttttccaaatgctgtaagagcagatatcatttaatgtaatttcctgatgatgaacaagataatatctgcatatctatgctactgtgatagtacatgtggtgtgtgcaaccatggcatactggatgaaactcatatcactaaataccagtgaaatagctgttttgtgtgaattttaatggaaatttagaaaattactgataattggatcataacgcatttttataaaaaataattttgttcaacaaaagttttcttaggatcctgtttctttaatagctattctcttaatttcacctgatcatgttttttcagtttcagtttatgagggggggccgcagcttgctcccctaaactttccccattcccactgtgcctcaatatcatacctgaaatatttaagtcattctaccaaaacataagcagacatattcaccctaagatcgagcagttcttcgctaaagtgaaacaacataagacaaaaaaatatttcatgaacttaaggagtgaaaaaatgtatgattgacatctgcctctgtagtttctcatcctagcttcagagtacttctgtccactcgcaaattctctgcattcattcttgatataagtttaacatagtattctgtgtactcataatataatttctagatatatattcattataatagaataccatcacagccaggtgcagtggctcaggcctctaatcccagcacttttggaggccgaggcagatggatcacaaggtcaggagttggagaccagcctggccaacatggtgaaaccccatctctaccaaaaatacaaaaattagccaggtgcggtggcgcgtgcctgtaatcccagctactcaggaggctgaggcaggagaatcgcttgaacccgggaggcagaggttgcggtgagccaagatcgcgccattgcactccagcctgggcgacagagggagacaccatctcaaaataaataaataaataaataaaagataaaatagaataccaccacataagctgcagatgtgcaggtcagtggggtgacttcctccataattactttcagggcctctgactggcaaggctctgcttccggggttgcaatattatctacatcagcagaagagagatgagacacacatgcaggaagtttcagtgggccaagtcttgaagagactttgctcacattctgtagatgagaactaaatcctgtggccagagctacttgtaagggaggctgagaaatgtggtgtaacacaggaagaggagaatcaattacaataaccagccagtagcctctatcacagtcttataaatagtaattctagttacgtcttaaaacaattattgagtgaattcccttgaaatgcattgttatcagagttaaagatacggttcaataaataaaaagttattttcttctgaaattcagtagatgctttgtaaaaacagaaactatttcataagcattttgtgtgtacaaatttttatttctgtttttctttactaggacggacatataatgatctgaaccaatatccagtgtttccgtgggtgttaaccaactatgaatcagaagagttggacctgactcttccaggaaacttcagggatctatcaaaggtaacttttaaatatatagaagtcagctttcttcataaggctatagtctaatagtatttctgtcagagtatatatagccagttaatgtttgtaagaaggtgaaactgattatcttgacttacatagtcagtttctaaatcttaccaattcttagcacaggaattaagctacaagaagataaactagtactagcataggcaaaatgaaatgggtatttgagaaacagcagatgtagagagagttttctcatatatcctaggctttaaagtcaaggttaaaaacctaaaattagtagaaaatatgatggcaaatcatttatgtgatatgttccttagatggtaagacatttatattgaccataaaatacacacattgtagggaaatataatactgaaaagaaagtcagttaattttaccaagtgtctgtctatatatgagagagaagatatggcccaaaagatggcaagaaaatggtgcataacggtaatgagaaataaaaggcaaaatttttattagctcacctcatttgtccagaggaaactacagtgtgatactaaactgtttgaaattcagtgaagaactgggaactaagcccaaaaagctgctctatagtctaagcttacgccagaggcctgccttaaagtttatgtatgttagccatagtaaagcctcagcccattgacttggaatgtatctctgttttctatcagacttgattgtctgatttagcaatccacagaaagttgaaaggtatttgtgtatacatttggttttagggggcaggtttaaggggctaattgacaagagcagcataagccctgtgatttagggaaacaacattacagctgatttaaaattaatcccacagatggtttttaactcagcatgcctgcttctgccccttttctggcctttgaaacctagacgtacctaagttgaagttctatattgcactagttactagctctgtgacctaaagctagtttctcttgtcccatttgtaatatgagaataataatactgtcccatgtcaaatagttgtacagatctaatgacatgtacatttaaaaattataacatagtacttggcacatagaagcacttcctgagtattaagtattattgttacacatggaatatttcttagcctcttttgaagactgtttgctagttttttcatgttcttatgcgtcattcagtatccaattcttttattttatataactccctattaaattttagttgatagctcatggataattttagctgtggtattatagatgttaaagggacctaaaagatcagttagccaacatcttactgagagtcacacaactggtagaaataaattgctagcaaatgaattctaatacgcttgcaaatatagtaattcttccaaggtgagtcaaccaaaaattcttaactatttaccatattcaggtaactaaattatttaagataaggtagatagaagcattgtaattcatgcagcctgcccttcaggaacaaatctagttatagattatctaaataataagatcagtcccccaaaaaattaaaaataaagtacaatattttagagagacccacacaagagataatacatgcaggttgagtatcctgtatctgaaatgcttgggaccagagtgttttggattttggatctttctggattttgaaatatcaatatatacattatatacttaccagttgagcatccctaatctgaaaacccaaaatccaaagtgctgcagtgtttccattaagcatcacatcagtgcttaaaaacttggatttggggcatttgagatttcagaattttggattagggacaagattaggaacaagaactctgcagctagactgcctacattcaaatcctaattctgccatttaccagctgtggagctttagacaagagtattagtttctctttgtcttaatttcctcacctatataatgagacatcaataataatagggttgttgtgtggagtggtggatgggttaataagcataaaggacttagaatagtgcagggacatcagtattagctaatgctatgtatatgacaataatagagtggtgaatcattgatataggccatatgctttgaattgtgtttcaaataatgatgatgaatatatgctactacatacatattggatgagaatatttgaatggcatgcatgacttgccaaggttgaagtgtaattttggggtgtaaaacaaaaaccaaactaacttattgatgtgaggatgaaaactgtcaaactagttctttgacaaaatcttgtctgcatgtattttatttaacataaattgaatagccattacttagacattataaaatatatatacgataaaaattcagagtatagattctcaggtagcatattacaacctcgtacgatgactactattatggctattgtattatttttaaaacaaggaaggaagttctttttatttaaaatcaactgggatgttgtgtttaaaggaaacttatagactgaagctcctttttttctctccatttatttattctttcagttgttcagtcaacaaatatttatcacacatgtgctatatgtcaaacactctacaagtgaaagagtgtacaggagtgaataaagcagacatactcccagccacttgaagggagttcagcccagagcaaaatgaaaactcagatagttaacagtaatatgagaggccagcatttacaagataggtatagtagggactgtgcctcactggggagtacaggctcagactcactaagacatttggactcaaatgttcttgaaacactggcccagccaaagaaaatgtggcactcattatgattagtatgggttatagaaggcatctggtaacatatttgctggtaatcatagatttttttcatttatccatgtaggaaaaaatgagttaaaataaatgaggaagtcactgtttctacagtaactgaagatataaacatttcaaggttttgtttgtttgtttgtttgtttgtttgcttgcttgcttttgagacggagtctcgctctgtcgcccaggctggagtgcagtggtgcaatctcggctcactgaagcctcctcctcccaggttcaagcgattctcctgcctcagcctcccaagtagctgggattacaagctcccaccaccaaacctggctaatttttttgtatttttagtagagacagggtttcactatgttggccaggctcgtcttgaactcctgaccttgtgatctacccacctcagcctcccaaagtgctgggattacaggcgtgagccaccacgcccagcccatttcagggtttttatgctaatctgtgtaatgtgtatttcctttggcagagcttttccttttgtgcctcacatgtgctcctctaattttatatagtgttaagtaaataatacaggtaaacagacggagcctaaataaattaggcaatgtgactacaaactgtagttttgcaagcatgtagttcttcatgctgtgaacagttgaatccatgagctcttaaaagataggtagcttttcttccaattttactatattctatgctttagcaatttgttctttctattctgtcaccctagcatgataggaaaatgttagcaaattaaagcctcttgatatgttaataaattactcgtgcattgttcccatgcttcattgaatttcttaataggagcttcttacaaatgagctagaaacctgagactatcctgtataaaatccatcaataaacaagattttaatgtatgaaaatatatctttttatatgcctaatgggaaaatgacatttgaagtataataatataattggaaggaaaaactactatagtgcaatattatcacaatgaagagatgtccactaagaagcacatgaagttcttgtagttataatcaataccgcaaatgaaaattttaatggagagtttcttactcttcagaagctcaaggaaaaattgaaatacttgaatgatatgaccaagaacattctaaaagatctctaacaacaaaagtagttgtttctaaacaaacactgggactcctgatcccagtaataattcttagcagtgaataattctagaatttgtttcaataaacatgtggtaccccaaatactttttatattccttactatatgaaagaattaagaaactatgaaatgtacaatgccaaaaaaataaatatttattttctttctttataccaccacattacacaggcttcatgaaattctgtgttgtatcagttgggaaacttctgaatgaaagtttcagaaaacacagctgaaagtggcttgaacaatagtgggaattgggagaaaaagtcaagaggttgtaactggaacatgaaaagaatgtaggcttcgctcaaatatttgtttctgtgtcacatattgtgcaaatttaagatgttttctaaattctctgaacttgttttctcatctttaaaatgaacacaatcatacttacataatagggttgttgaaagattttaacaccgtaaagtagttaaggcacctagtataatgcctgacacagaagtggcattcagtgagtggcagtgacaaagcaaatttccataattgtcatttgagagttcactatctttggtatgattgacaaaaacctactgaaggttatttgattcctctgatttattttttattctagtaagattaaaaattaatgccatttaataaaatattttaattcaataaataattctgttttatcatctatttgagttatcaaattatcaaaactgtaacatcaaaacactaaggttatattaaatgtttattagaactttaggtgcacatttatttagactgaaatattttatatttataatattcttacttgttctttggcccacttaattgaacattcgaagagcacaggagcaaaaaaaaagttctttatcagtaagattttttagacctctcatttgattagacatcacaggttcaagttttatttattatgtgtacaggttaggggctatgtttattgtttgacatgagggtcaacagatgaaacaatctgcctttgacctatcttttcaacaccaaccaacagtaggtttagagatttcctccccaccccatttatataggtattccttatggagatgtaaccttatggtgaaatctatcttacaacatgatatatgctagggcttcagttatttacatatactcatatgaactcgactcttaaattacagtggttacatgactttgatgtgaagcacagtctctgctcattaaagtgtaaatagaattttcctatttcccagtcatgccctctgataagtgaaatagtttcatcacaaaaccaagtcctactaatattgacatgaacataagacatcacatacacacacccattcatcgagtggaaaaaatatattttgttaacacaggagttgtttgactgacagatgatgataagcataaccattttcccaaattattatgccacttaataaaaggaagtgataatgccttgaggctttgaaatgtgataatgcaaatggatgcactgaagtgtgaatactcttcaaccatccaccctcaatacttccaaatgtctatctaccacacagaaaagagtttatattggtaaggtggggaatgcatgactcagcaatctagagcaagttgggtttgttgttgttgttgttgttgttgttgttgttgtttttgagatggagtctccctctgtcacccaggctggagtgcagtggcatgatcttggctcactacaatctcaactagagcaagtttctgtggttattttatctttctttttcactgtaagttaacaacatctaaaatgaaattaattccatttacttgatcataatctacctaatgcttaattttaaacaacaaaatatgaagtatgggcaaaactactaggtgtgttagtggtaggatgatacaaaactaaaagataaaagtgtaaatgtgtaaatataattatataccatctgccaaataaccctgctgccaaatttgaaataacttgtttcaatgtatgttgaatgctgccttaacatataatccacactatgttgaaaattgttttcattagacttgctaatatggcagtgctgagggacaaggtattgactggcagtgtttggatactgttttaaactcatgagatattcatttatttaaattaatacttttattcattcactcattctttcattacacaagcatttattgccaacctactctgtgccagacactggagatacaaaggcaataagacttagttcatacctttaagaagttacagtcattgtttacccagtgacatattaagctgttctccttctaattgaaaaaatggaagaaccaagaaaagtgcaactaaaaaggtagacttcacagacactggtaaccagaaacagtgaagtgtttttgtgtttgtttgtttatatctccagtgttgcttgttggagacataatagggtgacagggagctttatagatttatacagaacttccaaagcagtcctaggctctgtttgcttatactaaatgtctctttatcctcttttcttgttccttcccacttagccagctgaatcaccctttcagaaaaagagagggaaaaaaatcctatagagcctgttttgctttgaaaattttaggctgttaaagaagaaactgaaaacagcaggaacactgtttagtgtatgctcttagaagaatcctacctatggaaaggaaaagagagcctgctttatgcactttaatttcaccagccacatgtcacctctgtgtctaaaccacagcattatcatgcaaaactaggccaaattcagtctcctttaacctttctttccagctgaaacaaaatattaagcagttagaagtgatcttgaaactaatttgtagccccatcattatccttctacttaatacctggaaaacttctagaactaacacatgaagatttaagatgctctactgtttgtaggtgaaagtatttacttttcactaagatatataaaactaactttcttaggaactatcttgggataatgataataataatagccaatattttgcatgtgtttattatatgccaggcattgtgctaagcatcttacatggattttcttgctttaccctcacaacgctatgatgagttgcactggttatatagattgcattttcttccattcgttacctattatttctccataatacataggtaggatattctttaaaaaaaaaaaaaaagctagtgattaatttctcttctagatgccctctaccttttctaagtgccctggcagtttttatacactatcaaaaaaaaagaaaaacaaaagaaaaaaaacaaggaaagaaaaagaaaaaagaaaaactctccctattatccagtaagaatgagttcttttaaaatatcctgcacaatgctcagtcatgtcagatatgaggagaggagtcaaaagaaatgcggtcagtgagccattccacacctccaaagttttcagtcctatgtgggactagcattcctgtgaaagtgcctaaagctggatgtggtggctcacgtctgtaatcctagcactttggaaggcagagtcaggaggattgcttgaggccaggagtttgagaccaacctgagcaacatagccaaaccctgtctctacaaaaaattaaattaaaaaaataaagtgccaatagatttttttttttttttgagtttcgctcttgttgcccaggctgaagtgcaatggtgcaatcttggctccctgcaacctccgcctccagggctcaagcaattctcctgcctcagcctccccagtagctgggattaaaggcgtgcaccaccacgcctggctaatttttgtatttttagtaaagatggggtttcaccatgtgggccaggctgctctcaaactcctgatccacccgcctcggcctctcaaagtgtggggattatcggcgtgagccaccatgcggccaagtgctaatagattttgctaatcaaattgcaactttagatcaaagatgatctttcttcataatatactcaattccaccctatgaaaaactataaaaagaaacacatttaattaatagaaaaatgtaatcttaacacttctctttattatcgtttcatgacttcaggttctgttccttaataatgtatttgaaaattgtgtactgatttgctgaagttcatctgatgacaaaaggccatattaagccaattaacagtataaaattgcaaagggaatgtttaatccacacttacaagaacgtaattttaacatattttagagaaacaaattttcaagtcatttaaagcattcttatttagaacaacccaaaacataggaaagacttggattgattggaaaggttttgtttgtttttgtactctattttaattgattttgactttactatgaaaatttttaagcaaagaaaaagtaccaattcctaataacaatacccattaaccaatacctacatgttataattattgacagtttagcttttattggtttactgaagtatttttaaataaattaaatatatcatactttacccctaaatatttcagtgtgaaaaatagtattttcccatataatcagatcaccatgattatatctaacaaaacttatgacagttccctaatattatctaacactgtgcctataatcaaggttttctaattatctcccatgtgtcttaaaaattgttttgcttaagccaggattcagtcagcgaccacacagtacatctgattcttctgtcttatctgtctaaaggttagaatagctcccagccaccctaacacccccaccttttttttcatgatattgactcatttaagagagcatgccagttatcttatagaacataacaataacagccaatattttgcatgtatttattatatgccaatgctaggcttctgaatttgtctttttgttcctcgtgttgtcatttaactcgctgtaactagtaaggttttgatgtacgctgattcaaatatcaatgaagattgataatagaagttttttgttttgttttggtttggttttttttttttgagacgttgtctcactttgtcacccaggctggagtgcggtggtgcaatcttggctcactacaacttccgcctccgagattcaggcaattctcctgcctcagcctcccaagtagctgagattacatgtgcccacctccatgcttggataatttttgtatttttagtagagatggggtttcatcatgttggccagactgatcttgacctcctggcctcaaagagatctacccaccttggtctcccaaagtgctgggattacaggcatgagccactgccctggccaataatagaaatttatatttggaaatatttggtcaataacactagccaaaatataaagttactatagttaatttaaatttatcaaagttaaaatgttcacatgtgaaatatatttctgggtcatataattctaaaagccgactaaaattatctctatgagataaaccaaattcatgattaaacagcaaaaaaagagtatacagggaagactaaagtctccacattctcactgcccagagacaactgttgatatactgtcatatatattcttcaaaaaataaattatacaaagtagaattacttgatcaaaactatatgattttttaaatgttaccaattttccccacaagaaatttatactgatttatttgccaatagcattatgagatatcatgttttccaatactgagtattataaaacttaataatttttgacaatctagttaataaaaatagtttttgtttgacattttaacaattgtgagtgtacttacgacttttgattacatatagtagaaagtcaacttatactggctttaatttaaaataaaaatttgattagcccatataactgagaaatccagggatgggtcagttcaggaaaactggatccaagtgcccaccagaattatcaggatccacacctctgttacttttctacattggcttcattctcaaacaggcttccctgtgttacagtaatgatgtctttgtaaccccgctagaaaaagagagcttttcccagatagttgcagcaaagtttcatccgatcaagttgaattacctgtccatttctgctgcagtcatagtgccaatgtggataaaatattatgattgacaggtctagatcccatgcccacccagggagtcaggtagcgaggtcagctcacctgcaccaggtagaccaagagtggggaaggaatggttcacaaaggttgaaggcataatgaatgctaaacagaaaaaaagaatatatatccattacattgtaggaactggtactattttttcttatatatattggaaattggcatttattattctgtgaattgcctattcatcatatcatttcctcatttatttaattagattgttcattagcttcttattgatttgtaagagcacatttttaaggaaactagctcttatgtgctatgaatatttttcactttgttatgtctttcgatttttgcataaaatttttttctaaaatttccacatggaaattttatataatattatataattgggtcaatcagtcttcattcatttagcatttattgctcgcttaaaaaggttcaggtactgtaggtgtgagaataaagagatgaataaaagacagggagtttcttcgaagggctacactactgggttaaaaagatgagaaagttgcctattaccagatggtgtcatgtaaggctttacagatgcaatttgaaaaacctccaaaataatgagttgaagttccttagataaaaagggagcccgggaatttacttgagcacagaagtgtctgtaggtatgatttctatgttgtcataacagaattttcagaatgatgacaggtagttcatgactaaaaaacaaaaaaggtaagaactctcaaagcctcttctaaggattttcaagcccttgattacaaaagataacacgataacttagatatgttagcagttcaatgtcttaaaagtattgagataactaaaagctattgttagaagccagacaaatgagtcaaatatacccagcttcaagctgtatctagcacagagctgcagctggttctgtaaaacgtctagccactgactagcaacatgatcttcatttgacttttcttcagtgtactcatttgtaagagatttggtcaagtttacctgaatgtttccttccatttctgtggatctgtgaggaatgaggaattaagtaggaaattatgaaagaaaaaagtcacatcaagggccgggcatactggcttatacctgtaataccagcactttggggaggccaaggcagaaggatcacttgaggacaggagttcgagaccagcctgggtagcatagtgagattccatatctattgaaaaataaagtcacattaagatcagaatttcatatttagcaatgaaaaagcagtgcagtagtgtggaatgtggagacccaggtacctgtttcctcctcatgaaattaggttcgtattgaatgccttgctgacctcagatacttatgaaaatcagtctagaaaatggatgtgaagacaatatgttatacaaatatatagtatcatcagcagttgtaatagcagtagtgaactcttgaacattttatgtgtgcaggtttgagtattccttatccataatgcttgggaccagaagtgtttcagacttcagattgtttcagatttcagaatatttgcatatacacaatgagatagcttgggaacagatccaagcctaaacaaaaaattatttcatttcatatacaccatattccatatagcctacaggtcatcttaaacttttttttttttttaacaattttgtacatgaaatgaagtttgtgttaagtacgtatgtgtggaattttccacttatggtgtcatgttggcatgcaaaaggttttggaatttggagcattccagatgtcaaacttttggattagggatgctcaacctatgtaacagtagaatcctagtaccatgaacatcattaccattttcagttttttatgatatattagaattcagtgttattgacattgctttaactaggcctctgatttgtccttgacaaacttttttttcttgaaaattataatgtagtttggtgacattgaccattcatcagatcaatccacatttatttatttgtatttgtttaaatcaataactctgtgctcagacttttatgttctctaaaagttcttctgatgtctcatataataccatttatccaatatgttttatttatataatttttgtggtcatttttacttactaaatttatatattttatacctgtcctaagaaaagggcttggtacaatatgcaggtttaaaagatagaaaaatattggtaaatcaaggctaagatgacagaaagaggaaacagcaaaatgaaactaaagaaaaagttagcatgcagaaatacacatcaaatacataccagaatgtttcaaggtacaatctaaggtattgcatctaaacagttgttttaaaaacaaaagaagtatgtatttcccattaaaaattttaaaaaataagcactggaataaacacatttaaacaattatatttactatagtatttatcagagccttaagatcacgtaaatccccacaaacatctggtaggatttttgtttcatgtaataaagtcacaaaggtttttatttttaggaaaaccaagctttttgtggcactgaagtttgagacagatttctctctttggtcttcaaaacagggaaactgagtgataagagtagagaaaattctcagcattatttcttcactaactacagtagtgtttcatgtgaacatcctaatgctacacatgtaatttcccgtagattttataaggaatgtgaatttttttacattagtcacttctttgattcttcaatattggaaacagtgcctttttgcaagctatgtaggctttttagcagttttaaaaactgaattataataataaagttttatagggatagaaattttatttttcatttttgcattttttgcaccattttttcctatttgttaaagtgttcacctgtaacataaaagctaaaaaagacaaaacagcaataaatctaaaaacaggctttaaactttcagttaaacttttgtatatggtaacacttaaaaagtgcggaagtcactgtatccaaatgcccactgtttgacagaaaaggacactatttattgatgtagtaactataatgaaaattgaaaaatattgcaaagtaaatttataaattttattaagtgtagccttaccttttgaccagaattcttaccatattcatctgccaaaatcagatgatattgacattgcagtatttgctaaaatttttgaagtatagcaaacttacaaccttgtcagtatgtaggtaagtaggtaattgattgatagatggataaatatgatatgataggtatctattaggatctcttaagcaaatgtcatctatgacaaaattcttatttccccaaacatttggaagctttttgctttctaattatttattgctgtttgactgttagaagcaaaatgatagaaaaatattaagtacaaagcaaatcacttgcattatgtttcataaaagtaatttctaaccttattaggtaaaaattcaaaattagaaatacattttaagaagttactaatggaggcatatacagactttaatactgtgcaactgtttcctacaaagcattactctgtaaaacactgcaataacatgactttgatgaaacttgtgtaaaataaaaaatataagtatttacttttccttttccagaagtgtaagagaagattgaaaaagattagaggaagagacatgctcctttttaaagaatgttttgtgagattttacaggacaaacagtatcagttaagatcaaaccttagggattgcacagacattttatgcacgtgagaggtctattagcatattcacgacagaacaaagtattaaacattttcagtgctttgaaaaatatactcagtaatgggatggctgggtcaaatggtatttccagttctagatccttgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgcggttttgatttgcatttctctgatggccagtgatgatgagcattttttcatgtgttttttggctgcataaatgtcttcttttgagaagtgtctgttcatgtccttcgcccactttttgatggtgttgtttgtttttttcttgtaaatttgtttgagttcattgtagattctggatattagccctttgtcagatgagtaggttgcggagccataaaaaatgatgagttcatgtcctttgtagggacatggatgaaattggaaatcatcattctcagtaaactatcgcaaggagaaaaaaccaaacaccacatattctcactcataggtgggaattgaacaatgagaacacatggacacaggaaggggaacatcacactctggggactgttgtggggtggggggaggggggagggatagcatcgggagatatacctaatgctagatgatgagttagtgggtgcagcgcaccagcatggcacatgtatacatatgtaactaacctgcacaatgtgcacatgtaccctaaaacttaaagtataattaaaaaaaaaaaaaaagaaaagaaaaaaaaagaaaaatatactgagttagaaaaacatatctgaacatctagtaaagtataaaatatgtgggtaattttaaatgaaaaactcattactttcggccaggcatggtggctcacgcctattatcccagcactttgggaggcccaggcgggcgaatcatgaggtcaggagattgagaccatcctggataacacagtgaaaccccatctctactaaaaatacaaaaaattagctgggcatggtggcgggcgcctgtagtcgcagctactcgggaggctgaggcaggagaatggcgtgaacccaggaggcggagcttgcagcgagcccagatcgcgccactgcactccagcctaggcaacagtgcgagactccatctcaaaaaaataaacaaataaataaaataaaaaaataaaaaactcattacttcaattccgtaacagaccttacattcatttcactttatagcaattacttttaccaataatgtaattatgttgttttaaatattaagattttatgtaatgtttaacaaaattacattcccttttttacatctatctaaagagatttgagagataatgaaatttaacacaataaaatttaaaccttagaactttttaaaaaatctaaatttttatactgtcatactttgttttacaaaatgaggacaaaaaagtttaggaaccttaaaatattaacacttttgtgcgtgaaaaatacagcttttatataaattgttgagtctttgttaatcataattaaagttaacaaaaaatgaacataatttacaagtaatttaaatattcaggataagcacccttgcaaataagagtttattatggaaattctaacagactttttactgctgatgacctcattgtgttatttgaattagtctcctgaggccaaaagaaaaggctcataacaatttataaatgaatcttcctctcttgtgtaacattatgtgtccctttgaaacactaattttctactacttctcttgttaaaattaagccttcgagggatcttcatagttaattataaatattaaattttgaaataaagtagacattgtacttagtactcttgttttctctgtaaacatacttaatttatagtatgcaacttaaatcaaaataatgtgcttatttgataccataagcacggactctgtataccattaatccaaaatcagacaaaaactgaagctaaggcagtttgctatttgaaatcatgaagatggtatgctggaaattcctaatgattagatgtgctaaaattttgagactgtgatgcaattaagcacatgctttttgaagaaatcagtatagggattagcatcataatcagtaaatagggtggtggtactgataggagaggtcttagtggcctcagcaaaatgctttccaaggaatccgaatttcctggattattccatcacccttaggtgtgtagtttaacagtaaaaaggatagttgttccatctatatactaacagaatgagactaacattctatcaggcttccatatggagggttgtctttcacactctgggtaactggctgttaagacaaggttttcactaatatggttgtcaaatggtcaatctcttcaccttccctccattgggtttcctgtattccaagctaaattttcattatgtagcttattaagtagaaggaaaataacgaaactgttggtgtggccttaacagtttaaactagatcacctctgataatctagttaacaaaaacttggtaaagtctagatactttgtactatgaattatcctcttgggcagtttataacaagtgtaatgatttgtaattaatatcaaaatccagtatggttaaaaatgtaatacaaaataatgtatttatgctgtatggctaaaatgaattaacagtgaaatactgaaagtataaagatttattatctaggatatctaatatgactgtattaaacaaaatattttttttcttttaatagccaattggtgctttgaaccccaagagagctgtgttttatgcagagcgttatgagacatgggaagatgatcaaagcccaccctaccattataatacccattattcaacagcaacatctactttatcctggcttgttcgaattgtgagtatcttcattgagttagcttgcctttggtaccttaaaattttaacataagtaaattaaataaaaatcaaatcagttgtaatttgattaacaaagattagagacgagtgaagtagaaattaaagatttcaaagtagcaaaatatgaattttttttattgagttgtctcatttgcaaaattggattaggaagatagttatctgttgctaggtattatgagcttaaaccaaaccagttgtccagttataaaggagccaaaattgagtacatacctttttttttttttttttcagtgagagggtctctcactctgccactgaggctagagttgcagtagcactatcatagctcacagcagccttgaacccctgggctcaaaggatcttcctgcctcagcctcccgagtaactagaactacaggcatgtaacaccttgcgcatctattatttttttatttctcttctttttttttttttgagacagagtctcgctctgttgcccaggctggagtgcaatggcatgacctcggcttactgcaatctccgcctcccaggttcaagtgattctcctccctcagcctccagagtagttgggattacagatgcccaccaccacgcccagctaatttttgtatttttagtagagacagcgtttcaccatgttggccaggctggtcttgaactcctgacctcaggtgatccacctgtcttggcctcccaaagtactgggattacaggcgtgagccaccacgcccggcccagctattatttttaaacatgggatctcactttgttccccacgctggtctctcacttttgttctcctgggctcaggtgatcctcctgccttacctccctaagcactgggattacaggtgtgagccaccacacctagccctggagtgcattcttaatacccactgcctcctttctcacaaatgaggcacactggcacttgctctccccccctccctcattctttcttcttgggcagcatgttttaaaaccagtttccaaatgttttgaaaacctctttctgttacttttctctttctcctaggacataaatatatttaagtctcactgaccttaaaaaaaaaaagcctcctgccagcctccgcccactctgaagttctttcccatctctctccctgcacagtcagattcctgaaagcacaacctctgctgtcctgcagtgcactgtggtacctgttgcctctactttatcacctcccattcagtctttagcctggttgatttcagttccacatccatcactttactgaactgttttggggaggtcacatattatgcagatagagcatcccattttttacctatcatgtctcttgaagcatttcacgctattgctaatctctccttgaaattttctttcaagttccttttacaataccctctcctggtttgcctcctgtcatcctaactgttctgctcagtctcctgttcagattgtttttccttaatgttcctcttctacaggatttttctttatatttcagctgagctgtgtcattcagttacaagctagtgatttccagcttctctcttctttgcaaacatttctcatgggttcctgacccatatttccaagtgcctactagatatttctacctgaacatctcacagtaccataagcagcatttcaataaatgaactcctcatctccctcatgtacctgctgtggttaaatgccgtgattattcactcagctgcccaatctagaaattgggaagctttttcctagatattttctctgtctttccaacctcttacatccagtcagacatccacagattctaccaactaaatatctctatctccttttctgtatactgtggcactttctttaatttagattcccattctctctcgcctagagtattgccaaagctcttaacaaacctcttttcctttattcttgccttctccattctggtctagataggagcactataagtgactgaggagtattgtagaatgctaaattaaatctcttaatcaataatttttccccttattaagatatacctcagaccactctattgtatggggctgatgtgtccaagaaacacattggtaaagcagagtatatgaaactgcatctcctgtcttcgaaaatattttttcccttcacctaaatgacagctctagtttgtaggtcttccttaggcattctctccattatggggaaaaaattaactttctacagaaatttagtatgaatacattttaagtaacttggaaaccactgataggtgacaaactacaattatttttgttaagaaaaatgttgtcagaattatgattctgtttgagcacagattttatccctttcataattctacaccagcataagaagttaaggaagtctggactaactagtcttttgagaaaacaaacccaaatcttacttttaaaaatgaactctgtaatgataaactaaaggaaaagacataaaactatttttagaccaaagttattaaatcagtctagtttatccaaacattcaccttaattctgtgaacttggattcttttataaaaaatgtttctgagttagaagtttcttgagaaatactttttaaatccggcacttttaaagtatagatgttctcttttttattttctgttaattttgagaatattagatttatgtcattgcctatttatctctataaagcaatcagaacagagcatctttagtttctgggtgataataataattccagaagtaggaaaatacttcacactcacaagaggcaaatgcttttcaaattccagatacatggacacataaagagcttataacttccaacctgcagtttcagccacaagtcaaaactaaacaaagtcacaaaaatttaccagtcaagatctcaaaagagctggctttctttataatagatataaaatatgctcttaattgatttgaactctcaaatagtcagacaagaatacaaaaaaactaattaattggattcgctgatcaccaaatgatcagaccataaaaccaaaactacattctcaatcattactgccgccagtggaaaattacctattagctgtgcggaaaccagaaacaaacaaaaaaatcagtagaaggagtaaattttaaaacctagaaaaaaaaagtcactggagttcaaattctgtttgctgcctagggtccaccctggaagctaagaaaagatgtacctgggcttaagtagcccatgagatatatttcttaagctacacagtcaatttgagttcatcaggttagtccacatggaactctcaaggggaccaccaaaactgttagcaaaggaaatttttggaaaacactgaaactagagattttcaccctgggaggccttttcataccacctcaggtcccgtcaatgacaatcattgccttagtgagccaccaccatggagggagcaggacacctcttgcaggtactttggggatgaggaaaaaggtcaggagtccttcctgagaaaatgttatcaactgggttgtttggagaattaaatgagagtatatatatgatagtattttgaaatacataaagtggtattcactgtttttttacctaatcaagttagtctgaagccagatttacaagacttcttcaagtgtgactccataagaatacttgttatgaacagcctaagttaacctcatctatccctaatcagctaaacactttctcaaatcataactcagaatttattcttaagtagatttattattccagcgaaatggaattcaaacttgaatctatgcaagggtatgccagaatattctgcacatttatcctacacatgcccttgtctatagcagtgctgcacaacagaaatataatgtaaactaccatgtgacttaaaatttctagtagccacatttataagtaaaaaaagaaacaggtaaaattaattttaataaatatatttgttaatctactatttccaaaatgttatcatttaaacatgtaaccaatataaaaatgtaaaataaggcattttacattttacatttttggagggagggtactgagtctttgaaattcagagtgtattttatatttacagtgcatctcaatttgaactagccacacttcaagtgctcaatagtgacatgtggctagtggctactgttttggacagatctataaaactgcttttttggagactcagcccaaatatcttatgtcacgtggttataaataaaagtatcagtctaatggtttactaagtatttatccttatggtccagggaattgtaatgtcctcactcccattccaaggagtttatgaaatagaaaatgcattaaaatttgggtcactaagaatttgttcacaaaaataaaatacacattaaaataagtgtctgtcctttaccttagaccttttagacctagtcattaaacttgttatttgtttcaatgtacttagtataacaacaataataattgcttaaaaatgctaattaactacatacttcattactttaaattaaaaatattattttaaacaaactaccagtgaaatcacttgtctacaatatgagaccctgaaaagactgttttcctgacagctgccattgggcaaatcatgaataaacttatagcagtgtttggagtttcttcagatattaatattaaaagacacattttacttggaatgtttttactttacaacttaccctagacatataacatgtatacagaagtaattaaatctttttccctggcttgctgaccactcagtaactcgttcaccttccaaattcagtatattcaaccctcctattcaaaactcattcgtcaaacatttcataatttccaaggaagtgatgtttagaatttgacactttctgtgtaaattatggcttgttttgaaagcttaccctaaagcctctttaaaccataatgtgtctttaaaagtatatatgtatagtagaaacatttttgcaagtgttgtaactaaaaccaaaagatagtgctactgaataaaatattgttgtttatcttgaatactgaggcattaaggacaatgcatatttactcagaggaagatgagaaatacttaaccaagagcctagtgcatggtaggtacataggttaattagtgaaaacttttggaagattctaaaagatacttcttggctcttggaagagaaataggagaaaataaacttctggaattagacaaaggccattagaaataatggttcctccatttgttagaatgtgaccttgaattttctcagatataaaaggggaataattacacctactctgaagggcgatagtagggattcagttaacttagataatacagagcctggcacagaaaaatgctttgtagctgttatttcccttccctttgtattttattatgcttccaatcacttcaaatatacatcttttctttgctatagttatgtcccaggcactacctattacccataaacgagatttgttttggcttttaaatggaatgaagagaaggaaaagaagaacagaacagaactacaagaagcgaaggatgtaaaagattattatgagatgactaagcgaaaatcgtgtaagacagaagaatgaagaagttgagtaaagagaagaggcaacagggaaacggcattagatgcccacgatggaattagttgatctgtaatcatccaaaagcaagaaaggctgttagtgtcttcagaggggactaaggggtatgatagaatacagaaggacaggtactttccagtgcaggcaaggtgagttttccatcactgaaaaagggttggaagatatgaaatgatgttggagtggatgtaattaggagaagaaagtctgccattggccatttatattgcaggacctaacctgaactttgtaaagactaacgagttccagaattgtaattcctgaaattaccgtttaatatgtattcatttatacatcttatctcccatgcctaaaacttttctaatataatggtgaaatgtccaatctgttgatgtacacatggaaaatggcccaattgacaggtagtaggcaaataaatataaaagttttttaaggttaatatagcacctaatcctctatgttagtcagacatgagtcaaatgaaaaagaaaggctctgcattgtggcttgaaggtaaaagggaaacacatggaaaaagcaatctccacagtaatcagagcttgaaagatcaatacttacttataaacaaataggttatcaatttctattagtactctaccactgtagcaactggaggccttcaggtataatgagaatatatgtcagtaatgtaatatgtgaccttaagacagttgttaatcagatctttttaaaagctatttaaaacactgaaatgtggaattcaatattctctgcttttaggtgccaccagattcattcataactttgttaccggaaataaatataattctttaatttcagatttcttttcactaagcccatctgtgctattcttggcatgtctttgttaagagttgaaaactagacaggattttgtaatttaggttgaggtggagatcagcttttagcggctgatgataagaagtacggctttgcatgtataaatgggttttcactcacatctgtttaataggttaaaaaacctagagacaagcctgatccctctaaattaatctctgcccactacctacagtgaaaattaaatgccttacatcagcatcctgcaataataaagtgggttctgaagataaaactttttggtcaaacctactagtagttaagaactgaaaagaaaacccgtatcttactctcacccaccatactcccatctcccaacaataccttgtatgtttaggtgtatttaacacacatttgttaaacattgttagccatgtgctgtgcttggggctggggatagagagataaataaggccttaggaactggcagtctggtgggaagtccaacagtgaatacttggtacagtgcgtaaagctggtagtcattttcataactctgtgccaggtaagatacatcaagctttctctatgttatttcatttaatcttatttaatcccataattcccccaaggtattgtcattcccagtttacatagatgaaggaatggagacagttgcttgacacagttacttaaggttaagtaagcttgcccaagatagagaaatagttccaccaagattcaaacttaaatctgtcatattgcattcagtttaccattgctgcatctacaatttttatatccccattttatttaatataatttagtgacagatatgttattttcactaccttatttttaatagtgaattaaacatctaaaaagcaaataaattagtgaaagacatgtcatataatttttttctaacttaatttcactaacatttatttatttctcatatcacttaaaatcctaaacagcaatatggacttcttggatgcatatctgattttcaggtgaatcaatactgtcccccttacttgtatattgttttttcattgttgatcttatctctttcatcacccttttctctcatccaacactgaacatgaaatagtggcaacatattacaagtttacaaaattgatgacatctggccatactaaatttcagggagatattgaggaagatcagtatttgttgcttttactccaacagccagcccttaaggttagtggcaagaaagggagtttaagggggcaaagtatgtcccctttgtacatacatacaaaggaattgtaaagcatacaaaggaatgaacagagattacatattaaagaaagaggactaaaatattttggaaaatgtcatgtaggtttcttagcattattgaacctgggaatgacatgtcattcatcctagacttgagagagaagaattgaagcagggaaagggaaatatgtatctatctttgctataattgtagttaagaaatccttagcagaaatgaatgttatttaatccttttaaacttggaagcaaatttaatgacatcaaaaacataagaacaacctaagaactcccagtgtgagaactcccaacttaagaattacaggtaaagcattaaaattaaatgcattaggacattgcaataaagttattcctaggttttctgctataggaacatgtactggatggcagacactatgttatccaaagacaatagtcacagaatgcaaaaaggtctagttcatctactgtcatttgtacttactttattcttcgttcaacagattatatattgagcaacttctatgtaccaggagttgttctaagtgttggagataaaacaatgaataaggtagatacggaacctactcatagtggggaatatagacagattaacaatcaattaaaaccagtgtgataaatgtttcagtgctgtttgaggaaacacagattgctatttgagcatactggagagccgtggtagcgcaaggaaagtttttcaggagaaaatgacatcatggctgagtcttaaaggataaaaagaacttagtcaggtcagaatagtgaaataaatgggtaagtttatacccggcctagggaacatcacagacaaaggacaagaggtgagagtagtgtggcaagattttagagtgtgaagaggggaatggtgagagataagagttaagcaggttccagatcattcagcctcttgtaaaacaaattaggtagtttagactctctcctaatcactcccaagagctattgaaggtttttaagcagggatttgcattttaaaaacattatcagaccataaggtagtactaatactttcgtagtctttcacaggtaatcatggacattctctacctaattccacactgcagtgatcagtatcagagtgatttttgtgatcagtatcagagtgatttttgtgatcagtatcagagtgatttttcttattgcaatgttagtgtatatatagccttaattattcgaaagaaaaatccaacttatgaattgtcattaatgcaaaattatttatcagaaaatcgtagagcactggaaccccatcatttcacagatgagaagaccagaagcaaaatgacctgccagagttgcagactgacaactgctgccttggcctagtcaagcccagacaggcatctcctactgccttaatttgggggcatctttctaggaccctgatctgcctccacatcttgaaggattttcaagatagccatgtttcacaaaggaacgagggcagctgtgtttagagtggtcaaatttctgattctgtttttttgcttaggaacctttcacaaccttcttcctcaatgcaaatgatggaaaatttgatcatccagatcgaaccttctcatccgttgcaaggtcttggagaactagtcagagagatacttctgatgtaaaggtaggctcttttatttgttgatattcattaaatttcaaaatatgtggaaattttgatttttttaagtgggtatgtataagacattttatattgcagctttgttccatcatattaaaattatatggtacatctaaccttataggaaataattttgaacattatagaaaataactgaaaattctttcatattacccagtgaaggtgttttcgttatttcaaaaaattcctacctaatttagatcaaataatcaggagatgtgaaaagcctataaaatgcctttcctgctgttaactcaatatttggtccattccataaaacacagcaggaattggatttgaccttaatgtgtcatattgttatagcttgcctggcttggggtttgcgtagcctggggcaattaataaagcattaatgacaagacccatttaaaatgtaggcttttccgtatagccttagcttttacttgactgtgcctggggatactatgcaacaatacacattagattaaaccaacacacacacaatatccagaaacagccagagagcagagtaattttacagttggtactgcttaactattgttaaatacaaggatttgttattcatttatatgggctcctattttaaaaaagaaaaacattgtattcaaagcaataatatatatttgttctctcatttgtctcattttttttcctgataataaggttacatggccaggttattgcataggtaaatgtgtttcttattttaagctcattttcttcaaggcacatttttttcccattactgtcactcagtacaaaaatgttacggtatcattccatttagagccttaaaccaacaaaagttagtgagttaaaatcaaaattgtcattcacatatttatgcttctctattgcaaaacatttgtaaaaggcaatttcagtgttactgaactgtaattggatgaatacaagttttgttcagtatttttccaaagcagaaaataaaggaaatggagccaagtagattgtaacatatctgtgtgttttacttgttgttgtcaaactttacataaatgaatatttattcatacaacatatttacatttgtaaaaaaaataagagaatttaatatgcatccttactatattaagctttgaagttctaacggtcttacaactttgctgagacttaaactctaaaatatccataagccatcatttaaaatgatttgttaccagtgaagtcaaggagggagtctgtttcttatataataacactttgagaattaatacagaaaatgggagtccataggctcccattgaacagtagtatccagaattcacacaatgttcataaaaggcactcaaatattttgtatgtgaattaaatattcttatctgtaattgaaggcttcttatcgcagttaagattattgatattttaaatcagagctatatccatattatatcagcctatttcaaatgaaaatgcctgctcactgttgtttgacatcatcacacacacacacacacacacacacacacacacacacacacacaaattggcttttcaacttaattcagagatccaccctcacatatttgggggtcagtcattctaatttttatatacagttttagatttcacttcctagcctgagaatttcactgatgctttataccaccagtctctgataaccgatgccctgtaccgggctttttcctctaaattctcccagaaattttcctcttcaaaaccctttcagaaacatttacattttattactaattgtatttggggggctcctgggttcacatcatccaggacaaagaccaatgtggatatcactaacttgggagtttttttgttttttatcctcaagcagctgtactgaacacaaacatgcagctttttttttccccaaagacttaattagttcataagaagctcatttccccaggatgacattacacagattgctctcattttcagctctcttaccaccactcatgaacctttcatattatatgttaatacatcttagatatcttgccatgtagacttcccctttctttttaaaggcagcatgctacatatatacaataatttatatatgtgatctctggttgatggagaatctttctccctgattgttactatgaagcacaaggctgtagtgaacatctttgcacagacatcctgatggactccttctatatacataaaggctaattcttattaatgggactgatggctcaaagacaatatactttttttattttttaagatattgccaaaccatcatcctcaaagatgaaaattcactctctacagcagtgtgcaagggtacctccttccccgtgccccctacacccatcatcactattgtattaaacaatggaacttctgctagtctggcaagtgaaaaattaagttatgtttgttttagtttgcatttttttttgagtgacgtggaacatttttcatgtacttattgacctgtacactgactcctatctattgctcatttttcagttgggtcacatgtctttttcttactgatttgaaaaagatctttgaagttgcagaaggttccattgcaagtagggtttcttggtcgtcttagctttgttatggttcgtttaatgtgtgtgtgcgtgtgcgtgtgtgtgcatgtgtgtgtgtatgtgtgtgtgtgtccagtcaaatatatttatattcccctctatagcatcagaatttgaggtcctcatgaccagagtgttaaagagaagataagacttttgggtaataactagtgctaacttgagaatcttctgaattcatgattaaacctgatttatcagagaaaaatatgttgctacgagtagtaattgttttgctacttgtgtgttagaacctaaagtttttattcttatttctaagctgttaaagcacagcatgatatattttttaaggaagtgtgtttccatttccagagaagaaaagtatctctgcaatgtctactaacttagtcagttaatcacataggagagaactaggatgcagtagatggttttattctgtctgtctctattaatgtcagtctcttcctgtgctaatgaacgcaagctgggaagaaggagtgctgctgaagtgacctttcaggagagaggtctctggagttgagtcagactagttagtttttactttattattattttttaaatttctttccctctagcctagtcttggtaacaatgacattcaactcactgaagttcttacactaattttccttaatgccttcaaaagttgttatattacttttagaatagctatgtagatgtcagaaaaggtagctgtgacaaaatgtcattaaggtgacatagtgtaaattaatacagttaatggaggtgctcgccactgactcattgacccattatgagctcttgtggaattaatgaatgccagggcatcagtcttttgaaaaaaaaaaagaaagaaaagagatggcagctttaaaaccttgcaatgaattatattagaaaagtgaaaacgtctggatcggatttgatttcactaggaagccataaaatggtacgctctctcagcaaaatatattaaactgaaatgtcagatttgatgcaataggtatacaattatgatagtgttaatagtggtcttctatcattctaagacatactttcaggtccaatttctcagcagcttgaacttgtcataagcttataaattaggaatcgcatttgaggatatgttcttattttttgacagaatgtatataatactattaactataccgtggggttttagtgtagctgctaaaataaactagaaatcacatttatagacacaaaatgtctgctataatgttcattttgccatttctttaataatatttggtgttttcctgcactgtttttcatttaggaaattttaaactacttagactttttccttaaagagaagctgattaacagaaatttatcaatgggaagagagtcagcagaacagcagttatcttaagcatgcaatctagtgtctaatgtgcctctgtaggagtacacttacacattataaaaataagcccatcttttaaaataatactgaatagttttcaaacatgtttttgttggttgatacagtccttgaaacaatcctatgaggtagtagtcattaaccctattttgtaaaggaggttcatgaatattaagtgactcacctaagttcacacgcaggcaggtaaagaggaagccagtactagcacagagtctgtccagttatttaagatgcttcatatccaagaggattttaagaatgggagctgcaaggccacttcatgcctaggcccggaagtcacatcatgttacttccacagcgttgtattgctcaaagcaagtcatggggccctcccagaataaggaagagtagacacggactccacttcctgatgagatgagttgcaaagtcacatttcaagaggtcactgagggtggagggattactgtgcccaccttcggagacagtctaccacagtcctccgaatctggtcaaaattcacattcctcttacatgtaaaatatactcaacttgttccccacaagtcccatcccagtatttgtatcagactgaaaatctggtatcttgttgtctacataagccccaggtacagataaggcacagcaattcctaatttggagacctgggagctaaaaagacaaattatctgtcccatgtacacacaacatgtggtggtaagacagaacagttaaacttcggtagaaactccattcagaagggggagaatgtggaaggtacatagcagtcaatgttcatagcagttctgaaacgcagccaggaataagttgtcgattacccagactgcagggacagggactgtccatggattagggcccaggtctgttatctgggcttggctccttaattcattattttccatggctcttggttacttcctctgggacattggctttgccctctgaatcgttcttttgtttccagaagaaataaacatggtttgcagctgagtatctttctctgcatgcttcctgaccatagaaagttagggccaaagcctcatattcccaagttggtacagcagctttaaaactgtgtagcctttctgtgtatcaaattagaaaaagctaatactcacaaatccttttggaacaggattctctctttcaagctgtgaattaggatactgtttataatgccctaagaatccctttctcgtgaatcactctgtgtagctgagcaagtctgaaaaacactacctgaaattttaacttttataaaagggttttacagacacacccttgattttagctttattctatggccatattttacttgtagcaccttcgaattgatctccatcctgaacctatgtcttattttgagaatcttttgccaactgaagagagtgttctaggcccttctattgcttgaaatactgcttcaaaactgaacagtttcttcctgagttcatctctctcttgcatagcttatctcttttgcatagcttacaccattagatgaaaccattggtcactttcagcattctgcctggaaatcttctaagtcagaagcacatgcttattaggtacttgttctgtctttgaaattattgcagaagacgatgttaattttccaccactacttaagagggactgcttccaataacaacttccttgctgatcttccagaccccaccaggctcctcaccacccctcccacttctgcctgctgcctcatcgcaagccagaatcatgtgttaaattctttttattactttagcactccactttgaggattcagtttctgttttggtcatttatgactttgtaacaaatcaccccaaaacctataggcttaaaacaactatttattcatcgacaattatgcaatcagagttaaggctcaaaaaggacagctaacctctaagccacacagtgacagtggggcagcttgactgggcggcagaatctacagtggctttgctcacatgtcttgtgcctcatctgagatggctggaacagccaggaactgcctgggcatgtctgtctctatcacatgtttctatagcaagggagccactctattgcatgtggtaactggcttctaagaggactaaaacaaaagctgccaggcctcttaaactcttaggctgccctaagaagccttgcagtgtcaccttgtcacgttctgtgtgttgaaacaagccaggccatattcagacaagggggaaatagactccacctctttatgggaggagtaaactggagatgccaaagggcttgctcttgggatgggaggactgttatagccatctatgagaaaactctgtgagttaccaatttaaaaaatactttaagtactagtttggtttgtaccattctctacagtctgagtgtgcatttagacataaaccaaaatctcatgagcaagcaatttataaaatacatctgattagtttaggtaatatatgttagtccatatatatgtcaactttaaataaccatattcagaaaatatgattaagtgtaaagtttgtttgagctcaaagcttgagaatggtcaccccataacataggttcaagtagccctgaatatacactctgattagcagcaatcataaatgggtttttaagaaaaaaagaagaggcaggtcctaagttgcttaccaagaatttacattaaaataagataagccattggctatacattgttctttgtatcaccgatttcaggaactgaagataatgggtaaggcagctggtcagaaaccaaatgcctttttaaacagttgctccccaggcttgggttgaggaggcagcatgagtgactgatgtcccacacgcacgtctctctggacctgatgaatttttgcatgcctcacataactcagactgctgtgagctattcttttcctcatatttgctaaaaatacttgcatcatctgaactgtctacatagctattcattgaaacacaatccacagtgacagaacttttttactgaattacaggatgcactttggtactgggtaaactctagtctcagaagtaatatttttgatccgtgcccctaaaaaaaattgagaccaaatagcttctagaatatattttatataaagttatgaaatgtattgttttataaacattatttcatttaatcctcacatctaccctaagagttcattgctgacatcaccaccatgttacatatcaataaactttttgtcaaaaggttaagaaacctgcccaagctagcaagaagtctggattggactcagacctgtttgattctgatgtatgtaaggtagcatttccctggtagaagaagggacaatcccaatgctgctgcctgcccagcttccccctttatcttcaactcactggtagccatgaggttcctcttctttaagaaacacactttgagccgcgtacggtggttcatgcctgtaatcacagcacttggaaaggcagaggtggacagatcacttgagatcaagagttcgacactagcctggccaacatggcaaaaccccagctgtactaaaaatacaaaaattagtcagccatcatggcgcacacctgtaatcccagctactcgggatgctgaggctcaagaatcgcttgaacctgggaggcagaggttgtagtgagccgagatggcaccattgcactccagcctgggtgacagagcaaaactgcatctcaacaaaaaaaaaaaaaaagaaacacactttgaaaaccagggcctgcaaagtttttaatcaacatttcaatgcctgaaatttaggatatggtaaacatagtaatcttgattcatttttaatttcacaaatatttatggattacatattatatgttagcaccattcttagcaagatagacaaggtccctaccttttgggatttctattatgatgggacatgcaagcatacaacaataaatagagaaaataatcattgctatgcagaaaattaaaacagagtaacgtcatatagaatgactagatggtggccggatgttgtggctcatgcctgtaatcccagccctttgggaggctgaggtaggcagatcacgaggtcaagagttcaagaccagcctggccaatatggtgaaaccccatctctactaaaaatacaaaaattagccaggtgtggtggcacacgcctgtagtcccagctacttgggaggctgaggcagaagaatcgcttgaacctgggaggtgtaggttgcaatgagctgagatcatgccattggactccagcctgggtggcagagcaggactccatcgcaaaaaaaaaaaaaaaaaaaaaaaagaaaaaaaaaaagaatgactggattgttactttaaaaggcagaatacagaatataggagcaggaaacctggatttaaagtatctgggtttgatttttggccttactaccaatttgcagtgcagccattagcaaattacccacccaatctttacctcagtgttcatgtctataaagcgggaataatgagaacacctacttcacaaactttttgtgaagattaagaaaatatatgtaaagcacttagaacagtgccaagacatagaaaggtaccaaaataaatgttacctgctggtttaaaacagaatgaccacaggtaacatttaagttgattcctggccttggagcacaaatgtagtaattgccatcttcttgcacataaccagttaaatctcagagatgaaacgctcatattctttggtttatatttttgaaacaacaaatcttttcaataatggaattgtgaatataaattatactaatgtcttgtgtttacatacactaactttaaataaaacttgctatttgaaacaagattgtaaaacaataaaactgagaccaaaaaaaaatctcacctctgctgcttcagctacttctccctagacttcttgtgatttcacttcctctactatccccttcacaaaactccaaactatccccaactctggacttcgggttcagagagctttagtcactgatagctctggtgtttgaaacctctaggggctctgcaaacaagctgtgcttcagaagtttctttctatctgtgtttaaaacatgtctgtttagtgattgtttccattatgagaaatctgggagagtttctttgtcccttcaaacatcaagcctctaacagcttacatctacatcttagttaatgccctaatttatgaccacatttgggtggcctgataagaatggagccaaaaaaaccatccttacttagaagggtgtcctgaaggccctggtaacacgacttctttctatgactagccccagttagggcctccttgaatgatcctactggagtattcttcctcctgcccttctaaagaaccatcaagacagatctttctaggccttccttgttctttggtggaggccagctgttagtgcccttctttctagagtgcctaaatgaaaatgaaattagtcttctgccacttttgcagtttgagaacaattctgatggcaactttaaaatcaactttttctatatttaaattgagctattttatacttttgagccttttaaatgtaacttgaataagcaagataacattttttaaacagaaaagtttccccttaaaaggcagatttcatttcagggtttatatccttttccttttctttaataaagttcttcattcactctttccccatcttgaggcatttttctgaccatctgtgtattccccagatttctagtcttattaaaataacttcatccaatatctttaatagcttaatatttaatgagcacctgctgcgtgcaaagtatagcactgagagctacgaaggatccaacaaaacataaacctcacaaaataggctcaaaactttgcgtttgcccagattttattcatactaaaattgcattttccccaattttattcacattaataaatatgacatcctatgtttcttgcgcctttgtgaatctaatttaatgactttcagtgaaattgcattgtagtggtaagtaggttaataatgaccacatattttatacaggaaagaatgggaaataatatatgaaaaacattatagagtgccaagatggtataagataaattaagactattttagttgtttaaataaaactaaatatattttgctatgtacatgtagatatatacgttcctctctgccctcaaggaagcttctgtagcctcgttgtagagatagggcatgagcacaaataactgacgaaaggcagtaagggaaacacctgatttatgtgagtctagtacatataaatcacactcccaaccgagcagctgcacaagcttacgttccttcccactttggaccctttagggtgttattgctattgtgtcacatgaagaccaggtcatatgcaaatagcaatagtctttgccttctctgcgccttttactaattcctcatgttttcccaaagagtgagagtaagagcagaagaaactatatattttacattcatacattgaagtcataagataataatatgcatttctgattggatgccaatacatgagaacagcagtgattctttacttctactctcctgtcagcgatcaaaccaaactgctccttccgtgactgataaacactgtcatgtttgcccagcctggaaatcaaactcatgatagtcattgctgatagaatagtcactgctgaagtgccctttagcctgtcttatccttcaattaaactgtatgatttttggcaaatgaacatgtgttttctacagtatggtttttctttcagcctcttctccatttccccgttcatattggagtcattgaaaaattatattaatttgtattaattccactagaattctcttttcctttttcgttgtggccttgaggtcttgtacatagtttattgttgatacacatttggcccctagtgtgagccatctaattccctctctttagctctgttgtagatttcccctctttgataaagttccacaatagggcccctttctctccacacttagcagttgcccttctctctttctcctccctatacatgcatatacaccacatcttcccattctccaatctctcctttactttgtcacccagtgtcttgctataaaacaaatttgactgtgttaaaaactcttttttaaaatttctaaaccactaagacaaaatccaaacagcgtatccttcattaaacttttctcatccatctggcctcatatacctcccaccatctcatccctcccttgtcttgatctacccacaatataccctgttctcctcttgtgctcagtttctcaccattccatataactccctgagggtgcccggccccctcttctggttttcatcttagccatgctccaactccaatggcccatctccaatgaagtctctcctgacttgcccagaatcccctgctctttcctccctgctcccttcttcctcagctgctattgtgtattataaccatctggttctacatctgccccacaggccagactatgaattacttgacagtaaggccatgtcttgttcattttttgtttcctgagtacacatcacagtttctggtactaaaaacctttactgtatgcataagtaaatgtcagagaaatatgtaaaggattttagaaagatttctatttaaatagaagaaaactgagattcttaaaaagcaaagctccatttatccagaaaaatcatttatatggacctgttgatgcacccataatgctggagaaaatgaacatttatatttttcttatggctcacagtgatcatcataagagtaatggtcagtttcacacagagtgttactaaaatgaatgcccacttaaaacagatatatcagttttagtgggagaactcgtgaagagaaagattttatatatgctttttctagaaagttagggatccagtttatttgaagacctcagtatgtggtggttttaattttttctatgcatccctagaaaagactacagtgagatttaaatttcagatgctatgccatcaatgttgatcatattacacaaataaatgtgtagcctcacaaccctatcttgatatttgaaaaaagatgatcaggatggtacacataaaaactacagcagtttgttttaattttctcccaattactttttaaaaaacaacaaaaactttcagggtattaaaatcagttcatttctacatcagatttattctaaagtaacagaaacctcaaattagatgctgtacatcacacacaagttctccttgaatccagttgtttatgctacagttacatacaagtaacacaagttgtctttgcatccaatttattgagaacctgtcatttctatggcatgcattaaatatttaaaactgtttatcatattgtgtatcatctcttttattgtgttcagtgattgatataaaaataatttactttatcaagtaaaaaaaactatgaatctctttataaaaatcacatattgtaattgtcagtatagttaaaaacaaaagtagaaaatatgtgatctattacaaatactggcaattagtttttaatttggatagttcataaattttcagatgaagattttacacaacatagacttgtttatatagctttacatatttgttttctaatgctattgtgaactgttgttaatttgtatactcatttctcttcattaatttatgggaggataagattgaaaataggtaacattttaaagtagctatcataaacataaattttcaagtgaatttttcacaagaaatgcttcatctcagatctttaaataaaattaaatgaagaatagaatagaattaattcataaaatattggttttaagaaattattttattccatttatagttaataagttataagttaatagttttattcaactgatttttataaagtggtttaatatgcttcatttttattcctgataggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggtaagagagattttgcttttgcttgggcagtcatcagggagttaacatattctgtagttttgttttgtcctgttctttactataatattaccaattatacttaacatctataaatacaagcttaaaattttaaatgaaaaagaaaacattttactgttgtcttgacagcattccttattgtagagtggattttccgttcatgaggactaataaagcaatggtaattcagttatgtttgctcctttaggagaagacaatcagatgagcatctgttgactaatataatgtattctaaagtgcttaaaataaatgcctatttcttagttttatctactgactaaatctgaacgcttttttcacttataaaaacactcagaacagaaaaaaatttatttagaacatatttatatgtgcgatatttatgctgtgaaacataccttatggtgtaaacattctgaaatagaaaacatctttttttgttttgttttacagacagtgtttcactctgttgcccaggctggagtgaagtggtgcaatcatagcacactaaagcctcaaactcctgggctcaagtagtcctcccacctcagcctcttgagtagctggggttataggcaaatgccaccatgccaagttaatttttaaaaaagattttttttggtaagataggatctcactatgttgcacgcactgatcttgaactccggggatcaagaaatcctcctacctaggcctcccagaagaaaacatcattattttaagctatattacagatatctgggtgtttaaatgagaaatgtataaacagaatgttcacatatgggaatttgatgggttttaatacatttcacacatatttaaggagattttaatcccaacatggttatagtaggtgacaataaaccactttacaaaacagcctctctagtgtactcttgaattacatcaataaaaccaatgacgccaaatatatttttaaccctgtttcattcactcccaagtttttccaactgtctgataaatatattttattttgtttttacagcttatttatttgaatcagaattcaaataaggtccacacattgtgagggaattcacatattccttaatcctcttttcttaaagagcttaattgaaatataattcatatcctgtgcaaattgttcatcatttaaagtaaaaaaaaaatgaatattagtccattcacaaagttgtgcaaccatcaccacaatcaatttaagagcatttttatcacctcatagagaaccccataccttttagcatcttccccgatttttcctgatttccccattctccccagctagcccaaggcaaacacaaatctactttatatctccattgatttgactattctagacatttcatgtaaacagaatcataaaatatggggttctcctcccctcctctcgattttctgtcacttttcttttggactttactgtcagtcacacattttcttctattttggagctgtatgttctgtctctaagaaatattttacttttaacgtactttattttagaaagttgctgatgtaatatacctatgcttaaaagcatcatctagataatctgcaatgtgttctcccccctttttttttaagaaaatttcatgttttgcataagtcttattgccaatctctctcacttctcaatctgttaaattggcactttcagatatatgcagttatttcatactattcccttgaacaatagcttatttcttcaatttatatttttaatgtgaatgacttatatttcagtaatatatacttctgaaaatttctgattctttttagaattggtatttcatcaccacattattctcacatacttgaatgttatctgtaaatatcagtgtaaggataccagcgctacaaatggaaccctaaaggctcattgtatatcaatatctctcagtcacatcattccattgtagctccagagctcagagccctgcttggcacatactagttgttcaggaaatatttctgagtgaatgaatgaattaatgaattatagaggtgtagtaatctcatagctgttagcatatagtctattaagtccaaaccagtcaaactgaatgaatccttcactccggcaagcaaagtagccaatagttgttggaccaatgcttttgttgatcatgctattgaacagaattctcatatgggtgctgataataagtgcctcttacctgtcaggcattaagcaaggcacttgattttttttaacatttattttacagataagaaatatgaaggccagacatgtttcataatttatccatggcagagcccagattcaagtacagaaaagttttaactcctaagttatactctttccagtatgccagctacctctgatattatctcttctttgtgaaattctttgagattattcgatctctacttttaggtttataattgtcaatccagaccttatttatttcctttaacttcgtggacatggttaatgcagatcattcacagataaagactgcaagtatactaagcttaaatatgcattaaagaaaaatagagtggttatctttattatccactggacatttcacatttattaatttgctaatgtttactgataatgtaccaggaaatgtatatgacattttttagacttctaaacatgcagtaatgcagactggatgagcaggaggccactgttgtttcccagtcccaggactaggccacatttcctgctagaagagtactattttcagtggtacccattccattcagtgtacagataactttaggaaagggatttgccttcttaataaaagactgaaagtttgagaagaaagttttaggatgagcgaagatttactatgatacagggaaaggacgtatgttttttaaaaattggggaagtgggctctcatgtaaatgatctaaaccatcttgtcttaagtttctagtagaggcctaaattaacaaaattgtgttgtgaaaagcatagggcatttggcgttagcatttttgaaagcagttatgtaagatcagtttctcattatagttatttaagcagagacttttttgtattgaaaagaagccattggagagagagtatgatgtctcctttcagtttttgcagcagctcccttatcttgcgttaccaatagcaaatttcagtgagaacaggagtaactaagtatttaaactagtacttaattataatacaggtaaatacttctccagatagagaaagcctgcgcagaatgctgtttggaaataggaacacagctagtcagtggtcttggtgagaagctgcctgctctgtaaatgagccgaagtcataacaaagataggtggaagtaaaggtcctcagtgatatctcttcttaggagtacgtctgcactgatgcttccaaatgcagacataggaaacagtggactaagtgattggtcaaatgcctccagattcgtccactgaaaaataatttgtttgctatagaaattggtccccacagtttttcctcctttttgtcttcctctctgctcatagctcacactgtcttcttagctgttctgctgtgtttattgctttacctgattaatagacatggcaaaacaggctttaaagataaattggtgaaaccttgtccctacaaaaaatacaaaacttagtcaggtgtggtgacacagtgtctgtgattccagctactcaggaggctgaggtgggaggatcgtttgagcctaggaggtcgaagctgcaatgagccgagattgcgctactgcactccagccgagatcgcgccactgcactccaccagagcaagaccctctctcaaaaaaataaaataaaataaagataaattggcattcaacaaatggtgctggaaaaattggtgctagaagagttggatatctatatccaaaaaaaaggaaggggaaggtttcagtccttacatcacaccatataaaaaaattaactcaaaatagatcatggacctaagtttgaaacctgaaactatcaaacatctaaaagaaacatataggaggaaatctttgtgactttatgttagcaaagatgttttagatatgacaacaaaagcacaacctataaaagaaaacattgatacactggactttattaaaacttagcttgtttgaacactactgtaagaaaattaaaagacaagccacaggctgagaaaaaatatttcaaaacacatctaataaaggactaggatctaaaatatataaagagcactcaaaaatcaataaaaataaaacaatatttagataattaatttttttaaaggaggggcaaaagaatcttcagcgaagaagatatgtagatggcaaataaacacatgaaaagatgcctcatatcaaaaattaatccacaaattaaaattaatcaaattgaaaccacagtaagctaccattacacattagaatgactttaaaaattaaaagggggaaaaaaaaaaaaacctctgacatcccaagccctggtagagatgcacaatagctgaaattcacatatcctgctggtacaaaacagtttggttgtttcttataaacacacaccaaccatataacccagcaaccctgcttcttggttttagccccccaaaaatgaaaacttatacaagtacatcaatgtttataatggctttatttgctttcatcaaaagctggaaactacccaaatatttctcacctggtaaagggataaacaaactaaaataaactatagtaactccatattatgaagtactagttagccataaaaaagaaccaagcactgatacatgtaacaaaatcactttcttgctgtcacttggatgatgccaaaacatttttaacggctttattaaaatataagttatatatcataaaattcacttgttttcagtgtacaatttaatgatttttagtaaattttaacagttatatgaccatcaccacagtctaatcttagaatattttcaccaccccagaaagattccctgcccacctccagcccaaggcaactgctaatcaactttttatctccaaaggtttgccttttctgtgtatttcatataaaaggaattatacaatatgtggtctttgagtttgacttctttgagtagtttttgagattcacccatgttgtagcatgtattggtactttgcccaactttttacataatactaccacattgtgtggaatatcacattttgttcacccattcatcagttgatgaacatttgatttgtttctactttttggcaattttgagtaatgctgctatgaacagtcatatacaaatttctatgtgaacatacatttttatttatttggggtatagacctaggagtagaattgctgggtcatatggtaaatttatgtttaacttcttaagaaactgcccagctgtttctcaaaatgaccttgcattccccagcaatgtatgacagttccagttcctccatagcctcactcccacttgttattacctgttttttttttttattacagccattctagtgaatgtgaggtaatatctcattacaatatttttttttcttttttttttgagacagagtctcgctctgtcgcccaggctggagtgcagtggcaccatctcggctcactacaagctctgcctcctgggttcacgccattctcctgccacagcctcctgagtagctgggactacaggcgctcgccaccacgcccggctaattttttgtatttttagtagagatggggtttcaccgtgttagccagagtggtctcgatctcctgacctcatgatctgcccacgttgacctcccaaagtgctgggattacaggcgtgagccacggcgcctggcctacaattttaatatatattccctagtgactaatgatattgagcatctcttcatgtatttattgaatgctaaaacatttttagatttattttaataaaacatttagtgattcattatagacacagaatttgtgttcttcatagtcaaagaagtttgtatgcccccagaattaataattttattactgatgtgcctaaatgaaatagaaaagccagtcttgcttttaaagacaaatcccctagacagtgttataccccaaattttttgaatgtaggaaaagctaataattattgttgatgagaaacctttaaataattaatgttggtataagctaaacaagcaagacctacctatatctgcagaaaatgctacattcaactagtgtgttgggtggtaatgcaatccaactaaataaactttccagataaatgaattttctagattttcctaagtgagaactttttagaagcattatggttatctgttaagttttattttatttttaattgacaattaataattgtttatatttatggggtatactgtgatcttttgatatatgtatacaagtcagaatagttagcatatccatcacctcaaatatttatcattgctttgtggtaagaacatttaaaatatattttaaaaatatatatatttacatatatatataaataattaactacagtcactttgctgtgcaatagaacaccagagtttattcctcctaactgtaactgcaccattgaccaacatttcccctttccctatccatatctcccatcagcctctggtaaccaccattctactcactacttctatgagtttgacttttttagattccatacataagtgagatcatacattatttgtatctctgtgcctggcctattttatttaacataatatcctccaggttcatccatgttgccacaaatgacagaatttcctgttatttcttaaagctgaatatcatttcattgtttatatataccatatttttaaaatccattcattcgttggtagacacttaggttgcttccatatcctggctattatgaataatgctgcagggaacatgagaatgcaaatatccctttagcatactgatttcagttactttgggtaaatacctagtgggatggctggattatatggtaattctatttttagttgtttttgtttgtttgtttgtttgtttgtttgttttgagacagtgtctcactcttgcccagactgaagtgcagtggtgcaatcagtgaccactgcagccttgaactcccgggctcaagtgatcctcccacctcagcctcccaagtagctgggagcacaggtgcatgccaccacacccagctaatttttaaatttgttatagagatggaagagtcttgaactcttgggctcaagtaatcctcccacctcagcctcccaaaatgctgggattacaggcatgagccaccaagccaggcctatttttagttttttgaggaatctccaaattgttttccaaaatggctttactaatttatgccactactaacagcgtagttgttccccttttctccacatctttgccaacacttatctttcatcttttttataatagccaatctaacaggtataaggttatatctcactgtggctttaacttgcatttttctgatgattagagatgttgaacattttctcatatgtccattggccatttgtatgtcttcttttgagaaatatttatttaaattctttgcccatttttaataggattatttgtttccttgttgagtagtttcggttccttgtattatggttatctttctaaaatttattactactttgttccctgcccttttatacaaggaatgatacttcattttttacttaaaaaagtcaagtttatcatcctgagtacccattgttattccatgaagtgatataattccatatctattattttctactttcttcttcaggttgtcagctatcagtacagttccctttaatagccctcagccataccaatgaaaattggttgtttacaatctcttctagactacaaaaccagataattcattgtatcaagcccttattataaggcttaagaatcagtcaagtgctcagtgaggccgtagaggaaatgtgaattttgtagctctgatagggagtgactttagcctctacctcaagtttcactggccactgctgatttggaagttgtgtatcaacagatgaagtgacaaaaccatccttagtaaattaatgtaactacaggcagcaccaggttaacacttcttcttacatgcaaacagctatctggctggcctaaggcattcttctcccctagtatagctgcttgcatttgtttctcctctttcctcattccaagacttaactgctgacaactgctgcaaatcagaatggataccctaatcttagccaccttaccccataccctagtgatagtcctgagtcatcctgatatgaaggttgaccaggatatcataatggcaatgatagtgcttgtaggacatgccatttgagtgtgtattctgtgccagatactgtgctagaacttcaggtgcatcattgttttaatccttaaaaaatcactttcagaggccaaggcagatcgatcgcttgagaccaggagttcaaggaccagcctgggcaacatgttgaaaccccatctctactaaaaatacaaaaaaaaaaaaaacaaaaaaaaattaacaaggcatggtggtacatagtcccagttactcgggaggctgagtgagagaatcacttgagcccaggtggacagtgaggcaacatcacaccattgcactccagcctaggtgacagaataagaccctgtctcaaaaaaaaaaaaaaaaaaaattagctgaggagttattgacctgaaacccattgaggtaaaaatatattttttttgagacagagtcttactctgttgccctggctggagtgcagtggcacgatctcagctcactgcaacctccgcctcctgggttcaagtgattctcctgcctcacccttccgagtagctgggattataggcatgcaccaccacgcccggctaattttttgtatttttaatagagacagggtctcaccatgttggccagcctggtcttgaactcctgacctcaggtgatccgcctgcctcagcctccaaaagtgctgggattacaggcctgagccaccatgctcggccccattgaggtaaatttacatgccaaataccaccaccttatcaaggtgtcagtgttcttattcacagtctccaggataggtaagtggtggtggcaggcaagaggagccgtggaggagaggagaaaggagaagagaaggaaatccgaagccagctccgtagggtgagcagaagatgggaagagatgagaattcagcatggtccagccccagcagcttttagggcctgactgtctatggtccctgtttctatatcttttaccctccacccttacccgtaaggcttcctttcactgccaggaaaccctgaacttacagctgaggaagtgccagctctctctgcccatctggtatgagaggaagtgtgtcctccttcaattctacaaatggaagaaatgatattcatttacattctaagctttgtagtcatgggattttagaactggaatacacctttatttgaatgaggagtctgaggcctaggaaggcaaagtggttcatggaaactctgaacccaagtgcttttctaactaaccatgcttggtgtcacaagttggaactctgaatgtagtgtccccttgttccgtcttaaagtctgtaaaattccacctgtattttgaattaaatttaatttatagattgacctgcgaacaaaaccatagtagaataatactgtttctactgcaatatatattccaatcaccaaattataaagaaactttggaatatcctgtttgttatttgcaaactgtctgtatctgtgcttagatggcctccaaacacctaattgtgacccagacttaaaattcagttttcctcagtgacactctggtctgtctcagtacacatgtgatcaatacacaggttttcttttaaaaagtctctttaaaaaacctgattctcaccagatggtttcatgacatttgggttttagagaattaacagattattcattgaaaggaatagcctgaaaaattgtataatactataaagacaatttaaactctgaagtaggttttccctcttactgtaagagagaataaaacacatgaatacaaattctgagtaacaatttttaaaatttataattgctcagagtacttatattgcacataaattaaatataacaaataatttactcctgatactaatatgaccagtttaagaactgacttctgtttatatatacttcttacctgttataacttgtctttttaacatctaaagtgctgataagcagactttattcaaagtgtgcttctttaaaataagcctcacggtgtagcatccctgtaaatacatattaatccagccagctgtgtgcaatgcactaggaactgtaaggattcatatgtaattcagtgaagccactgttcctcaaatatttactctcgcagattcagaagaattaagttttacaactaatatatgaaggatacatattgtgcatctctggaaatataaaacattctcagaaatgaatagtccattttaattgtaagtagtaagttccaacttgtgttcatgaaggaatgagagaagcaaggcactgcagtttccctatgttctaaaccaaattcctgttatttcatcataggaattaatggatctggtaagacttgtgaactgaaactttattccatggagcgaaaggctttatacaaaattctgcatattcaggataattaaactgccccagtctgtgttctctgcatcacctggaagcagtgccgggtgaaatggatcacgtgtaggagtgcctcacttgaaaagtgcttattgtttctgtgttgtgcttctgggttttccttgaaggaagcctacggaatagaaagggaaagctaccttgtgtgtcaacaaaaagctgtatccataacagctatagcagccattcttagttgcttcagaattagagctaaaggaaaagcccacactgctgcctctgagaactgtcttaagcatcaacgctacgcaaagacatctcgtgaaatgtggctgcatgattctgcagctgctcgtctctcagtgtctcctgtgctgcttcaacttgaagttttccttcatagcacctttttcatagtttctgttgctccaactcctggtcggttttctcatcctactactaggaaatgatcatactgatctcttgcagaaataatgtcagatatctgtgttaaaactaaaaagtttaaccagttatctacatatgttcatacttgctgaaggaatgtttatttggtgagtatttatgtaatatacaaagtctaggcactcatataaaatatcaagtatttaaattttccataaattccttgaatataggctgtattttttatgttgttttgtaactttaaaagtttctaactttatattggctgggtaattcatacaggatttagttcttatgaaatagctttagagaaaatgtgctctagtatatttataattttgactaggattatcttcagttatttgaaagagttctttgtaatgagcctaaagtataaaatgaaaatgtcatatattccaaagagatgacattcacagtggtaaaaaacctccatttctttgtatggattagtattctgtacctatgagtattccctccttctttcaaactgtcattaagaaattcaaggcaaagatgacaaaatattataaaaagtgatatcattgatgattaaatgcccagctttattactgcatgccagcaattgaacagcaggtatttgatgcatttgtagcagactttacatgtctacaacctaatttcattttttatttttttaaaaaatgaagcagtactttgttgtttaagttatggacaataacatgtatgtaattggttagaattgtttgttttgtaaatacagtgccaagagttatgtttcgctgtgaaatacaaagtttactctcactagaaaacctggaaaagcgatacagacacatttagtagacatttcaatgcattctaaggtcattaagtttatacgtcaagaattggtttaatttatccacatgaagctaggcttattagactgacttactcatgaaacattaataaagcattgtgtttagttctaacctgattataatctgaccttctgacaaaggacagaaatagaaagtatctgataacattaccctaatgctgggttcatccatcataatctacccttttaaaaatttgttttagaaaaaggccctttcacggatgtgcattgataatctcatctcgccctcagcccagcagattcctggtgctgctgggccaagtacaggctgtctgcagtcagcagagcatgcacagcaactgaggcaggggaagccaagctccagtgtggctctgctcatattgtattataacctttacagaatgtccgtatttcaaagaaaatgtttcctttttaagctgggttttttttttaagtagattataccccaaatgcaaatgtaaaaatttgcatttggggtataatctacttttaaaaaccccagcttaaaaaagaattttaagcaaataacataagaatttttggaagtcttatgtaggaattcaaaatatcaagatagacatcttgtgtttgagtgccatctctggaacacctgttagccatgtgttgtgctgaacccctattaacttcaacagggatggcaccaggttctagaggccaaagaagagacccagagccagtgagcatgacatagagttttactggggacttacctatcggggaaagtccagtggtagcaggctggacaggagacccatatggctcagtggcagcagactggacagcagaactgcaaccgcttgcaaaaaacctgctgtttatatcacatttttatttaacactcccccacccaaccacaacatcctgtatctggcaaccttcatttaacccaaaacaaagggccttgattcccattatggcctgagttccaagagatgggccagagggggctcagatattcttcacagataaggaatggatctccaggttggccaccccaattccctagcttgagactctcaactgcattcaggtgtgtctgccatacagggtctttctcaaggtttgttcaagtcatcactgtcaggtgcagcttaccgcacaccatgacacttggaagtaagacaccctatctcttggaactgcagtgtcctccttatttctcaaattgaggacttgttcattccataagtctttactgagagctagttatgagcaaagcattatggaaaatacaaagaatggccatggatcctactctaagtgaagttagagtagagaaattccttcgttcattccgtaattatgaaggggctatcatgcacttcatcctgctctgggctctgggaacacaaggatgagcaactcagtgagtggcttcagaaggtgcactctagttagggacacagacaaataaacaaacagtcccagtaaacactgatagtgtttattcaacagatacctgttgagtgttccgggtgatgttttatgtgtttgcaaggatccctgccgtcctggagctcacttttgatcaaagggagacaggcgatagacaattttttaaaagtgaaatatctagtatcttagaaggtgaccggtggtagaaaataccactgcaagaaaaggagactgtgagtacctgcaggggagagaggtcaggacagcctccctatgaagggagattagaggtaggcctggaggagcagagggagggagccaagtgactctcttggggaaagagcatggtgggcaaagggaacattagagcaaaggccttatggcagggatgtggttggcaaggaggccagtgggccaggaaagggtgggcaagtgggcacacagtaggacaagaggactgagtagtagtgggggagcatcacacagggtcttgaaggccatcataagtactttgcctttttaccctgagtaaaatgtaaagtccttgcaatcttttgagtggaagtgtgactgatcttccttatgttttgaagggatcactctggctgcagtgttgggaatgaatgattctgcaagggtagaatcagggagatctgctagaaggtaatttgagagatgatggtggcttggaccaggggtagcagtaaaagtagtaagaaattattgattctgggtgtattttaaaatttgagcctatagtctccctgggacttcctaccagtggccattttccctcaggtatctctagtcttacagaggcaggtgaagggctggggatgagcatgcggagtagtgatggctacagcagcagagatagataaatccatcttagcagaacattttagagagttcagctaaaatgaaagcgtgggtgtttagtgcctgttgtcaacttggccctttagcagaaattctaagcagcggaaaaagccagagtcaacatgtttatcctccgctagactgtaatctttttcaggacatcgaatgcttattcatctatgtgtcctctaaggctaatgtctgacatatggttggtggtcagtaatctggggcaggagagatattagactatattcaccttgtttatttgcatttcagtgggatctgctcccaaagatcagaggttttgtcttgtttgtcacagcatcccagggcctagaacactgcctggcacataacaggtgctccatgttgaatgaatgaatgctccctctgtttgaaatgcccttctcccagatgtctttatagttcatttcttcactggggtccttaattgtcacaaactcagagaagccttccctgacctcctcccctaaactagcaatcctcccccactacacatacaccctactccccatcctgcttttctgtttccttcgcacttgtcacctgctgacacaccctgtatcttactaattatgttagtttttgttggtctcctcccagtacaatgtaaactctcttgcagggactttgggtttttttgttcactgctataatcttacaatctagaagagggtctgtcacaaagcagatggccaatcaatatttgctgagtgaatgaatgagcttcttccccagccccgccctcattactgacatttcctttattccttcctcttgtgatcatcacatcttttccactgctttaattaataaacctataaatatttattaaacagttattatccaatgataggttaagagttgtgggaaatgcaagataagaattagataaagtccctatcttcaaaaggcttacattctaattgaggatatagtattaactttggaaacaatgaagtgctaattggcaatcatcccattcatttgtacagtacctcacagtttgttgtaaaatgatttcacaagtaaatttgcatgtgttatcttactctattaagtaacaagaggatactgatgaaaagtgttgggtagaaattcatagaaaaaaacaagtgagagctgagaacacaggaagcaaacactgaacttgagtaagaaggatgagtaggtcttcaaaaagcaggaagacaatgctttcaagctagagagaaagaaagcaaaagctctgaggtcataccagctgctgtgtgcccaagggctgtgaagtgtctgtgctggggaagctaaggatttatatcaggaagtcctgagaaacagtggggaaaggtgggatggaggtttgaaaggcctgagtcacataggttatgctgggaggagcagtggcagctttgaaaaagagaatggcaatgtggacatgatggcttgacaagtctgtcccacaagcaggacaccagacagactggattcagaagaagtttgaagtatgttgtagtaacccatgtggagagctgtgagggttagaaataatcttctgtcttatacatccagaaacagtcaagtactggaataatttaagccccttaaaataaacatcaaagacaactatattgtctctacttaaaacagttgaattattgaagttgtaatagctacaacttcagtcaaattatgaaaagaagatggcatagacactacagaagtgacaatatggctttctgattatctacttgaatatatgcaactctatttagagaattttttaatctcaaaagcagatttttgacgtaatgagaaaaagggatgggaaatatttttgctctgatctagaagaagacatgggtatttaatattcttaaattttaaaattcaggagaaatattgtctcctcacagttaaatttggtagtctactttcttttttttcataaatttcggagaagctttaccccaaacctgctagagaaagaattctgtaccatccaatactcatgggagaaaatagaaattagaatgagggaaatattatccatctaagagatatcctctctagtttaaatatcactctttatttccttctttccagatccccagggtagagctctggattgggaattggtttatctaggcttaacgcaattgcttctgcctttagatatgcaagtagagggtaaagaaagctattaagaccattatgacactaatagcttagtaatcaagtatttctttacatttttccaatgtaagtattgtactaaaaatcccgtttcaaagtgccaaataggtttgtatataaaaatggttctgaaaagaacaaaataaacagataccaatgaccggtcaatactgtttatagtaaagagtcttaatgtcaggcttcagctttagacaagttgttatattttaattattgatagctaatgttccattcttagatattcatttaattttgaactagatttagcttttaaatgtgtaaactgtatcttcttttctttctgcacagtaagtggcaagataaaaaatcgacaagactttgtttaacctcttacctcattgttcctttgccatttaattttataataaaaaagacaaaattatttaactataattaattatttattgattcactatgctgcctctctaagatatagaatagggtaaataactatagacataaatattttttaatttaattaaagactattatgagcatctatgagctaataaatcttaaaactgagatgaaatggatgaatactgagaaaaatatttaaaatgtcaaaattgagacttacaaggcttatggaaatttaaatggtaaaatcttcccatcccctcctcaaaattcaaggcccatattacattacacgtaaattctaccaaattttcaacagataatgaattcattttcttatacaaattgttccaggaaacatggaaagctatccagctaattttatgaggctagaattccaaaaacagtgaaggggaggaaaaagaaataaggcttatttcatgtacggctataaatataaaaattctaaatgaattcttatcaatgttattaaatgtgtgtgtatatgcctgtgtgtgtgtgggtgtgtgtgtgtgtgtgtgtgtgtgagaattgcatcaggactaagtagagtttaacccttaagatcaggaaaaagatagggattttccacatcaccactgctgttttacatagttcttaaggctaagaacaattctataagaaaacaaaaagttgtaggtgtaactactaagagtggctacaaacacaatcaacttctagaaatcagtatcattgttctacatcattaataaccaagtataaaatatagtttcaaagtattacagttgcatcaaaatttatgaagtatctgggaataaacttaaccaagaacactaagataaaacttttatggagaaaattttattttttaactctaataaaggacatagaaaatgatctgtataaatcaagatatttggggaccttggatagtaaaacctagtgtcagtgttcacaaattaatgtataaattgattggcattccaatcaaattcttttgatatatctatgcacttaatgtaaaagttacaaagaagaataaatgttcctgaatagcctagtttatcctgaaaaaaagaataaattctagcacatattgagatatgtaagaaataagataattaagataaggtaataatagaaatgaaaaatatagaaagctggacacacatacgttgacatgataggtacatagaagagagagcaaaagaatataaagataaaataaattaagataataatagaaatgaaaaatatagaaagctgggcacacacatatctagacatgataaatacataggagagagagcaaaagaaaaggaggaaggagactgggcttctatgtagattatgatattatctgtaaataacggcagctttatgtcttcgtttcaaatatatatttacacagtaaagataataccatacatctctgagaaaaggaatttttgtttaatagatggtattggaaaaactcactcactttataaacaaaaataagactggacccatatctaatatcatatatgaatgaaagtagatgtagattaattaaagatcaaaatatgaaaagtaaaaccataaatataaagctaaatgatacaaatatatttatctctataattcaagacaaaacctcaaagcataaacatttttaaaacatgatttgatgatctcaaaattaagaaaatatatccaacaaagaacatggataaagttaatagatatatgacatttgggagaatgcatttgcagtgtttcaaaccaacaaggaactcttatctaaaatatataaatcaggccaggtgcagttgctcacatttgtaattccagcactttgggaggccgaggcaggcggatcacgtgagctcaggagtttgagaccagcctgggcaacatggcgaaaccctgtccctgcaatacaaaaatacaaaaattagccaggcacggtggcgcatgtctgtagtcccacccagctactcgggaggctgagatggaaggatcactggagcccaggagacggaggttgtagtgagctgagatcgcaacactgcactccaccctgggccatagagtgagatcctgtctaaaaaataataataataaaattaaatatataaatcaacaatataaagacaagaacctccagtgtttaaatgggtaagggatatgaacaggaaatttacagaagaggaaacccaaaagaccaacaagcatattaaaaagatgtcaaatctgttagtaatttgaggaatacaaattaaaacaatgagatattattttgtatctcttatactggccaaaattagaaacctggataatactaacagttgatggagataaggacgtatagaaactgtcatgcattgctagagagtgggcacggatgactcacattaagtatgcactcccagttctactccagattataaatcccaaagaaattctcagaaagatccaaaaggggcatttatcacaggcttgtgtcatggggattagaggtagcctggtgtttgttaccaggggagttttgtgcagccatgagaagcaatgggctagtcacacagtgacacaggtagatttttaaaataatactaagtgagaaaagtaaggaacaaaatgaaatttttaaccctatatatttttatagttcaaaagtatatccacaaaagaatgagtaatattttataagggcacatgcaaacaaaaggagaaacattaaatacattatagttattgcccatggtggtggaaggaaatgaaaataggagatggagataaaagagaaaaaacacattttaaaagctcaaattattgaaaagtcatcattcccactaccactcatgattccattaggtattttattcaataatggttttactctaatagagataatagtaaatttcatcaaacctttctttagtggtatctataagatatatttgtaatgaatgcgcttagctgatcatgttggtaaaatcttcctttaaattatttatctgattccataactaaattgaattcctgtgaatagacttgagcagtagttactcaataatgaacctctatttactcattttttaaatcccttcatttattgcatcagacactgaaaatattactaaataattagactgacattttttcttaattgaatagttatagagaattgacaaaatcatttatacaaattgaccaaactaatatagacataatacagaattttaaccatctcttctttcagactcatttcctgtgttctactctgaactgttatttcaagatcgatgagatagacaatatagaaattctgtttgcctttagtatggaaactgttctttcataaaatgtcattgtttacattgctgaatgagaaacatccacactaattggtgtagatgaaatacaaaaaattttgaaaggaataaatcaggaaagggattgaagggaataaattactagttaaatgtgatcacaggaaaagttgaaaagtattatttataatattttatatacttaaaaaatgaaaagcagtttttggcaatcttaattcaagaaatcatttattcattaagtgaattccaaattggtttcaacaccatggaaatcacagagaatgactttgttcacatatttagtgaccgccgtaatttagaaaattgtcttacatggctctgcaatagctgaaatttacaaagctagatgtacagctcttttccatgttgttgaaatcagtgtcctctttaaatcactaggaagttgatgataaatgactgcagtaagtgagaggcgtagtgagccatgcaccatcactacttatttcacggacctgagcaagactccctacctacctgtcaagacacctctaggaagcttctgatggcttcttaggaaataaaaaggccttttttttttcttttttctgtttatggaaacttagtatgggccttgactctcagtaatttatatttctttcccattagctagcaaacatccaaaattgcccagtgattcccaaactgtgtaatagctgagttaattcatagtggaagaaagatattcccttctagtcatctcagaggtaagctggaggacttcaggcaggaaaataaatgtatatcagagtttctcataaaattgcttaatttcaaactaatatttaaaaatgagaaatgaaactgtaacatggtattaaaaaaggtaatttaaattatttttcttttaaacatgagtgtgttttaataagaaatttatttatgttaaatcatattatgtacctaatggagccaagagaaagtttagcattttagaaagggaaaattttcatttaggtctctgtactttcatttaggtgtctgtaaaatactactgaggtagtatttttccatttctaggaactgaagatctgatacatataaatcaagtacagaaatttaaagagcatattctcctttttatatatatttcaaagtaaaaaaaaaataaaaggatatgaaggtgtactaagttttgatggtctctcatttctttcttgactcatttcaggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggtaggtgttaaatcccatattattccaaaaatttctgtcatctctcaaacacaaatttgacatttcatctctttctgtataattttgttttcaacataacttcttacaaaacagatttcaggttcttgacatatgtggaaaaattgaaaagtcccaaaacaagtaatgcaaccagtatgtggttcctttttaaatttcagacactttaaatatacttctatatctgtatatttgtttttcttacttcaaaatttacattaaaatatgtaatgctttacgtattttagtaataagtgaaacctagctgaatatttaaataggaatattccacattaacataatctgccactgtggctattcttaaaaataacagcacaagtgctaggattacaggttcagtggctcttgcctgtaattccagcactttgggaggccaaggtgagtgaatggcttgagcccaggagttcgagaccagcctggccaatatgctgaaaccccatctctacaaaaaatacaaaaattagcagggtgtggtggcgcagctgtgtggtcccagctactgtgggggctgaggtgagaagatcacttgaacccaggaggcagaggttgccatgagccaagattgcaccactgcactccagcctgggtgacagagcgagaccctatctcaaaaaaataataaatataaataaaaggaatatttctaccttttagacagaatactcaaaaacatgcatgaatgaaatagatgcagttatgctattttattcttatgtgttttcaatctgaaatgtttatagctaacagttgggaattatgtgctgtagtatgtatatagtatttttagtgaaaatattcatataaaatattacttaaatcatttctacattgcacaaaatgatttcagataagtggaaagagtgaagatgcaacagctgctacataagtgttgcttcaaggaagtgatatcccagtcttccattctaccagatatctgccatctgtcgtatgcaaaacaagtaatcatttctgcatctccagccagtggaatgcttttcttattttttattttaaaggtggaaaacttggagatgggcgcaatgaagctctacagaaaaatttgcattcataagtttatttcttatatacctctataaaattaaaatgactccatttgtatggttcaagcaaagaagaggaaaaggaagggaagagcctcataatcattgatccttggacccttagggcaaaatattctgagaacacgttgcaagcgtattattaggggcaatattgtaccatattgtgtgcacacaagataaaattattgcctgaagccaagagaaaaacatagagacagaatgaatgaatgagagagaaggcaggtgttatgaaatggctggtgaaataaggaattttctctacaaatcattacactcacccaactgagtatccccagttgtgtataaattgtaatcagattatttggtaggagataattctgagcttaattagtctcaactgtacacccttgcttattacatgcctgttttattaaatactttataaactattcttttaaggctaataccttttagaatcagaaaaaaagaaaacagttgtaatagttcatccttatattctaagatcaactgaattgtcttttgacttctaaatgtcataggcatttttgcttttggatattttgttatacatttttacccattataataaagtcctgttcttataaagaaagttgcaagttaatcctgttgggcaaaacaaattaaatacattaaacacaaaataaaataaattaaataaattaaatacaaaataaaatacattaagcatcttatatgtgatgaaagtgcaaggcagcattaaaattgacagaaaaatagcaggtttgtccaatttaaatgagggtttaaaaagagataactgaaagaatttgaaaatgaaattaaaatggaaattttctttacatggatacagtgttcattatttgaatcttatcaaaatacctgtttctacaaaataacatcattgctttggacagtgaaagaattgtgtataaggctttgttaatgtagaacttcttaatgaaacattacatagaaatgtaaaatttaaaatgtaaaaattaaaaattaaaaattgtcttctgttgaatgggaatgattcaagcatatgttggcatattatatagatggtctgaacaatatcttgtattacagcttcatgaccttctagtgatgcagactctctgctactagggtgcctcagctcaggactctgtctcctttcagcatgctcattcgaagcacataattgccagacactcaggtttcattagagagacccagagtcatactgtgaaatgttatgttctttctccccagaccccttgcccacttcctcaaccctataattctgtgtcagttcttagaacacgatacatgtgaaggagcgcatacctggaatactcttacttcccttcccccagcccccagaggcctgagcacacatcagcagagaggtttaccatgaccctgtggacctgtgtggactcaagattgcttaggaagagcctctatctccttgtgaccactagggggccatttagtacagtgtagacataacagattaaatgatttcaaggaatgctagttaatttcccctttcccacttcccaccattcccccctctaacatattcccattgctgttaatgccagttagccaagtagaagctaacagattcccacaaagacagttctgcactaacatttaagaatgtgaggaatagtgtcctccaaaggacgagagcccacctgaatcctgtgagctgggtaagtgaggccgagtcattcaatctcactttacctcagttgctctctctgtaaatacatctattgttataagaaagaacccagataaaatggagtgaagtacagcatattcattatttagtggtcatttatgcacccttacctatatacaacccctatgagtagaccatgtgggaggcacaatacctttttttaaaacattcttgttgagttcctggaggtcttgtactgctgtgttgcgacttgagagagttgattcccacctaagtggttggacacagactcttggaaaaagcagagtttaagatattaacccttttattgagctcaatacatttattttatttgataatgtttatcttagtatttttaaaatacaaagattgtacatttcatatagataaaaccaaaggaaggctaattatggctacactaaactccatctagcctaagatggattttttcatgcttaaattaaacactaatttaaaaagagaaatatttaatatatgaatatctatatatgtctcctttgtaaaaaaaaaaaaaaaaaaaaaaattctactacttgcctataactttgagttttgaagttagtgctaaagtttgagaaatggcttaaggttattgattcattctttcttgacaggtgaaatcatgaagcagcactaaccacagcaattatggcattaaaatgtcaagaaattagaggtcagaataacagataattttcttctctatgtcagattgaaaattgacattctttgacagtttaggaactctggctgagaaaattatgacagcttaacttattttatacttgtaaagcagtaattgataataaactttatcatgacagcctctgggcagaaacatgacagtacagttctggtacaaagctcttcttaatatgtaaacactagatctgttggatagtagatattatttaaattgtctaaagtcttggcttacatcgtaatcttctatgcactttttttcatagatgagctgtactatttgagcagtttttcaagcattataaagaatattttttcttatcggtttttatatattaataaaaagtatatgatctgatttatatttttacttactaaatgatgaccaagaaacttcatcctatgacctgcttaggaaagagaatattctggttggtaatcatttagtcccatggttttctaacaccttgatgctcaaatgtggcccataacccagcagaatcagcatcacctgggaacttgctagaacttcagcctctcagccttccccaacctactaaatacatgtaatgagatccctaggcaacttgtttgagacattaacttttaagaagcactgctctactaaaggtgtgttagaatcatttggaaagctttttttttttcccctacaaaagtacagagaatggtataatgaacctccatgtacctatcacccaatttcaaaaatttaaaaccatttcatcaaaacctcacccctccccttgtattttttttctttctttcagagacagtctcactctgtcaccaaggctgaagtgcagcggcttactgcaccccacctcccaggttcaagcaattctcccacctcagcctcccaagtaactgagattatagacacccacaaccgcacctggctaatttttgtatttttagtagagacagggtttcaccatgttggccaggatggtcttgaactcctgacctcaggtgatctgcctgcctcagcctacaaaagtgctgggattacaggcatgagccactgtgcacggcccccctgtactatttttaatacacatgtcatacccatctaactccccatccactctatcctccccatcacatgggcatctcagaatatccagggaaaggcttcaatgaagcaagtcttattttgaaaaaaaaaaaaaaaaattatctgggaatttcacacacattcccaattaaaaaccattaatctagctaacactctcattaaataattttttgtttgtttgttttgagacagagtctcgctctgtcgcccaggctgaagtgcagtggcgcaatctgggctcactgcaagctctgcctcccgggttcacgccattctcctgcctcagcctcccaagtagctgggactacaggcgcctgctgccacgcccggctaattttttgtatttttagtagagatggggtttcaccatgttagccaggatggtctcaatttcctgatcttgtgatccgcccacctcggccttccaaagtgctgggattacaggcgtgagccaccgcgcccggcctaaataattttttcagctgggcgtgatagctcacgcctgtaatccccacactttgggagaccgaggcgggtggatcactaggtcaggagttcaagacctgtctgcctcagagtatgattatattgtatgccataggcaacaaaaatggatagaaagatgggaatgatattataagttgtatcacagctcaaccattagtatttgagtgacattaagtcagtcacttgaattttatgtacctgtattttctcacctaaaaaattgatgacagagatgatacctaattcatgggagaaaaatatgtgaaaatacttaaactataaagcactacacaggcattattacctaaaggcataattaaatgaagttatcttagaagaacttttgttttaataatttcattatatatgacaccaaaactatcaatttaattttaaaaaatctgttagcaacagagaaaataagttaatttgtttttaatattatttagtaaaaagaagcagttgtggcttttaaatttattttcaatactgtctccaaaattttataaagatggcctaattgcagcccacttattgcctgtaacattctttcttgatctaaattagtattagcatttatatcctttattatcctttatatttttaaaagttttacattaggccaggcgctgtggctcatgcctgtaatcccagcactttggaaagccgaggcaggcagatcacgaggtcaggagattgagactatcctggctaacacggtgaaaccccatctctactaaaaatacaaaaaatagctgggcgtggtggcgggcacctgtagtcccagctactcgggaggctgaggcaggagaatggtgtgaacccgggaggcgcagcttgtagtgagccaagatcataccactgcactccagcctgggcgacagagtgagactatctgaaaaaaaagttttactttagtgtcattagttttgtattcatattatcaaatgaattagcaacactattactggcattaaagttgtactggttcagcaagagaaaaaaattgagtcagtatttcaacagaagctgtaagcatataccagacaagttattaacaagatactaagttctgaacttgtcataatacttgtcatcattctatagttgacgttgccagactgaaaatgatttcaatggcttctttttaacggtgagaggtatgcacataagtctatcataaaaggctgttttgctggcagctattagaacatgtgagccattgcaatatttatttatagatatacacatttatttatgctggaaatattaaaatattaagtagtttttaatattaccaacagtcataaaaatgtggcatttttagtctaattttctgttaatatttcttggctttcttagcttatagtttctttttctatctttttctcaatctgacagggataacactgcctccctttggatcggctatggtgaaaatatgcccataggaagtaggctagattacttcagtttttactttattttcttgctgaaatattccttgctactacagagaattgacatgatagggctgtcaagaaccagaagatagatgtgtctttaaccaaaacagctgcaatgctggcttttctgagaagatgaattcataaaatttataagacaaaaaattaacacactttttcatcctgatgatgtaaatgaagggtaatttaagggcccataatgacaacattgaggacctctacaatcattgtcttccttgaattctttctattattctttattctttctatgaatcctttattcctcagcctttcctccccccatttctgattctctttgatatgacaaggaatatcaacaccacctgcccgatctgcgtgaatgagttgtagcacaaggttatccatttacaactgccatgatgcctaattgtcttcatatgggggatatccagggttcttctcctgggcagttattctgagaagtgattgcaacaaatgatcacaaagtgggtgattaagatttcttaaaaccatcttaatttccccctataattactgcatgttttactgggatgaaaattttaacagattcaaaagccaaattaaaatggaaagaaaacccctacattttaattagtggagtgaaaatacgtatttggtgttctttaaagctaaaggatcattttgggaacatgaaaaataccatgattcctaaaactaataaggatataggttcaaatatatttgttatgtgtttctcactgcaaaggttttcattgagagccataaggcttgcattgcaaaggtttgatgaataaggttttaatatagaaattagtatcaaggaaattaatgacacacatttaattttgattagtgaataaatctttaatttaggtctatcttacctgctcataattactgcagtacttcactaggccatggtcatcaatcgtccactagaaaagcataaataatgcagctagtcaaagttggatgtatgtcatttatgtgacttgtgcttctttcttcgctttgtgttatttttattgtgtggtgttgagaagtgctaattattgattttcagaaattaacagcaagtactttcacaagcatctaaagccatattttactcaagggaagaagggtgaaaattgcagcctgctgtttataatagaaatagctggaagggatttccttatcttctattaacatagatttcacttctataacacagttgttacctcagcataaattaacaattattcaaaacatattgcatacttcaatttgttgaaatagatattactcaatctaagtacctagacatttcagttagatatttagaactcatttttaaacattttaaacatattgataatgagcctatttaaagccatttgaagtctcagtacagtatatctaaattactgttgcccatttatgtcaaaatcaagaatattttgttctgctgaatacgtccaataatactttattctcactttagtatactaaaagtatatgatttcaatttggaatatttataccagcacctggtaaacctgtgtctcaatgtcattccacataccaaacaaatctatttcagctttttaaaaaaatattttcccatgattaaacacttctagtgaacttataaaggccaccacttctctctcgttcctgctcctacaccaccacctccccctcaacttgttttcctcctccttcacctcctgaatcagccagcatagagtttagtttatataaacttattcaaccagggaaaatttggcagggatgtcatactgattgttctcacctgtggtaaaggatttgtggattgagtcctctacttaggtaccatttaatgattaaccccaaagtgggcaaagaaccagaaacctggaagaatccttaagcgatcatctgctaaaatcttcgcttccaggtaggcgaatccctaagtcatctagaaaagagtatttcagttctcttcctgagtatcaacaaatatttattgcaatgagactctacagcctttcctatctgcttacaatgtttatctctgaaatatttaaaatcctcagtgaaaatgccccttgcttggatataatctttttttggtcattcctaccccaacatgtagcaaaaggtaaccagcatttctctcatttgttgtgcctgaataacaatcctatttgtatcagtcaggatctcagcacattacctttcaaagcgataatgaagactccaaagaagacatacacatgaccaacaagtatgtgccagcatcattcatctttagggaaatgcaaatcaaagctgcagtgagataccacctcacacccattaggttagctactatcaaaatagaaaataacaagtgttagtgaggatgtagagaaactggaaactttgtgcaccattgataggaatataaaatgctaccactggcgtagctgctaggaaaaacaatatggcaatcgttcaaaaattaaaaatagaattccctatgacccagcaaattctacttccggatatatatccaaaagaattgagagaaagggcttcaaagagacatttgtatacctatgtccacaggagcacttttcacaatagtcaaaagtcgaggccaggcgcagtggctcacacctgtaatcccagcactttgggaggctgaggcaggcggatcacaaggtcagggatttgaaaccagcttggccaatatggtgaaactccgtctctactaaaaatacaaaaattagccgggcatggtggcaggcacctgtagtcccagctactcgggaggctgaggcaggagaatcacttgaacccgggaggcggaggttgcagtgagctgagattgcgccactgcactccagcctgggttacagagcaagactccatctcaaaaaagaaaaaaaaaaaaagttgaaagcaacccaagtgtccgtggatagatgaatggataaacaaaatgtggggtggtgtatgtgtgtgtaatgcattattagtcaaccttaaaaaggaaggaaattctgacacatgctacaacatggatgaaccttaaggacattaatactaagtgaaacaagccagtcacaaaaagacaaatcctgtatgattccacttctatgaggtatcttaacgagtcaaaatcatagagaaagaaagtggaatagtgacccccagggactagagggagtggcgagtttttgtttaataaatatagcgttttagttttagaagatgaaaagagttctggagattggttacacaatagtgtgaatgtacttaacactactgaactgtactcttaaaaatggttaagatggtaaattttgtgttatatatattctaccacaattaactttttttaaaggataatgaagagagtttaataatggttctatttacaaaggtatagacatggtaaagtggatgaacaagggaaagcgacaaggaaagggagccattcccagaatctggcaataaaagtgctcacccaacaagagctgtggccttaggtagaggagtactggccaggcactgccaaaacgggacttggcagagaggggccatataatcctgtctctgctcctgagctctgtcattggctgaacccactgggaaggtagagagcaagggagcacaggtctatggaggcgcatcttccagagccaaagaaggtgtccagctcactggtctgttccccctgggttgttcatttctctaggccaagaagacttatttaaggcttccaggcttgctcagccacaatcagctacattaaaatgcactcactcttcctacctgagttgacttatacttattttaagtggagaaattgagtgagcttgtcattgatggcactgatctgatttggacagaaaatattctggatggagcattttctctccggaggaaatgatgcttactttttcacattcatttgttaagtcagttatgtaatatcaccattataattcaacatgccaaggaggaaacagggatcagcaagaggataagtcacatcttaattctacttagatttacgctaaaagaaagaaaccaagaattaaggcaggtaactggacaaatcagaatctctctctcaaatattgtctaagtgcatctactaattaaggcaattgtggtccctttttactcggattaccaaatatttgcttaaatattctaataattttgccaggataattttagccttaatgcagttgaaggttaaaacaaaaggaaaaatatttattctcctattttgtggtttctatgaaaaactagaagcagttgaatataaaatagcattttaattttttatatagtttaatatttataaagcaagaaacaacaaagtgcagatattatttgcttgatttattttgctcctgtttttccagcattaaaaagtaatgctttatatgatcttgttttattacaacaataaaccagaagcaaaagcttatcagttaaaatgtagtctgccattaagtaacctttccttttatcatttcagacttaaaattccattgtttttgtttatttttttcctatttggcattggtagaattgcaggtggaacagaaagatgatatcaatcacatgtatttttttattttgtgtcaagcttgtattttttggtttaaaaaagagcacttttaagtattaaaagccttgtaagtaagagctatacagtgagataaacaaaatgctaaggaaactttgaaaatctttttctgttttctcaagcaaccacttttactacttttttcttgaattttctgaaaattgttagtgaatttactggtatttggacgtagtttgatattttgcattgtgggtaccataacctatagtactttataaaatgctgatttttctgaaaaacaatttaaaagtttatacagaccagggagatggatgaataggtcatttgagagcctgtattattagctccttcatgctgtttgtcatggctctgtagacctgacggcatttcatctgaaagataatactgaattacatttaccaaaaaaaaaaaaaaaaaaagcagttgtaatcattctatggagaaaaatgtaaatgggttaaatctacctgcaatgtggaaaagacaagattaacgaaagtttttgcctaccacacaccagagaaggtatggcttctgaattctggcttacttggttgccacatttaattttaccttagtaggaagtcttttatatgaataagcaaatgtgcaacacataagcacacattatatttatcgatttccttttctgaggattcaattccaggtatgtatctttattcatagaggaggtagaacttccttggaaggaaagccaaaaaggaaagaaaacaattaagagatacggaggtcaaagaaagaaggcatgtgtcacatcatagctaacacacatgcccctttgtgcacactttagaggacaccttctctaaatggatgaattacaaaaggcactcctttctctggctctccaggtagattctattacttatttgccttccaactgggcatctttgtacagggcataaacagcatacccatgcacggtggccctgacctatgagaaagaagaaagactcaagagaacttgttaagtaaggaaaaaggggactcccatgaagatgtcataatttcgtaacttagtaggtgggtcctgcagaattgtataaaggagagcctcatcagactaaggaatgggataatcaggaagtagggaggggacaaaagagaaagtgtccctaatcgaaacttttccttaatgggagctctatatacagataagcaggtaaaactgagttatgtgtcatatatgtgtttgtaacctgaaaatcatttatgctgttcagattttcttattttgttcatttgtgcataactcacttcacatttatctttacttctctgcctatacctacaaaattccatgttttagaacttcctcaaggtgttcaacctacctatttctcggtgagtcttagctggagagaaaaataaatgctaagtgcatgatgtcagttcaataaatattcagcaaacaattttataatcagtaagaatccatataacaattaaaatttaacactctttaacttaattttcatttctactttaacaattccaggtaaagaaataattattataattattttatgagacaattgagttttgatatatacaagttttattaataagttatcagtaccctaaaagattacataatgtaaatcattactttatttacagcttcgaccattacattttgggttcacaaatacttacagaaaataaatacacaaaaccattttggagaaacactttggcagtaaaactaaacttactcctaccctatgactcaccaatcccatatctaggtatagaccctccaaaaactggctgctaacctccatcaaaagacatgtacaagaatcttctaagcaactttattcacagtaacctgaaactgttaacaacccaaatatccatcaacagaattgataaattgtgttaggttaatacaggggaatactatacagcaaaagaaaaatgaacaaactaccgatacatacaacaaggttgaatcttgcagacataaagttgatcaaaaaaggcagaaacaggaaatatgtagtgtataactcaatttatcaaaaattcaagaataaaaaataattgatgataaacatcagaataattattagcttgacagggtgatggggctagatagggggaataattggctggggaggcacacaaggttaccagtatctatgtattctctcatgtacccaccacccagaccaagatatggaaccttctagttccattccaaagtcctctgtcttaatgtagatggtggttagaagaactgaaaaaatgtatatacatacatatatacattcatcaagctgtacacttaagattagtgtaccttatacacttttatcttaaaccttaaaaaatgagtaatttgaataaataaataaaagtgaatgcacataataagcttaacttcaggataccaaaatcagtgatttcttaataacattaagaaagaatattatttaagtacaagcaaatctatattttcatgttattctaccaaagtgttgtctaccaatggctgcatggtcttttgtatttgtgaaacatcaaacgttttgttagccacatttgttttaaaaaatctagtggtttaagcctattacctatgctggctttgtatgaaatatgtaagactcatgataccactgtttaagtaaaaagtcactatgatttattgattctaagatgcacaccattttcatatctcaatactccaaaatcataatgtgtcttacaatcaatcaatcatagcatattttaattgatagcatattttacttattaatagtatataaaataatggagcttctaataatggataacatagatttaatgaagttggattgatggacatttccaaagttttagtctctttccatatacattatacatgctcatgagctcacgtgttcaatgttaactcattttgggtttactggaaagtacaacagatacacaaagcaactgatatcttgtaatacaaattaaagttttcattattatattttaaaaggattcacaagccccaaagcatataagaaccagacagggaatagatgagtgacacaagccagtggcagtgcccaggtcatgtgagtggtgggcgttacaaaagggcagttgtgcaggaatgctgatgtggtattgcctgatctgcgaagtttttaagagaagccaaaaaatccaatttcttgtatgccatttactgacctgtaaattttggctcaaatagaaaccatgtctgtgagctgaatctagcccatgggatgccagtgtgtgactttgggctgaatgtaagctctttgagggcaggaatctttatctgtttcattttaccagtatcattaatatctagaatggaatctagtatgtagtaggtactcaacaaatacatgttttgtgaataaataaagttaacgttaaatctcactgacccttgcagaccaatgtatagagaaatagatacatgtagaatttttttaatgacatttctggataatatagaaggaattcatctcacagttccagtagtttctttttttttttaacttgatatatttggaaatttttaagggaaaatttctatatggtagaaaaccttttcatgctgtggacaagctaattcttacttaatcttcaaacctgagctctgtcctttttccaaaagtctctttcctaagaacctattccccttcccctctgtcactcgtctgggctcccagggcagcctgggcttgtctcccctgtgtcctgctccctaccatgtgcactgacacactcatcgtctttattttgggggctgctaacttcctgaggtcagcctggtatctgactttgtatcccttggcatagagtaagcattcaacaaatgtctgttaattgtttttgtggtattgaattgtaaaagtaaaaaattctgaagtgcttttctttttctagaccaggtttcagttttatacaaatgccctgcttctgtattcaccaaatatttttagaatctctgttaagactaagtcaccatcctgacctgcagagattcagtctgaacaaacagacatacataaataattgtgtgttaaaatctatagtaaaggagaaaaatgtgctgtgagaatatgcagggcattcattatgatttagaaggatttagatccttgcccaaggaggtgaaggatttagatccttgcccaaggttagcattcggggaggattttctcctacacagggagtagctctcagaacaactacttcattgtaacaattcatgggttgcagaatgagttctgcgtgtcaccaggcaaccctcccattcacaggacctgcacacttgacaagaaagtcattgatgacccccttaaagtgggaaaggacagaaaatcttacatggggagcaggtgaagaaagatagtaggtgctcactctcccctcaaacgttttagtaatgacaagaagtagaacttaaaggagacagcatgcttttcaagatcagaaagatctgtacatttttaaatcagagggtaaggaattactggaaggcaggactaccagatagctaaaaggtaaatattggactgagatcctttgggtcatgaaggcatgtaaagtagatcacaaggaagagggagtcagtatagtctcaaaagaaataaacgttcagtgtcgagaactgactgtcttaatgaaaggataaagttagtcacaatctcgtctttatcctgatgcctgattggggaactcttttaaatatatatgcatatgtattctgccttagtccaaaatggtcagagttgggactcactgaagagaactgcacagaagatttctagaaattttatccatttcataacattttctagtacaatgttaatactttcctttaagaaacaaaactagagtcaagcaaagcatgtttgttgactaattccttcaataaacatttaaaggctccctactaagtgcaagacactgatctagagattaaaacatgtttaattttacccccggctcctcgcccccacttgtgtcctttttctggggaagtaaaaacaggagtagtagtatctgttgttagagagacgtttagctgttcatgatacatgaagctaggtattaagcacttgctaaccagggcagcgttaacaataaaattaccacttttctttgcaaataattctcaagagttagttattaaaaatgtgaacctaaccagaaatggtctcttcccccttttataatcataaatcttgcactggggagacaaaagtaggatgtaaatgcatcatatgtgaataaaatttagttaaatagtcacacttgtgagtagacaccatgcaaataaatgtatacataaaaattggacagcacttaaagagatttaataattcatcccattgcctctgcagataaaagaaccaaagtcccatttacgcgatggctaaaatatggcagataatgatgcattcatatttaatattgctaataaatttgcaggttcgcatttttattgataaacattttcttgaaatacagtgtaggaggacagatttttaaatttaagtactttataaattagaattgtagatagcgatgagattagtggtggtgctatgtcaagagccatctaccaactcacctgtgcttctacaagcacctagctatgattttcctatttcacttttacgtgcaaccaaattgcacacaatttagggaaaaaattagcatggtagcagagtaatgatcatagtaaatatcatgcttctccttgttgacataaattacatataatatttcagaaaaagatttttgttagtctagcttaatatatggaaatattttgcctatagaatttatgtatcgaggaaatacttaagtttcttttaagatgatctctttgacacacacaagaaaggtatattgtacagtccagacagtttgagggctaaaattatttctattccttggaggctataaaatctcatttccagctacacaggctttaatgaaatattgtatagcttaggatacaggaagatttatttcttttttgggtgagttctctctaaaatttcagggaaaatttttgagaaaatgaatttataccttaaaaataatattccagaattcatcttaaaatagcatagaaagctaaaatatatttttgtaacaaaagttttgttatatttaataattctataaaatcttggtgttctttctgctgatcaccctctgaattaattggaacctataactttctgaattttattttgtataattggtagacttcatgtctcattcttttttttccccattaagattccagaagcttatttcattagagacccccacactttccttcttacaaaggactttattaaggtatatgttctgtatttagtgtggaaagtgttctttggtctttagctgcatgcatgtattcacaggttagattttccacatttaaccccagcttctgggaataagaatagtgactgggttaactgaagcatgtttggaaggagaagcaaagcttgtctacaaaatactaacacttggatgattctgcaccctgagaaaagagcacccgttgaattttctggactttttttcatggctgacttgggatacacttgcgttgtcaaagagtgtgttggcctctctctttgatgcatattgattatgacaatcaccctccttcccctgcaggccatggaggcacagatacagaactttggacagacgccatctcagttgcttattgagccacatccgcctcggagctctgccatgcacctggtaagacatatcagcatgttgagatttttttttctttcctttttacctgggaatagagcaaataaaattgtgattttaacagcatattttaaaaggcttctcgatttattggttaactcttcagcctaagtacaaactaataccccagggagagacagagaaggaagtgtaaatctacctttaagtcctacttaagctgtcccacttttggattcacaaaaatagccatcttctctatgtatgactctacataaactcattcatgcacacacaggcatagagacacacactgacaccagaattagactatatttgtaaattacaatgaaaaatgtattgcagacacaatatgatattgccaaatttcgtggcaagatacagtaggggaagtagttcatttgaataaaaggaaagaaatataaaggtaatttgtggttattacagagaggttgttgaacagagtggttaagagtaagggccccagagccggacagggcaaacaccatctctgcactagctagtaaatgacttgggcaaggtatttaacctctctgtttttgcatttcagcatcttcaaaatagaggtaaaaatagtacctactactgagaattgaatgattcaatactgtatagcacttagaccagcacctgtcatacaataagttcttaataaatgtgagctgacatcatcataattagctactggttaaacctcttattcccactttgcaagggagtcatattcttttcattttaatctgaatttaaaagtccatttccataaaaaagtttctttacagtttattagcaaatagtaaacattttcttctttaagtaatttgaagaaggtaaaatttttatgagcaatttctttagaattttttttaaaactgatttttcactatttttttactgaagtaaacaattcttgaaggtaaaaatgcgttcacaagatgaacttcaagacaacaagtactctaattttagagtaaagagctctggaatatggtccataatatatgtgtaaacaaatgtataaggtgttattttgtgatggaagtattaatcacacctttcatttactctgtcatttaacgaatttttattgagccccttctgtatgtcagatctgatgctaagcactggagatacagtgacaaataagtcctctaaactttcaagaaatcagtagtcgaacttttgggaaacacataaatgctttttgttgttgttgttttgagacagaatctcactgtcacccaggctggagtgcagtggcgcaatctcagctcactgcaaccttcgcctccctggttcaagcaattctcctgccttagcctcccgagtagccgggattacaggtgtgcgccaccacccctggctaatttttgtatttttagtaaagatggggtttcaccatgttggtcaggctagtctcaaactcctgacctcgtgatctgcctgcctcagcctcccaaagtgctgggattacaggtgtgagtcaccacgcccgacctaaatgcatttgtttttaaatttttttttaagatagggtctcactctgttgcacaggctagaatatagcgccatgatcatggctcactgcagcctcaaactcctaggctcacacgatctttcttcctcagtcttcctagtagctgggactacgggtgtgtgccaccatgcctggctaaatttttaaaattttttgtagagattgggttttgctgtgtttcccaggctggtcttgaactcctggggaccctcagtctcccaaagcgctgggaatacaggcataagccaccatgcctgcctggtgtgtgtttaaactctttttttttttttttttttttttttttaccttccttcaacagctcagccaaacagcttcagcctccttggttagtcactagtgaactcttttgactgcagttggtctttctgtgtaactaaacagaaaggtttgcaccaagctcaggctgttgccgtataaacccctcagccacattgtagacatagagatgtggcctcggagcctcaccgtttttaataaactgtccagaagaatatctctaacactttattttatgaaatgctttggcagaagagttttattcccgtgttagttttctgtgtttaataataataataaaaatatttatcctggagatatgcccagtcagaattcattactttcctagaggaagttgttagagactgaattggcatgaaactgtttataaagaaactctaagctttctaagttcatgtagcagagaattcatatatactgcaaaccattaagaaacatgtatgaaagctaaataatggttatttccagcctccctactttatgtttttaatatggtggtatttgtagtgttttgtaggacttacagtatctactttctgtcaagtcatatgctagatgttgacaaaacagacgctaaaaacagaaagaagaaaacacatggacacgtgacagggaacaacacgcactggggcctgtcatgggggtgggggtggtgggaggggagcatcaggaagaacagctaatgtatgcagggcttactaccaaggtgatgggttgatctgtgcagcaaaccaccatggcacacgtttacctatgtaacaacctgcgtgtcctgcacatgtatcctggaacttaaaataattaaaaaaaaagaagaagaagaagaaaaagcattggccctccataagctcccagcctagaagggagaaacaaggcttcaaccataaacagtcagtgccagagcagaacctggggagaactgccagggaagcgctcggctgctttatggggctactgtattttaattatttagactgtagtcatgaccccagatcaaccagatagaaatgaaagtattagtcaattcactttatatttcgtgtaaaaaatgggagtcactaatttgactaactttcccaccaaactgatttttaagctgcattgcataactgtgttacgtcatgtgggtgtgtctatgagctaacttttcacattgcattgtggtgatatttgaattgaggctggtctttaatgattctgtgtccctgtatcagtgccttcacagaattcttattctctactctctgtgccattccccagtcaaagctgctcgatttggggcagacattcaccagtatgaaagtttaggtggcttttcctccttgtgtgtgctcgtgctagccttgtctgtttaacctcattctccctagacctttcactaactatgttattccttttgtcttcctctgttctcttccctttctattcaacagtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggtatgtgtgcctgagcaaatcacttactaaagatttcttaaaagctacaattaaagtaaaaaagtgtactgggactgggattagctcatatcccacattatctacaaaaaacagcagactaaataaataattgtcaaatccaactaagggacttctatctgtctccttcatttctgctgtatgttagtgcctcataggatgcttggatcatagtcaactactcagtaactatttgacaaattgaagcagttctaccaataattcaggttctcctactctattctgctattgcctaactgcaaaaaaatacacccttcttttttcctatatcaaacagaagagagtttgaatatgggtttctggatgctggcttcacatcctcttgtctctatatcagtaatttatttagcaaatatttgaatgactattatgtgtcaagtagtcccaagcactgtatatacagcaataaacaaaacaagcaccaactctatttttgcagagcttagaatctttgcaaaaagacaaaatctaaattctccagtgatttcacacttcacatgtgtttctccaaactctttcctgaaagtaccagccagtacatcttgaagcgacataacgttgtggcaaacatttagacatattgcaggagttcaagaccagcctggccaagatggtgaaaccccgtctctactaaaactacaaaaattaaccaggcacagtggcaggcacctgtaatcccagctactcgggaggctgaggcaggagaaacgcttgaacccgggcagcagaggttgcagtgagctgagatcgcgccactgcactccagcctggacgacaaagtgagactttgtctcaaaataaacaaaccaacaaatcaaaacacatttagacatatggatgcttaaccagggcagagtggatgtgaccaaatgatttagttggcccagtttaccacttgggatctcccaggaagccgaggactccccgtctccagagttgaatagctgagccatgccgaagtaacctgaatctttctattttactgacctctacattgctctaaaaaatacagtgatttatatcctagctttatctcctaagagtttctaagtgcacctattttaaggttattggtgatattatcaacgtaaggtaacgctacttccattccatcagagataggcagcacatatcttaaggaaaatatatgactgtattattctcaggagacagcctctagaaatgttttgcattgagaaaaactacaaaggactaaatttttatttaaaattgtttgaaagtgttgtatatattgtataatcacgtgtgaaaaactatgactaatgaacttcatcaagctctaaacattaatcctctgaaagtagcttttagtgagattaagattttaggtgtggcccaatttttataccttccatttacttgtcacatgttgaaaaaaaggccccattggatgggagccccagcttcctgtgtcctgccccaggtgagcgcaggctcatacccatccctgcttggaagcatagccctttcattgatttctgcttcctgtgtcctgccccaggtgagcccagcctcatacccatccctgcttggaagcatagccctttcattgatttcaggctcattgattgctcatgaccttagctttttgatgggttcaataaatgttacaatcttctatttatccagctttttctcatcattagaacagaaacaaaactcttcccagccttgtacatcgtaagtggaaacctgaagtccctgttgtgattattttgtaaggctgtctacagagacacatagtatcagaacaatttatcaaatcatttttaagcaaatatgcattttgtaaaatcatcataaaacactacccattaggaaatcccttctttctgagaattttatgttagtttttctctctttttttaatctttaggcctcagaggagctccaggatactccttggatcaagcccaccatcttcccattgaaatggatccattaataggtatgttaataaaaaagaataaattttcatggatactatccatatattcatatatagttatttttcataagatagttgaacaatattttttctaccacaagattaaaatgctaataatatcaaattatcatcaaggagctgtgtaaatcataatatgccatctaagaactttttggtattaaagcaatcgtttcttgatatttttggaggtcatttaagttggttataaataaggcaaataattccaaactgtattttctttcagcctaaagtgttctctaacagctcagtattatttaaaatataaggattcaaaaagattactaaaggctgggggaggaatagcattaggagaaatacctgatgtaaatgacaagttgatgggtgcagcaaaccaacatggcacatgtatacctatgtaacaaacctgcacattgtgcacatgtaccccagaacttaaatttaaaaaaaaaaaaaaaaagggccgggcatggtggctcactcctgtaatcccagtactttgggagtccaagacgggcggatcacgaggtcaggagatcgagaccatcctggctaacacggtgaaaccccgtctctactaaaaatataaaaaaattagccaggcgcggtggcgggcacctgtagtcccagctactcgggaggctgagggaggagaatggcgtgaacctgggaggcggagcttgcagtgagccaagatggcaccactgcactccagcctgggtgacagagcgagactccatctcaaaaaaaaaaaaggaagctaatattgaagaacatcttttctggcagtcttttttttttttttttttttttttgaggcggagtctcgctctgtcgcccaggctggagtacagtggcgcgatctcggctcactgcaacctccgcctcccgggttcacgccattctcctgcctcagcctcccgagtagctgggattacaggcgcccgccaccgcgcccggctaatttttggtatttttagtggagtcagggtttcaccgtgttagccaggatggtctcgatctcctgacctcgtgatctgcccatctctgcctcccaaagtgctgggattacaggcgtgagccaccgcgcccggccacctctggcagtctttatcactgaatttttttaaactgacatgttgtaaagcaaatgtttcatatgaattgcaaactgatgagctataactctttgcagcagacattcaaaatatttttaaataatcgtgtacatatttattagccattggatccagagctagcatcttagtctttcgaggcccttccggtttcatatatgtaagacagtttttaataatgtttgttctatctgtatcactggatgattagtaagataaattagaaaaaaattgaaaatgctacgaaaaattattaagctacatattaaagtcaaggtgttttattcttgggttcttttttttttttttttttttgagatggagtctcattatgtcacccaggctggagtgcagtgatgcaatctcagaccactgcaacctccgcctcccaggttaaaccaattcccccacctcagcctcctgagtagctgggattacaggcgtgcaccaccacgcctgtctaatttttgtatttttagtagagacagggtttcaccgtgttggccaggctggtctcgaactcctgaccttaagtgatctgcctgcctggccctcccagagtcctgggattacagacgtgagccaccacgcgcagcctcttattcttagattcaaattcatccttcgtctttgaacctggaaataagataagatacagacgtttcaattagttacttatacccatacacaaaataccatttacatgtctttgggagcttataagctttaggattaagaatattattagtctagtctagctatttctctttccagtagacattgacaatgaaatatacagctagtgtgtaaccatggaaaaattaataggtctattctaattagtaaaggaccaactgtatagttttcaagtggcctgggacccttggtcttcttgtccttactgacttttgtgtataatatttttattgcttatgtttcttagtaattatttttatactgttagtagatatctacagatagtagtacttaatatttaactggtgttagagagtggtggtgaccttctacatctgcatttctgtttaagaattcagcccagtgatttatcctgaaaggatggtgcgcagtaagggacaggctggcatgcagacaggcactggggaaatcagatggtgtctctgagttcctgactttattcagattcaatcccagggctctgcactgattctttgcctgtctctttcctccccagtccctctctcatcttttttgttcctctcctcccctgctagccctttctggaaaggccttctgtctgttgacaatccaggcctgtaaagctgctgacctgaagctccctgtggggctgcccacgtaacaacatcccttgctcaaatctctaccctcctttttcacaggaattataaataccatctgaaaatgacagacttggggcaaatattaatatatctcttccttaataacatacttcatacaatatttagttttcatgtgattcttataaactaatgaacttgtatatagtgaacatctaaagaattaaatgcattaaaatattgtattatgttttaaattaattgtcttgaattcctcatattgtttttattggtggagggagaactaaaatttctggcataattttaaaatacataatgtggttcataaataattactgcgaaggaaatttatattcctcaagggagaatcttaataatctcataccattaaaaaaactatttctggataaatgaagcatgaaagtattgttttccttctttgagtgcttggcaaaactcatatggaatctttcttcaaatgcttttttccatttacttttagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacaggtaatcctaactatgaaacaccatattctcttcaaaatgactattgttaaaaccaaagctgaatatgaaatcatacttaatgtaggcatttttatcatttgccaacttgagtagtcaagattcaaattaaatgttcacattgtaagcaaagtaactaactataacttcatgtattccgaacgttagcatgatcccagaattcataggacaaatggggctattgttcctttcccacaaattcatatgcagtaaaagatcctaaaactccccttggtctggcccaaaccctgaagagaaaaatcgtgattgtgttattttataaagtcttttctttaaaaatctcaagtgacattcttgtatcagtttccaaaagcaatgcaagaaagcaacctgtagccagatttgaataacattgtaactttgtcagcccatagatgaacttttcacaaaactggtaaaataaaattaaaaatatggtaaaattttttaaaaaatctgataaagttacacttattaccatttgaagaaaaagactaaatgaagcaaacctgtcatttctgtgttgcagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgagtgtttgtatcaaatttgtcctatcaaactatagtttatttaaatatattttgcctttttgattttcctaatagttttttcctgaggtgtaaggattttaaaatatgaaagcttaagtggccaaaatctgtactggaacgtagctatgttcaaagtgttaaaatgatcagtactatcacctacaacatggagagacttccagatcccctcaccagtcccctacccagaccctctgctcagcagcccagtcaccaaatgtccccatccttcagaaattttcttcagcttcaccttatccattaaacctcatattatttctttcagctgaaaataatctctccctgctctgaatttttagaagattttgcctgtgtctcattcagggcactaactgctatctaccatatatactgtagtaaatttctccatttattcgtttagcaaacagtgagtgagtacccccttcacatgaggcattgtgggagatgcaaaaactgaataagacagtttccttgcttgggaggattcctcaagtgatagttattccacagtgcaccctaagatatcccataggaagaaagcgttgggagaggctggactccttcgtgaaataattttggagtacagtgtttatactcaaactttctacataagctctgaaagtcttacacaaataaatttgttgatgcttgtttaatccgcagcctctcaaacttctttttccaatgaaacttttatttatgtaagagaagttagttattagttgttggactgctgccccaagaaaacactaaagtagataatgagtgtctgtctttccatcttcagttcctgtcatagtaatatacataataggtttccaataaattaaatgactgaagagctggataagagattggctagaaataattactgcttttaattactaagctttcaatagttcactcaaatgcatgactttcctgtataatatagaaaggtttctgtgaagtgataatggcaagtactcaaaccaggattattcaaattgtcacagcttacacagcactccaaaataaactgaaacatgaatttggggaatacttataacccaacagagataaaaatttttcaggaaacctgtgcatctacaactaaaatactataagagtagataagaaatctacaagatgccatgttacattgcgtggctggctgctgcctctctggttagttccaacctgtgagacagctaggggtggaaactgaattgcacatccacccttcatgtcccactccatccccccaacccttatgcattttgacaggaataccgcaaaaataggaaatggctttggatggataagaacaaaggccccatcatagtacaggagagaatggagaaatacatttgtatgagaagatagtggaagattggattagatgtccaaatgttatgtgaagttttattcctgttgcccatagctagagttgaacagtggatgaagaaactaggtgtgttgtaaaatagcatatgcctcttggcatagctactgaacaagagagtgtctattgtacatacgagtctctgttctaaatttgaacaagatgtgatctttatttgagggaaaagatattcaatgttgcttgatttccaaccagttcaaataattagttaccaattctgttattaacaaacattatgctctaaataccagtaagataatctccctatttactcttttgtaaagccatgtccgtaaacaattcatttttaacagaattctagtatgcctatgtatgcgtatgtgtacatgtgtataagacatatgacctaccagcgatggctttattattctcaagaatggtacattatcaagtatattttatctaaatatatgttcacatatttccaaattgtctttatttccataatagtgtagcatttctttaaaaagtttaattaagcagcaggtctgtgtagtatctttcatatacattgataaaaattagaacttgttagaaaaaatttaaaagaaacagaatagagctttaaatctaattaattaccgtcttcaaaatgaagcccagaaatgatgcaagtgttatttccaaaaaggggatttatttcttaaaagctgccatctggtagctgagataagatgttttatataatatactgctaggaggtaaagaatattaaagaaaaatattaaattatagtaattatctatgttcactactgtgttttctaatgatctcttaaaccaaaagatggctaactatcaattgtagctttggtacatcagttagcaagaaaagttaaatacaataatatttaaattatttaaagctccttacaacaggagctgtgtaaatacaaaatgcttttttaattcttaagaacaaaaatatggatattatatttgttaaaaagcagtgtcatattttagttttaagtaaggacaagattatcttaaagatattatgacaaaattatcaatatgtatttttcagtattacctccatctataggaatttatttttagtgaaaagctgttgtcatcattatgaacctaaaccacttccatagaatccatcctgtcaagactttattagatatttaatgtgaacatacgtagtatggtacattaataaaagggaaaagtgctcttctagaataaacaagataagcacctaaagtattagtcaagcaacagtatgtgttgggtgcctactgtgtgcctactgtgagcctggtactatcccagcagctgggaatgctgcaaagtcacaacctctgactttctagagtttacaagaatctacttttatactgatcacaaactgtttctcctgcttggatatactgaggatgtcaagtatttgttaaatgaatcatgaattgttatccgataatattttgtaccatactttaaggattcgtaaaatgcttaactttacatcaaattgatgattatgaaaaaaactggttttagcttttttccataaggatgatcacagtagtaaaaaagtgatctcaggtttagtattgattgactgactgatttgtgacccacttatctatttaaaaagctaacctagtagcatatatatgcctgactagggcaaccatctgtgtcggtctcttcactcttttttcaggcagtcacagcacacactgaattgactgccatatcagtgccctgcctgtggtttgacatagacatagttgttgccatcagaaaactcacaatgtgaaagagattttcttctgttccagtttaatctactctagcttccaattcacaggtcagagaagcaggccatatgtgttttctatctcataatacattgatactcaagaccagaaagctagttatgtctaaatttgtattaaagtgtgtgacacaatgcccttaggttttggaggttgtatgtattaacctatccttgacgtgggaagtcctggcatgtaacataatatcctagtagctgttataatgaagggattggccttggtgtggacatggaactgctttgtgtgtcaccgaggccaaatcacacctgttcatcacaacatcatgaaatgataggatttatcatttaacctttacatgcatatcactaaaatcttctcaagataaaattcaactgactttaacatatttgtttctcttgcattgtcattattatattgtaatagatagctctattaattccacgaagaaaaaatgtcatgtttgtgaaatctttttggcaggtatagaaagtatgtatggttttattgtgtcaaatatattgtgaagaatgcagacatctcagaaatattagtctttttctaatcattttgaccattgtgatgaattggtcacaaagataatgaatatttgtaagcagactatcagatatagagtctcagaccataaaagagataagcaaagtctacctagtgcaggttagagttgaattatcattgctttattaatgtattttataatattattcattgttattctttcaaactcgcggctttgaacgtataaattatcttggagactttaaataggtccctaactagataacagaattgcaaagatgtgaaggacagatgctttcatccgaaacagacttttacacaaattctgaaactaatttggaagtgataaaaattaatttgcgcactttaattggaagcagcctactgcatgaaagagagcagagcagagcaggcaatttgtgctaaaagctgattgaattttttgtcaggtaggtatcttggacttggccgcttatcctcttgagcctctctttgcaatatattacaacccatctctgactggtgttctttaaaaggatcaatggtattcctttggaatccctagagtccaaaatttcattgatcttaggacttgacatttctcattacgtgctgtagcttccaacaagatagtcacaatagaggcaagttaacattgttgtctcttcaacagacactcaaaatacattgggacttcagctcaaaagccaatctgcttttaaagaatgtagttttaatgtttataccacatacaaggtgctttatagagagtttgatatacatacatacaaaaatttttaaatcatagccatgtgaaactttgaaagaggatttaccgttcatcttttcaactcaaatctacaaatattcattgggtagtttgtataacacattgttattatgcttttctattccactttttaaaaataagtattttagctcgtgtacgggcattatgcagactgtcaaaggagaagccaattgcaaaggagactccagctgtgcacacacaccttctctgggctcccattgtgtatgcctcagctctggacgctgaccctcctgccagccacaacctgtcaccaaacatctgccaaatcacatccctctctttgttggcatccaggcttcttttaaaaagactatcctggtgcccagctccacaactgccactaaccagtgctattataagaaatgaaagcatggccgatggatagcccagagagatttgtagagtatatttagatttagatacattaaacaagtttgtatcacttctcggagcaaagaatcttagctaggatttagcatatgttaaaccatctttgtaagatcagaggaagtgtagctccatatgcaatagttctcaccttgcagggctttttgaggaccaaatggtaatggatgtattggaacatcgatggcacagagtccattctgcagtagaccactcatccaccccatcccctcattctaacaccagtagactttccagggttccagactgagaagggagctgcttgctactcggcctcggcttttcctttccttttatgggactaaggcttcaagaaaggtctttggcctagattggaagcaatatatacagagtgactaatgtgttctgatcagagagcttcaggttccaaccagggggtgtctgggctttacgcagagcccagcttcctgaggaaggggaggtggatgatactattagttgtttttaggtgagcgtaggacagtaatgtactgtgacctagatctgggctcaggacttcaagagaagaggttgtcctgcagtggcagtgctcagaggaaaatgtagtcattgttatctctgaagaggaaaaagaagttagaatgaatgaataaataatttcaccgtatctgtcttccattcttcactgaatactctatgagtacataaggaaatgaaaccacatcatgggtgaatttgacattttccaacccacagaatgtttttacttgcattatcttgggaccttgggaaatgcgggtccaagtgtatttgatacttggaacagacctccacagcacctgcctgtggctgaggagttggggtcttgataagggactcctgaccgataccgctcttctcagctattccagcaaatttctaacataatatgttgaaataaatcttgaaatcatagtagtaatgaaactaccataccctttgactaaatcccttattctgggattttaactttcaaaactccatcatattttatctaagtataaacatgaataaaaatatcttctgccatgattctgcagtgacttccccagggtcagaaataaaatctgaatcagattttatcaggaggttcatcctctcactgtgcagcggaggtcttagaaactccactggctttgtttagttctaaatcagaaagaccacagcttcccctgcatatcagtgtcccacaaatgaggtttaaaataagaaccatgagttctttactttggccatttctctaaaagccagagaccatctcactaaaaaacctctcctgtctatgtgaataagcagcatctaatactagtatatttttttatcatccattttgagaatattgaaatgacctttgataaaaggaggatggaatttgtttattttaagccttttaatattcggagtttccaaatgcatgtctataaggaatctaaaaattggacgtgtttgttcttcatcagttctagtcattccagcacacggtgagtgcttctgtggaggcagtggtgggcctgagggcaacggcggtggccctcagaggggcggtccacctgcacctccctctgcactgggccctttaaccctgggctacatccatcaactgtgatgtgacagtgacagaatattcctaggattttgaatgattgttggggtgtgtgacatctgtccctagcaacgaaatgaaatataggaaacaagctttcccgccgctgcaggtttcccaactcagaaagcctggaatggcattttatttgcctttcacttaaagaaggaaacagtgctttcaggggccctaaaaaataccccctaatagttaagttccacagtttattcagatgatctggggaaatcgtaatgaaaaaaataaaatattttaaactctctaaatcagacatgagcctttgaaaaactcatttcctagcagaaaatgtataacatgcataaggaatatttttatacattttttttctcaattccctgcaataggatcagattgctttttattttttctatagcatattagggaaaggtcccaaaactattcattttatataaatgaattaagtgtataatttcagggttttccagtgtgctagtctctccaagataaaattatcatttagaaaaattaaacctgatattacacataaaatcttacaaatacttttttagagatttaatttttatggatacataatagttgtacatattgatgggatatgttatacaaggatacaatgtgtaatgatcaaattggggtaattaggatatccaacacctcagacattcatcacttctttgcattaggaacattctaaatcttctcttctagttattttgaaatgtacaataaattattagccgtagtcaccctattttgctaccaaacactagattttattccttctgcctaactttatctatctaactgtattgttctacccattaaccaacaccttcccaccacccttgccagcctctggtaaccactattctgtttatttcctctgtgagatcaatttcttcagctcccacatatgagtaagaagatgggacagttgtctttctgtgcctggctaatttcacttaacctcatgtccttcagttccatctatgttgttgcaaatgacaggatttctttttttttatagcagaataatattcaattatgtaaatatatctcattttctttatcttttcattatttgttggacacttaggttgattctatatctgagctattgtgaatagtgctgcagtcaacacaggggtgcagatatctctgatttgctgatttcctttgtttggaaaactcttatcaatgcttaaagcttattttaccaggaagcccagggcatctttgaaacaatttttttttctttttcacctttttcctgcagtgtgaaacataattttataaattatataaatatgtttcagacaaatccaggactgctgacattataaatggacactctaccaatagtcaaaacacattatagcaatatccatgtattcagaagaagatggcaaactagcatgagctgctgtcccccttctcccacactccatctaagagatgcctcaaaaacaaaattggagctgatgggtctgagaaaatgcaaataaaacggagaaatccttggggagacagaagataggcaggtcttaagagaagataggcaggtcttaaggaaggggctcttggccgaccagagtggaagatgtgggtcgtcttactgggtaaggccttgtgattatgcactttcctcatgaactctctgtggcttccctcttgccactgtgggcagagaactggagcagcagtccagctagccagcacccagaggtcccataagtgccaaagaaggggctattcagggggaggtgcatctgccagccctggaacatttaacttcccccaaccccagtgagggccagtagttcaacctaggaggcagctctaggaaagaggggcaccaagaccaaagtacagagtggttctctgagagacaagataggggatcgggggtggttaccccaccaaaaataggaattcacaaaggaaaacaggcaagcatgcaaagaacacaagtgctagaaaagaaagaccgcaaacagaacaacctatatgggtgatgcagaataagctcatttctttctgataaaagaagagaaaaatatagaactttttacaaaaggcataacattctctaagtccttcaatttatgaaagcagttagcagtgaaaatgcttctgggatataattcagctggactttttagctaggttcgcactaataaagtgaagtaggttcaattccaacccttagctgtatgaacttgggcaagttgaatcaccttgcaaagccttgggtgtctaggctatagactagggatagtaagagttcctacctcatagagcatgaccataaatacatgatgtaacacagataaatgccttagcaggcattgtacctgtttcataacaataatggaagaaaaagaatagccattaccactctcgttacgttctaagcatgttacatacgttaacttgtcctgtcatctaaacagcatgtataatagattcgctagttatgcgcatttcacaaaagaggagagcagagaggttaagtaactggctcatggtcacacagcttaataataatgcccttaataaacatgggtattttttgaatattgcattgctggtgtagctctctccccctgctattggtctgtagtgcctcactgctgctgttttcttgcaggtgactatccggcaccaagagccgtcctcacaggccatgaccatgaagttgtctgtgtttctgtctgtgcagaacttgggcttgttatcagtggtgctaaaggtcagaagtcatttctttcattttcaatgtctagaagatgactgttttctcacactaagcgtgattgtcagtttatttcttccaggaagcttcccatagacaaatggtatcccaaagttatttgtagatgtttagttttatgattaatatttactggcactaatataaaatatgtataaaattttatgtagtattttgtggtcaacagtgttctaagcagaacactgataaattacagtgtattcttatgatgcagccattgtaaaggacatgtaaaagacaaggggaaagtatccctgatgtagtgggggaggtggggggtcatgtcactcatcagacacggcctaggatcccctccctcttcaagtccctttctttataaggccaggggctgtgtagaggttggtggaaaggaaacaaagattacttggttctttggaggttttgttttgtttttgaggcataccttcactcttgtcacgcaggctggggtgcaatggtgcaatccaggctccctgcaacttccgcctcctgggttcaggtgattctcctgcctcaccctccctagtagctgggattacaggcgcccgcaaccaagcctggctaattttttgtattttcagtagagatggggtttcaccatgttggccaggctggtctttaactcctgacctcaggtgatccacccacctcagcctcccaaattgctgggattacaggcgtgagccaccacacccagcctctttggagtttttgtagaagatctttcatttcaggaagtcaggaaacttaggtcctagttctggctcaaatagcagttctctgtgggaagactcccaggcagaaaggagcctgatgcttggagaaactgaaaggagccctgggtgctgctggagtatcaccgtggtgccacaacctggaggaatgagaaggctgaagggatgggaggggcctggggcacaagcatttgcaatttttttttaaatgagtatagtaggaaactattgaagttttttaatcgaggtgatgagatagataggtttggttgttagagctcatttcagcctttctacggagaatggatagagtctgaaggctggcaccatgtttttaaaattttggtatctaagaataaataacccagaaatggacacataggatattttcagtcttttaattttaaaaagtaataatatgtgtaatatcattttaccctgtgaagttaaaaaaaaaaaaaaaaaggaaaataagtgacacatagtaggcgccaagaaagagacatttcctgcaggggctgtgtgatattagagatgattgctggtgttttcctaattttctatagggcaagtctattactttagtaatcaggacaaaatttaatcatgtcacttgctttgtaaaatatgtgtctattcagctcaattaaaaataaacacgtaattcatacattgttttgtggaaatctttttgggacaagggaatagatatataacaccaaactatagtgaccaatttttatgaattgatcagtgaattttttactttatcaacactattttataagggcaaaaaaacccagaaaccatcagagccaaatgtcactccttaccctcctttcacactcttgcctcactattcatttatttgaaagacaaaatatctttctgtaggctgaaatacttaagttttctcaattttgcttttacattttatgcgtatggatgacagaaaaaggtaaaatgtacttgacggcagtgtattgatgtggtacaacgcgtaaaattttgatgctacttgagaaaatgagcagctgttctgataattctattaaactttcaagaaaagtttctaaaagcgtattaagagaaaatgtctggcacataaagtcttttattgtcacgtaatctgtgagctgtaccattttactatgaatattacctgacaaaggaaaagaccaagtatctacctggtgaagaagcgtgcggcgtaggagtgtgatatgtagcaggtactctggctttgctctgtttaaatgtagcatcagcgcttggcctggccagcctacctctttcctgtcctcttccgtcacatctgagcgcacacccagcaaggttttcaggttggtgggagctagtatgtcgtttgtcgtccccaactgaccctggcattgatgtccccactttgcagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggtaaatctgcatagttcgtgctaagtaggactgaagccaagagattaaagattgattgttttacattaaataattcataatagaatgtctgtgctatccagataaatgtgttctagattaaaagtatataacttcttgcggactggtactttaaagaaacccaaagttcatttaattgcaagtaattaactcactgcattagacttcagaaatgatagctgttgtttgattaaagcttagaacctcgggagggtttttaaagctccttttataattgtttcagtgctgcaccctcacaacattaaaagtgagtttattttcaaagatttctatctctagaaccctaaacaaaaattacatatacccatttgcccttcattcatgaataaattataattgctgggttgtcattattaaacactgttttgaaatatgtttcttccatttgttctttaattctctataatattaatattcaagatttaactaaacatgttacttaatgctcaaattcttcctggattaaattgataatattctcttgggaatttaatcttggttttaataagatcttttgtatatgtaagaacttcgatgaattccacaatggaaattctgtggattgaacttgattttgttggacaaatgactgacagtaggcaataatgataagggaactgtactgagtacttttcagtagtgacagttggctatttaggaaaaattgagagaaatggttgttgtgtattttattttattttgtttttttttgtttgtttgttttaccttttctgaaggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggtgagctgcgtcaaggacaagtatcatcactgagaactgtcattgaaggctctcttcattctaccaagggtgaattgtgctgtgagtgcaattccagcatccaaatgaaagaaagactggcaaagaaaaggggaaaatgaggggaagagtaaggattctagtgagagggaaacagaggaagagaataagaaggaaaaaaagaaaaggatctgatgaagaacaggtgcctgcagacatgttttaagggcccaagacatagaacttactcccaccaagttccctgttctcaggttcctgcctagtctcagacaggccaccctggcttatatgatgtgagggaaacacgtatttttcagcagaggtgggattcagtgtgagacctacttcttgctaaccagtttccagcaaagtgcatagtgtgggccgtagctggcccccctttcaacagcatgcggcactcacgcattacccagaacaatttttttacccccatgttcttatttacctgtttctcatttatgttattttgttttattgtatgtatttccttaaaacacgttaatcctttaatccagctctttcttggaaagagttgatatggatgttaatcaattaataatgattttccattgttcctcaatttgcaataggattttattatttcctgaaatttacctttgggtttcttacaaagtgaaaataatattagaaatataaagtctaaagttcctaagcctttaaaataaactacaaccctgtaatctgaatatggcatgtgatttctaatttttgctatttaacagaaataagaaaagcttgttaatcaacgtttttcccaactacatgtaatattcctcataacagtattggttttaaaatattttaaatattaagacataataaagttaacaaagcatcttcacaatataataaaatggcactgaagtcatcaggaaaaacgctgtaagctaatttagtctgggaaaggatgtttggtctgcagcccagactgtttttaaagaaggtttaaggttattattggagtatcccaaagtgctgcagcccatacttaggaataaatgggaatggtttgttgtgttactatttgtatatatgtgtgtttccagagtgtttgaaatgatttgtgtttgtaagcagtttcaatatttccctgatattcttactcgttcgtgtattcattttgctgccatcatcataggttgagtgcagtgcaaagtactaaggatccacaacaagaaactgaccccagagagctcagatcctcataatcattgcatatgagggcaccaggaacagactaacagaagaaggaagggatgaactcttcttgagggctgggaagggcaggaaagaccttagaagaggctcatccattcaccaggcatgaacagacagggtggatggaagagcatattcaaagttgcagtagtattagggggtctcaatggaggggggaaagatactaagtttctatttctattttaacctcatccttggttttgattattttgttgttttataatgaatagtgcatgcatatcaattataaactgataaacatatattggggatattactcaaaaggtatttattggatgaggtgtctaatcaaaagtgaagcaacactttatgtagacagaaatcctgaaacctgagttcagtcagtggcagtgggactggggaggaatatccctgaaaaagaagcctcagagctgaacagctgatcagttaggagggagagggagaggagacaaggtgacttaaccagcaaaagaccagcaaggtcagaaggtaccagtgattcatggtggacatgttgaatctgagggttttgtgacacagcctggcagtgacctccacttggcaatgggaaatcagcatctggggcttcagaatgagacgtcgttgcctttacgtccagggagactgtggaccgagaggacaagaggtggagtgattcaagggggcaaagaaaagaaaggtcacagagataggaagagatgccagatatcctcagagaagccaatagatgcccaaaacaaggcagcggacaggcacgtgtgtgattgctgagagaaatggggcacccagcggaggctggaaatgtggttccgtgggcccctcacgctctgcagcagggctggctgtccaggtgtgtgcgggctaactgtgctcctctcagcagaaccaagaagaaatttcagtcctacttccatgaatacaaaattaagacttggcaaaccttgagatcgtgatattgtctagtgtaaaatgccaaactttgagatactgtctagtgtaaaatagcaaccacagaaatgattttatatcactcttaactgctgtttctgcttttccaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattca

SEQ ID NO: 766 - DNA, 195989 bp, Homo sapiens
aatcgccactgggctcgtcacgacagcctccttcagctccaacccggctaattaatccccactcatggatataggcacacaaactaaaggtaggaggctgctgccggcggaaaaccactcaggccacctagacagtttggaaatcaagaggaatctctcagctttggtattacttgaagcatattgacgttttgaaaagacttggcaaagcggctctcttctgtgccgaaaacctgcttgtcttttaccgctgaaatgcaaatacaggtgtattaatgggcatccatcaattagtgatcttgacggggttttctaaaacaaaatcactaacttgcatttagagtaagataattaacgtctgttaatccttggggtcttcttaaatgcaggttgaaagtttgttctttcatgcagactactggcatatggaagttggctttagatggaggagtacctgtgtaattttctcattctggatgttcctatatgttaaaatgattttttgaaacgttatggaggtagtatgctctttttttacttatgtttttttcttttctccatttgttgaatctgaaaattattgctgagtgtgtgagatgttctacccctgtttaagttaggatatttaaaaaatatttcgtacatccctctgccccagcagatgcagtctttgcactttggtggacttgcccagcattacaagcaggacacaacgctatatatgcacttatagaaacatttgaaaaataaattgtctgtgggatggacagagtactttagcgttatttcatagtgacctgtattttagtacataaaattcaggtgagatcatagagatcaagcttcctcacagataactatcccgaaaaattgaaggtttggggtatctggcttgtttacagatgtataattaaggatatatctcctgtcttaagtgtccttaagtggtgacctggcagtagacttctaattttatactatttcgtgtgatttaattaagggaaaatggttaacatttgcaaagaaaattaacttgcagttatctggggggttttttggatttaaacatcattttgaaaacaaaaatgaaataaatcatttcatttctgaattttggaacctggaaacaggaggaggaatttttttttctagttggtggtccagttgtgtcctcaaagtacaggaaactaaagaaatactacttagtggttacgttgtggtttttaaaactaggtggatttttttaattgtctacctttaatttagatgccacgtctttccaattaagaatatttcccgtcaaatcctataactcccggtaacatgtttgtagacactttcagagtcacttttaacaagatattcttcagggctcccacttgctacttaagcttttgatttttgtttgtgtgttttgttttgcacaggcacagcatcacaaaaccacctattatttaatttctccttatccaacagtgatagattccaatttagctgaaaatagtatacattggggtgcgtggcacccagctactctatttcccaagaaccttccatccccttaagagcagggtctgggaacacccaaaaaacccctccccactttgccgtcatcgcgggtgaatgcaccactaccttttggcagttggaggggagacccatcagagccggagaacctgcagccacgacggcgaggatgtgcagtggtctctggggaaacgccgccttctgccctcacccggcgcgtgtggccctgtgccgtccgctcgccgcctctctctcgctgctccgcattcccgtgccctcttactttcctctctgggctcaagatcgctacgctttatttctgcgtgagcttatttgaaaaccttacttggtgtcccggcttactctccacgtctgctccagaccacggtctgcccacgcacccctcagcctgcaccgcccacgtccggcccaggtgtggtcgcagccaagccccagccgcgggcccctgcgccctgcgctctctcccttgggttcaggccagagatgcttgccccaagacctcgccccttgccttcttgggccacctgcagaacacccttggttgtcaaggacgtgagacagccgaggacggggaggccccagggctgttcgggggaccttaagtgggtccaacgggaaggacgcgggcctgcgagggatgccggtcgggcctggctggagccaggcgcgcaggtggcgcatcttcggggctcactgtgcagcttaattgggttaaagcgaagctaaacaccgaagcactttgtgcaaactaattggtgcaaccagcgccttttcactaacgatttgcactttgagaaagaaaaatggatggtgagaaaaggtatactaggaaactcattagatctagagtgttcaggaaagtgaagtcatttagtttaaaggacgccaggactgtgttttctaagctgcttccttaagcacccctcacacaaggagctgaaggtgatttacataacataggattcaccggtccgcgattatcactgtgggtgaactgggcgccctggaatgaataatactctagtgcaagtactgcttgttgctgcaacacagtgattttctattacactgaacacgtgaaatgaattgccttctgtagctgaatcctttcagtgatcgtagacgcccctcattgttgaagcgagaattaagctattcggagaagcgtgttttccatccccgaaatttttttatggaaatgacctatagagagggattgcaaataacagtacatttttgtgcagttcagccgattttaatctaggcttgggggatatatttattttatgggagtaatatatttaactatttttcagtgaattttaaaaaaatatcatttgacctattaaactagttatgtcaaatgattatgtagtacatagagatggcttaatatacatttatgtattaatgtgaaaagtttttttaaaaaactccagttataccagtcttgcaatattttttgttgtaaatatactcagtgctactagaataaaattgtgtgtgtgtcatgctttaggatgtaaatacttaattgttttcagtggtaggcatgcagacatctttgacatgagctaataatagaatgataattgaggaaaactggcctaattgaaggaaaaaaatctcaagaatctcatgatttaatgatagtttgaaatgcttatattgaatggtatttagaattttaatgcctaactgacttttacattgcatttacttagtttatgaggcaggctcgatttaaaatgtaccagttaggaaaaaaaaaaaaaaaagcaataaggacatagcacaccattatcataaatgttagtagtattagtgaatataaaataattaaatattgtgatccttaacacttcgaagcgttcgaaataacagtggcaaaacaactttgcctcaagtagtatttcctaaataacttgtctccacttctgcagacctgcttacttatatgggatatacaaagtaattcataaatagtgtcattattaagcttaaagaaaaaccctgttatgttgagaaatacaagaatgcaatatttctttgttttcgaaaaaaacctgatttaaatttgaattgcatgttcacaaatctcagtaattgtaacctttcatctggaaaaaaggtatctgttaaaggatatgcacatacatgttaagtgcttatatagatattgtttggtgttttttcattatctgctagctgctagtctattcacaagtattaatgaatttaaagttttatttttttaatatgtgcttattacgctggggagataaaaagaatatgaagttgagtttattacattatttatccctactgctggagtggctttgaaggctcattgtagccatctgatttctttcccccttctttttttttaaatgcacccaggctatttcaagtgtttcattctgccagacacaatatatttctttttttacactagagaaattaaagacagatatttgtgcagggttttctttatgtgtcacattaaataaagtaaaatagagagagtttttctggtaacctaatttgatggcatctatacctttcttcctgtgtgattcctggtataagaacacttgagacaaaaaatagcttgaaacctttcaaggtttcagtgatttcttaaagtaattatttcatcttttaatatcagatttatttcaaagtcaagcagaggattgaggtcactgtttgcacaatttagaccctattttatttcttcaactagaacattttgagaatcgtggttaattttttagaattgtttattcttcacttgactgataaaggcctttgcctcagttttcttcatcaccctagttcacaatcatatagtcacatttgtagtgaagagtactttttttctctacagtgttgcttaataagcttgatattggtattaataggtttttgaaaagaaaattttgagattaaaaatggaagttgggagtatacttgtaagaattgaccaccgctgcttgatttgcagacttgaagtaatactggataactagccaaaacttttcttttggtagaaaaagaaatttaaagcctggcttattttcataattgtctctgtttcctcacttcatttgcatatgtacacagaggtacaggatgttttcagttgtatctgtaaactgaaaaaaaaatggggaaagggaggttatcaacctaaagaattttttattgttcagcataaattgtgatctctaaccttttccaaacatttaaggacaatgaagttagtcattcatttattgaatactgtgtaggaaatatggattccaatagtctaatttctcacaaacccttcagaaagttactattatctttctaataaaactaaaatctttttgttagatatcagcttataattttcttgtgatattatagaaatattcagacaggataaatgggctcacatgattcttttctatataatgtatgaaaattaggtatttcctaacctacaacatatacacaaatgtatgtatgattttacatacatgaatttacgtacatttgtgtatatggctacatttttagtactcttaatatgctatctttttattgcatttagagaaaacaaaggaatcagaatcgattagtgtctgttaatccctacatctgtactaggtcatccaggactgcattgctctcattactgtttcatactgtatgtgattaagccactggaaatattcaacatgaccttgagactagaatatggtacatagataatcaacttccagtgattacatgtctaaaataacctttcctatttttaatttatagttttggagcttattttttaatgagcaaagtaattcttctaaagtaagatttattttttttaatgattagtaactggagtaataatttaaaaggataattacataaaatagaaaacgattaccttttatcatgtatattatgtgcagtaaaataaatggtttacagaaaaagaaggaaattagtttataaatataaattttctttatatctttacatataagtatagagataactatctgagaatataatacctatataatatttcatttccagttacatttcaatattttcactattgtaataatatacattttagtacaccaatatgtactatttcttgaaagcacactttttcatataatgatttgtcaaaaatatcaattctaaagtaatactaatgaatagttaatacttttacattcacatatccttatccattttattatctaaaatcccaatcaaattagaagcatgaacagcatagtttgtaagatgtagtggtgttcctgattaaaaaaaaaaaagtgggaacctagtgaaataaaatgtatagctttgtttttctgtgaaatttattttttttaagttagatatgtctgtgaaatttatttttttaagttagatatgtcgatgtgtactttgcatacagtagtattccatgatttttccatatgattgtgccattctatgaattctgacaaatatataccatcatagaagctctaccacacatgtagatagaacatttctattaccacaaaaatgtttcttcatgccctgatttcattatttttatttggaaattttatgattaatgtataaatgtctggctgttttagttttatatcaaaagatctttagactgtaacaccgttatttatttcccctagagtttactattttgtcatgcttctaattaaagacaagttttaatcaaaaaacactgacacaggcaaagtgtaaaataatatttcagatatataagcaatatgtttataatttttattttatgtaaagtttaattttcatgtatgtgacaaattaatacttggtagaagattgatttttcaaagaaactcctaatatttagtagctaacatgaatatatgtgttagatttatgaatctgatttacagcttacacatcaaaatatgcaagtaagaatgggtttctcatataagttagcaacatttgaggcatatttgtaatgtttctagctttatggcactagagaaagaaatgtcaagatttctcaatatttttactttacattttcagtaaattaaccttccctttgagtggtaggaattgaggctaaagagtttattagatctaatattacttaatatatgcacattcttgggacatgtgtataaatatacattatcctaattttgtataaatatacattattatgtaaatgtagatggttacaaatactctaaaccaagaattattaaattataggagtgaagacattgataatgatgctctttcaaatattttgtctttttacaacttggaatagtacaactagtcttttatttcttcccccaagatatacaaattatttaaatgctttctgttttgtatttttattttgcagttacaatagaaattttaatgttatgcatgcttacaggcctattaagaaagaagttattgctttcttaataatctcaaaccatctttaggaaatacactctttttatggtttgcaaaatagcccatgcatgcatgcaggctgtgtacagacacacacacacacaaaaacaccagtgtttaagatagcaaaagattgaattggcctctatacattttccgtattcatctgttaaaaggaaacaaccactaaatattggaatcttgttgccaccaggaagtaatatccacatccacaagtttgtctcataataacccttaacagtttttgataatacctgaagagactgtacctaaatggatttttaaaataacacgggaaattccaacagcatgtattcagtcacatatactacgtcaactttgaatgtcataagcttttaattatgaaattgagaagtttattgctagccattttgtccatagaaaaaatttacttaaatatttacctacattaatatgtgtgtgtgtgtgtgtgtgtgtgtgtgtgtgtgtgtgtgtatatatatatatatatatgtagaccctcactaatttaaaattgttttttacttttttgcaacagaccaagtttaaattttttgcaaccttaacctgcatttgataaacaaaatgtataactcttcagggggaaaaatgtgggatgttttgttttttgttttttactggcaatttcagttcttcatttgttttgctctccacgctgcattagcacagttttcccctgtgtgcatctgccagtgtacaatttagccacgggcatctgtagaccttgtggtgatcagtattgcaggcaaaagccatatgtgtttaaataaaaaaaaaatctctttatttcatttgctgttttaactggatggataacttttgtgcctcaagacagaaaaagaaaaaatacagaaataattaattgcctctattcttgaggcagtttcatttcccctccaatatggaatgcttgtcagctttcctgataaatgactgcatgtatttgcatagattttacattaacacaaaaattagttttatttgtggaaaactagtttacataataatataaaacccctgttattgattatgtttccaagcattgatgactttagaggggtggtagtattctaaattttcaaaagtctgatcaacctgtataatttaaactttcttttgataaatagttttacattaagatctaaaagacatatttataacattttaaagttttaaaacttcttttctagatatacttaccacaactgtttcagactcatagtagcacccatttggtaagaagattttgattttgaacttttgccaaggaatatttttaaatacatattaccaattacgtacacttcagccaattggaagactgcatctatatgaattactttaattttcatattcatattatgaaaaaagatgggtgctatattggatgtgtacagtttagctaattcttgggaagttatgtattatttacaaccaaatttaaaatatatctgagaactgtcctctccatctttaacctatttccttcaatatacttaattaatcacccagccctgaaaaaaccactctgctggagctgttagggtactgaaaacaattctacctctctaagtggcaggcagtagatgtttattcatactataatctggcatcttgttgtctagaggcaacctgctaattatgtgctatcgttgtattatccatgttatggaaaattcaaatatgttcactactgttagttacatcgcaaagcttttcgtaaaatatacttgatcctcaagaaacctactatacttaatggcaacctaaaccaagagtgtctctgccacttcttgattctgggacaccctgggtgccagctgtcacagctcagctaatgatgacaaatgcccctctctatgcagattgcagagcttgcaggctgctgtgaaaggcaaccagattacctttcttcagatagtaacttaacctttaaaactcatgtcagaatgaaatgatcagctgtgatagtttcaatatctgtatctttaaaaacaaaaatcagaataatatcaaataatgcttttaaaagtttccagtatttgtatgatttacagtgttttacccttgaatgctgtaatattcttaaataagaaactctgggtaagacatacttcacaaccactttagagtgtgtatttgaactctgcgtataaatcaggtaataggtaattgagaaaattctccagattgtttagtctaaaaaataggctgatgaaattttgagggaaaatatgttcttctcttcacctgaatgaatggtaaagcctcaattctcccactgcttgtacaagcctagcctgtcccaagccaatagttatattatgtcattaaaacttagttattccaaaatgatttagagaataattgttgctaatgattgttttctctgggtattttcaaatatgatcttttaagttattaatttgttctatagaaatttatcatattacagaacctatacttacatggattattcaaaacaataatgaacaccattaaccataatgtaattcagagggataaattacctattaaatgagataatgctttacaattgcaacattcttttcaatttacaaaggatttatatccattaattcatttgatacttaaaataattctgagctgggaaagatgggtgacaaggaacagggaccaatatttaatgagtatttaatctcatttaatcttcacaacaaatattagctcccatttacaaataaagagactgaggtttagaaaggttgcatcttaccagggtcacacaggtaattgcagagccaggtctgtctgactgtggctgccatcagcattacagtttctagactacatatgtccatagccagatataattcatagaaactgctactaggcttgcatttacataaacaacataattgatgagttttaaagataggttctttataggatgcttttaaataggtaaatactgagatacttttatgttataaattttaattttataaggataatgtattgatctatcacattgggagaaactatttaggaaagatatgtactgtttactgaatatcaaattggactaattcacctagataaccacttcattgtaaaacttaagattaatgggatatacctttataaatgtgatgaggagaagcaattatttcaataattacttgagtgaaatatttatatacttttcttttataaaggtttatccatatcatagttttactatgtaatatcagtgagctataccacccacaatattgtttttcagctcaagacacattgaaaacttcctttgatcatgaatttaagtgcagtcatttccaagaaagctatgccaatgccagttgtatttattctgtagtaaattattctttggtatagatactaaaatgtgaggaaattttttcaatgatacatatgattatattattatataaagactattttatgtactgattagtagaattatattagtacttatatagaattagtacttatagttactaatcagtacttatgctcaatttgtatttcactctacataaaaattaaaacttacagtgaaaattttactaaaatgtgtcatgcagttagtatcagggaaaaaagtaattctgccgcataagtcagacattttatatcagggcaggaaagaactctggaggataatgcaatgtaaccctcttcataactgtctgaatcttctctacaccattaccagccatggtaacaaccatagccagaggtggttatctaacctctacttttacctccatgaatgagaaacttactacctactcagatagttaattgcacttacaacagttctagtggttagaacgctcttcctaatattgaaccaaaatatttccccttgaaactttcaccttctggcccctactttcccttctgaatagtattatccctttaacaaatatatgctttttaaattcagcatttcagataccaagttgaacatactccagtctttcagctattacacctttggcatcttttaagtcacctcactgttcaggagccattctggtacatgattttcttcaagtacggtgcctagaaagtattactcctagaatggattggtacatgtaaagtggagaataatagcgaaacatgggtcacatgagctttttgggcatatccatacccacgcagataaatgctgtatgtcaacaaatatcttatttgtttaaacatattattaccgaggtcctaagtacatgacttttgtattcatccaactcatatcttgctatttttaggtattttttccgtgacttgacttataataataagttatacatcattattttaagaatcaataggcataacagttctttctaaaaatgtgttcataagctacacatagaatattcagagcaaaacaatctaactttaatgaatttaatgtttttgctcagtttaagtgtagaaggaagctaatccacttaataagacctcaggatacattgaatttactaaatactccacagccttcgtatagttttttttccaaatatttaaaatcctaatattagtttttcatagctttatcgaaatgtgtaactaagaagcctcatttgggataaagtatatactttatgtattttggcatttatcaattttgctttgtcaataaattttgtatctacaaatgaaatctgcaggtttcccacatgcttgatcaatgactagcaaactaataaactttcaatgcaaatagatgtgcttctaggacttgtagactgttataggaatcaccaacatattgatctacatattttaaccttttgacaataacaagagtttctaaataatttagcatgagcagaggtaaatacttttaaaaagtgatatttttaataacttgaagccaatgtgaaaatttgtaaattaaaccaaagtagtcacaagacccattatgctcagttgttttcttcaagtgcagtgcctagaactgaatattcagtatcacagagtgaactggtgaatgtagggcaaagaggcctcccttaagtattaaatacattgttggaaaaaacgtattctgagaattctcaaaacacatttgagaagcagtagtaaaatacaaaatgcattttaatatatattaattaagtaatttgtaaaatacaaaatacatttatgtctgtatgggtggcaaaaaaattgcattaacttttttgtgttaaagccttgaatttctttaagtgcaggcgcatgtttttatttgccaagttttttttttaatgaggatgtttcattactactttatttattactgctgtgacatctaggcaataaaagacaaagacagcctgcctgaaatttggctttcttgcagtttgtatcttgaatggggaataaagaagtccagtgcgtttacaacagaaacattctcaagtgaagagctgccccatctgtttcatctggtggcttatgcaataagaggtgttatcacatgaatctaaatgcacaagcggtcgttttatgaactctttctgtgctttgaggagtttataagttgcctactctattgtgtatcagtcccagctgacccaagtgcattctgctgggcatatttgggggataattagaactaatgaagcctggaatacagctaattctctaagtgatttattcttatgctcttctctgatccctaagaattctccaaatcataatctatgccacttattttttcctagcattgtgttgatacagctactttatgcttagctgatggacatcaaaagtaaattcggtatttgaaaggctgagaaacatgtttcaaagtaaaactttacgttacttattagtccccaggcttgagaagaatgccagttcttcaacattttatgtttttgtttaaatctcaaaatgtttatggcacttgcaagtagataatagcatagaaaatataaagcaataaaagctcattaaaaaatgtaccactgggaaatcaaacctacaagtaaaataattgaaaattattaatggaagtttcctatttcttaattaggtttcccaaggaaatctgaagtttaaaaaaaactttatgaatagctttcatgttccaaagctgtttcattaacctggcttcactgtcctagcagtgttgaaaatgatgtttctttacgtgccctcaccaagtagtcagtgattcagtggcctgtaacgctgtaaatcccatcaacttgctttcctttcctgttataactgtttcaatgagtggcacttttgttgtgcgggttcagatctggtagcttactgagggcacactagaatgaggacagacacaaatgccaacaaaagaaggctataactttattaaagccttatactcagtaaataagatagtggagccacttcagctaagtagttttataagctatgtcctatttgatcttctgttgtctagaaactatagtagaatttattaagaattgttagttttacctattgattccagtgtttaatatttaccatattctagagcccagataacaaaacccttaagggcaagtaccactttattagttagacatactgaaatacctgtactaatgtagatcaccaactagactgattatcaaccaaaggaccagttggagattcctgaatctcattacaggatacctaatccagcctcagataaattctagtcttaattgtataccctgacgtaagaagttactgtttctcatattttaccttctgcctaaaagtcagctaaacactcgaaaacatgtcttaggaacttgatgaaaagttgcaggtcatttttttaagaacatttttacatctttaaacaagacaaagaacaaattggtaaaattggctaaaactgagtttttgttatttgcaagttattctgctaggtgctttatctatattactgtatgtaccttcatcttctcaacactatgaagtagaaacttctggcctcatttcattgttaagaatctgaaacacagagaattcaagtaactcttccaagttcacaaagctaggagttagcagagttaagattttcatctatgccatctggccccaggctccagagtgtgctttcttagtcatcatatagaacctctctaagtttgtcttgtcatctgtagaacagggataattctgtgtcatagggttgttgcacaggttaaataaattaatacacataaaagtttatgtgttttaaaaagaatatttttaaacttatattacccaagaccacacagtaactagcaaagataggactcaaacccagctttttctatctccagacttctgagtttatgtagcatcatgcttaggtatgtttgttgaatgaataattaaatgaatatcatctgttctgtacttcccagtggaagattttgttaattttgctggttattttgatagcatatagcaggtactcagtgcctgaatgagtgaaggatttttcaaacaatactcgccaatataatatgttctatacattgatcactcttaaatttatatctctagccaagacctctccccttaatttcaagctggtatgttcagtggtcttctccacatcatctcacatatataagatgcatttcaaacttagattcccaattgagcacctgcttctccatcagtcatctgtacctcagtaaactgcagtgccttttttccggtttcttaggccaacaacatggctgtcatctttgactcctcgcttgcttgtgtacccaatatccagagtgtcaacaaatcctccagactctgcccatctctcaccaactttacagcttccatccttgcaagccaccatcatctcttaatttatttttggtgcccattatcctgtatgtgtactactggttatctgaggcaatatagaatgagaaaaagtacaaggaattatgctagggaacatagcttctcactaatattcctctgtgaggaatatgatccaataggaataaatgagaaggaatgttcagaaaagtaaggcggaaaactaacagatatgactatcttaaatgccaaacacaagagagttgtaataaaaagttagtggacaacagttcagctaccacatagagttcaaataacataaaaagttctttgtctttccacatccgtatcaatggaattgtagagacagaagcagatcacaataggattgaagagtaaatcggaggtggaaagtgaggtagacaatacactttcaagaaaagtaggattgaagactattctaagtgaagtaactcaggaatggaaaaccaaacattgtatgttctcactcataagtgggagctaagctttgaggatgcaaaggcataacaatgacacagtggagtttgggaactcagggggaaagggtcagaagggaatgagggataaaagactatgaattgggtttaatgtatactgctcaagagatgggtgcaccaaaatctcacactaaagaacttactcatgtaaccaaataccacctgttccccaaaaacctatggaaataaacaatttttaaaaagtagaaataaaggaaatgcaagagatagtatggtaattatgaagtgatgcaagaaaaaattttaaaggtatttgaacatatttagggcatagagaaagaagccatagaggagaggttaaagttaaaatgaaggactaaatcatggaggtctctctatctccaagatcagtagaaggaaatggtatcattgtcttgaggctacaatgagagatggcttttttccttgaagataaactctacacaattattaatattgcattttattttattccatatgtatttgtaacagtggagggtgagatgttgggtttaggataaacaggtggagatctgaaaatgtagcaggaagaaactgttgcattgtggaagataaatttgtagatggtggtttttaaagttggtggattatacaactaggcctcagttttctcttggcacttaaagcactgggactgaggtaagcttcaagaagggacttagatgtttaaactgtcactaaaaggaatgggagataacgatgctgaatcctgctttacctggcaaccctagatgaaggagaaaagtagatgtagtaaaatttctaaatagataagtgactgagatagcttaaacataggcagaatagtttactaagcggaatatggacacaggcatagactgctgaaatacaaagaaatcaaagaattttaagattaaggtacagaatagattgtctatatgaatactgaattctctaaaagtgattataagattctgggtggagagggaaagaattttggggaaagaagacccatgaagagtagaatgaatgctgttaagtgaatggaacaggagacaatctgagtcaccagagcctgcacaaaacaaacaaatgggcctaagaggggttgctgggattttggaagccaaaagataacttgatgaaatcctttgtagcctaatgctttgaatacttttgagagatttgataagcagttttatcatcaacaactaatgatatgggagtttatttaaatttattcctggagccagggaattcatagactcttattttaaaagaccctaacattccatatgaaagtgttttttaggtgtctgcccaagtgataatccactttagtatatctgtttccaatactaccaaagtgtccatcaggatattttggtaggacctagtcatatgttttatttgaagtatgtaaaactgccaaagatactttactcttaagtgttttcatatcatataactttctttagtttcccagtagagtgaggaagccctccattaggaaccagaaagcttgggttttagagcttgctcctttttgaatagaatatacaatctttattaatgagcttagtttcctgccctgtgtgatgaaggcattggagtagatgatttcccttctaaaattcattcagttctctgtattatttaactttgagatgagtacaaaatagcagcagttttacctttaaaggtgtatctcgtcatgtgcaacatataccttcctgaaaagttagcatatttttattatttgaattatatttaaatatatctgtgaatttattcttcaaaggatccttacaataaatcttttaaaaatgaattcattttataaatttaatgatttctttataatgtataatttcaaatttaaatctttagttattaaatatttttaaaaacaactctatatatttgtctttatgtaactttataaagggtataatgaatatgaatataaggaatacaaaaccaatgataagtaagaaaatagtaagaaagtaattaatcactttaaatgaattcatgacttcagggtactaacagaatttggaggtttgattgaaggaccaatcattgttgaggaattacagagacagtgagatatgtcagaagactagatgagagcaaaatattagagaattttgcttggcaccttctgatcaacaatggtaacaaaaatgtgattaagacttaagggaaaaagtcaagtctgcctcaaatcctgtgggtaagcaaataagatctaaatttttgaaaaataaatctgtagtctgataaattaagatgtattaggttggtgcaaaagaatcgtggtttttcccattacttttcatggcaaaaactgcaattacttttgcatcaacctaatatattgtaagccctagagccatcgctaataaaataactaaatagatgtagttaaaaaacaagtgaaggaatggcaaaagaaggcagtaaaggaggaagaggtgaacaaaaaagatatgaaagatacagaaaacgaaaagcaaaatatcagatgtaaatccaaccatatcaataatagcattaaatgtaaatggattaaacagtccaataaaaaatcagagacaggtgcagtggctccgtaatttcagctctttgagaggctgggatggatggatcacttgagcacaggagtttgagaccagcctgggcaacatggcaaaactccatctctacaaaaaatagaaaaattagctggatatagtggcacattcctgtagtcccagatactgaggaggcttaggtggaaggatcacctgagcccatagagattgaagccgcagtgagctgtgaccacaccactgtgctccagactggacaacagagtgagactctgtcaaaaaaaaagaaaagaaaagaaaaaaaaatcagagactgtcgactgaattaaaataaaaataagatccaactctgtgctctctacatacaaccagatgctgttaactatgtgttttgacccagtttaggttcaaagatacagataggttgaaaataaaaagataaaaaaagatatgcacacaaacagcaaccataaaagacctagagatggctacaataatatcagataaaatagacttttacactaaataaagccactacatacaaagagaaacactttgtaatcaaaaaagattagcttataggggagttataacaattataaatatatttgcacctaacaacaaagcccaatgtccataaagcgaaaacagatagaattgaaaaaagaaatattaaattatccaataatagttggaaacttcaataccccgctttcaataatgaagacaataactagatgtaagattgacaaggacatatgctcctcaatttacaagggtgttgcatcctgacaaacccatcataaattgaggagtgtattttatatgtatcatttttgcaccactgtaaagtcaaaaaatcataagtcaaaccatcataagtcagggcacatctgtaaatagaagactcaaacaacactataaaccaaccagacctaatacacatctgcagaacactcccaagaacagcaaaatttcttagtgcacatggaacattctccaggataaaccatatgtcaggccataacacaagcctcaataaatttaaaaggattaaaataatacaaagattttttgacacaatggaattaaaaatctttctacagttgacaaactgaacagcaaatactttggatgataggcaagattcataaatgatatagaaaccatgccatgtgacttgaaagaactgaggctagtgtacccaactaaggagtctaatttggatggtagagatggggatgaagtaggatataatagtttcctctaagaagcctgtcgtttatagcaaggagaatattaatatgtatacatgaccttccagaggacacaagtaagataattgggtggaagttacagcacaaaataaggaagaatattataactgtacttttcagttcagtaagatataggcagtattgtacttccctttttaaaaaaacaaggtctcattatgttgcccaggcctgacacaaactcctgggtttaagggatcctcccacctcagcctcccaagtagttgagagtgactagagtcacatgccactgtgcctggctctactttcatatattgtgttccttaaattggatttttaaagtcctatgtagaaaagccaaacaaggccaggtgtgggggctcactcatataatcccaatactttgattggctgaggcaggaggttagcttgagcccaggggtttgagacccgcctgagcaacatggtgagatcttgtctctaaaaaaatgaaaaccttagccaggcatagtggtgcacacctgtggtcccagctattcagtaggctaaggtggaaggatcacttgagcccagaaggttgaggctgcagtgagcgatattgtcaccactgcactccagcctgggttacagagtgagattctgtcaaaaaaaaaaaaaaaaaaagaatagaaaagaaaagaaaaagaaaagtcaaacagtggtttttaatagctgttcttctagcaaggataagtttaattcctgcaatatgtcttttctcaaaaagtcaaggagaagccttaataactggagcagcttggtgtgcaggcacctctaccgctcccaggactggagctagaacttagatattgaatcaggacatctcatgtctttctcaacaaaataatgctcccttcccccaaacaaatttaccaaactctaaatatattattgcacaacttccttatggtttggaaggaactttttcctaactttatcaaatctaaagaaccatgaagcaactctttctcctaagtctatgcttcagtcataagcactgtgaattacgcaaatagcttagttagatatgtagatgagttaaaaatagaatctgcaaaacaaaatgcagattgtacaaaaattaaggatatgatcaccagtccaggatcacctccaataggttatctcataagctgtgaacattgccacttaaagtgattcactcagggcctaaggaaccttctgtaggagaaattgaggaagtgcttatactctgtatgatttcatatacacatacaaaaaagtggactgaaaaatataaatctattttgccagatgttcttaacatttatatttatctgcattaaaacaatgtttttgttactggagagtggaattttcaataagattttaataagaaaaattatttcatttgctatattctctcagaacataaattacactgtagcagtaagttagactttctttcatactctggaagtacattttagcatattattcttccagtaaactacctgatatctatagagtgctgaagaagttagcagccagattatttggtttacctacaagagattaatttgcatatcagcaaggtctgcataaatctgggtgcagtatctttcagtcttttctctgttttgtaacacttgacccatcaatttagatagtaccttgcctgaagtacaaaaatgaggaagacatgtatattatctcttttaatgataggcaaatgaggaatcaactcttacaggtgtctgggagatttcagactatgtatttataatcttatttaatattatataaccaaatatttttatgcctttccactaattttctaccaaatgcttaaagagagtctatttagaataaaaaccacttgaatggattatttatattaagagcttactaaacattctttgtaatattggctattattttttaccttgaatgtgttgcttaaatttggactttttctcaaacactattggtattttagtggcaaaattatttaatggtagatgtttaacattggagatcttagcatgtattgatttgcacaaaaattctattctttaaaggtcatatgtaccaaatttcataaaggaaatgcattggagatgcttagtagacattttcttaggcactaagtattacttgcttataaggatattttactgtttatgtataggttaaatacttcacttgtaatgtccatcttgtaaagaaagtcctctctgtgttgaaaatctctcattgctaatcttgtttttttatatgtccagtaagagttaccaatatatctttcatgagctatggcaaatcattgataattactgttcaatttattcctccctaggcaaatgggttcctttgtagtacctaggacaagggatccacaggcaggagtcctctggcattgatgactgatggaataagccatagtgacacatagctactataccacatgagagcatcatgatttgtttattttagaactggttgtagcaatattagaggatgaaatgattttcttaaagcactaggagagtggggactacatcatcaggataacttaaagaaaagctgctcaaaaacaaagtgtcccagtctcttcaataaattgtattctctccttgactatttaatttatgcaaatgcacaatgaaaatatttttgcttcatatctgaatcttcataagaaaatgtatatttaaaaataataaaatcatatttttcagttatctacattaaatcttttattcatgttatagtttaattacatgatatctgtcttcaccaatggaaatgtaatgtgctaaatgctccattaattttttccccttataccttatgctcagttatgcctggtacaaacgacatatacttttctgatattattgatgaggtgttcatgacctttctgttgagatttgtgtggtggtgctgtttaaagaaagagtacttagtggaatttgtgtgaccacaccaggcaattgaagaataggtattatttctggccttggttctataacccaagttaattataatcactttaagaagaaaacagtcttgctatagcaagctgttttgggttttctttttctaaatgagagaaaattgatgtgatgctttttacattgcattttacagcaaagcataagatctgtttacctggttgaaattcaaattgttttattatggtgtcaattctttggttttggcagcacttctaaagtgtctattcacaaaaagactcccatagtgaatgaatgctagtgttgacaccacctaacaagcagggattatgtgtttacagaagaagtaatatgataggtcaagtataagaggcacttctcaagagcacttcagcacataatgagtgactgactagaaagtgcggagctgccactctttggcttggagtccgtgttgatgcctgcctctcttctccaaagctctcttgatcatgttcagctgctctgttctcatgtggggaataatagtagagtaaagctgcttttctgtctcatttttcttgctaatttacacattcaagccattttttgtttgctacccttatttgctattcccttttgtccaggcactgttctcttttttgcctcaggcctaagaactaatttgagcttctataattacttcatgttttacacctgtctgcgtatcatgcacccgcttgtctctgtacttaagctgtatatttccttgcagaaaagctagttttcatatacaaggactcctaagtttctcccctcagactgcctacagaagaaacacaattaaactgttgcgatatcctcagccatgcagctgacctttgcagttcatgaaggacaaatgaacgctgtctgctcagacagtttgtgttaagacattgttgagcagagagcctgagctttgttcctcatgaatgaagcaatggttgtagtcattttaaaatcattaagactctgaatgcacagtctcattctacagtgtttgctctacagctgctcttctgctttaatagcagcttattaaatttgggtcaagcgtactctgaagagtatcacaatgaagaaactgttctaaaagttacctgtttaaaaaaaggcaattgattagatttttaacttaagtgacagctgcaattcattgcctattctttgtgatgtcctgcagcccaagcagccttttgtaatttgggcttcattttgcaagagctttcctgaacaatccagggttgctttccactcggagcctgcttcaatccaattaggagtttaacaagggtcaaattaaagagactttacacttcatgtttgcatcattagccataagactgttatgtgagtgcatgactgtgtgtcagggaagagggggaaaggctgcaggatgggacagacacaaagctgtcatccaccgtgtggtgtgctcctttactgatggaggctcagcaggctagcaacaacatttccagttgtcttttggggttgctgccttgtcaaatcagctggtatatagttgtttggaggttacaggtgctagctggggctgataaagaagagtgttttttgcctactcttttctcttctggtagtctgttgtgattggacaaacgactgggaagacatgaagttgaaacctcttgagcattcattatttttgatgagatgacaactatctaggttcatgttctcactcctcgtgctctttcctggctcttcttttttttttttttttgaaaacataattgttggttctgtaaaatattatcataggaaatggaaactaatttttaggagaatagttagaggctttgcaaagaccagttacctgttattcaggaaaacagagttcactatagtattttcagaattgtgttacgtagaatagcattttgctccactttgtccataccatcaagatatatttatatttagccatattatgttactgtttaaagaaaatgacctgtttctaaaaagaagagacaatagaattctgctaatcagcagttccatgcgtgggatatcgctagagaactgttgctgtgccccttgagcaaagctttgtgctgctacacacaaagtaaagatttatctaaaataacactttcattgttcctttcttacctcctcaacccattaataggtactttagtatcatgagagttttcatagtttaatcccctttcaaaagcttttcagaataaaagctctaaatggtcctcagtattaatttgatgtgacttctgtacaatatggtttaaaactctcagaagcacatttttactgcttaccctttttcatcagagcaacgtgtggaaaataccagctaaatgtttagtggagtctctattgtgagccactgttgttgctttctgataacatagattttcaattaaaaaattattgtcattgtgatatatatgactgttaatcctcaagaatatttgggctctccatttttaaaaatgtaaatgtcttcttgttatttttcaaagctgtagttttataaagtctctgatttgcaaagaattgagagtgagtaataaagtcagcctggtaaatagtaatcaggcttgattatatgcactcagttacatctttgtttatatgtagaccacagtagcttcaaacacaagagcttccagcactaataaataacctacctcaccttttttatgtgatgcttttgaatacacatttatctttcttaaaacagttaatatatggtaaatgtaattcttgctgtctgtaaagcatttgatgatggaactatacattccatgccaagttccatttcctcgactcctcctgcaactgcaaagcctccaatatgacgggggcggggaacccctattaatccttttaaattccagatcccctctctgatttttttccacattgtcagaggggatgtatgtatgtgtgtgtgcatacatgtgtatatacacacgtgaacatccttccacagagaaaaaggtatttatttctaaaaatatttttgaagcacctgctagtgctagggactgagccagtgaaacagcagagagagctcaaacaataccaccttgcctgccggggctttagtggagtggagagatggacagaaatcacaggaaacaatgtaaacttacgactgtgaatgtgctcttattggggaatgtgatctggtcagcaagttcagagacagttttcctaagcaagtgaccttaggctaaccttttgaaaacatcatgctataaaaaatttttgtttattttctttccaaagaactgaaaatatttctgcatatgcttcgaactcaacaaatttacaaacataatgaaatttgtgctggtaatatattaggtaaaagaacatgtagaaaagggcatctggaaggagatataaataattataatttctaaggaaagttttaggctcagttttaagttacatttatggacaggaatgagcaagtgacttctaaaactattcctttttcttcattatattttccctgggtttttttttttcttttctttcttccacaaagttttttccatgatttatctgcttaccgtgtggaagcagattggaatcttccactagtgaatgaacagtgtgctgggaccagatcctctgggggtttgtgggtctgtacattcagtgacctcactatggtagcttgaaatctgcttatgacagtaggatctatacaacagaaattggtaaaccctgcaaattctcctcccctccctgcaccagcttgtttagcagcacatccgtgcttatgtctgatacagtacgtgggatttgggcctgcaaatagatttgggaaaaagagtccataacacagcttccctccatagctccaaaggagctataaatggaaactagaaagcttaaaatcaagttttggattttttttattaattaagttttatgagttttaaaatttagccaattatatcatttatcttttaagataatagccacaactcctccccatggattaagtgatgattacttttttaaatgattgtcttttgcatgtaaatgtttactagtttccagtgtaatcacaggcaatataaattcgaaggtatatttttaaactgcacactaatgacctttatcaatcagtctttatttttttccttataatgaattaaatgttgttgtgctttcaaaaccaatgtactcattggttttttctaatataaaagtaatacttgctaaatacttaaatattatagtgtagtcaatatataatagtataaaaaataaaattaaaattactgataatcaaacagcccagagataagaatttaaaatactatacattttcaatgtatctgtctacatataggtagatatataatttttatagatcatagtataaagattattttgtaacccacattattcacacaaaaatataatatgaacatatttctatatcaataagtattgatctacattatttcttttagtagctacataacagttcattgtatgaataccatatattaataataactaatcacctacaggtaaacattttttgatattttctctattttaaatactgtataattttgtaaatactcttttgtatacttgttcatttaccaggatacatttcttaaggtagcattgctggtattgagaattcatggtttgtttcattttgtttttgaggcatctatacaaattgcttccaaatttcccttcagaaattttgtactaatatgtaaaatagcatattggattatttatgttattgctcctttgtcaatataggtattattattcttatttatttttgttaacctgattaactgatcatcacactggttttaaagaatctaattttaaaactatttcttcgtgctctatagcttgtaagcttaaaattgacttcagtatattaaatgttattgtattatttttcaattttgattattccctaagagaaaggaacaaatacatgatttgaagtgtgcaaaatttatgtaaaaatatgagaatacagttttacatgaaagacctgataaaatatatattatgctatctaggaagagaagcaattatgaatattcatttacagttggatatttgagatatttcacattcttcacatccattcatgagtgaatatttgttttagaggaaacattttggattttaaaaccagaatgtggagtatccctttgtagaatgttgccagctaattgaagttacaaacaacaaaacaaccaaaaacactgcaatccaagcaaagcgtatctgaagcaaaatttggcctaaagcctgccagtttacaaactctgcgttttgtggctttcttcctatgtaatataatacacatctaaccagttcttaactaaaactgtttctcttcctttccctgaaaccttagtaacacctacctgtttagattgagcatgcccaacttggaggctgccacagttgagaccgttttgtctcatctcacacccatcccacttcactcttggacttcacttgactttatctgcagttgctgtttttgagtatgtaaagataaaagataaaaatcttttcatttacttatttttctttttttctgatattgttaatatttaagtattttatattgtaggtaggagggaactttttttttcctcttttgatacacggtctcactctgttgctcaagctagagtgcactggcacaattatggctcactgtagccttgacctcctgggatcaatcatagctgggattataggcgtgcccccatgccaggctaattttcttatttttttgtagagacagaggtcttactatgttgtccaggctagtctcgaactcctgggctcaccaaacagtcctccccgcttggcctcccaaagtgctgggattacaggcgtgagccactgtacccagccaatatgtttttcatgtttaaatgcaatgttgcttattttttggtataaaataaaaatgctacgattatcggaacctcatttgtatctcagtaaattactggcttgtattaatttactgcttaaagtaaatattataaaatatatattattttaaagaatgtgggcagaaatcagaattcaaaataacatttttaaaagaggctatgccattagcatacatactgagatatgcatttatttaaaacatacctatacttgtttggaatcatgcttactatgttcatatgaatccaacattgaggtaaaaactggctttttaaaaaaaattagttgacaatagacatatagagtttgagtttagacctataaatagctaactattatttcaatgatacgtatttggcctttgacctttgttgcttaaagactagctcacgatgctccgcagttaatgtaaaacttagttaaaccatggcgacctattccggagtatgagaattggaagtgagaaatggaagtaagaattctgaactgggagtgtaatcagctgtcactgtttaaatagtccagttttattatttctccttcaactcttcattttttcatgtaatgagcgtaaatacggactttttaactgttatattagggatacatctatgcctaagctgaagcctgaagctatattttaaatttgtgattccatcttagaaggaataaccagagtacaattttgaagaaataggttaaaaatgcattcccttaataactacagttttctcctcgaaaaggttaatgtagtaaaataaatactatgagaggtatccatgagttttaatatctggaaatcttttgtgtgtgggacattttaaaagttctttgtgttttaatgaatattcaattaattgattttaaattaattagatttaaagacagaaagcattctactttagtctgcatgttcaacttacagatttgattttactcataaatattttgcatataaaaacaccatttactttcaattaatcttcaattcaaatttaaataactgataggtttgagaaatcaaattcctttaatcacttaacaccagatccatactaattcatcagattctcttatatatttccaacttcatctattaaatttatttatttattttattttttgagacatgttctcactctgtcacctgagctggagtgtggtggcacgatcttagcttactgcagccttaaactcctgggcacaagtgatcctccagcctcagccttcagagtagctgggactacaggcacgtgccagcacactcagctaatatatatatattttatttttgtagagaataggtctggctttgttgcccaggctagtcttgaactcgtggcctcaagtgatcctcgtgccttggcctctcatagaactgagattacaagcgtgagccacctcaaccagacccatccattaaatgtataaatctgatttgttactatttacggcagtagtttaaatacttagaattttttttttaggtttataagtctgccttatgttttttaagtgtttgagaaatcaaatgtattgattcagcaagagtaatttgaaattcttacaaagaactgtgatagcaaaatgctatagttaaaacagcccaggggtcaggtgggttcgtgttctgtccgtccctcactcattcccaacaacacagtcaaaagataaatcctaagtaaattaccccacaaatttttgagttagaatttgtgataaattatttcattgcaatttttcaaaataaataaagcctcaacatgatttgtcacaagtcatagagccagttagaagaactcaacctagggctcgtttgattcctaggtccatgttcttaactccaaaccatttctcaaattatagaaccattgccatagagtttgaaggtattttctaagtcatctggtctaattctacattataggactcctttcttgaacatcccttttaatatccatccattttgaatgtttatagcaataaggacctcctgttaatttttccccttctggctactgtcccccttgtcccccttaaagctatctccaatgacttctttctttctttgtcttaaaaccacttaacataggctttgcttccaacacttctctgaaaatgcttttgttaaggtcaccaatgacctcccttttacaaaatccataggccaatctctattctatttacataatttatcataccctcatcctgaattgaaactgaccttcccttccaggatgccctactcctgttctacctcactcgcttctccttttcagtcttctttgccaaaattctctccttttcttcaaccacctaatgttggagtgtcccaaagctcagttcttggacctttttttttctttttacaattactctcctggtaatcttatggcttaaatatcctccatatactgaaaactccaaaatttctatttctagcctgactctctttcttgaacttcaggctcttatattcaaatgcctacctggcatttctgcttgagagtccaatagataaaccaaacttactttgtctagttttgaactcctattttcttttccactgcccttcccaattcccaaaatattgctgtacctacagtctttcttatcacagttcctttcagctctttcaatccagttgttcgagccaaaaccttggagttaatttgacttctctctttctctcacacccaacatatacagtctcttagcaagtcacattatctctacttcaaaatatatccagaatttaacttgtcaccatctccatggctaccatgtagataagcctcttctgggtattctttaattttgaatgcaccccgtacaatgaaatactcagaaatggcctgattgaacgtgttgcaatggaattgctctatcccttttccatcatcataattcattctaggattgtaaggatcattttagtagtcatgtcatggtgttgactggagtcaaccaaagttccagtatttcttttatattaattgctgctagataggtatcaccatctaaaataattaagtgactatcacttgtggagcacctacatatgcaactttgtttcattattacccttaaagataggaattattatctcaattggtagatgaagaaatagagactcagaaaagctaagtaatttgcttaagatcacagggctagaaattggtagaaacggtagtagaatccagacctgtttcactttaaagccaatccttggaccatcacatatgaagggctgcagatgagaaagaacatgatacactcaaggatttgaaaaacatgcaatatattgggaaagtataagggacagaatgctggcaagaatcagaccagagagggaagtgctcagttttgagggatattataagccatatttgaggagtttacattttactgacaaacattgggaaggtactattaaggtatttcaagcagatttacttttctaattaatgattactctaatgttagcatgaagaatgaattggatgacaacaatgctgagttttaatggcctaaactagagtagtagcagtgaaaaaaacagaaattgatagatcaggtggatttcaggagtaaagtggataacatttgtgaactgactggatgtgggaggtgagagagaggatgactgccaggtttctggctgagtggttgataacattcattcagaatgaccattggaggaaaggaaggtagtgctggaatgggtataggagatgtgataactttacttttggaaatagtaaaaggaatctaggagacatttcagtggtaatacccagatgacatctgatctaggatctaggggagtggaggtctcagctgcaggtaaatctgtgaggtaaatctgtgagacatcagaacatgggtggtaactgaagtcacagaactggatgagttgaatggcggattgtttggagattccatggctaaactggggctccaatatcagagtgtctagcaatcatgccctaatgggaaaggaaggggagctggacatgagtgtctactgtgtgcctttcaatggatatgccttttacctgcagatggcctgatgccttattgtccagccctgaccaggagtccctcccatgggtaactgtttataatggcggatgccattgtgtctcttgtctgacctgtgtctggcgtatgcctgcctgaccgtggctatggttctgcaaacccaaccttgtggttcccccttgcatcctagggaaaagccagctggtagctggctggtagctggttcttctaatgaaaggcacaaattcgatacaccgccacaacaggaaataagttcagaaagctgttacttatagatcctgggcagggaaggcaccatgagtcaggagggaagttctctgtcccaggtcatgtgaggcaggtgtgtagagtcagagagagagagagagagagtgagcgagtgagtgcttgcatggaaactagcagtatatgtaagggaatgggggcaggagagtcactttaagttcgtgggcaaatgtatgaatggtccatttgaaggaaatggcaaaaaagctaagagcccagtctgctaggccagagagaggcctctaagtttttgtatttggccaccggcttaagccatttgtggtgttctacttctagtacctaggcagcaacctttgctgtgttgtttccattacaaagatgccagtcttttaaagataggaaggagttgtttgcaaatggcatttaaagaatagatagagagttagtgggaaaaaattaggagagtggtagtggaagtcaagaaaagcgtttcaagaaggatggactgaccggcgaacagtgccaaatctgaaggggtcagctagatagggactgaaaatagccattgaattgaataaggcgacagtcactatgaaaagggttgtttcagcagattgtcaagggcttaaggatattaagtatttttcatttttcaagctaaaaggggagctcatttcagtttattaaatttcatcttgcagacttcaagctaacttctacttcatgattttgaatgtcaatagatctgatctgaatatgaaattctgaggaagatttttccttatagccactaactgtttattaattattctcaacatacttttgaaaacatttgaaatgggtttgtatcagaggtgactccagaatttctgtgtagaggagattaagactgtgagcgtttgaatggagaattgaaagaacaatccatggaacttgtgtgtttccatggcctatattacaaatcaagaaaaacagtgaggtgttctagagaggtttttattcacaacttaaataagtttaaggaaggacacatgcagcctcatacaaccgctctttcttctgtcattcttgacatagttttgcatttttgtagcatccatgacatgaaaataatattaaataccttagtgtccatttatattttgacttaatttttcagctctgttgttctgacctatctgggtaaaagtaatctgccttgtgttgtaagtgttaacactaagggcctgccatgcaccagccacctcgctgggatgtgtgaggatgatgtttagatagttcttgcaccagattttttaccgtattacacgttactgtctgttttttgactcagaaaaataaaatcaacttgcaaaggaataaaaaagaaggaagaaagggaaagcaaggtgggaaagaaggtaaaagagggaagaaggaagtatttactgagcatctgactaggtaccaaacattatgctagaaactttcatgtatagtatctcatttagtccttacaattttgttaggcactcattttacagtggagaaaactagagtttgagaaagtccagtaagatttattaacttatctaaaagctatgtaggaagtaagaaataaagctgagatcttattaatgtccagaatgcttgccaccacacatcatgccatcttacctggaaaattcattttcctcattttaatattttagtcctattatgacttcttaatggattttcagataacataataataagtagaaaacatgaaaataataaaatatggtggattataagtacatcattcaagtttgctattgaaggaaatgtatgtttcttttaaaataatgtgatccatttaaatatcagcaatcccaagtaaaaactcaaataaatactcaagtaaaagcttgggctattcctgaaaatcattgttagttttgagatatatttattcacatagtcagcctgcaattgtcaagcaatatagcacaggaagcattgttcaagttgctgtggaatacctattttattctctgcttacaatgactggactttaaagaatttttaaccacataaggacttttaaaataatgtatttattggtgattatcaatatataacagtatgttgcatatataacatacaactcagaacacgtaagtactttaaagttgacttaaacctacaatgaaatattaagtacagaacctattacagatttttcgagcaaggaacccatttgacaaagaaagaaaaaataatcactagcataattattactggatttgttatccacacatccagtatctctcaaccctcatcaggtgttgattgcaatgtatatttttactctaaagtattctatgcaagtagatatctctctatatatgcagttagcaaagatagtcaaatatactgctattagtaaggcagcattacactgtatcatattacctatgttaatacactcttcaaagaagttatataatgttttaattttttaacttctacaaatattttttaaattatcccatatcttgttatttgtaatataagaagttaggtattgtgtattgttaatatagcagttacctcatttatttacctgagagtactgtttgcaaataattaggagaatgacaaaaaagtatggttggaaattgtattatctgtcagtacctctactgaaagttgtttttaatgtccagtggagatgttttgatatttataattgactctactttgtttgcttaaagtatgttttgactaagctatgcagtgactatttgaagatagatattctattcaggaatttttaaaacctcaatgtctaaaagaactcatcaaactcacccgtcttgaactgtcagtgaaagcacatgcttttaatttctaacacacattagttgtgtttgcactacaggtacacaacaggaagtaaaatcgtgaacccatagcttcccagtatcaattaaaatcttggctgcatgaaacagtattttttgaggattacctgatggttgaagggttcattcattcctaaatattctgtatcctgggattaaacctgaatagcagaaactgtcaacctggactttcatgttggcccctgttctggttaaaatctttggttgcatggaataggcttcattcaagttacctcaagcaatagatgctataggtatatatggtctggaatttaaaaatggaatagctgagtcagctttagggaccaactgctctgtttgtctttcataaaccatttggtctgctaatctctgagcgttcttttcttcttctcaacagataatcttcctgtgcttactcaaacagctttggttccttgtactttcagcttgcctgagtcttatcttggctccctggcctctcagtacattgtgatatttcagcttcagttcctactgccacacagttctttctgcatttcctttttctagctctctacagaaagaatctgactcattctactcctattttttagtcaggccaaaccacggactattggcaaacctctggattagctgtcgttgattcagcctagaggaggtaccttgcggtcctcataggtcgacctccttccacaaaaactgtggctgagcccatttctctcagaaggcagctgcaggctgtcttgtactacctcatggtaggattgatttttctaagttgtgctttgggaaatattgtaagccttgaaactcagtgtaaggttattgttgaagacattattgattatactatacaggtttttttaaaactcttggcataaatttatttctagctttagtattaggaaataattgtgcaattattcctgaactcgtttgtttttatcttcattacctttgtggtgaaattattacttttttcttttttttttttttaagatggagtcttgctctgtcacccaggctggaatgcagtggcgcaacctcggctcgctgcaacctccacctcccaggttcaagcgattctcctgcctcagcctcccgagtagctggaattacaggcgcctgccaccacacctggcaattttttttttttttttttttttttttttagtagagatggggtttcaccatgttggccaggctggttttgaactcctggcctcaagggatccacctgcctcagcctctcaaagtgctaggattacaggcatgagccaccgtgcctggcctattacttctttttcaacattgcctgttgggagttcacaaatttgtgccccaaacacaggaagtttaaatgattctgtggtatgcttttttagtcttattatccaacttacacctgaattcattttctgtttttcacctttttttaaatatatttctaatttgaattataatttatatattcctgtaagtcactttatatcttttcagaagtgaggtatagatgtaaagtatataaattataacacattcaggaacatgttcatgtttccagctagtttttagttaaatgtgagcaaattttaaagaaatggacaaagtattggaaaataatagtatgtgacatttttctgtatttaagtaattttaaatcatccagctacttttttaaaaaaacctaaaattcccattgggtttagaactatctttcaaatataatttgagattagaaaatctattttattacacattaatcattttttgtcataactatttgtaacatattctttgtcatggagaaggtagtagaagtgtaataaaattaatatacattttaaattatttctacataaacccgtttctaaaacagcagcctctagccctccaacaataacatactcctaaaattatttttccccagactctacttcttggctactcctttagaaaaaaaaaaaagaaactgacatcaattttatataaaagaagcccttgaggtggaaagttgggaagactgcatgagtttatagcggacaaaatgtcgcttacattttgctgctcagtagtttgatatactcatttgctgatgtgaaatgacgagggcttacaaaacagggttttgttttttagctgcctgtagacctagtggggcctaacagaacccagtcagcaggtcattaactctggagaaaacagcttgcattaatatgctctaatccggtataattagtcaaattactgcacgccgaccagcttgtcatgtgttgtcagacttggcatgtacgctgggttgcctgggtccctctggaatgccaccctcaatcagaaaaaactgctcatttgtagtgggtcttgaactcttgatgcaaaagcctactaaaatagtggtcatagaggaatttttattaatttttgagaaaaaaatattttcatcaaaaataatttagtactttggtgattgaaatggaatctgttcatttttgctgttttctgtaccatatctatgtaatactccaagaaaaattaacattagtgcaaacaaaaaagaggtcgaaaataaataattaccggttgatcatttatcattccaatatatggcagtgtgcatttgtaggtgtttgtgtatgtgtgggtctttttccagtagggtaagaggttattaaactctaaaagggctacattagcataaatttacaagagctcttgttctggcggcatgacaaaaacctgtgttacctttgcattaacactgaattgcttgttgtgcttttggcaatgacagataagtccgtgtaattccccattgcaacagaaatgatgctccagattccaaacgcatcctgaagatgtcactgacaataatcttcaaagaacgggcagtgaaagtgggctgtatgtttgtaggatgatatactgcaaatgacaggaagaattatgtgagtgaagacgaatctgtaacatattattaagcaatttcacgagaataacagggataaaaggataatggatgagggtgtcattattaccttcatgtagagggaaagcaaaagcaaaggtagagagacaagattaattgaggaagggtgaagcattcattgctcatcagctcttttgtactctttgctcctgaaattccagactgaggaggggaaaaggtgctcagagctgcattttaatgcatctggcaaagagtaggatactgacaaggcactttttagccacctccctttttatcaaaatacacataatgactgttaccttttgaatgttccaaaatcacagcaaaaattcagcagaaggttttattctttgtgtatatatgtatgtgtgtttggcagctttgattattaattaagcttttaaaacccaaaattataaaataccaaaatggttttttccatgcattgccaaaaaattgctattttcaatttagagaatcacgttctgtgatgaaacatttcaaaatccattatattattattttgattagtctgaggacattgtgttaaaaaggcaatatattttataagcagtttttactctccattttctaagtacatttccctttcatgtagtaactggttttttttttttaaatttaaatatattttctctttgttaaatgaagggtgtgagtaattaaaagcttaaaatactaaattctccatttatatcttttttaattacctgtttcttataacttctcattgggccaattactccaaagcacatattatatcacacacaataagatgcaattataacatagcaaccactatccttctggttgcagaatggtggtaacacaggtgttttgctgtaatctaagaaaccttttggggcatgaaatcccttctgattataatttactcatgatacggagttaaccttaaacattgtagaaactttaaattatatatatgtttctgtgtgctggactagtagaaaaataaaatgatcatattacaagcttaaatatgtatccaatggagatactcactcaaagattaatttgggaacaagaagcctacatttcatccttgtctacatagcaagttcctatattcaggaaaggtaacaaaggattaagattcaggagtcagtcagaattgagacccatgcaaggctgatagccagataataatcaagagtgtaatgtgtatcatacacagacatgcatagcagtaatgctattaaatgctacacgtatataccatctagtaatgctatattttattgcatactgtctctctgtatgcctataatgttttatccttgtcattttctgattagcagaactagaatttccattttagttctataaatgggaaatttgaggagcagaaaattaaatgagtctacccaggtaattttatagtaaatgatgcttctaagaataaaaccatcttcagatacctcatccaatctacattccatttgctgtttgattttttaatttgttattcatgccacattctgttttttgatattttgctagttttgatatgtgtcttttaaattatcttaaatgtttcttcactaaaggagcatcctctgccttatcttttctgtagagtaagggaaaagaaactaacatttcccaagtacttaatatgtgtcagacactgttctaggcactttgtatatattatctaacttaacatagttataatagctaagtgagttagatatcattatcactgttttacaaaggacaagcaaattcagagatgtccagttatttctccaagctcacaactgggaagtgttagggattcaaatctaaattttcctggttccaaagatcatgttctttcaattactacatactcacttactcttgtctatcctatatcttaacatatacagtcaaaattatactgtctttttacatctatcccatgttttagatctccaaatgtctgtattcagtggcctttttctgcccacatattccttgatttctgcataacatttgacactgagcttccgaaatcctaaacatgcttccttgccaagtcctccgctccccttccctggccactcttccgtcggcctcgccctcaatattctcccatccccaaaggtatgtcctttcagtcacctccattctctgccatagagatctaattccttttcgtgctttaaactttcactgtgtacagataatcccaaaggtacttctctagtcttgtcttccttctacagctctatattcttagctgcctgctctgttgattagctcttagtatgctttgattatctcaaccaagctcataattttccttttttctaatttccttttaacttcccaattttaaaagatgtcgtgattctaatcacccaggccttattgcccatttgaattacttagaaattctttagctcagcatcagaagcctctcccacctctttagcctattggagtttatctcccatctccatctttggcagatcaaccatccttcaaggcccattatcagatatcatctttagtaagaggctcgccccaaaccaatcaaacgtgtgtatttctcacatctttgaatctccaatcaatttgtaccttctactatatattttattgtagtttgtcttttattatttctatagttgtctactcacttccttagacagtaaacatcttgaaggcaggaaccattgtatcttatacacatagtacttggaataaccttacaagatacttaataaatatttgttgaattgagttaaataaaattatctgacagtctcaatcaagtatttttaaaatattttttcttttacatgaaaaagcctttactatgttgaaatttaatattaaccttttgattatttgacactcttgaatgtattttctttcctaatttacatttatacattgcaatttattatcataatagttaccatttaatgagcatgtacttcccttggtactttgttaattccggatatatggaggtgagcaagtccctaccttcatgaaggtcactatttccttgagaagatactgctcttttcatatgacatttcataccaacagtcctttgtagttatatgtatgatatatggaaaaaattaaaaagagaaattagagcactttattatatatttagatatatcttaatcttaattatattaaatccttataacaactataaaatgtaggtactatttatccccatttaacaaatatggaagcagactctgagagtcaaaggtactttttccaaatcacaaaagcagtaaaatggcagagccggaaatggaattaaagatggtttaaagccaaagtctgtggttttccactgtgccacatggctctgcatatccttgtcttagcaaagagatgttacatgacaggagctcttaactgtaactcctgtatttgcctcaaactagaggaggcagggaacattagtcataattatgccagacgatggttagaatggtattacttgttaaacttagggaaagcataccccctgcagttttataaaaggaaggaaaatatctttctacttttgtgcaaaatgcccaatcaggttgagcacacatggttgccctacttgctagcagcagtcacaagatcccaattattgatataatttgggtcagagagaatgttttctgcatcctaccgagctttgatttggggcggtgtggggggaaggttgcaggatacctcatagaggctgacactttccactgcatgtgctgctgtgcagatgattataagagagcaattcttcattcaccataagtccaaatcaaacgtagaacatgacaaatagaattagttcctctcttccctttgcattaagcaaatttgatgcttcgttgtgaaaggaaaaagcaagcaaacatcaacagattgactaatacaattctacttagcctttcaagcaatctctcagactgcctcttatgcctacgtgtctctttatttattcttttcttcttgttttttaactccaaacttcctttatcaagacttcttttgtcttcctttcctgtaagctgtttttaaatgtattctttgttttggggaaaagtaaaaattttctgttggtttcacattacccaaatttcaaaattctagtccacatactcatacaaaaaaatgatactcctaagttttagataagttaggatttctttattcaatttcttgcatctattagatgattctaattttatgtttcaacttataaacttttaaaggtgggatcatacaagtccctttcattgaccttattactacccatcatggtgacatacccaaatgttcatatactagtgcttttgattataaagattttctttttattttcagattttctaggcattcatgaaatattagtttcatttattttttaacatagttttggccttgtaaatagcattcagtgtaatgtagacatgaatatttcttacagaagaaatgaagagtataattcatttattttttttaaattttaaagggatacataataattatgcctatttatggggtacatgtgatattttgatacatgtatacaatgtgtaatgatcaaatctgaataactgggatattacctgaagcatttatcatttcttgtattgggaacattttgaatattctacctattttgaaatatacaatacattgttattaactatagttactctgctgtgctattgaacactagaacttattccttctatctaactgtatgtttgtacccattaaccaaactctctttatccccacacctccttcccatcctctggtaactattactctactttcttcttctttacagcagtccccaacctttttggcaccagggatgggtttcatggaagatcattcttccatggacccagggcatgggtggggatggtttcaggatgaaactgttccacctcagctcatcaagtattagattttcataaagagcatccaacctagatccctcacatgcgcagttcacaacagggtttgcgcctgctggcccatggctcacctcctgctgtaaagcccagtaccagcccatggcctggaggttggggactcttgctctataagatcaactgttgtatatttgtctttctgtgactggatttgaagagcataatttaacctggtgatttgattaggtagaagccaagcctaaggtgcctactatcctagtatcactatagtcaccatgtataataatacttcagttaaaaaatgccttgagataaggcaaccatgtctcttcctataccagcgagattctaacatttcctctcattagcactgagaaagtttttataggataagggactggagagaggttgagaaggaagatgtgccagtgctgatgctagcgaggaaaaggttagagtatccagggttacaggagcatggtgccaaggacgtcatgccacagaaactctgagggacaccaaccaagtgaccagtgatctctctctcttttttccaactagcttcaggaattgattcccctatttctctcttccagtactattatagattactttcacccagggtttcttttccttttgacctcaaagaggaaaagaacacagtcttctggcgtctcacaactgtcctctccctttagccctcagactcctttaaacttctattggaaaattctaagtctttatatcacttcattttgagagcttcttcttgaaacttatgtatgacatactataaatgaaacttttttcggacatatctttactgatgaggaaaatttttcattgaggaaaaaatcttttattccctcacatgccttctttgtccatagagaagaaaattccactcaagcttttgttgttcttcccatgggaaggaaatttctgctctcattttccagagcattttcattgctgggtgttggaggccttgttttggtttcaaatcacactgaattgatcaagtcttcccaggataaccttgcaataagggaggataatattagatattaattttattaatatttatgaataattactatttaatattatagtcattactattaatttttatgaaaagttcctagttttacatctggttattgttcccctgatgtacatttccttagtcaaaaaccctgcaggaaaaggcaaaatgcgataggctttaagcagcaaaatttcacccacaggttctaattctgattccattattattacaagtatgaatattcaggaatcatttggttgcaagaaatagaactcaaactagcttaatgtaaaagatcatttattttaagcaataggagtagctcatgaaatcccatgacaagaacaggcagaacctgaggagagactggaactgaggattggaaagccatttgtctggatgtctccccttctgggccacgtggttctttgtctctgcttctgcttcatcgttgtttctcctcacagataagatgtccctggatctccccgctagaaacccaaaagtcactgcagggacattacagagactgcaattcactgctgctccattaccaactaaagttccactttcaaattccaaggagagggaatttggttggtttgcctcggcaacaaatgttcaccctggtctaaatcagctctggtcagaaagaagtagggacacacctctgagagtatgggaaagcttttttgagaaagggggcatggttggtacatacattccaaaaagtctctcccctttaactattttggttcctcctttcctcagtatactattcagaaagaagaatgcgcaacccagtttggagaaagataggaagattcttaaatatgaacccatcaacagggagtcagacagagaggagcaggacattccatacagatagaaggaacagtgagtgcaaaagtacagagaggcgaaccacttctgagaacagcagggattcaaggggatgtagagcagtggtatgaggggaacccagagatggatgctgatactcagcagcagcatttgctataggatgctgggggtggttggctgggcacggtggctcatgcctgtaatcccagcagtttgggaggccaaagagggtggatcacctgaggatcacctgaggtcaggagatcgagaccagcctggccaatatgatgaaaccctgtctctactaaaaatacaaaaattagccaggtatggtggcgcatgcctgtaatcccagctacttgggcagctgaggcaggagaatcacttgaacccgggaggcagaggttggagtgagccaagatcacaccactgcactccacactccagcctgggcaacaaagcaagataccatctccaaaaaaaaaaaaaaaaaaaaaaaaaaaaaaatggatgctggggatgggagtcagagtctggaggcaggggcattggtaagggttgccggaggttagaaaaccactaagatggggtccccaccctcccctgcgacggtaccagtctatggccttttaggaaccagggcacccagcaggaggtgagcagcaggcaaggaagcactgctgcctgagctccacctcctgtcagatcagcggcagcatgagattctcataggatcgtgaaccctattgtgaactgtgcattggagggatctagggtgcacactccctatgagaatctaatgcctgatgatccgaggtggaacagtttaatccccagaccaccccaccccctcaccccctggtccgtgaaagattgtcttccgtggaacgggttcctggtgccagaaaggttgaggactgctgctaagagacttacacagctttatcagtgaaaataaaaagaacagatgtgagaaatactgtggagctggaatcaacaggattagccaccagttggacgtagaaaggaaatgacaagaatatttacagatgagtcccaaatgtttagtttgatggctttatgaatagtgttgccatccactaagataatgacaaaaacttactattattatagtgaccaccctttctgagtacccattatatacaaaatactgtgccagaaacctttccatccactatttaatcactctattgtccccatgattgatattattttcactgttttatatataagaaatgaaagtcttcaagaatttaggtatgttgcctacattcatgtaactcaaggtacagagttaattctcatgcccatttctgacatcagaaccaccgtgcacttgggtttgtttttcttaagaaagaagaacagattttaaggaaaatagaagttcagtttggacttactacattgtgtttcctgtgagacattcagctggagaggtctagtggacatttgactatgggtctgcaacttatgagcagtctgggctggacccttcgatttgagagacagcagcttaaagtgggaattatgagagtggcagaaatcactcaggaggaggaagctgcccaatgagttactatgtaaagcatacgcctgcctctcctgggggttgtttgacatcataaatacactgacatacaatttttcaaggcattcactttcaattttaggaatcccttctatatcagttattatagccctgctttttagatttgtactttttctctctcttttcaaaaatatttgccagggatttgtcttttctgagaaccagtttttagacttcttaaattttcacttttaaattttctaatgatttttctatttattttagctatatttccctctgcttttttcctttgattttttttctgcttttttaagatttaaattgaattccaaattcatgaagttttctttatagttgtaagcatttaaaagtaaaaacttacattggctttctattttcatcacatttcatggtaatgttttaaatattcaccatttcctaaatgctctattactgtgttcatgcctaagacaatgacattaacccaaatgaatctaattggtaggatatctttggtaataaggtctttcttggggcactggaaagaggataatgtaaagcctcacattgctccctctagattctataccacatgttacccactcaactcagaatccataaggaagagctgtgctacagactcaaagaaaaagaaaaagattcatcctctcttttcgagtatgtttcaaaacaccaagtcaaatcttttggttaagttccaaaggaaaaagtcagcaatgaacattgtgatctgagtgaggataggagctcggggagtgcctccaagcccttgtactgcctttcccatctgtttttcactttctcccattcccccaagtacttagtagagttttccattaagctccactgaactgagccattctcagcaaaataactccacaggttatttattgcggttcaaataagttccaaatcaaattctgtgtcattgaatatcatttttaaattccttcaagtcagattggtatattacattgagtttgtcatatttaaccaacaaactaaagctaaacattttccaaaggaaaaaaacaaatgctgaaatacaccacttggattttatttaatattatttaaaataacattaaactagaacatgtggacataaattctataactaaacttactgatttatgtatcatagaaaagtaataaaacaactctcttctaaataaaggcttatttacacaatgttaaatggtcagaaatacagcacttaccaggatgttccttgtcagcacacaaggtattgcaagaatagattacctggatgaatgattcagaagccttttatctagagagtcaatataataaagataggacatagtgtattctggtccccattgtggatcctttttttaatttagagaactaaattgatgtcatttacttagaagaatgctcaataacaaaatgtattactttatccttttaaatgtcctaccatttttcagagaatatttaaagcaaactaatgcatatcagaaataagttatcttgttactgtcaaaggatattaaatgtagttgcttaatatatttacttaccttgctttagtgcctggtatatcaaaccattgaatgtcaatcaagatatgcattaaatcattatagagattagtggtaaatattactatattattaaaataaatttgaggccaggtgcggtggctcacgcctgtaatcctagcactttgggaggccgaggtgggtggaccacctgaggtcaggagtttgagaccagcctggccaacatggcaaaaccccatctccactaaaaatacaaaaaattagccagtcgtggtggcgcatgcctgtaatctcagctactcaggaggctgaggaaggagaatcacttgaacccagaaggcagaggttgcaggaagccaagatcgcgccactgcactccagcctgcatgacaggagcaagattccatctcaataaataaataaataaataaataacaaataaaaaacaaaaaaacttgagaaaacattcccatatttagagggaagtgtactctatatgggaactctgaggcaggatacttggtatcttagtcttttggggtcactataacaaaataccttagatcaagttatttatagacaacagaattttattgcttatagttgtggaggctgggaagtctaagaacaaggcaccagcacttttggtgtctggtggaggctctctgccttatacatggtgccttgttgctgtgtcttcacatggtggaaggggaagagggtttcccaagcctcttctataagggtactaattccttcccaaaggccccacctcttagggattacagattaggttttagcatatgaatttcagagggaagggagagacacgaacgttcggaccatagcacttggattccagtctcagctctcccagcatttagactttttgtgaccttgatgaaataagttaacagttctaagtctttccttcctcgttggtaaaatggggatacaaattcttgtccagcctatcaaaaagtgattttgtgatgcttaaagttgaatatttgaaaaatgtgtggtatgtatatagttatatattaagaacttctacattttgttttgtagatattttaaattattttgctatgaaacggtccaatcagtagaaaaaccaaccaatgtcatgtactcaactgcccaactttaacatttcataaaatttgatatatttgcttctgatcgtttttacaaaataaaacattaaaaaaatacaagtttttggccagtggcccatgattgtaatctcagcactttaggaggtcgaggcccgtggatcacttgaatccaggagctcaagaccagcttgggcaacatggtgaaaacccgtctctactaaaaatataaaaattttggtgatgcacgcctctggtcccagctactcaggaggctgaggcaggagaatcacttgaacccagtgtccttggagtgtcacttttccagctggaaacctctgtggcctatggtgccttttcccaagttttgcttgggcccactgggcttgttctgcccactcagcctggcaggctatgctaagcttgcactactggcccagatcccatgcctgccaagggcgagccaggcacagagtggtgaagaatgtgtgagcgagtgcatggtccggccaccgtgcacagccaggtgtgctggctgtggcagggcaggcagctccaggcactggcacaggtgctggctctgtatgagactaaggctggaacaggcatactgcaagtggcttcaatgatgggcaccgggaaatgcagtggcgacaagaagctggtagacaccaggaaccacagagccccaaagagagtatcacaaccatggctcagggagcccctaggtctgggctccctgaagggccccagctcttctcttcctctctccttctctcttctctccttcttatctcccacaacatggcaagcaggggccatgtttcagccctgtttgtgttaacagctctttcggtcatccagactaatgtccagcccttagcagagaggagacccataagaagtgtggctgagtcaggttattttatgggctcagacgggaggaagtacatggtgattggtccatgggtgaacgtgggcatgcctggaaaatgcaccatctgatcggccgaacggtcatcaatgaagtcttccctctgggttgtggatttcacccggaagtggcagtcaagcctcccggcttcaggccattcctggcttgaaggtggggtttcaccagggactctcccctttctgcccaggaacccgtctgcctcctgccatcagcatgccatccacagcacccaagctgtttatgctgagaggtgcctgcaggtgcatgtcgggttgccttcagctacccccagcctccctcctgagctcctgggtgcccaaagtccagacggggccccaaggcggcggagggctggcatgtcattgccaccccaagtacacacacacacccggctgggtcacagcagtgcccaggctcagccacagccttgtactgtaccagaacgtgctgggagccaggagaggccagggaatgggaacaggcacttctgagcctgcgggagctagggcttccagggcccctgagaacatagggatgcccaggtccagagccacagctgggcggctgtagctcagtaggaggcggggctcccacctgttcctggctcctgctgcattgccgaacacacaacttcatccgcaccttccgcgcatcagccggaggcttcccagcagctgttctagtcaggctgcctctgccatcactgggaggtgaaagttgcagtgagctgagatcatgccattgctctccagcctgggtgacaaagcaagaccctgtctcaaaaaataaaaaaaatataagttttaccccacaatggttccattttgttccctctttccctagaaactccacattattatatggatgcattatcctaatatgatcatgttcaatttaggcttcctactcaattttcagtttttcatatatgcaacaattttaccccaagcataagtacatccattatgatgacatttaatagaagggccaggccactcacatagattttcagaaacactgaatttagtcatcatcaagaaaatctgtaatcaaactctgtttgtctttttttgttctctttctgtgtgttgatgccaaacagaaataaagaagacattcgtttaagtgcatttacactgtaagaaagattgctcattgaaaatattgatttttaattatatctttgagataggtaaattaagaaccagaagcaattccacaacttgataaaaactacaattgtaggcaaatttggatgacaaatatgaatatttactgtattgggaataaggttaatattttaaaacaaggttgacaggagaaaaattgtcttagtttgcaaaaggaaatttgtttctttaagtgaaaattggggtcagtaggccacagctcttcttgcttttacatgcctgaaatgaattaaataatgcagtagcaaagcagtactgagcagactaatgacaaaattatacattaaggctcaaaatcattatacactagaaatacatattttatataagaaaacatgaaattttaaatgcattcccacttcacctccattatcttaagagagaaaaactaagtcatatcttcttatgttcattaaggaactcatggtctttttctagggagcaagggtggttactggattctgtttgctgattgtgatttcaatgtgattaaagacttattcttcatacagtagatgcagtatccagccccatatgctattcaaagtgagtatggtattattttatagagggtaaatctaattttgagttgtttacccttctttggattcctttatgtgaaataatgatagtaaataactttgttaaacatgtacttactatgttctaggaattgtgctaggtaccctacacccactctctgattcacaataccctttgaggcagacatgattttcaccattttatagatgaggacacaggctcagacaggttaaataagttgaccaaagtaaccaggctagtaagtggcagttattagatgctaacttcatattttcagtagtgacattttcaggaatgtattgcaaatatattaatattcaatccactatcaaatttcatgatttatgacttttaaagtaagtgtgagtgggagtctatttttagaaatcaaaatgaatagcactttaagtacactatgcacttgtgtacacttatacacatggagcattgtgtttggctcttttggtttcagtgccaatgccagtagttaccctatggaaaatgttagtgaaaaacactaaagtgtagtagaaagtacattttattatataagtaccgttttatatgtgggcatatagtaaacaatcaacctatgcatattacatataactttactttgaaagacatgtaaatagaacagagtcatactgtgacatatctatatgatgctcaaataaccatctgattcagagaagttatttcattagaatgtggtttttattacaacctttcactctttagtccctcgtgtcaagttgtatagacagggcccaagctgtcatgtcctcagtgggttgtatttatttataatggtacatttttcccagcatcacaaaaggcagaaaatttgttattgccatgtgaaaatactcattttgtaccattattctctttacacatatttgtcctcagaatatgggaaataaaattagcactactgctacccggtaatctttacaagaggattgtttttgaagataaggaattcaaatatcaataagctgaactgaaaacaatattaaatttccaatgtgatgtggcttctgtttggatagagatggagctggtctatgtttctttactctgtgttcatagtatcaaagtaagctttgtatctgtttttctgtaatgatgacatttacacttggttgcattaatatgaagtaacatggattgcgtgtgttagtaggttctttttaattactgtgtaaaaataatatgtaattgaaacaaaaagcattgtttccaatcctaattttttttcctcaagtccatcctgtcaagctgcaagcgtgaaagttattttctggtggtgtgattagattggggctgaaccctccagctggcaggcctgtctgtgactggcggcggcctgtccccagtgcttgtcatttcctgacatgcctgacaggatggggacagccgccccagacaggttcattagatggtgttttctacagctgggctaaaaataaataaataaataaaaagtctgtgctttgtaaaagcccaagctgtaggggcccttcttgttggtttaaaccagggccttgttttgacaaattttgatctgtgcagtttttagattttctgacacatttttgtttccttcccctttggcctgcactttgtgctctctgccttgttgctgcttcaaaatcctaacatagtcttcccaagagaaaaagaaccaccgttattgagggcttaaaagaaacaatagtgtaatacttcataaaatagcaatacttaatctatttccatggtgatctgcacaatggaggaaaaacaatcttgggacttgtgataagccaattacaagaaaggttaagagtttttttagtgccagaaacatgccatctacatgaaaacataggatcattactaacagtctacactgtcaaatacactgctctttagaactgccagaaatttaagctgtcttcatttttgagcttttaggaagctgacagagttttctgcctgtgttcataggcttcgacgtcagaaagagaaattacggaagactgtagaatacttgctaattaaaaccagaaataaattcaaaaatcagatttagaaatatgcttctttgtcaatgatagggcccctttaagactaacgatttgccaaaaatggagtgcatttgaaacatacatttctacagagtcatgatttatcattctcaaccccaaattcaaacttttagaactgcagaattggaaagaaaaaaaaaaatcttcagccaagaaattattattctgggttgcacctgtaattaaaaagtagctattgacatctgtgccttagagacttgccgtagtcttcctactatcatagttgctgatagctgctttccattaagagaaacattttatcttaatttttagtagatagaacatgcccaaatagaacatatctgaccatatttgtctaaataatcttagtgttgctgttagctatatttcctttcacatgtaaagatacaaaatataataatgtttgtatctcatatgctttgtcattggtgtaataagtagtgttgctgaaaaaaaatcaaattcctcattcacagaaatcctagcccttacctttcctttgtattgttagctttcactgctttagttccccgtctctatgacaactgtttaaattgggatgggcaactgtcatctggagtattactgagagaaaagtgttagtgagcacacagttcccatagatagagcatttcaatataatccaattttaattgagctccagagactttgatgtgctgcagaaggttgggagagagctattccagggagaaattaaagcagcccagcaaggcttccctactccagactgtcaccattttaagtaagcattagcatcagacttaacctgcccctatggaacatctcacttcttttttcagcttttcactgatttattttgccatatgtaaaagcaaagcactttcatctttttatatatgtttttacacccatttgattaggcttgaaaagcttgtactggacctgagattcatcttatgctgtctgttggactttgctttggcggctcataaaagacatagaaagtagagtagggattagcttcaaattgtcagctattatatattaaactttcttttttaatgctgctttgtaagaccctattttggagctaaaaagttgaaggaagtgtaatttgtatttagcttcgatttgtcattgaatttcattttaatgcttagattcatggtcatttattagtggctacgatttttatttcaaaatgcattaaaatatcttttcctcatcacatgaaaagtacctttcagggaaagctggttcagagcagctgaatacagatacatcaatccttaatagagaaaccattaaccctttattttttttaatggagagaaaaaggggtatttttccatatatattcaaagagccttttaaatattttgaaatataatgttgaacatgcattaaatatgctagtaataataaaaatgacatcaaatcacaatgttaattataattaaataagtactaaatactttgattgtgcagtcaaaaagctttgttacaggtatgataaacttaaggaaattatctatttgtgacatacttgacatttctgatctatattggcaccttaaagaaaaacacgtatttagaagttaagtaaaatatgacaataattagaaattagtttgagtctatgcatcattctagatacttctagtaccagaagtagattgactgtaaagctaatgaatcttcagccagggccccttactcttcaggccttggggatgatgggagttgctgataatggtacagtggtttcagtttactaagttgcattaaaagatctcagaagaatagaacctaatttctaaggcactagtaatttgttgagttttttttttctaattctaaatattcatgtgcatagcttattataaacaatgttgcagtgagtgatctggtacatatttcatcttgcttttctaggagtatattcacagcataaattcatagaaataaaatcaccaagtcaaagggtatatacaaatacaattttgatagatgctgccaaaattttcttgatatgttttattatttgtgcgcccactagcaatgtagtgagaacttgtttttctcacagtaagctcagtattagcaaacttttggatttttaccaatctgatagattaaaaatatagcattttcatataatgttctttctccaacaatgaatcaatttaatcatgttttcagtcaaggaaagccatttttactattttctgtgatttatctatttgagcttttttaaaaggaaaatgtcaccctctcaatgtctgtgggaggggattattgataaatagtatggtttgtctcatgcatgttatttttccatattagttaacataaaaatttataatacgtataatgaaaattatatgcacatataggtatgtccctttctccctgctcccaacctaagttaatttctcattcctcaatggaatttcctcctaaatattagtgtcatttgttctgaggataagaattttttttaatttacctgcatacccaagaagaatttttctgctctagcatagatcaactgccctattacctcaaattctagcttattacttataatacagttagctaaatatattaacactctgtttgctacataaaattctaaaccagaagggctgcatcctttataaattagttagccaatgtggatgtctctagtatatatttttatttatttactaaacatgcatattggagaagcatacactggcactccaggcagctgcattcattgagtacttgctgtgtgccacacactatactgagcaccagggaaaacattccacattaaggtggggttttgactgaaacacagaaataacctctatatatggagaaaataatattaggtttatttatgttatcagtggagagcaaagttttaataacactagatattttaatttatattttattcactggttatcattcctttaaagttgtcaggtgtagataggttaattgtttttattggtaacacattttctttgtggaagttcatgtttatgtgagtgataacaaacagagtgattgccgtatctaaagtctggactgaacttcttttctttttcataatactcgtaaatctgccagtaatcctaaacctaggaaatggcagaaaactcctagccactggagccagaaacccttgagactcctttcatacctttacctcagcacaaaacaaaacactctagccctatctgtctcagaactgtctgttcttccttccctcttcctacctgctgcaactctcttaagtcagacttcctctacttcctactggcttcattcagatttctagtttagcctcattccaagtcattctccatactgcttccagagtgctctttgcaaatgcagttttaatcttataaccaccttcctccagtgctctcaatggcatcacattcctcattagagctgccatctattgagggctaagttaaaatccccattccagttcatcctttctgcagtgagtgctctggacagcctcttgcctgtagacatgtgacctctgtacttggagtggaaacacctgagataagaactttacataccgtagctcatttaattctttcaacaacccagtaaaatagaatcatcctatcaatcttacagataaagacacaaatagaaaagctgggctccatgaaaggaggggccgtctctgtcttgttcacaatgtgtcccatcacctagcacaatatctggatcctagtacatgccgactgaattttttttgatgaacaaattatgtgttatgccaacaggctttgcctaggatcagagaacttgctcatgatattcaaatgaaacaaataaaaggcaaattttcagcaaactagtattttgcttcaaatagctttacaaaaaaagaataaaaactcagcagaagagaaaaaaataatcctggggcattccagaaatgcagaagaaactttttggttatatttaaccctggaaatactgttttcgttgcctgcaagtcgggtaatctctaaatcctctttttacccaattatagatatttgtgaaaggtactcatttgccagcaagggccatttactgggctatttacagttaaactgagttgcatttcttgaagagctaattttcctgtaatgtagaaaactggcggcagaagcaaaaacaccatgggaaattcagtaggtgcattgtgtagttgaagcatgaaggtgctttaaggtgttttttgtttagttttgttttgttttgttttttatgttaaacttcaaatgcagaagacagaacacgcaaaaccgtttagtaagtggtaaataagaacaaattccaggaaataatcagagctgattggagcaatgtgacacacagaaccagagactggatcagagaataaagtacactgaaaaggatctgggctggggtcaaggcagagactgctcccatcactcctgactgagggttcactaaggtctgggtaggggaggatcgtgaattcatttgttcaacacatctatgtagcacagcctttctgctaacctccccacttgatacttgctgtgttatttcatttaatactcacagcaaccctgcaaagtagatgtaatttgtcccattttatataagggaaactgtcacaagtgtattgggaaacttgcctgaagttatacaaactttagagtctgtgtgtcatcctccaagtccaagttctttccactacagcatggcatacagatatataaaaaattactttagtctacaaaactaagtgctagtaaagtacatacttattgctacatactggtaggatgagggaatgtggcaagggtaacattcatactgccttaggtagatacacagtaaaatagacccaatcaaaaggacttccaaaatgcaagtttgcctgcatgaggttatgtttcattctaccacttctcttcaggagacggtgatgctgagggagctgtagctttaagagaaagaaaaataaattctcatgaaccccaagcatgcacctgtgaatacccaggggcacttgggttttcaagtgaaaatatgcttcacaaactcggaacccatattttatgatagctttcagttgctaattgtcactgaaaaagaaaagtctttaaaacctgaaaaataattcacattcatcttttctttctggtccctgatgagcctactacctacctggcagatacttgataaatggtaaatattttttgaataaatgcttttttgagcagtaagtttttaatatatcatagaaatttaccaggtagacaaggaggagaagttattctagaacataaagtgtggaaatgtttgatatctgcatttgtttttttttaatttcaatagactttacttttttagaacagtttaagtttacagaaaattgaacagctaatacagagagttcctatatatgtgtgtgtattggtcctgtttttttccttcttcaaagaacagagacatgaaagtaacatctgataataacactttatattagaaaattgtcagctgcaagtaacagacactgtaaactggcttcgtaaaaaatagatagatgatagatagatagatagatagatagacagacagacagacagtcagtcctggattctggtggtctccaaggttgattcagctagtcgtggatgctgtcaaaaacccaggtgcattgcctgtctttactcagtgatccttggtttgtcctaattcttacgctgatagcaatgtggctccaacacttcaaaaaatcaacataagctcagaaatattcaaaggaatgagagagcatctcttccattggctccctcacagcatgtggaaacttttctaaatccgatatacccctggaactggccagggggtcagtgtgtcctggcttggaagtgatgtaagagaagtcaatacctgaacatgattggagttgtgtcaatcagggaaatggggcagggggatagggttggaataggaggagtggaatggtttctgagtaagtaagcagtagtgtctactatagagtttcttttaagaaagcataataaaatacaaatggtaaattttgatcaggccttctgaaaaactggaatttttttcagctccaataaaccacattttttctgtctccctcaatcatagacacccattgacatagcaccaattactctgtttatacttctgctactagagaataactatatatagaccctgtatatatacagggtctcctagcttaatcattaatagaagttaatcagaagaacaaaatcagaaatcagactctatatataccctttaattcaatcattcaacagattttttactgagtttcgacaacataccaggcattgtgctaagtaatagagatacagtaatgagaagaaaaaaaatggtcaaaaagcttatagtctagtggaggagattacattaaaaatgaaattatacaatgaatttgcaaaattacatttgcggtaagtgctgtgaagagaacttgtctcataggtgctatgagagcgtaagatagggtgattttacctagctagggaggtcagtggcaaaaatagaagcaaaaagagaccttgaagatgagtagaagtgaacttggcaaataggggagggaagatatttccagagagggaagaatatgtgcattggctctgtgacaggaaacaacatggtaggtaacaagggactgaacaaaggccagtgtggcttgacctcaagggcaaagtggaacctgattcatctggagcaggagacctgttgtgtgcaccactaaccccatcccatctcttttgttgttggctctgcttcctcagaacttctgctgccttatgatttctgttgactgctttctcgctgtgttctagcttcttcccactgtcctcttcaggccgtctctgaatatcttgaattcagatcattaagagagatcctctgattggaccagccagccaaattcatgatagcatggctctgatggttttaacaaccacagactgtagctaccctacttagataaccgcaggtggagtatcccttgtcgcaaatgcttgggatcagaagtgtttcaaattttgaattttttcacattttggatatatataatgagacatcctggggatgggatccaggtctgaaaatgaaatttgtttatgtttcatatataccttatacatgtagcctgagggtaattgtatacaatatatttgaaatacttttgtgcatgaaacaaagtttgtgcattgaactatcagaaagcaaaggtgtcactacctcagccacccatgtggacagtctgtggttatttggcatcattatcattcttcacactgaatttatacgctactgataagcaatcattttcttacacttattcatacataagtacataacagtaaaaaaaaagacacactgttaacaccgtgtaaaaacaatgtgttcagtgtaactaagcggcacagcagcatcacagaatacctggatcagctgttaaacagcagcaacaacagtcaatgcaggctttcagtctctacctaccatgctgggttttgattagaaggtaggaggttgtacagtaacccccgtgaggacactgaataaacagtgcgtcacatacctgcgttatgactgtgacctgtcacgtgaggtgggatgtggaattttctacctgtggcctcatgttagcactcaaaaagtttctgatttttgaacattttggattttgtgttcccacattagagatgctcaaggtgtacttttaatattagtactcatcgtggttcaatccagggtggtggcataattggtaataaacatggtacaaaggaacttttcagaagagggtgtcacccatgttccatctagtccataacaaattgggaatcactctggaatgttttaatatagctggttttaatcattatagaccatgtagattaataattcttttgcatatgtttcttattaaataaaaatcaagaaaagtattcataattcattagtgtgttaaattactgccatgtgctaggctctgtgctaagtatgaagaatgcagagacatacagaattcctgccctcagtgagtcaataggttagtgggagacaccaagaagtcaaccaacaattatagtttggtaagtattataaaaaggtgggtacagggttcccagtgggagcagcaggatctcctagcttaatcattagtagaagttaatcagaagaacaaaatcagaagggatctgccagtcagaagaaatatcatttgcaggggcacaaaagtgtgacagaacacggcacactggggagcagagaagtgttcaggatggttagaatttaagagctaggaagaatgcacattgtggctaaataggggattttatactactattaataataacatttgccactttttaaatacctactatgtaccatagtatatatgcttcatatgcataaattgtactatgattttgattttcatgacattaggatgcaaatttttaaaaaatgtttgaagctataatggattaaaattaaaaagtgcactagggccgggcggggtggctcacgcctgtaataccagcactttgggaggctgaggcgggcggatcacgaggtcaggagatcgagaccatcctggctaacacggtgaaaccccgtctctactaaaaatacaaaaaattagccgggcgtggtggcgggcgcctgtagtcccagctactccggaggctgaggcaggagaatggcgtgaacccgggaggcggagcttgcagggagccgagatcctgccactgcactccagcctgggcgacagagcaagactccgtctcaaaaaaaaaaaaaaaaaaaaaaaaaaagtgcactagtatttgtaatacatgcagttttcttcaggttaacataaagaaatgttaactagagaaaaaaatatttttaattaagtcatatttgactattgctacaatcattactgcaactctaccctgtaatcttgtttcattctggctgtatctaaaattttaatatgaaatacttttaaaaagagaaaataatttgtctcgacaatttataatatttgtaaaatcagaccctattacctaattagttaaaacaaaaacctctaacccagaaatccaaatgatctgaaacagaagaaaataaataagtctatagagagaagacatataaatataactagtttaaaaaattagcaatatgcagaataatacatagagaagttaatgtattcagtatagaaatgaaagtaaatactggaaactagaaattcgtttattttcagtagtatagagttctggtctccccacctcatccctttgtaaaataatagcagagagaaaaataaaagattttagactatgccaaatttgagaaaatgaggaaacatagccaaagatacaatatttacacaagaacattcatgagtaggacaaaaatgaagcaactgtgccagtatcatttttaattttgagagttttaccatgatttgagagtatgtgtttgaagatgaagtagacacagaggactccagctgcaactcagtttgtttgtaaattaaattttaaaatattttgctcaacaaaaattgagttccttctctgtgcaagttctataaggaatacaaaaatagagtacaactcagtctctatcctcattaagtccattttttaggggatgtatataataagatagatcaatttaaaaggacctgccacaatgtaagagatgctattggagaaatacaaataatgctcttttgagtagttcctggttctttactaatgaatataaaatacaattcacatagatttgaaacagtattgcacttctctagtccaaatagcgtctaccttgcagccacagcagtgatttctaaagtgccagtttcattgtctcacctctttctttgttaaaaatcttatagcagctctccattattctcagaccagagtccaaactctaatgtgagttatgagatctcgccccacatcctgctgcccactcaccctttgttgttctaattttatttttcacctctctgcttcttacaatatatgcacacacagtctgtgtccgttgcccccccacccccagcactgtgtttatgtatctttacatacatgtttacatatgtgttgttccttctgcttggtacttcctttttccccactcccctgccttttcccattatttgtgattttccaccaaactgtgaactcctagagatcagggactctgcttctcctgttcaccattggttcctaatggtcagctgataaatatttgttaaattaaaggaacggaagaaaaataaaattgataaaccatgaggacacttggtagaaaagagctgacctaattatgggctgtttataaaataggaagccttcttgcagtttatcactgcttatagtgagactggtagctggtgtcccaaatagttgggcttcgtagttaagagttaagtgctatgattccaataatgtctaggatacaaactaccactaaagaaacaataaatgtggcttttagttcagtaaaaggctatgtgctgtggtccagattttctacatctgttttggtgatgtcatcaacaaagattagaaccagaggtctgcatgggtgtgtgtgtgtgtgtgtgtgtgtgtgtgtgtgtgtatgtgtttgtgtctgtacacatgcacaaaaaggtagggagtaattgcagtagtaggctgacatttgttaagcatttcctgtgtgccaggcactgtgctgagcattttttgaaaagagctattaatatctcattcaatcgcacaatgaccccatgaagttaggtaccattatttctccccatctttagataagaaaaccaaaacatcaaaaatcaatgaacttgcctgaggtctcacagctagtaagagaggcagacccaggggaagccttaagtctaaggtaagcaggtccataaattgatgaattagagaaaaaaaatcaagattattaaatcaaaagttctctacggatgggctgcctatatttcccccaattgtaggatgttttgacaccccccccccaccgcatacccatatgcccatgtaccaataatggctgtgtttataatggcatataataacattcctaaacacagccattatagcaacattgtttaattttcattgaggatgtattttctggaaagcttcatttttccagcttcatttcttgatcatttttgtttgcctcacagttaagccatttccaatttttcccgttttcagttttatattactgaattattttcatcaggattaattcttttccatgtaagttttatggagtgacttggttctgtgatcaatcttttggtccatattacattttactgactatagtgcctgcccttgacaattttattttgatgatagtattcattattaattgaataaaaggctaaagtgaaactcttctaccagatatttgaagatttctttattgtgtaggagtggtctatagcagttgttctctaactttttttcaccaattttattataaaagaattttataaagctctataccacattgcacatgtttaaattaacagttacaattttccataattttaaatattttaaaaagacgtgatatccagtatgttctaaatattactattttaaaataaaattgttatattacttttcagatatatccagtagaataaaataagtagagtagtgattgattactattatcatctgttttaagatgtacaaataagctcttttttcaaatgaacattttatataatttctctctttgaactcatacttcctttcaattccttcccccaaatttacctaatctaaaatatttgtgcttgtgagtcttttttgatcactatgttatactactctgcaaaaagtgtatatacttactgattaaagctttagttttttaggttcctaagaccataacattctaagtatttaaattttttattctgaaataaattgttacaaatattattagcatacagtcatacaacagcataaatatattgtgaactttgaaaaataattaagcataaaaaatgaaattatattagaaattcatctcttaatgggatgaatagttaacacatgcacatatgaatattacttattgctacaataatacaggaatcaatattagagctacttataactttcttttttatagaggtgttgaaaaatcttgttcacataagtaaacagcatgtcgaagttgtattatagacagtgttattcagtgttttctactctttccaagttgtgtgctaaaaatcacataaggatctattgtcagaagttatttttaattatctctcaattgacagcccatttagatccaacttctcctctttgaaagtaaagaattgggaaaacatctgacttgcaaaaggatttttttttcagtccagtcactgggaacattcactttccaatgcctccatcaggtatttcgaatcatccaatttgatgctcctacccctcaacagatcttatactccagtcaatacaccatagagaaataccattttttattttattttttaagtgggagaatggcaatgtgtttttcccatctcctttttggagatgggaaagagaacctgtactatcttatgtttctccatttctttggtagggaaatagcatcaccaagacatgtggtgagaggtgggaagggagtgttccatagctgctccccacatcctcactgcatgtgccacacagcaggtatcagtcagacatggtcttccaggtggtcattttggaagtcaagcctctcccagtttgtagatcgactttccttcagggccttggaatcttctccattcagctgacagtttaaaaagagcatggatgatctcatatgagtgtggacctgaaatttcttttgaactattcttcttgaatatatttgctgtaatcctgagccattgccacaaattccaaatttatatgaaattataaaagtaatagggatttgtaactttaaattgcaccacaacaagctctttaattaaactgttgaggctgcaagtgtggattgaacgcgacaaccttaggaactctaaaaagggtttgcccagccttctgcagcattttcaacaattcgtaacaggaaattcaactggaaacaaaatttagatttttttcgtattcaaagaaaaaaaatttgtaatacttgtgctaatatatgcattagatgatttgagatcagcaaagctatcactaaacaagtatttttttaagttgcacaatatttagcttccttaaaaagaaaaaaaggtgaaacttttttcatctgtgatttgacagtcatttacatgtttctgacaacatatacatgtccgatacgcatgagtgcacagcagccttgtatttttcaacatgatcatcagataatatgtggtaagcacatatttgagtaggtggtttacaagggatttctatgacatttgtattgtattactttctatgtaccttactttctatgtgctttctatgtactttagttcataagtgaactaaaattcataagtgaatggggcagacttcagggtatgagcctgacatgaactttctcccttcacttcttttggatattaagcagttagctcagtatagttcagtggtcacttaagaaaatcacaaagttccataagatttggggtcaagatgctttaatattcttgcttatgatctgtatgatgtatcaaaaattatgtttattcagttctcaaaaatgaaactggatgggatagtatttgttgattagatttcattgtatattaaatactttgaagaaacaggcaggcacaagctagatgatatgggaagcttggcttaagaaagaaaacaaaaccacaaacctcaagtatacatgaaagtacttaaatgacagaaaaatatcttggactataataaaaagcaaactgaaagaattattatagaatgtccttaaacttatagaaaattatgtaaccagtaaaggtataaataaagaagacgattttatagtatcaggccatatttcaggcctgagcttgatgcccagatttttatagaaatgtaccataaactcagtattcaactgactgtgattgatattcctttacatttatgaaagttatacagattgattaactcatcacttgcctgaagcagcatcccctccggtcattctgcccccatcccactgcattccactctatcctccacatgcctccctagcgctgtgcctcaaatctcactctgccaccttcctgctaagcttcaggactttcccagtgcctgtgagcagagcagggtaacagagccctggggtatagtccaaggaagccacagtaatcacatgtatctgagtaccagtgttttatcttaacaattcattcatatttgcagtattttccagcctgtgctaattttactacaaaactgttttaaattgcttaccagaaataaaattgatgctcaagaaggggttccaaatgatattctttgacataccttagtatacattttcccatgtgagaggcgtaagtccataatatcaagtcaaaattgcttagcctaaagcccttccataactcctctggagtcaaggaatcctttcattgtaaaggtagtgtcttctcagaatggatctaatccagtcgaaagttccatggtagtgcaaattaaactactaaaaaagagaaaccagctgtatttagattactgttttggttcttgattaaagtcagcagggttgtttggtggactataccattaggacataaacatgagaagtctgaaggccacattggagagagcttcttctggtttagcaaaggagtcaaaatgcacatactctgtacaatttctttagaaccttccccatatgtactatttctatcagtttcccattgtgatttattaaacaaacatatatggagcacatatgtgccagacactattttaggcactgtgtatcgaacagtaaataggatagatgagagttctattctcctatttgatgtcacagggaggggacagacaaaaaacaagtaagaaaattaatcattttcatgtgcagaattaaacagtgataagataggctgtgtgttgggatcacttgaggtcaggcattcaagaccagcctggtcaatgtggcaaaaccctgtctctactaaaaatacaaaaattagctggttttggtggcacacgcctgtagttccagctactcagaaggctgaggtgggagaatcgctcgaacccaggaggtggaggttgcatgagaggagatggcattgttgcactccagcatggctgacagaatgagactccatctcaaaaaaaaaaaaagagatagagttacatgataactcttaaattgtgtgtcagaaaaggcagctgagaggagtagatctaaaattattattaatttttttttttttttgagacggaatcttgctctgtcacccaggctggagtgcagtggcatgatctcggctcactacaacctctgcctcccggattcaagcaattctcctgccgcagcctcccaagtagctgggattacaggcatgtgcaaccatgaccggctaatttttttgtatttttagcagagatgaggtttcgccatattggccaggctggtctcgaactcctgaccttgtgatccacccacctcaacctcccaaagtgctgggattacaggcgtgagccaccgctcccggcctaaaatttttttaaataaaaatgtattatggaatgaaactctttttaaataaagaaattgtaggatcatcttattccgtgatcagtcttgaaggtaacaagcagggaaagcaggaggtggtttgctataaaaaaaagaaaagaaaagaaaatgaccctaggctctatcaggttttcctagcagggaattatggctagctcagaacatcgtctttcatcagcccttttaggatttcagatgcttaaatataacatgggttattgtaaagtaattaggtaggttttttgaaaagcatataagaacatacataaaaataatttttcttcccatgtcccctttggtaagggctgaacacttatttaaatgatgttgccattgttcaaaatagctttggacctttggatctgtctttcagaatttgcttcctaagccatttagaagctactagcaaaatcattttcttttaattttgttatctctccttgtcctctttgcatttaagctttactgatcttaggttccttttttcttgctgcagagggtccctaaggaccattatgctcccaggctgtagctaagagaatggtgataggaaaactgagtttgtgtattagctgggatccagtcaggggagaggaatcagagtgcaatttagataggaaaagtgtgatacaattatcatataaattatgccaggagattgagtaacaagggactggctagtaagaaataaagataactctaaagaatattggccaggcgtggtggctcacacctgtaatcccagcactttgggaggccgagtcaggtggatcatttgagatcaggagttcgagaccagcctggccaacatggtgaaaccccatctctactaaaaatacaaaaattagccggatggtaatggcacgcatctgtaattccagctacttgagaggctgaagcaggagaatcgcttgaacacaggaggtggaggtcgcagtgagccaagataacgccactgcactccagtctgggtaacagagtgaaaccctgtctcaaaagaaaaaaaaaagggaattgatgaagccatttatgggaggtgtcccaacagaaacactctgctacagaacggctcggggtgagggaagtactgagaaaactgctggtcactgggtgctgggagcatcatgcgtcccagagccaagtgctggagaacaggcgcctgccaagtgagaacaccagaacagagaagaaaaaacacccttcctcctgtgtggtctcttcagtgccctttcctgacaaagtttaatgctatgacaggtagcaaaggaaaaatattttaaggacacaggttcgttttcacagagcaagcaattaagggtgaatttgcacatggaaggccataaatgaataattggcacagtttataaaatacagttttacatggtgcacttaaggagtcaaactaacatactttttggagctatctgcttgctataactaacgtaaaaactgataacatgcttaatggaaataaatgcttggtcaaattttcattacaccatagctccagaaggaaaaaataagtcaaaatatgactctgtgtgtgtatacacatgtgagatattaatatatctggacctagaaatatagatacaggtatctttctgacataatgctatgggtataagggtgccaacacagctttcatgggaagatctatcattttttctgatattatattcactttactgtttgggttttcaaatggccatagtatttttagtaccttagtgaaataattattatagttgaagatagattttgttgttgtggctgttttgtcttaaaatgtttcctacttgacaaaaaaaagagaattaatcctgtatcactatccctttcctttttaaaaatcatactggtctatgaaaatcaaatatggaaaccattatagccaactaacaatttataaatataaattgtggcaagtcactataacccttttgtgaaatgtacaagaagaagttttgcatttagaaatcaaaaaccaattgtcacctgatgctcaacaacaaggagacataaattcatcaatggaacttaatagccagggtcatgtactttatgttctttgtctctgcttaaactaaccatttccaggtatcattatcactgtttttcagatgacaaaaaccagatggagttaaataattgtttttcaaaatactgtagttggtaaatagcagagccaagagttaagtaggagtctgaatggctccaaaatgtttcagatttaaatagacgtctgactgcctccaaaaacctttcaatgtctagagaaagacaaaaactgaattaagggttacaaaatgggattttcaaaaaataaagaccaaaagattatacacttacatattttatgtatatttcctagagaaaggaagtgtaaaaaggaacttcataacttgttttcaaatgtatatatgaatataatgcatgtaaaatgaatataatgtatgtaaaactcagtaactgttttcatttccaccaaagcaaatataagtgcggtagagtataccacagcaagtagaaaagtccctctgaattgttaatacacgttggtgtatcaggaaggaatgtgcttgttgtagatttgaggacagtagcttaatcaaatatagattatatacatggtaaccagaagtccagatgtggatgcttgctgtgattgtttcagtagctcagtattagagccaaccttggccttcctctcatagttacacaattgctgctacagtttcagctatcatatctccattcaagcaggaagggcaaagtggtatgccagctatatatgactcatttcatcagcttttctcaaacatcctcaactgcttttggttttgatctcattaaccagtgcttggcctaatgtccttccacaaagttacaagggaatttggggaagcagggaataacattgtcaggactggcttagaccatgggtcagccaaactctgccctgggggccaaattcagctcatacttgttgtaaataaaattttgttggaatacttccatacccctttatttacacattgtctatggctcctttcatgttacaatggcaaaactgagtagttgcaactgagaccatatagcctgcaaagcctaaatatatttactctctggccttttacagaaaagtttgctgacacctggattaaaccaatcatgatcctttgcctggggttgaccatatggacactttgggggtagctgggcttccattaagcaaggaaggggagaaaggatattggaaagaaccaacaatatatgtctcacaggtggtcacctggtccaattaattatatacaagacccaaaagtgataatatattttcggttttaagtcacagagtctccttgaatatgtttttctactccttcttttcctcaagacccaactaagacactttagaaaggcagaaattttgcaaatacacagtatcaaattattgacaatgttgtgacagacagtgaattcatttctagttttctgacttttactaagttactgtcagagtagatcttaaatccatattttattgattgacacttccctttaaactgtttattttaggttcttgcatacactgagggacttcacggaaaatggatgttcagcgagatacgagctgtattttcaagacgttaccttctacaaaacactgctttggaagtatttatggcaaaccgaagtaagtccccttaatattttgaaagaaaatgtgctcatatttacatattattcatttacatggtatgataatgtcttgatttttcctactgtatttctgatgtgctctagcttaaacaaacagaaattctttttaaaaaataaaaaaagaatgaatttgtttgaaatgttagccctaggtttctcatggataaagttatactgaaagctgatttttcatgaagattcattagctttacaaataaatcatgataggcacttgaagatgacttgtaaaattgatggctaacttatcctgcggttttctaaactctgttttttttcttcttaccacagcctcagttatgtttaatttccctgatcaagcaacagtaaaaaaagttgtctatagcttgcctcgggttggagtagggaccagctatggtctgccacaagccaggtaattatatcatattacatattatctatggcttgttaacatatttcaatctcaatattacagcaatgtaaatgtggttataacattataattatttcagagaccaaagaattttctttctctgaaggttatttgtagggatagagattatgaaaatagctattttgagaatgacagaatggttagggcagatttttatttaatacatataaataacaaagtaaaaaacttgattgcttatcacatagctagcatataattaagacattcttgcttgttaaaatcttacaggaaacataccaaaagcctgaagatcataaatgattaattgctatgtaatagcatataaataatgtttttataaatgccatatataaatgcttcttaattaaaacaataaaaccctgagagtttattaagggtaatagtcattaattatggtatagttgtaaccacatttcctagattttcatcttggtattttagaagaatcattttgaaatcttatattattaaaagatactaatgtaagtagaaaacataatcagtagttacttatattgctgatatcagtttgtcgtttttggctcgaaataactgaataccttactaaaagtggcttaaactataggggtgtgtgtgtttaatataaaagatctggagttaaggtgctgccagtattggttcagaggttcagtgatgtcagaaccctgttggctttgtattcacaaaatcaccgctacttcttcagctactacatcttcacacaactgcattacagtaggaaaaagacacaaaggatttctctttaagcttctctgttttaggaagaatgtatttctcagaagcctaaagcaatctttatcttaagtccctttggccagaatacagtcaccttcccattcctaaaacaatcactgccaaaaaggtgtgagttctgttggcttagcccaatcattccctaggttttatggaaaaagatacctctgattctttgccagctcctacatgaacaaaagaggatttccgttgatgaagaacaaagggagattgactttaggtagatacaacaatgtctaccacatagactgttatgtccttgagaattattacacagcactgtatggatggaaaggaaaactaatctttgtctatcctcccttaaataggctacagacaactgaaagacagggactgtgttttatttatcctttaatctacaggacctaacacagtgcctaattgcagcagtgctttttaagtgctgtttagctggggttaccttgtattgcaacttatctattctctttaagcttacagtgtaagaccaattcactgacacgtatacacatgctcaagatatttgctagtagaatgacaagattaaactaagatattagtagataatgaagcacttatataaaatacaggtcaaagaaaaatgcatttcatctatcaaagaaaatgaggttagttctgcaagacttgttcttattgaatctaagctgactcataataatcattacttcctttcccaagtgcttacatactatttgtttaatcatcaattcaagaatttactcaggaattgacattaagaacttacgaatgggcctaactttttcctatttaagaataatctcctgtcttctggcatatttctcaatgaccatgattcctgaaagattactaatagaggtttctatatggcatgtataatttccctcagtattctttgacttgtctggaccggaattcatttaaaacaatcagaagctcttttattttatttcttacctatgatgagtattgtttcccttttaaccacatttggtctctttttgacgtttggaagatcattcttttttttttctttgagacaaggtctcactctgtcacccaggctggagtgcagtggcgtgatctcagctcaccgcagccttgatgtccccaggctcaggagatcctcccacctcagtttcccaagtagctgggaatacagacatgtgccaccatgcccagctaatttttgtattgtttatagagatggggtttcaccatgttgcccaggctggtctcgaactcctggactcaagcaatccacccacttaagcctcccgaagtgctgggattacaggcaacagtcaccatgcccagctggaagatgattctttataagaaaactgaaaacaaaaggcagctcagtagttttggtctctctgtaattcataatgccattctatcttcaaacgtccttttgttgtccttggcttattttcccccaaaaagctcaactaattattagtttcctaataatattcttacagactcagttttatgtacttccctagatatacatccttagaagtaccaagtggcaatggggaaacactgcatctaggcttaaacctgtcacttagctgggtaacaataagcaagcctcacacttagtagcaattcaataaatattggtggaaagaatgaataacactactcaagcagaatgacattcttatctaccataaaatggggaaaatatctttacaagagatattctgccagagatattttgcaagatatctttgcaagagatattttgataatcttttgtgctatgtacaagacaatgcctattaagattccatgtgaatactcatgttaataatccatgagtaacagaaatagccttaagtctgttgttcccaaactaaacacgaaggagtcctgcgatatcacagtgaattctcaggggtgctgcaggtcattttttaattttttagggaaaaacagcaacatttgtcagataccacacaaactatttgctcgagttagttccaagtttcaacttagaatgattagatagggctgcatctttttcagtgacacctctgagaaactggtgtttggtggctactgtcttcaaaaacaagagccatatgaaaaatcagtgtggaacaggaaatgagtgtggtggtgtcagatctgattccaaggtttcagaagctgtgcagtttccaacagacatacacaccccattagtaaatgtggttatttaagaatgaaatataaatatttctctttaagtttatgagtattgtattttcaaatagctactcagttgttaagatgttaaatatttattgagttgttagagctaactacttaataaacagaattgtaagatatttctcttggtcaaggagcactatgaaaaattatggagatactaagggtgccatgaattgaaaaagtttgagaacctctgtcaatcagtttaaaaacccagtagctttatcatacttttctaaatacaactgcttttgttatttttagatgaacacattgaacctggaaagtttcataatttggaccaatgatcatggtttattcccttaggctgttcctatgtcccttcttctggacccatgcattttttcaaagttcccagttgtttatattttacaccattgcagggatagatattgtacgggcagaggctgtgcatgtgtacacactctgtgtgtgtgaaggcaagtcgaagaagttcattgatagacattaagtcaaatgcatgtaaacaggtacctgactacctacctacctacctaattaacatggagcagatttgctgtattgtttaaaagctacttgatttatcttaagtatagttttactttttttcttgtggatttgtgactcatttgcagctgtgatttgacaaataaggttgctttcaaattgttttatcctgagtaattaagtgtatcttctctataatagaattctcaaatattgctaatttctacaattaaaatatattttctaattcatctaagaaggataaaccataaattattttaagttgattatcaaagcaatatattagttaatattggattttttaaagttatgaattaaagagactatgtttgttatgctgtgcttaattgctaggaggatatcattggccactcctcgacagctttataaatcttccaatatgactcagcgctggcaaagaagggaaatttcaaacttcgaatatttgatgttccttaatactattgcaggtaagatgtctcattctttaatctaataatatgtttatgttcatcaaaatcatggtaatgtagcctgatataatacatttttctctttggaattcaaatgcatcattagagtaaattttgaagcactcacattaaattttatcagaaactgtgcaagctcataccaaacttttagatgcatttattgttgaagaggcttttccttgctttccttctgccatttcctttgctgacagctttgtctgaaggtttattagagtcaacaaaccattgccagagtgtctggaaataataatgggaaaagtaatttcactactttgtcattctcagcaatagcagctagacaggagaataacaacaggattctgcctagtacagatgtcacctggaatatggcatgattaggttacagcatctttttttcttaaaatcttcaaataaaaatacaaaatcagattacattttctaaattatgagtaactgccatcaacctttgcagtaccatgcttgcaaatcaaaaggaggtagtggctttgttttctgctaaatcagtggttgtcagtggttaaacatgtctatgagatttaagtacttcatcttttttcttaagttaagctccaaaagcccttattcatgatgaattacaaagagtttacttctataaaccaggctctacaaaaagtttttgcaattagatgaattcaaataaccacataaataaaggtgcttaccataattattgttttgttatgaatgaatgctcacaaccgtgtatttagagctgtgtacttctctgaatcattactttaaaaatataactatgtaatattactcttttttaatctatcatacataagtgtgactaaagatactataggtatatattaaatgcgggtaatatagatatgtattaaatagacaaaacttgatttgtccacaaaagggaataaagctatttgatatattaaaatgctttttcactttaatcccaatacattcatgtatatatatgttcatatatacatgcatttattcatatgtgtagtacatacacatatatatcttgaataaacctgtttactccctcaaagataaaagaaatgtgttatactatttaattagcacattatttataaatagaatgaatttaaacatctgaaatgtaaagaacttaatttcatgagcatatttaagtaaatagcatggtgtagcagaaagaacacaactttcaacaccaaagagaagagggagagaatcccagatctgccaactttctgtcctggagcataagttgaattttaacttttaactctatcgtggacttttaatattttaatagcaatatttaatatgtttacatctgttttaataactggtatgtttggtcttatatcatcttgtcttatacttttttttaatgtcctcttgctttttatattgtttgttctctggctttacgaatgcttttttgctcagtgctcttgtgatttaaaatgtaagcaccttgttattaattcccctagagatattacatttttaaaagccttataaactatttttcttaatttgaactcaaaaatcaattaacatttttaaatcatacctaagacaaaaacttcaactcaattttatttctcattcattgcttatattcgcaaatataaattactagccagaatccagattattattaacttcacactctggggtctacgtctttttgcaaattaagaaagatttcaaactattgaaattatgtgttcatgcagtatattattttcagctatatggatctttacctgatttttcgggatgatattctctgtacgttcttgtgtaacagttttccatattccctgtattaggtttttatattatctgctcttgagagacctatcaagacagtatcattagacaccattaggtgattttttttcccttggctgtgctagctatttggagctgttggatataaaactggagggcagggtgatatacctcacttgtagttcagtttccaatgtagcaggcattcatattaaatggttttcctattctaaaatgagattttctccaggctctggatggaatgttttctagttcattgttttaaaggtctcttctagtctccatcccttcccactgcattttactcatgtaaggtcagtttcccacagtgtggtacagtaccacctataactaccacccacttcatgcctgttactttctgggagtctctttatctgtccaactctggaaaggttgctgtgtctaaatctggatagagataacattgtcatgccttctaaaagttacacctgagcagtatagagcctaatatgcttttttctatttgggacaatctttgggtttctgagccagagcatgcagactctggtgggaatttaaaagcatcttgctattattgtttgaatcgttgaagtctgttttatttataacatgaagattatatgggccactgatttttttcaaaaattactgggtacttcctttgcaattattatgactaaacatgaaagcctgactattgtaagcaatgggataaaaattaacaatagggactaggcacacagaacacttacagtctagatgaataagtgaaatacacgtaaataagacattttaagatggctgatagtaaatgctgaatcattgctatcgtgaatgctgcatgagcttagcagaggggaggcattttaaaatgtgtttggggagaaaaaaagagaagagcttcacaaatttctgctagttgtatatatatggtgtattcagtggacagaattatcataccttctgtggagtagagaattatatataatattggagccttagagaagagccagattataaagaggcttttaggagtcagtatagtgttagagtagaagggaatgcgatgtggagttttagaaaaattaaactgataattatgtatggcataaatcaaaattgagattccttagcattagtgctataaggggagtagtaatagtaaattgttactgaatatttactatgtaccacatattctatttttccctgactacagaagcaagtaaagtatggtttctgcctttgaaaagatcgtaatatagtgaggaagcagacgtataccagtaattccactaaaaagtattggaatgtataaaattgtgtacaattttataatgtataaaaaagtattataatgggagtatatgtgaagccatttgaggtagtcaaatctaggagccattatttataactaagagagcagaaaaagcttcccataggtgacatttaaattgggaattgaaatatgattaagagttcactagaaagtaggcagagggcattccaagaagaaaatgtgaggtgaagattttggatgagcatatggcagcaggtatggcaaaaagagagtaaatgacactttgtacaatatcattatacaaaaaagtttcactgtcatttgttctagttcagtggttatcaaagtgtagtcccctgacctgcactattaccttggagacctgttagagatttctgatcctcagactcctcctcaagcctacagaatcagaagccggcaacctgcctttcagcaagccctctagttggttctgatacaaaaagtttgagcacaattgcattagccatttaagacctaattatcagggcaagatttgcatataaaacatttaaaacatagaagaaagtacaggattaagtgccattcagtgtaataaaagtttagagaagtgagagattaatatgaaatagtctactcgaggaaaccttggaaaagatgagctttaaatgaactctttaaggattttgtcagatgtagatgactatccaggcaaaataaaccgtaataagtagaatgacaattgaaaaaaattatgaatatgaatatcctgaggtactctccctggatatattcctattaatttaattcttcctttgctatcatcctgaaattttaaataggagtgccagtttaaactgagcaccagcattaaagacatgggtgatggttttcttagagaagcttcagtaatgccatgactgaatacttgttagggcagcaattagatttgcctgttttcctgattggtggacagtgtgtatccattcatctcttcttatcaaatcacccttcagagttctcttatgatcctaaaataaagggtgctctaaagatgttaagttgtaccagtatcactttaacgaacacgggtcctaaaaataatcatactattttataacactgttttagggatacggttattgttcaggaagtatttatttcatttgattgattgaaacttaagatttatcatttctagataggatgttagtcttctttttgacaaatgtaatttcttaggtaatctaaagccaagacatggttggcttatattttgtcataatatgttttaaacatttttatttgatatcaagattcagaaaaaaaatagtattgttattatgtctttctttcatttttcctattgaaacattccttggccgggcgcagtggctcacgcctgtaatcccagcactttgggaggccgaggcaggtggatcacgaggtcaggagatggagaccatcctggctaacacggtgaaaccccgtctctactaaaaatacaaaaaaattagctgggcgtggtagcgggcgcctgtagtcccagctactcggaaggctgaggcaggagaagctgaagcaagagaatggcctgaacccgggaggcggagcttgcagggagccgagatcccaccactggactccagcctgggcgacagagcgagactccgtctcaaaaaaaaaaaaaaaaaaagaaacatttctttgttaataataagaactcagaaaaaatagtaaataatagtttatgactattgaataatttataatgtgccaaacattgttctaaggactttatatatatttgctcatttaatcctcacaatagccccatgagttaggttctgttcttatccccattttacagagatgaggtagagagtagctaaataacttggcccaagtcatagggctaataagtgacacagtcgggattcaaacctaggcagtttagctccagagtcttcattcagttactacagcgtactgttccaggatattcctggtaccatacaacttcacctccagtcaccagctttaacttattagctgcttttaaaacctaaataattaatgatttaaaacaattttgtaattttcttttacatttcatcaaattaaccctttgaaatttatttactgtcatgacttttgtagatactgatattctagtactagatctgggcctggaattactatctttaatgtagaagctggcactgttttcagttaagctttagatcaagagaaaaagactctgagacagagatttgcttgaggatttttattgaaaagcccttgggatcaacatctgtgggggagtgaagaagttagaactgggcagaaggaggattcagacctcagtgcagttgtgacaaaggcttcagtagatcccacagggtgcctggggctggggtaaccgttcaaagttgtcttggcttgaggcaagggagccaggtcttcattacctccactctgcaatcattggatgcagactcctgggaaggagacatgactggattgggggctttcttctaatggtagcaattcttcgagatggacatagctgaacaccaccagccatgaacaccaccagccatcattgctcccagcatccaccataccagcagttctcagacttcagtgtatccaaagcaggattgctaaaaccctgatctttggttccctactgccataagttctgattcagtaggcttggattgagccgcaagaagctgcatttctaagaactccccatttgatgctgatgccattgatctagggaccacactttgagaattactgccctatatctatatctttaaaagacatacctaaaaataattttattaatcttcatatagcaccgtcagtatcacacatgatgactcttatgatagggcatccttagcattttatgtgcattttatcttcccaatgagaaaaaaagttttgctcagtaaatacccatgaaattaagttacttaatatttatttttgtaaatatttgcaggatgttgtgatctattatgtaaattcactagaattactggacgagggattctttaaacgtcttggattaaagagaagtgttacagaattggaatctggttgacaagatgaaacaatcttttctggcttcacatgtttaaaaatataggtcaatgtgacctaataaatttcatattttctataaatattatccacaaatattctataaataattctaagacttagattaaaacagtaccaaactgtacattattattacactctcagatttatcttttttcccaaaaatattattttagtatgaaatgcaaagtacattttatgacccatttcttaaaagtgtctcatacttgaccaatttcacttttctcctttctagatgcttttaaaaataagattctgtataaagcacatggtctcagtatcatagtattaatgcattatgcagactttttacaccctcctgtggtatgtgtacatgtgcataattgcatataaataaacacacatttactgtatgtaagttttgtaaagatactttacatagaagtatcttgccaaaagaagcttgccaaatatcccggaaacgtatttaaaagacatctaaaatcccataaatgtgttcttaggctttgttttattctatttataaatttaatgaatgttcattatagaaaattggaaatacaaaaaatggtaattttaaaaattaaaccactcaaaagtctaaccgtaaatatcacagttgacatttgggtgatttttctgtttttcattctctgtgtgtggtgtgtcattgggaacctgtaatgtatacaggtttgctttctactttttccatttcactaaatattctttgaaggcatgacttttaaaactacatgagagtccaacctagaaatatggcaaaatttctttaactatttttgaaacacttgatttttttcaaagaacattaaattttagatgattgtgtaaaataatcttaatgatacttagagttctactaaaaatgtggtttcaactttcagttcccaaattgacctgatttctgtttgttttctgaaaaatacaacctatgccttattttataccttgttagataatattatgcaaaagatattaaagcctgtaattcttgcattttaaaaaataggagagtaaccgctaacacggctttgtgtaaatgatcccctgttaaacttgagaattttttttaaggattttgagttgtttttcatatgatcagctaatgaattcagcacaacttctccaaccccaacctttttctcctgtttagcattttccacttttttactctgtgatgaacaagccctccctggttaattatgtatatatttagcaactgcatgtgttgggcttattattgtcatctaattagatgtaacttgaactgcttgcttctagaaaaatcattaaaaattctttcctaatgacctagagatgacaaaatgtctgtaaagtgtgaagaagcagacaagcacaggaacatcgctcttaaagagtgttaatccagatgctgccatcatctaattaaacaatattttgctgtcattaacattttcaccaaggaattgcagttataatttctttgtcagctgtctctagatcactttaccttcaaaaccaaagtgccatataaaaacattaaattggatggtttaattaaaaagtttttttaatgaagaaacatatccagtgtttctgagatctcatttactgtttcacttttattatttgagtagattagtgtcataggcttgcggtatttaatattcatcttccaagataaattcttataagcatagttagcaaaataaagtgtatgtgtgtgtgtgtgtggagatagatagatagatagatagatagatagatagatagatagataatctccacacacacaaatatatatatttacttaccactgctggaaaaggaaaggaccctaccaattatagcaccagtgtatttactaaatatcaactatcctaaagaaaaaacaaaacaattagtaattaaacatctaggtatgccagagcctcatgagtattactttggaaataactcattttttggatgatttaatgaacagtattttttttcatttcacaaaggtgttcagtaaaataattaaaggagtaatactaattcatgattaaaacatatcaatgcaaaaccccaaagtgccacttcatcactctttttttccatgtaacattaaatacattgtgcatttttaattcaaatcaaatacatatatgactgtccattttacaaggctcttatgcagaaatttttattaaaaacaagcattaatgtcatatttatttataaagtttattatatttattagaattaaaataatgctataaatctctgctaatttaaaaattactaaaattttctttttagcacttattttcaaaggacctctcaaagattattgaaagtgaattacaaaaaaaaatgcaggacagaataatagacatgaaatatggctattggcatcattcattttgtgtatacgtgtgtgtgtatttttaaataatgcttttcttctttgtatttttttcctaaaatagcattattttttttttaacttttattttaggttcaaggagtacatgtgcagattttttatagagataaattacatgtcatgggtgtttggtgtacagattactttgtcacccaggtgataagcatagtacccaataggtagtttttggatccttaccttcctccttccctctaccctcaagcagtatccttttctttcttagaaaatcatttctattaaaaaggctggtgtcttcaaatatagtctacatttttatgctgtttgcattgacacagtacatttaaatactgtgtttatgtaaattggctttttaacagttttccttaatatataaattataaaacttcatcagaaattattttaacaattgtggttatctgattttcatctatcaattaatttatttaagtaatatatgttatatctagataggtagcatcagcattattctattaaaaaaatatacactggaatacttgcttttcattaaaatctacagatttttaagtagaacagctcccccaagaaaatggaagagctctaaactctgccatggacccatttaggatcccagaaatagctctgtctagccaatctgtactctttgtatatatacatataaaaaaagtactgagccctatcaggtgtcctaggttagcatacatatgaactattagtaataaattttcaagtttagaattgtacagcttttattttacaatattggtactgttttagcagattattgtcatgtcaaaagactttaatatggctccgaactcttgtttaatctcatcattagtattattcaccatagacttaaacacaagcaggttcattgattgcttgagctacctagctgtagatgttttcttctcgtttaatgtagacattcacaatatcattctctctcatatatacctctacgcctttgcataatcctcgtcttctaaagataatgttctgcagttttcctttacttgacttatatttgttcatcttctgaaatttgggtcattttattccatttttatcacatgcatatccattccatcaacaaacatttattgggcagatggcatatgccaacacacagagattaaaacaaacaaacaaacaacccagccctgacatttatgagtttacagactggtggagaggcagagaagtaaacagcaatgtatatcaggtgtaatagaggtctgtatgagaactgtggtgaggcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttgtaaaatgcaaagcttcatataataaacagataaaatagtcatcaataaagtgttttctaaatatattaattaatttggtttggtgcttgcaattacagattttggttcttactcagattgtagttctttttttttctatttcacagttatgttttccaaatgctgtaagagcagatatcatttaatgtaatttcctgatgatgaacaagataatatctgcatatctatgctactgtgatagtacatgtggtgtgtgcaaccatggcatactggatgaaactcatatcactaaataccagtgaaatagctgttttgtgtgaattttaatggaaatttagaaaattactgataattggatcataacgcatttttataaaaaataattttgttcaacaaaagttttcttaggatcctgtttctttaatagctattctcttaatttcacctgatcatgttttttcagtttcagtttatgagggggggccgcagcttgctcccctaaactttccccattcccactgtgcctcaatatcatacctgaaatatttaagtcattctaccaaaacataagcagacatattcaccctaagatcgagcagttcttcgctaaagtgaaacaacataagacaaaaaaatatttcatgaacttaaggagtgaaaaaatgtatgattgacatctgcctctgtagtttctcatcctagcttcagagtacttctgtccactcgcaaattctctgcattcattcttgatataagtttaacatagtattctgtgtactcataatataatttctagatatatattcattataatagaataccatcacagccaggtgcagtggctcaggcctctaatcccagcacttttggaggccgaggcagatggatcacaaggtcaggagttggagaccagcctggccaacatggtgaaaccccatctctaccaaaaatacaaaaattagccaggtgcggtggcgcgtgcctgtaatcccagctactcaggaggctgaggcaggagaatcgcttgaacccgggaggcagaggttgcggtgagccaagatcgcgccattgcactccagcctgggcgacagagggagacaccatctcaaaataaataaataaataaataaaagataaaatagaataccaccacataagctgcagatgtgcaggtcagtggggtgacttcctccataattactttcagggcctctgactggcaaggctctgcttccggggttgcaatattatctacatcagcagaagagagatgagacacacatgcaggaagtttcagtgggccaagtcttgaagagactttgctcacattctgtagatgagaactaaatcctgtggccagagctacttgtaagggaggctgagaaatgtggtgtaacacaggaagaggagaatcaattacaataaccagccagtagcctctatcacagtcttataaatagtaattctagttacgtcttaaaacaattattgagtgaattcccttgaaatgcattgttatcagagttaaagatacggttcaataaataaaaagttattttcttctgaaattcagtagatgctttgtaaaaacagaaactatttcataagcattttgtgtgtacaaatttttatttctgtttttctttactaggacggacatataatgatctgaaccaatatccagtgtttccgtgggtgttaaccaactatgaatcagaagagttggacctgactcttccaggaaacttcagggatctatcaaaggtaacttttaaatatatagaagtcagctttcttcataaggctatagtctaatagtatttctgtcagagtatatatagccagttaatgtttgtaagaaggtgaaactgattatcttgacttacatagtcagtttctaaatcttaccaattcttagcacaggaattaagctacaagaagataaactagtactagcataggcaaaatgaaatgggtatttgagaaacagcagatgtagagagagttttctcatatatcctaggctttaaagtcaaggttaaaaacctaaaattagtagaaaatatgatggcaaatcatttatgtgatatgttccttagatggtaagacatttatattgaccataaaatacacacattgtagggaaatataatactgaaaagaaagtcagttaattttaccaagtgtctgtctatatatgagagagaagatatggcccaaaagatggcaagaaaatggtgcataacggtaatgagaaataaaaggcaaaatttttattagctcacctcatttgtccagaggaaactacagtgtgatactaaactgtttgaaattcagtgaagaactgggaactaagcccaaaaagctgctctatagtctaagcttacgccagaggcctgccttaaagtttatgtatgttagccatagtaaagcctcagcccattgacttggaatgtatctctgttttctatcagacttgattgtctgatttagcaatccacagaaagttgaaaggtatttgtgtatacatttggttttagggggcaggtttaaggggctaattgacaagagcagcataagccctgtgatttagggaaacaacattacagctgatttaaaattaatcccacagatggtttttaactcagcatgcctgcttctgccccttttctggcctttgaaacctagacgtacctaagttgaagttctatattgcactagttactagctctgtgacctaaagctagtttctcttgtcccatttgtaatatgagaataataatactgtcccatgtcaaatagttgtacagatctaatgacatgtacatttaaaaattataacatagtacttggcacatagaagcacttcctgagtattaagtattattgttacacatggaatatttcttagcctcttttgaagactgtttgctagttttttcatgttcttatgcgtcattcagtatccaattcttttattttatataactccctattaaattttagttgatagctcatggataattttagctgtggtattatagatgttaaagggacctaaaagatcagttagccaacatcttactgagagtcacacaactggtagaaataaattgctagcaaatgaattctaatacgcttgcaaatatagtaattcttccaaggtgagtcaaccaaaaattcttaactatttaccatattcaggtaactaaattatttaagataaggtagatagaagcattgtaattcatgcagcctgcccttcaggaacaaatctagttatagattatctaaataataagatcagtcccccaaaaaattaaaaataaagtacaatattttagagagacccacacaagagataatacatgcaggttgagtatcctgtatctgaaatgcttgggaccagagtgttttggattttggatctttctggattttgaaatatcaatatatacattatatacttaccagttgagcatccctaatctgaaaacccaaaatccaaagtgctgcagtgtttccattaagcatcacatcagtgcttaaaaacttggatttggggcatttgagatttcagaattttggattagggacaagattaggaacaagaactctgcagctagactgcctacattcaaatcctaattctgccatttaccagctgtggagctttagacaagagtattagtttctctttgtcttaatttcctcacctatataatgagacatcaataataatagggttgttgtgtggagtggtggatgggttaataagcataaaggacttagaatagtgcagggacatcagtattagctaatgctatgtatatgacaataatagagtggtgaatcattgatataggccatatgctttgaattgtgtttcaaataatgatgatgaatatatgctactacatacatattggatgagaatatttgaatggcatgcatgacttgccaaggttgaagtgtaattttggggtgtaaaacaaaaaccaaactaacttattgatgtgaggatgaaaactgtcaaactagttctttgacaaaatcttgtctgcatgtattttatttaacataaattgaatagccattacttagacattataaaatatatatacgataaaaattcagagtatagattctcaggtagcatattacaacctcgtacgatgactactattatggctattgtattatttttaaaacaaggaaggaagttctttttatttaaaatcaactgggatgttgtgtttaaaggaaacttatagactgaagctcctttttttctctccatttatttattctttcagttgttcagtcaacaaatatttatcacacatgtgctatatgtcaaacactctacaagtgaaagagtgtacaggagtgaataaagcagacatactcccagccacttgaagggagttcagcccagagcaaaatgaaaactcagatagttaacagtaatatgagaggccagcatttacaagataggtatagtagggactgtgcctcactggggagtacaggctcagactcactaagacatttggactcaaatgttcttgaaacactggcccagccaaagaaaatgtggcactcattatgattagtatgggttatagaaggcatctggtaacatatttgctggtaatcatagatttttttcatttatccatgtaggaaaaaatgagttaaaataaatgaggaagtcactgtttctacagtaactgaagatataaacatttcaaggttttgtttgtttgtttgtttgtttgtttgcttgcttgcttttgagacggagtctcgctctgtcgcccaggctggagtgcagtggtgcaatctcggctcactgaagcctcctcctcccaggttcaagcgattctcctgcctcagcctcccaagtagctgggattacaagctcccaccaccaaacctggctaatttttttgtatttttagtagagacagggtttcactatgttggccaggctcgtcttgaactcctgaccttgtgatctacccacctcagcctcccaaagtgctgggattacaggcgtgagccaccacgcccagcccatttcagggtttttatgctaatctgtgtaatgtgtatttcctttggcagagcttttccttttgtgcctcacatgtgctcctctaattttatatagtgttaagtaaataatacaggtaaacagacggagcctaaataaattaggcaatgtgactacaaactgtagttttgcaagcatgtagttcttcatgctgtgaacagttgaatccatgagctcttaaaagataggtagcttttcttccaattttactatattctatgctttagcaatttgttctttctattctgtcaccctagcatgataggaaaatgttagcaaattaaagcctcttgatatgttaataaattactcgtgcattgttcccatgcttcattgaatttcttaataggagcttcttacaaatgagctagaaacctgagactatcctgtataaaatccatcaataaacaagattttaatgtatgaaaatatatctttttatatgcctaatgggaaaatgacatttgaagtataataatataattggaaggaaaaactactatagtgcaatattatcacaatgaagagatgtccactaagaagcacatgaagttcttgtagttataatcaataccgcaaatgaaaattttaatggagagtttcttactcttcagaagctcaaggaaaaattgaaatacttgaatgatatgaccaagaacattctaaaagatctctaacaacaaaagtagttgtttctaaacaaacactgggactcctgatcccagtaataattcttagcagtgaataattctagaatttgtttcaataaacatgtggtaccccaaatactttttatattccttactatatgaaagaattaagaaactatgaaatgtacaatgccaaaaaaataaatatttattttctttctttataccaccacattacacaggcttcatgaaattctgtgttgtatcagttgggaaacttctgaatgaaagtttcagaaaacacagctgaaagtggcttgaacaatagtgggaattgggagaaaaagtcaagaggttgtaactggaacatgaaaagaatgtaggcttcgctcaaatatttgtttctgtgtcacatattgtgcaaatttaagatgttttctaaattctctgaacttgttttctcatctttaaaatgaacacaatcatacttacataatagggttgttgaaagattttaacaccgtaaagtagttaaggcacctagtataatgcctgacacagaagtggcattcagtgagtggcagtgacaaagcaaatttccataattgtcatttgagagttcactatctttggtatgattgacaaaaacctactgaaggttatttgattcctctgatttattttttattctagtaagattaaaaattaatgccatttaataaaatattttaattcaataaataattctgttttatcatctatttgagttatcaaattatcaaaactgtaacatcaaaacactaaggttatattaaatgtttattagaactttaggtgcacatttatttagactgaaatattttatatttataatattcttacttgttctttggcccacttaattgaacattcgaagagcacaggagcaaaaaaaaagttctttatcagtaagattttttagacctctcatttgattagacatcacaggttcaagttttatttattatgtgtacaggttaggggctatgtttattgtttgacatgagggtcaacagatgaaacaatctgcctttgacctatcttttcaacaccaaccaacagtaggtttagagatttcctccccaccccatttatataggtattccttatggagatgtaaccttatggtgaaatctatcttacaacatgatatatgctagggcttcagttatttacatatactcatatgaactcgactcttaaattacagtggttacatgactttgatgtgaagcacagtctctgctcattaaagtgtaaatagaattttcctatttcccagtcatgccctctgataagtgaaatagtttcatcacaaaaccaagtcctactaatattgacatgaacataagacatcacatacacacacccattcatcgagtggaaaaaatatattttgttaacacaggagttgtttgactgacagatgatgataagcataaccattttcccaaattattatgccacttaataaaaggaagtgataatgccttgaggctttgaaatgtgataatgcaaatggatgcactgaagtgtgaatactcttcaaccatccaccctcaatacttccaaatgtctatctaccacacagaaaagagtttatattggtaaggtggggaatgcatgactcagcaatctagagcaagttgggtttgttgttgttgttgttgttgttgttgttgttgtttttgagatggagtctccctctgtcacccaggctggagtgcagtggcatgatcttggctcactacaatctcaactagagcaagtttctgtggttattttatctttctttttcactgtaagttaacaacatctaaaatgaaattaattccatttacttgatcataatctacctaatgcttaattttaaacaacaaaatatgaagtatgggcaaaactactaggtgtgttagtggtaggatgatacaaaactaaaagataaaagtgtaaatgtgtaaatataattatataccatctgccaaataaccctgctgccaaatttgaaataacttgtttcaatgtatgttgaatgctgccttaacatataatccacactatgttgaaaattgttttcattagacttgctaatatggcagtgctgagggacaaggtattgactggcagtgtttggatactgttttaaactcatgagatattcatttatttaaattaatacttttattcattcactcattctttcattacacaagcatttattgccaacctactctgtgccagacactggagatacaaaggcaataagacttagttcatacctttaagaagttacagtcattgtttacccagtgacatattaagctgttctccttctaattgaaaaaatggaagaaccaagaaaagtgcaactaaaaaggtagacttcacagacactggtaaccagaaacagtgaagtgtttttgtgtttgtttgtttatatctccagtgttgcttgttggagacataatagggtgacagggagctttatagatttatacagaacttccaaagcagtcctaggctctgtttgcttatactaaatgtctctttatcctcttttcttgttccttcccacttagccagctgaatcaccctttcagaaaaagagagggaaaaaaatcctatagagcctgttttgctttgaaaattttaggctgttaaagaagaaactgaaaacagcaggaacactgtttagtgtatgctcttagaagaatcctacctatggaaaggaaaagagagcctgctttatgcactttaatttcaccagccacatgtcacctctgtgtctaaaccacagcattatcatgcaaaactaggccaaattcagtctcctttaacctttctttccagctgaaacaaaatattaagcagttagaagtgatcttgaaactaatttgtagccccatcattatccttctacttaatacctggaaaacttctagaactaacacatgaagatttaagatgctctactgtttgtaggtgaaagtatttacttttcactaagatatataaaactaactttcttaggaactatcttgggataatgataataataatagccaatattttgcatgtgtttattatatgccaggcattgtgctaagcatcttacatggattttcttgctttaccctcacaacgctatgatgagttgcactggttatatagattgcattttcttccattcgttacctattatttctccataatacataggtaggatattctttaaaaaaaaaaaaaaagctagtgattaatttctcttctagatgccctctaccttttctaagtgccctggcagtttttatacactatcaaaaaaaaagaaaaacaaaagaaaaaaaacaaggaaagaaaaagaaaaaagaaaaactctccctattatccagtaagaatgagttcttttaaaatatcctgcacaatgctcagtcatgtcagatatgaggagaggagtcaaaagaaatgcggtcagtgagccattccacacctccaaagttttcagtcctatgtgggactagcattcctgtgaaagtgcctaaagctggatgtggtggctcacgtctgtaatcctagcactttggaaggcagagtcaggaggattgcttgaggccaggagtttgagaccaacctgagcaacatagccaaaccctgtctctacaaaaaattaaattaaaaaaataaagtgccaatagatttttttttttttttgagtttcgctcttgttgcccaggctgaagtgcaatggtgcaatcttggctccctgcaacctccgcctccagggctcaagcaattctcctgcctcagcctccccagtagctgggattaaaggcgtgcaccaccacgcctggctaatttttgtatttttagtaaagatggggtttcaccatgtgggccaggctgctctcaaactcctgatccacccgcctcggcctctcaaagtgtggggattatcggcgtgagccaccatgcggccaagtgctaatagattttgctaatcaaattgcaactttagatcaaagatgatctttcttcataatatactcaattccaccctatgaaaaactataaaaagaaacacatttaattaatagaaaaatgtaatcttaacacttctctttattatcgtttcatgacttcaggttctgttccttaataatgtatttgaaaattgtgtactgatttgctgaagttcatctgatgacaaaaggccatattaagccaattaacagtataaaattgcaaagggaatgtttaatccacacttacaagaacgtaattttaacatattttagagaaacaaattttcaagtcatttaaagcattcttatttagaacaacccaaaacataggaaagacttggattgattggaaaggttttgtttgtttttgtactctattttaattgattttgactttactatgaaaatttttaagcaaagaaaaagtaccaattcctaataacaatacccattaaccaatacctacatgttataattattgacagtttagcttttattggtttactgaagtatttttaaataaattaaatatatcatactttacccctaaatatttcagtgtgaaaaatagtattttcccatataatcagatcaccatgattatatctaacaaaacttatgacagttccctaatattatctaacactgtgcctataatcaaggttttctaattatctcccatgtgtcttaaaaattgttttgcttaagccaggattcagtcagcgaccacacagtacatctgattcttctgtcttatctgtctaaaggttagaatagctcccagccaccctaacacccccaccttttttttcatgatattgactcatttaagagagcatgccagttatcttatagaacataacaataacagccaatattttgcatgtatttattatatgccaatgctaggcttctgaatttgtctttttgttcctcgtgttgtcatttaactcgctgtaactagtaaggttttgatgtacgctgattcaaatatcaatgaagattgataatagaagttttttgttttgttttggtttggttttttttttttgagacgttgtctcactttgtcacccaggctggagtgcggtggtgcaatcttggctcactacaacttccgcctccgagattcaggcaattctcctgcctcagcctcccaagtagctgagattacatgtgcccacctccatgcttggataatttttgtatttttagtagagatggggtttcatcatgttggccagactgatcttgacctcctggcctcaaagagatctacccaccttggtctcccaaagtgctgggattacaggcatgagccactgccctggccaataatagaaatttatatttggaaatatttggtcaataacactagccaaaatataaagttactatagttaatttaaatttatcaaagttaaaatgttcacatgtgaaatatatttctgggtcatataattctaaaagccgactaaaattatctctatgagataaaccaaattcatgattaaacagcaaaaaaagagtatacagggaagactaaagtctccacattctcactgcccagagacaactgttgatatactgtcatatatattcttcaaaaaataaattatacaaagtagaattacttgatcaaaactatatgattttttaaatgttaccaattttccccacaagaaatttatactgatttatttgccaatagcattatgagatatcatgttttccaatactgagtattataaaacttaataatttttgacaatctagttaataaaaatagtttttgtttgacattttaacaattgtgagtgtacttacgacttttgattacatatagtagaaagtcaacttatactggctttaatttaaaataaaaatttgattagcccatataactgagaaatccagggatgggtcagttcaggaaaactggatccaagtgcccaccagaattatcaggatccacacctctgttacttttctacattggcttcattctcaaacaggcttccctgtgttacagtaatgatgtctttgtaaccccgctagaaaaagagagcttttcccagatagttgcagcaaagtttcatccgatcaagttgaattacctgtccatttctgctgcagtcatagtgccaatgtggataaaatattatgattgacaggtctagatcccatgcccacccagggagtcaggtagcgaggtcagctcacctgcaccaggtagaccaagagtggggaaggaatggttcacaaaggttgaaggcataatgaatgctaaacagaaaaaaagaatatatatccattacattgtaggaactggtactattttttcttatatatattggaaattggcatttattattctgtgaattgcctattcatcatatcatttcctcatttatttaattagattgttcattagcttcttattgatttgtaagagcacatttttaaggaaactagctcttatgtgctatgaatatttttcactttgttatgtctttcgatttttgcataaaatttttttctaaaatttccacatggaaattttatataatattatataattgggtcaatcagtcttcattcatttagcatttattgctcgcttaaaaaggttcaggtactgtaggtgtgagaataaagagatgaataaaagacagggagtttcttcgaagggctacactactgggttaaaaagatgagaaagttgcctattaccagatggtgtcatgtaaggctttacagatgcaatttgaaaaacctccaaaataatgagttgaagttccttagataaaaagggagcccgggaatttacttgagcacagaagtgtctgtaggtatgatttctatgttgtcataacagaattttcagaatgatgacaggtagttcatgactaaaaaacaaaaaaggtaagaactctcaaagcctcttctaaggattttcaagcccttgattacaaaagataacacgataacttagatatgttagcagttcaatgtcttaaaagtattgagataactaaaagctattgttagaagccagacaaatgagtcaaatatacccagcttcaagctgtatctagcacagagctgcagctggttctgtaaaacgtctagccactgactagcaacatgatcttcatttgacttttcttcagtgtactcatttgtaagagatttggtcaagtttacctgaatgtttccttccatttctgtggatctgtgaggaatgaggaattaagtaggaaattatgaaagaaaaaagtcacatcaagggccgggcatactggcttatacctgtaataccagcactttggggaggccaaggcagaaggatcacttgaggacaggagttcgagaccagcctgggtagcatagtgagattccatatctattgaaaaataaagtcacattaagatcagaatttcatatttagcaatgaaaaagcagtgcagtagtgtggaatgtggagacccaggtacctgtttcctcctcatgaaattaggttcgtattgaatgccttgctgacctcagatacttatgaaaatcagtctagaaaatggatgtgaagacaatatgttatacaaatatatagtatcatcagcagttgtaatagcagtagtgaactcttgaacattttatgtgtgcaggtttgagtattccttatccataatgcttgggaccagaagtgtttcagacttcagattgtttcagatttcagaatatttgcatatacacaatgagatagcttgggaacagatccaagcctaaacaaaaaattatttcatttcatatacaccatattccatatagcctacaggtcatcttaaacttttttttttttttaacaattttgtacatgaaatgaagtttgtgttaagtacgtatgtgtggaattttccacttatggtgtcatgttggcatgcaaaaggttttggaatttggagcattccagatgtcaaacttttggattagggatgctcaacctatgtaacagtagaatcctagtaccatgaacatcattaccattttcagttttttatgatatattagaattcagtgttattgacattgctttaactaggcctctgatttgtccttgacaaacttttttttcttgaaaattataatgtagtttggtgacattgaccattcatcagatcaatccacatttatttatttgtatttgtttaaatcaataactctgtgctcagacttttatgttctctaaaagttcttctgatgtctcatataataccatttatccaatatgttttatttatataatttttgtggtcatttttacttactaaatttatatattttatacctgtcctaagaaaagggcttggtacaatatgcaggtttaaaagatagaaaaatattggtaaatcaaggctaagatgacagaaagaggaaacagcaaaatgaaactaaagaaaaagttagcatgcagaaatacacatcaaatacataccagaatgtttcaaggtacaatctaaggtattgcatctaaacagttgttttaaaaacaaaagaagtatgtatttcccattaaaaattttaaaaaataagcactggaataaacacatttaaacaattatatttactatagtatttatcagagccttaagatcacgtaaatccccacaaacatctggtaggatttttgtttcatgtaataaagtcacaaaggtttttatttttaggaaaaccaagctttttgtggcactgaagtttgagacagatttctctctttggtcttcaaaacagggaaactgagtgataagagtagagaaaattctcagcattatttcttcactaactacagtagtgtttcatgtgaacatcctaatgctacacatgtaatttcccgtagattttataaggaatgtgaatttttttacattagtcacttctttgattcttcaatattggaaacagtgcctttttgcaagctatgtaggctttttagcagttttaaaaactgaattataataataaagttttatagggatagaaattttatttttcatttttgcattttttgcaccattttttcctatttgttaaagtgttcacctgtaacataaaagctaaaaaagacaaaacagcaataaatctaaaaacaggctttaaactttcagttaaacttttgtatatggtaacacttaaaaagtgcggaagtcactgtatccaaatgcccactgtttgacagaaaaggacactatttattgatgtagtaactataatgaaaattgaaaaatattgcaaagtaaatttataaattttattaagtgtagccttaccttttgaccagaattcttaccatattcatctgccaaaatcagatgatattgacattgcagtatttgctaaaatttttgaagtatagcaaacttacaaccttgtcagtatgtaggtaagtaggtaattgattgatagatggataaatatgatatgataggtatctattaggatctcttaagcaaatgtcatctatgacaaaattcttatttccccaaacatttggaagctttttgctttctaattatttattgctgtttgactgttagaagcaaaatgatagaaaaatattaagtacaaagcaaatcacttgcattatgtttcataaaagtaatttctaaccttattaggtaaaaattcaaaattagaaatacattttaagaagttactaatggaggcatatacagactttaatactgtgcaactgtttcctacaaagcattactctgtaaaacactgcaataacatgactttgatgaaacttgtgtaaaataaaaaatataagtatttacttttccttttccagaagtgtaagagaagattgaaaaagattagaggaagagacatgctcctttttaaagaatgttttgtgagattttacaggacaaacagtatcagttaagatcaaaccttagggattgcacagacattttatgcacgtgagaggtctattagcatattcacgacagaacaaagtattaaacattttcagtgctttgaaaaatatactcagtaatgggatggctgggtcaaatggtatttccagttctagatccttgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgcggttttgatttgcatttctctgatggccagtgatgatgagcattttttcatgtgttttttggctgcataaatgtcttcttttgagaagtgtctgttcatgtccttcgcccactttttgatggtgttgtttgtttttttcttgtaaatttgtttgagttcattgtagattctggatattagccctttgtcagatgagtaggttgcggagccataaaaaatgatgagttcatgtcctttgtagggacatggatgaaattggaaatcatcattctcagtaaactatcgcaaggagaaaaaaccaaacaccacatattctcactcataggtgggaattgaacaatgagaacacatggacacaggaaggggaacatcacactctggggactgttgtggggtggggggaggggggagggatagcatcgggagatatacctaatgctagatgatgagttagtgggtgcagcgcaccagcatggcacatgtatacatatgtaactaacctgcacaatgtgcacatgtaccctaaaacttaaagtataattaaaaaaaaaaaaaaagaaaagaaaaaaaaagaaaaatatactgagttagaaaaacatatctgaacatctagtaaagtataaaatatgtgggtaattttaaatgaaaaactcattactttcggccaggcatggtggctcacgcctattatcccagcactttgggaggcccaggcgggcgaatcatgaggtcaggagattgagaccatcctggataacacagtgaaaccccatctctactaaaaatacaaaaaattagctgggcatggtggcgggcgcctgtagtcgcagctactcgggaggctgaggcaggagaatggcgtgaacccaggaggcggagcttgcagcgagcccagatcgcgccactgcactccagcctaggcaacagtgcgagactccatctcaaaaaaataaacaaataaataaaataaaaaaataaaaaactcattacttcaattccgtaacagaccttacattcatttcactttatagcaattacttttaccaataatgtaattatgttgttttaaatattaagattttatgtaatgtttaacaaaattacattcccttttttacatctatctaaagagatttgagagataatgaaatttaacacaataaaatttaaaccttagaactttttaaaaaatctaaatttttatactgtcatactttgttttacaaaatgaggacaaaaaagtttaggaaccttaaaatattaacacttttgtgcgtgaaaaatacagcttttatataaattgttgagtctttgttaatcataattaaagttaacaaaaaatgaacataatttacaagtaatttaaatattcaggataagcacccttgcaaataagagtttattatggaaattctaacagactttttactgctgatgacctcattgtgttatttgaattagtctcctgaggccaaaagaaaaggctcataacaatttataaatgaatcttcctctcttgtgtaacattatgtgtccctttgaaacactaattttctactacttctcttgttaaaattaagccttcgagggatcttcatagttaattataaatattaaattttgaaataaagtagacattgtacttagtactcttgttttctctgtaaacatacttaatttatagtatgcaacttaaatcaaaataatgtgcttatttgataccataagcacggactctgtataccattaatccaaaatcagacaaaaactgaagctaaggcagtttgctatttgaaatcatgaagatggtatgctggaaattcctaatgattagatgtgctaaaattttgagactgtgatgcaattaagcacatgctttttgaagaaatcagtatagggattagcatcataatcagtaaatagggtggtggtactgataggagaggtcttagtggcctcagcaaaatgctttccaaggaatccgaatttcctggattattccatcacccttaggtgtgtagtttaacagtaaaaaggatagttgttccatctatatactaacagaatgagactaacattctatcaggcttccatatggagggttgtctttcacactctgggtaactggctgttaagacaaggttttcactaatatggttgtcaaatggtcaatctcttcaccttccctccattgggtttcctgtattccaagctaaattttcattatgtagcttattaagtagaaggaaaataacgaaactgttggtgtggccttaacagtttaaactagatcacctctgataatctagttaacaaaaacttggtaaagtctagatactttgtactatgaattatcctcttgggcagtttataacaagtgtaatgatttgtaattaatatcaaaatccagtatggttaaaaatgtaatacaaaataatgtatttatgctgtatggctaaaatgaattaacagtgaaatactgaaagtataaagatttattatctaggatatctaatatgactgtattaaacaaaatattttttttcttttaatagccaattggtgctttgaaccccaagagagctgtgttttatgcagagcgttatgagacatgggaagatgatcaaagcccaccctaccattataatacccattattcaacagcaacatctactttatcctggcttgttcgaattgtgagtatcttcattgagttagcttgcctttggtaccttaaaattttaacataagtaaattaaataaaaatcaaatcagttgtaatttgattaacaaagattagagacgagtgaagtagaaattaaagatttcaaagtagcaaaatatgaattttttttattgagttgtctcatttgcaaaattggattaggaagatagttatctgttgctaggtattatgagcttaaaccaaaccagttgtccagttataaaggagccaaaattgagtacatacctttttttttttttttttcagtgagagggtctctcactctgccactgaggctagagttgcagtagcactatcatagctcacagcagccttgaacccctgggctcaaaggatcttcctgcctcagcctcccgagtaactagaactacaggcatgtaacaccttgcgcatctattatttttttatttctcttctttttttttttttgagacagagtctcgctctgttgcccaggctggagtgcaatggcatgacctcggcttactgcaatctccgcctcccaggttcaagtgattctcctccctcagcctccagagtagttgggattacagatgcccaccaccacgcccagctaatttttgtatttttagtagagacagcgtttcaccatgttggccaggctggtcttgaactcctgacctcaggtgatccacctgtcttggcctcccaaagtactgggattacaggcgtgagccaccacgcccggcccagctattatttttaaacatgggatctcactttgttccccacgctggtctctcacttttgttctcctgggctcaggtgatcctcctgccttacctccctaagcactgggattacaggtgtgagccaccacacctagccctggagtgcattcttaatacccactgcctcctttctcacaaatgaggcacactggcacttgctctccccccctccctcattctttcttcttgggcagcatgttttaaaaccagtttccaaatgttttgaaaacctctttctgttacttttctctttctcctaggacataaatatatttaagtctcactgaccttaaaaaaaaaaagcctcctgccagcctccgcccactctgaagttctttcccatctctctccctgcacagtcagattcctgaaagcacaacctctgctgtcctgcagtgcactgtggtacctgttgcctctactttatcacctcccattcagtctttagcctggttgatttcagttccacatccatcactttactgaactgttttggggaggtcacatattatgcagatagagcatcccattttttacctatcatgtctcttgaagcatttcacgctattgctaatctctccttgaaattttctttcaagttccttttacaataccctctcctggtttgcctcctgtcatcctaactgttctgctcagtctcctgttcagattgtttttccttaatgttcctcttctacaggatttttctttatatttcagctgagctgtgtcattcagttacaagctagtgatttccagcttctctcttctttgcaaacatttctcatgggttcctgacccatatttccaagtgcctactagatatttctacctgaacatctcacagtaccataagcagcatttcaataaatgaactcctcatctccctcatgtacctgctgtggttaaatgccgtgattattcactcagctgcccaatctagaaattgggaagctttttcctagatattttctctgtctttccaacctcttacatccagtcagacatccacagattctaccaactaaatatctctatctccttttctgtatactgtggcactttctttaatttagattcccattctctctcgcctagagtattgccaaagctcttaacaaacctcttttcctttattcttgccttctccattctggtctagataggagcactataagtgactgaggagtattgtagaatgctaaattaaatctcttaatcaataatttttccccttattaagatatacctcagaccactctattgtatggggctgatgtgtccaagaaacacattggtaaagcagagtatatgaaactgcatctcctgtcttcgaaaatattttttcccttcacctaaatgacagctctagtttgtaggtcttccttaggcattctctccattatggggaaaaaattaactttctacagaaatttagtatgaatacattttaagtaacttggaaaccactgataggtgacaaactacaattatttttgttaagaaaaatgttgtcagaattatgattctgtttgagcacagattttatccctttcataattctacaccagcataagaagttaaggaagtctggactaactagtcttttgagaaaacaaacccaaatcttacttttaaaaatgaactctgtaatgataaactaaaggaaaagacataaaactatttttagaccaaagttattaaatcagtctagtttatccaaacattcaccttaattctgtgaacttggattcttttataaaaaatgtttctgagttagaagtttcttgagaaatactttttaaatccggcacttttaaagtatagatgttctcttttttattttctgttaattttgagaatattagatttatgtcattgcctatttatctctataaagcaatcagaacagagcatctttagtttctgggtgataataataattccagaagtaggaaaatacttcacactcacaagaggcaaatgcttttcaaattccagatacatggacacataaagagcttataacttccaacctgcagtttcagccacaagtcaaaactaaacaaagtcacaaaaatttaccagtcaagatctcaaaagagctggctttctttataatagatataaaatatgctcttaattgatttgaactctcaaatagtcagacaagaatacaaaaaaactaattaattggattcgctgatcaccaaatgatcagaccataaaaccaaaactacattctcaatcattactgccgccagtggaaaattacctattagctgtgcggaaaccagaaacaaacaaaaaaatcagtagaaggagtaaattttaaaacctagaaaaaaaaagtcactggagttcaaattctgtttgctgcctagggtccaccctggaagctaagaaaagatgtacctgggcttaagtagcccatgagatatatttcttaagctacacagtcaatttgagttcatcaggttagtccacatggaactctcaaggggaccaccaaaactgttagcaaaggaaatttttggaaaacactgaaactagagattttcaccctgggaggccttttcataccacctcaggtcccgtcaatgacaatcattgccttagtgagccaccaccatggagggagcaggacacctcttgcaggtactttggggatgaggaaaaaggtcaggagtccttcctgagaaaatgttatcaactgggttgtttggagaattaaatgagagtatatatatgatagtattttgaaatacataaagtggtattcactgtttttttacctaatcaagttagtctgaagccagatttacaagacttcttcaagtgtgactccataagaatacttgttatgaacagcctaagttaacctcatctatccctaatcagctaaacactttctcaaatcataactcagaatttattcttaagtagatttattattccagcgaaatggaattcaaacttgaatctatgcaagggtatgccagaatattctgcacatttatcctacacatgcccttgtctatagcagtgctgcacaacagaaatataatgtaaactaccatgtgacttaaaatttctagtagccacatttataagtaaaaaaagaaacaggtaaaattaattttaataaatatatttgttaatctactatttccaaaatgttatcatttaaacatgtaaccaatataaaaatgtaaaataaggcattttacattttacatttttggagggagggtactgagtctttgaaattcagagtgtattttatatttacagtgcatctcaatttgaactagccacacttcaagtgctcaatagtgacatgtggctagtggctactgttttggacagatctataaaactgcttttttggagactcagcccaaatatcttatgtcacgtggttataaataaaagtatcagtctaatggtttactaagtatttatccttatggtccagggaattgtaatgtcctcactcccattccaaggagtttatgaaatagaaaatgcattaaaatttgggtcactaagaatttgttcacaaaaataaaatacacattaaaataagtgtctgtcctttaccttagaccttttagacctagtcattaaacttgttatttgtttcaatgtacttagtataacaacaataataattgcttaaaaatgctaattaactacatacttcattactttaaattaaaaatattattttaaacaaactaccagtgaaatcacttgtctacaatatgagaccctgaaaagactgttttcctgacagctgccattgggcaaatcatgaataaacttatagcagtgtttggagtttcttcagatattaatattaaaagacacattttacttggaatgtttttactttacaacttaccctagacatataacatgtatacagaagtaattaaatctttttccctggcttgctgaccactcagtaactcgttcaccttccaaattcagtatattcaaccctcctattcaaaactcattcgtcaaacatttcataatttccaaggaagtgatgtttagaatttgacactttctgtgtaaattatggcttgttttgaaagcttaccctaaagcctctttaaaccataatgtgtctttaaaagtatatatgtatagtagaaacatttttgcaagtgttgtaactaaaaccaaaagatagtgctactgaataaaatattgttgtttatcttgaatactgaggcattaaggacaatgcatatttactcagaggaagatgagaaatacttaaccaagagcctagtgcatggtaggtacataggttaattagtgaaaacttttggaagattctaaaagatacttcttggctcttggaagagaaataggagaaaataaacttctggaattagacaaaggccattagaaataatggttcctccatttgttagaatgtgaccttgaattttctcagatataaaaggggaataattacacctactctgaagggcgatagtagggattcagttaacttagataatacagagcctggcacagaaaaatgctttgtagctgttatttcccttccctttgtattttattatgcttccaatcacttcaaatatacatcttttctttgctatagttatgtcccaggcactacctattacccataaacgagatttgttttggcttttaaatggaatgaagagaaggaaaagaagaacagaacagaactacaagaagcgaaggatgtaaaagattattatgagatgactaagcgaaaatcgtgtaagacagaagaatgaagaagttgagtaaagagaagaggcaacagggaaacggcattagatgcccacgatggaattagttgatctgtaatcatccaaaagcaagaaaggctgttagtgtcttcagaggggactaaggggtatgatagaatacagaaggacaggtactttccagtgcaggcaaggtgagttttccatcactgaaaaagggttggaagatatgaaatgatgttggagtggatgtaattaggagaagaaagtctgccattggccatttatattgcaggacctaacctgaactttgtaaagactaacgagttccagaattgtaattcctgaaattaccgtttaatatgtattcatttatacatcttatctcccatgcctaaaacttttctaatataatggtgaaatgtccaatctgttgatgtacacatggaaaatggcccaattgacaggtagtaggcaaataaatataaaagttttttaaggttaatatagcacctaatcctctatgttagtcagacatgagtcaaatgaaaaagaaaggctctgcattgtggcttgaaggtaaaagggaaacacatggaaaaagcaatctccacagtaatcagagcttgaaagatcaatacttacttataaacaaataggttatcaatttctattagtactctaccactgtagcaactggaggccttcaggtataatgagaatatatgtcagtaatgtaatatgtgaccttaagacagttgttaatcagatctttttaaaagctatttaaaacactgaaatgtggaattcaatattctctgcttttaggtgccaccagattcattcataactttgttaccggaaataaatataattctttaatttcagatttcttttcactaagcccatctgtgctattcttggcatgtctttgttaagagttgaaaactagacaggattttgtaatttaggttgaggtggagatcagcttttagcggctgatgataagaagtacggctttgcatgtataaatgggttttcactcacatctgtttaataggttaaaaaacctagagacaagcctgatccctctaaattaatctctgcccactacctacagtgaaaattaaatgccttacatcagcatcctgcaataataaagtgggttctgaagataaaactttttggtcaaacctactagtagttaagaactgaaaagaaaacccgtatcttactctcacccaccatactcccatctcccaacaataccttgtatgtttaggtgtatttaacacacatttgttaaacattgttagccatgtgctgtgcttggggctggggatagagagataaataaggccttaggaactggcagtctggtgggaagtccaacagtgaatacttggtacagtgcgtaaagctggtagtcattttcataactctgtgccaggtaagatacatcaagctttctctatgttatttcatttaatcttatttaatcccataattcccccaaggtattgtcattcccagtttacatagatgaaggaatggagacagttgcttgacacagttacttaaggttaagtaagcttgcccaagatagagaaatagttccaccaagattcaaacttaaatctgtcatattgcattcagtttaccattgctgcatctacaatttttatatccccattttatttaatataatttagtgacagatatgttattttcactaccttatttttaatagtgaattaaacatctaaaaagcaaataaattagtgaaagacatgtcatataatttttttctaacttaatttcactaacatttatttatttctcatatcacttaaaatcctaaacagcaatatggacttcttggatgcatatctgattttcaggtgaatcaatactgtcccccttacttgtatattgttttttcattgttgatcttatctctttcatcacccttttctctcatccaacactgaacatgaaatagtggcaacatattacaagtttacaaaattgatgacatctggccatactaaatttcagggagatattgaggaagatcagtatttgttgcttttactccaacagccagcccttaaggttagtggcaagaaagggagtttaagggggcaaagtatgtcccctttgtacatacatacaaaggaattgtaaagcatacaaaggaatgaacagagattacatattaaagaaagaggactaaaatattttggaaaatgtcatgtaggtttcttagcattattgaacctgggaatgacatgtcattcatcctagacttgagagagaagaattgaagcagggaaagggaaatatgtatctatctttgctataattgtagttaagaaatccttagcagaaatgaatgttatttaatccttttaaacttggaagcaaatttaatgacatcaaaaacataagaacaacctaagaactcccagtgtgagaactcccaacttaagaattacaggtaaagcattaaaattaaatgcattaggacattgcaataaagttattcctaggttttctgctataggaacatgtactggatggcagacactatgttatccaaagacaatagtcacagaatgcaaaaaggtctagttcatctactgtcatttgtacttactttattcttcgttcaacagattatatattgagcaacttctatgtaccaggagttgttctaagtgttggagataaaacaatgaataaggtagatacggaacctactcatagtggggaatatagacagattaacaatcaattaaaaccagtgtgataaatgtttcagtgctgtttgaggaaacacagattgctatttgagcatactggagagccgtggtagcgcaaggaaagtttttcaggagaaaatgacatcatggctgagtcttaaaggataaaaagaacttagtcaggtcagaatagtgaaataaatgggtaagtttatacccggcctagggaacatcacagacaaaggacaagaggtgagagtagtgtggcaagattttagagtgtgaagaggggaatggtgagagataagagttaagcaggttccagatcattcagcctcttgtaaaacaaattaggtagtttagactctctcctaatcactcccaagagctattgaaggtttttaagcagggatttgcattttaaaaacattatcagaccataaggtagtactaatactttcgtagtctttcacaggtaatcatggacattctctacctaattccacactgcagtgatcagtatcagagtgatttttgtgatcagtatcagagtgatttttgtgatcagtatcagagtgatttttcttattgcaatgttagtgtatatatagccttaattattcgaaagaaaaatccaacttatgaattgtcattaatgcaaaattatttatcagaaaatcgtagagcactggaaccccatcatttcacagatgagaagaccagaagcaaaatgacctgccagagttgcagactgacaactgctgccttggcctagtcaagcccagacaggcatctcctactgccttaatttgggggcatctttctaggaccctgatctgcctccacatcttgaaggattttcaagatagccatgtttcacaaaggaacgagggcagctgtgtttagagtggtcaaatttctgattctgtttttttgcttaggaacctttcacaaccttcttcctcaatgcaaatgatggaaaatttgatcatccagatcgaaccttctcatccgttgcaaggtcttggagaactagtcagagagatacttctgatgtaaaggtaggctcttttatttgttgatattcattaaatttcaaaatatgtggaaattttgatttttttaagtgggtatgtataagacattttatattgcagctttgttccatcatattaaaattatatggtacatctaaccttataggaaataattttgaacattatagaaaataactgaaaattctttcatattacccagtgaaggtgttttcgttatttcaaaaaattcctacctaatttagatcaaataatcaggagatgtgaaaagcctataaaatgcctttcctgctgttaactcaatatttggtccattccataaaacacagcaggaattggatttgaccttaatgtgtcatattgttatagcttgcctggcttggggtttgcgtagcctggggcaattaataaagcattaatgacaagacccatttaaaatgtaggcttttccgtatagccttagcttttacttgactgtgcctggggatactatgcaacaatacacattagattaaaccaacacacacacaatatccagaaacagccagagagcagagtaattttacagttggtactgcttaactattgttaaatacaaggatttgttattcatttatatgggctcctattttaaaaaagaaaaacattgtattcaaagcaataatatatatttgttctctcatttgtctcattttttttcctgataataaggttacatggccaggttattgcataggtaaatgtgtttcttattttaagctcattttcttcaaggcacatttttttcccattactgtcactcagtacaaaaatgttacggtatcattccatttagagccttaaaccaacaaaagttagtgagttaaaatcaaaattgtcattcacatatttatgcttctctattgcaaaacatttgtaaaaggcaatttcagtgttactgaactgtaattggatgaatacaagttttgttcagtatttttccaaagcagaaaataaaggaaatggagccaagtagattgtaacatatctgtgtgttttacttgttgttgtcaaactttacataaatgaatatttattcatacaacatatttacatttgtaaaaaaaataagagaatttaatatgcatccttactatattaagctttgaagttctaacggtcttacaactttgctgagacttaaactctaaaatatccataagccatcatttaaaatgatttgttaccagtgaagtcaaggagggagtctgtttcttatataataacactttgagaattaatacagaaaatgggagtccataggctcccattgaacagtagtatccagaattcacacaatgttcataaaaggcactcaaatattttgtatgtgaattaaatattcttatctgtaattgaaggcttcttatcgcagttaagattattgatattttaaatcagagctatatccatattatatcagcctatttcaaatgaaaatgcctgctcactgttgtttgacatcatcacacacacacacacacacacacacacacacacacacacacacaaattggcttttcaacttaattcagagatccaccctcacatatttgggggtcagtcattctaatttttatatacagttttagatttcacttcctagcctgagaatttcactgatgctttataccaccagtctctgataaccgatgccctgtaccgggctttttcctctaaattctcccagaaattttcctcttcaaaaccctttcagaaacatttacattttattactaattgtatttggggggctcctgggttcacatcatccaggacaaagaccaatgtggatatcactaacttgggagtttttttgttttttatcctcaagcagctgtactgaacacaaacatgcagctttttttttccccaaagacttaattagttcataagaagctcatttccccaggatgacattacacagattgctctcattttcagctctcttaccaccactcatgaacctttcatattatatgttaatacatcttagatatcttgccatgtagacttcccctttctttttaaaggcagcatgctacatatatacaataatttatatatgtgatctctggttgatggagaatctttctccctgattgttactatgaagcacaaggctgtagtgaacatctttgcacagacatcctgatggactccttctatatacataaaggctaattcttattaatgggactgatggctcaaagacaatatactttttttattttttaagatattgccaaaccatcatcctcaaagatgaaaattcactctctacagcagtgtgcaagggtacctccttccccgtgccccctacacccatcatcactattgtattaaacaatggaacttctgctagtctggcaagtgaaaaattaagttatgtttgttttagtttgcatttttttttgagtgacgtggaacatttttcatgtacttattgacctgtacactgactcctatctattgctcatttttcagttgggtcacatgtctttttcttactgatttgaaaaagatctttgaagttgcagaaggttccattgcaagtagggtttcttggtcgtcttagctttgttatggttcgtttaatgtgtgtgtgcgtgtgcgtgtgtgtgcatgtgtgtgtgtatgtgtgtgtgtgtccagtcaaatatatttatattcccctctatagcatcagaatttgaggtcctcatgaccagagtgttaaagagaagataagacttttgggtaataactagtgctaacttgagaatcttctgaattcatgattaaacctgatttatcagagaaaaatatgttgctacgagtagtaattgttttgctacttgtgtgttagaacctaaagtttttattcttatttctaagctgttaaagcacagcatgatatattttttaaggaagtgtgtttccatttccagagaagaaaagtatctctgcaatgtctactaacttagtcagttaatcacataggagagaactaggatgcagtagatggttttattctgtctgtctctattaatgtcagtctcttcctgtgctaatgaacgcaagctgggaagaaggagtgctgctgaagtgacctttcaggagagaggtctctggagttgagtcagactagttagtttttactttattattattttttaaatttctttccctctagcctagtcttggtaacaatgacattcaactcactgaagttcttacactaattttccttaatgccttcaaaagttgttatattacttttagaatagctatgtagatgtcagaaaaggtagctgtgacaaaatgtcattaaggtgacatagtgtaaattaatacagttaatggaggtgctcgccactgactcattgacccattatgagctcttgtggaattaatgaatgccagggcatcagtcttttgaaaaaaaaaaagaaagaaaagagatggcagctttaaaaccttgcaatgaattatattagaaaagtgaaaacgtctggatcggatttgatttcactaggaagccataaaatggtacgctctctcagcaaaatatattaaactgaaatgtcagatttgatgcaataggtatacaattatgatagtgttaatagtggtcttctatcattctaagacatactttcaggtccaatttctcagcagcttgaacttgtcataagcttataaattaggaatcgcatttgaggatatgttcttattttttgacagaatgtatataatactattaactataccgtggggttttagtgtagctgctaaaataaactagaaatcacatttatagacacaaaatgtctgctataatgttcattttgccatttctttaataatatttggtgttttcctgcactgtttttcatttaggaaattttaaactacttagactttttccttaaagagaagctgattaacagaaatttatcaatgggaagagagtcagcagaacagcagttatcttaagcatgcaatctagtgtctaatgtgcctctgtaggagtacacttacacattataaaaataagcccatcttttaaaataatactgaatagttttcaaacatgtttttgttggttgatacagtccttgaaacaatcctatgaggtagtagtcattaaccctattttgtaaaggaggttcatgaatattaagtgactcacctaagttcacacgcaggcaggtaaagaggaagccagtactagcacagagtctgtccagttatttaagatgcttcatatccaagaggattttaagaatgggagctgcaaggccacttcatgcctaggcccggaagtcacatcatgttacttccacagcgttgtattgctcaaagcaagtcatggggccctcccagaataaggaagagtagacacggactccacttcctgatgagatgagttgcaaagtcacatttcaagaggtcactgagggtggagggattactgtgcccaccttcggagacagtctaccacagtcctccgaatctggtcaaaattcacattcctcttacatgtaaaatatactcaacttgttccccacaagtcccatcccagtatttgtatcagactgaaaatctggtatcttgttgtctacataagccccaggtacagataaggcacagcaattcctaatttggagacctgggagctaaaaagacaaattatctgtcccatgtacacacaacatgtggtggtaagacagaacagttaaacttcggtagaaactccattcagaagggggagaatgtggaaggtacatagcagtcaatgttcatagcagttctgaaacgcagccaggaataagttgtcgattacccagactgcagggacagggactgtccatggattagggcccaggtctgttatctgggcttggctccttaattcattattttccatggctcttggttacttcctctgggacattggctttgccctctgaatcgttcttttgtttccagaagaaataaacatggtttgcagctgagtatctttctctgcatgcttcctgaccatagaaagttagggccaaagcctcatattcccaagttggtacagcagctttaaaactgtgtagcctttctgtgtatcaaattagaaaaagctaatactcacaaatccttttggaacaggattctctctttcaagctgtgaattaggatactgtttataatgccctaagaatccctttctcgtgaatcactctgtgtagctgagcaagtctgaaaaacactacctgaaattttaacttttataaaagggttttacagacacacccttgattttagctttattctatggccatattttacttgtagcaccttcgaattgatctccatcctgaacctatgtcttattttgagaatcttttgccaactgaagagagtgttctaggcccttctattgcttgaaatactgcttcaaaactgaacagtttcttcctgagttcatctctctcttgcatagcttatctcttttgcatagcttacaccattagatgaaaccattggtcactttcagcattctgcctggaaatcttctaagtcagaagcacatgcttattaggtacttgttctgtctttgaaattattgcagaagacgatgttaattttccaccactacttaagagggactgcttccaataacaacttccttgctgatcttccagaccccaccaggctcctcaccacccctcccacttctgcctgctgcctcatcgcaagccagaatcatgtgttaaattctttttattactttagcactccactttgaggattcagtttctgttttggtcatttatgactttgtaacaaatcaccccaaaacctataggcttaaaacaactatttattcatcgacaattatgcaatcagagttaaggctcaaaaaggacagctaacctctaagccacacagtgacagtggggcagcttgactgggcggcagaatctacagtggctttgctcacatgtcttgtgcctcatctgagatggctggaacagccaggaactgcctgggcatgtctgtctctatcacatgtttctatagcaagggagccactctattgcatgtggtaactggcttctaagaggactaaaacaaaagctgccaggcctcttaaactcttaggctgccctaagaagccttgcagtgtcaccttgtcacgttctgtgtgttgaaacaagccaggccatattcagacaagggggaaatagactccacctctttatgggaggagtaaactggagatgccaaagggcttgctcttgggatgggaggactgttatagccatctatgagaaaactctgtgagttaccaatttaaaaaatactttaagtactagtttggtttgtaccattctctacagtctgagtgtgcatttagacataaaccaaaatctcatgagcaagcaatttataaaatacatctgattagtttaggtaatatatgttagtccatatatatgtcaactttaaataaccatattcagaaaatatgattaagtgtaaagtttgtttgagctcaaagcttgagaatggtcaccccataacataggttcaagtagccctgaatatacactctgattagcagcaatcataaatgggtttttaagaaaaaaagaagaggcaggtcctaagttgcttaccaagaatttacattaaaataagataagccattggctatacattgttctttgtatcaccgatttcaggaactgaagataatgggtaaggcagctggtcagaaaccaaatgcctttttaaacagttgctccccaggcttgggttgaggaggcagcatgagtgactgatgtcccacacgcacgtctctctggacctgatgaatttttgcatgcctcacataactcagactgctgtgagctattcttttcctcatatttgctaaaaatacttgcatcatctgaactgtctacatagctattcattgaaacacaatccacagtgacagaacttttttactgaattacaggatgcactttggtactgggtaaactctagtctcagaagtaatatttttgatccgtgcccctaaaaaaaattgagaccaaatagcttctagaatatattttatataaagttatgaaatgtattgttttataaacattatttcatttaatcctcacatctaccctaagagttcattgctgacatcaccaccatgttacatatcaataaactttttgtcaaaaggttaagaaacctgcccaagctagcaagaagtctggattggactcagacctgtttgattctgatgtatgtaaggtagcatttccctggtagaagaagggacaatcccaatgctgctgcctgcccagcttccccctttatcttcaactcactggtagccatgaggttcctcttctttaagaaacacactttgagccgcgtacggtggttcatgcctgtaatcacagcacttggaaaggcagaggtggacagatcacttgagatcaagagttcgacactagcctggccaacatggcaaaaccccagctgtactaaaaatacaaaaattagtcagccatcatggcgcacacctgtaatcccagctactcgggatgctgaggctcaagaatcgcttgaacctgggaggcagaggttgtagtgagccgagatggcaccattgcactccagcctgggtgacagagcaaaactgcatctcaacaaaaaaaaaaaaaaagaaacacactttgaaaaccagggcctgcaaagtttttaatcaacatttcaatgcctgaaatttaggatatggtaaacatagtaatcttgattcatttttaatttcacaaatatttatggattacatattatatgttagcaccattcttagcaagatagacaaggtccctaccttttgggatttctattatgatgggacatgcaagcatacaacaataaatagagaaaataatcattgctatgcagaaaattaaaacagagtaacgtcatatagaatgactagatggtggccggatgttgtggctcatgcctgtaatcccagccctttgggaggctgaggtaggcagatcacgaggtcaagagttcaagaccagcctggccaatatggtgaaaccccatctctactaaaaatacaaaaattagccaggtgtggtggcacacgcctgtagtcccagctacttgggaggctgaggcagaagaatcgcttgaacctgggaggtgtaggttgcaatgagctgagatcatgccattggactccagcctgggtggcagagcaggactccatcgcaaaaaaaaaaaaaaaaaaaaaaaagaaaaaaaaaaagaatgactggattgttactttaaaaggcagaatacagaatataggagcaggaaacctggatttaaagtatctgggtttgatttttggccttactaccaatttgcagtgcagccattagcaaattacccacccaatctttacctcagtgttcatgtctataaagcgggaataatgagaacacctacttcacaaactttttgtgaagattaagaaaatatatgtaaagcacttagaacagtgccaagacatagaaaggtaccaaaataaatgttacctgctggtttaaaacagaatgaccacaggtaacatttaagttgattcctggccttggagcacaaatgtagtaattgccatcttcttgcacataaccagttaaatctcagagatgaaacgctcatattctttggtttatatttttgaaacaacaaatcttttcaataatggaattgtgaatataaattatactaatgtcttgtgtttacatacactaactttaaataaaacttgctatttgaaacaagattgtaaaacaataaaactgagaccaaaaaaaaatctcacctctgctgcttcagctacttctccctagacttcttgtgatttcacttcctctactatccccttcacaaaactccaaactatccccaactctggacttcgggttcagagagctttagtcactgatagctctggtgtttgaaacctctaggggctctgcaaacaagctgtgcttcagaagtttctttctatctgtgtttaaaacatgtctgtttagtgattgtttccattatgagaaatctgggagagtttctttgtcccttcaaacatcaagcctctaacagcttacatctacatcttagttaatgccctaatttatgaccacatttgggtggcctgataagaatggagccaaaaaaaccatccttacttagaagggtgtcctgaaggccctggtaacacgacttctttctatgactagccccagttagggcctccttgaatgatcctactggagtattcttcctcctgcccttctaaagaaccatcaagacagatctttctaggccttccttgttctttggtggaggccagctgttagtgcccttctttctagagtgcctaaatgaaaatgaaattagtcttctgccacttttgcagtttgagaacaattctgatggcaactttaaaatcaactttttctatatttaaattgagctattttatacttttgagccttttaaatgtaacttgaataagcaagataacattttttaaacagaaaagtttccccttaaaaggcagatttcatttcagggtttatatccttttccttttctttaataaagttcttcattcactctttccccatcttgaggcatttttctgaccatctgtgtattccccagatttctagtcttattaaaataacttcatccaatatctttaatagcttaatatttaatgagcacctgctgcgtgcaaagtatagcactgagagctacgaaggatccaacaaaacataaacctcacaaaataggctcaaaactttgcgtttgcccagattttattcatactaaaattgcattttccccaattttattcacattaataaatatgacatcctatgtttcttgcgcctttgtgaatctaatttaatgactttcagtgaaattgcattgtagtggtaagtaggttaataatgaccacatattttatacaggaaagaatgggaaataatatatgaaaaacattatagagtgccaagatggtataagataaattaagactattttagttgtttaaataaaactaaatatattttgctatgtacatgtagatatatacgttcctctctgccctcaaggaagcttctgtagcctcgttgtagagatagggcatgagcacaaataactgacgaaaggcagtaagggaaacacctgatttatgtgagtctagtacatataaatcacactcccaaccgagcagctgcacaagcttacgttccttcccactttggaccctttagggtgttattgctattgtgtcacatgaagaccaggtcatatgcaaatagcaatagtctttgccttctctgcgccttttactaattcctcatgttttcccaaagagtgagagtaagagcagaagaaactatatattttacattcatacattgaagtcataagataataatatgcatttctgattggatgccaatacatgagaacagcagtgattctttacttctactctcctgtcagcgatcaaaccaaactgctccttccgtgactgataaacactgtcatgtttgcccagcctggaaatcaaactcatgatagtcattgctgatagaatagtcactgctgaagtgccctttagcctgtcttatccttcaattaaactgtatgatttttggcaaatgaacatgtgttttctacagtatggtttttctttcagcctcttctccatttccccgttcatattggagtcattgaaaaattatattaatttgtattaattccactagaattctcttttcctttttcgttgtggccttgaggtcttgtacatagtttattgttgatacacatttggcccctagtgtgagccatctaattccctctctttagctctgttgtagatttcccctctttgataaagttccacaatagggcccctttctctccacacttagcagttgcccttctctctttctcctccctatacatgcatatacaccacatcttcccattctccaatctctcctttactttgtcacccagtgtcttgctataaaacaaatttgactgtgttaaaaactcttttttaaaatttctaaaccactaagacaaaatccaaacagcgtatccttcattaaacttttctcatccatctggcctcatatacctcccaccatctcatccctcccttgtcttgatctacccacaatataccctgttctcctcttgtgctcagtttctcaccattccatataactccctgagggtgcccggccccctcttctggttttcatcttagccatgctccaactccaatggcccatctccaatgaagtctctcctgacttgcccagaatcccctgctctttcctccctgctcccttcttcctcagctgctattgtgtattataaccatctggttctacatctgccccacaggccagactatgaattacttgacagtaaggccatgtcttgttcattttttgtttcctgagtacacatcacagtttctggtactaaaaacctttactgtatgcataagtaaatgtcagagaaatatgtaaaggattttagaaagatttctatttaaatagaagaaaactgagattcttaaaaagcaaagctccatttatccagaaaaatcatttatatggacctgttgatgcacccataatgctggagaaaatgaacatttatatttttcttatggctcacagtgatcatcataagagtaatggtcagtttcacacagagtgttactaaaatgaatgcccacttaaaacagatatatcagttttagtgggagaactcgtgaagagaaagattttatatatgctttttctagaaagttagggatccagtttatttgaagacctcagtatgtggtggttttaattttttctatgcatccctagaaaagactacagtgagatttaaatttcagatgctatgccatcaatgttgatcatattacacaaataaatgtgtagcctcacaaccctatcttgatatttgaaaaaagatgatcaggatggtacacataaaaactacagcagtttgttttaattttctcccaattactttttaaaaaacaacaaaaactttcagggtattaaaatcagttcatttctacatcagatttattctaaagtaacagaaacctcaaattagatgctgtacatcacacacaagttctccttgaatccagttgtttatgctacagttacatacaagtaacacaagttgtctttgcatccaatttattgagaacctgtcatttctatggcatgcattaaatatttaaaactgtttatcatattgtgtatcatctcttttattgtgttcagtgattgatataaaaataatttactttatcaagtaaaaaaaactatgaatctctttataaaaatcacatattgtaattgtcagtatagttaaaaacaaaagtagaaaatatgtgatctattacaaatactggcaattagtttttaatttggatagttcataaattttcagatgaagattttacacaacatagacttgtttatatagctttacatatttgttttctaatgctattgtgaactgttgttaatttgtatactcatttctcttcattaatttatgggaggataagattgaaaataggtaacattttaaagtagctatcataaacataaattttcaagtgaatttttcacaagaaatgcttcatctcagatctttaaataaaattaaatgaagaatagaatagaattaattcataaaatattggttttaagaaattattttattccatttatagttaataagttataagttaatagttttattcaactgatttttataaagtggtttaatatgcttcatttttattcctgataggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggtaagagagattttgcttttgcttgggcagtcatcagggagttaacatattctgtagttttgttttgtcctgttctttactataatattaccaattatacttaacatctataaatacaagcttaaaattttaaatgaaaaagaaaacattttactgttgtcttgacagcattccttattgtagagtggattttccgttcatgaggactaataaagcaatggtaattcagttatgtttgctcctttaggagaagacaatcagatgagcatctgttgactaatataatgtattctaaagtgcttaaaataaatgcctatttcttagttttatctactgactaaatctgaacgcttttttcacttataaaaacactcagaacagaaaaaaatttatttagaacatatttatatgtgcgatatttatgctgtgaaacataccttatggtgtaaacattctgaaatagaaaacatctttttttgttttgttttacagacagtgtttcactctgttgcccaggctggagtgaagtggtgcaatcatagcacactaaagcctcaaactcctgggctcaagtagtcctcccacctcagcctcttgagtagctggggttataggcaaatgccaccatgccaagttaatttttaaaaaagattttttttggtaagataggatctcactatgttgcacgcactgatcttgaactccggggatcaagaaatcctcctacctaggcctcccagaagaaaacatcattattttaagctatattacagatatctgggtgtttaaatgagaaatgtataaacagaatgttcacatatgggaatttgatgggttttaatacatttcacacatatttaaggagattttaatcccaacatggttatagtaggtgacaataaaccactttacaaaacagcctctctagtgtactcttgaattacatcaataaaaccaatgacgccaaatatatttttaaccctgtttcattcactcccaagtttttccaactgtctgataaatatattttattttgtttttacagcttatttatttgaatcagaattcaaataaggtccacacattgtgagggaattcacatattccttaatcctcttttcttaaagagcttaattgaaatataattcatatcctgtgcaaattgttcatcatttaaagtaaaaaaaaaatgaatattagtccattcacaaagttgtgcaaccatcaccacaatcaatttaagagcatttttatcacctcatagagaaccccataccttttagcatcttccccgatttttcctgatttccccattctccccagctagcccaaggcaaacacaaatctactttatatctccattgatttgactattctagacatttcatgtaaacagaatcataaaatatggggttctcctcccctcctctcgattttctgtcacttttcttttggactttactgtcagtcacacattttcttctattttggagctgtatgttctgtctctaagaaatattttacttttaacgtactttattttagaaagttgctgatgtaatatacctatgcttaaaagcatcatctagataatctgcaatgtgttctcccccctttttttttaagaaaatttcatgttttgcataagtcttattgccaatctctctcacttctcaatctgttaaattggcactttcagatatatgcagttatttcatactattcccttgaacaatagcttatttcttcaatttatatttttaatgtgaatgacttatatttcagtaatatatacttctgaaaatttctgattctttttagaattggtatttcatcaccacattattctcacatacttgaatgttatctgtaaatatcagtgtaaggataccagcgctacaaatggaaccctaaaggctcattgtatatcaatatctctcagtcacatcattccattgtagctccagagctcagagccctgcttggcacatactagttgttcaggaaatatttctgagtgaatgaatgaattaatgaattatagaggtgtagtaatctcatagctgttagcatatagtctattaagtccaaaccagtcaaactgaatgaatccttcactccggcaagcaaagtagccaatagttgttggaccaatgcttttgttgatcatgctattgaacagaattctcatatgggtgctgataataagtgcctcttacctgtcaggcattaagcaaggcacttgattttttttaacatttattttacagataagaaatatgaaggccagacatgtttcataatttatccatggcagagcccagattcaagtacagaaaagttttaactcctaagttatactctttccagtatgccagctacctctgatattatctcttctttgtgaaattctttgagattattcgatctctacttttaggtttataattgtcaatccagaccttatttatttcctttaacttcgtggacatggttaatgcagatcattcacagataaagactgcaagtatactaagcttaaatatgcattaaagaaaaatagagtggttatctttattatccactggacatttcacatttattaatttgctaatgtttactgataatgtaccaggaaatgtatatgacattttttagacttctaaacatgcagtaatgcagactggatgagcaggaggccactgttgtttcccagtcccaggactaggccacatttcctgctagaagagtactattttcagtggtacccattccattcagtgtacagataactttaggaaagggatttgccttcttaataaaagactgaaagtttgagaagaaagttttaggatgagcgaagatttactatgatacagggaaaggacgtatgttttttaaaaattggggaagtgggctctcatgtaaatgatctaaaccatcttgtcttaagtttctagtagaggcctaaattaacaaaattgtgttgtgaaaagcatagggcatttggcgttagcatttttgaaagcagttatgtaagatcagtttctcattatagttatttaagcagagacttttttgtattgaaaagaagccattggagagagagtatgatgtctcctttcagtttttgcagcagctcccttatcttgcgttaccaatagcaaatttcagtgagaacaggagtaactaagtatttaaactagtacttaattataatacaggtaaatacttctccagatagagaaagcctgcgcagaatgctgtttggaaataggaacacagctagtcagtggtcttggtgagaagctgcctgctctgtaaatgagccgaagtcataacaaagataggtggaagtaaaggtcctcagtgatatctcttcttaggagtacgtctgcactgatgcttccaaatgcagacataggaaacagtggactaagtgattggtcaaatgcctccagattcgtccactgaaaaataatttgtttgctatagaaattggtccccacagtttttcctcctttttgtcttcctctctgctcatagctcacactgtcttcttagctgttctgctgtgtttattgctttacctgattaatagacatggcaaaacaggctttaaagataaattggtgaaaccttgtccctacaaaaaatacaaaacttagtcaggtgtggtgacacagtgtctgtgattccagctactcaggaggctgaggtgggaggatcgtttgagcctaggaggtcgaagctgcaatgagccgagattgcgctactgcactccagccgagatcgcgccactgcactccaccagagcaagaccctctctcaaaaaaataaaataaaataaagataaattggcattcaacaaatggtgctggaaaaattggtgctagaagagttggatatctatatccaaaaaaaaggaaggggaaggtttcagtccttacatcacaccatataaaaaaattaactcaaaatagatcatggacctaagtttgaaacctgaaactatcaaacatctaaaagaaacatataggaggaaatctttgtgactttatgttagcaaagatgttttagatatgacaacaaaagcacaacctataaaagaaaacattgatacactggactttattaaaacttagcttgtttgaacactactgtaagaaaattaaaagacaagccacaggctgagaaaaaatatttcaaaacacatctaataaaggactaggatctaaaatatataaagagcactcaaaaatcaataaaaataaaacaatatttagataattaatttttttaaaggaggggcaaaagaatcttcagcgaagaagatatgtagatggcaaataaacacatgaaaagatgcctcatatcaaaaattaatccacaaattaaaattaatcaaattgaaaccacagtaagctaccattacacattagaatgactttaaaaattaaaagggggaaaaaaaaaaaaacctctgacatcccaagccctggtagagatgcacaatagctgaaattcacatatcctgctggtacaaaacagtttggttgtttcttataaacacacaccaaccatataacccagcaaccctgcttcttggttttagccccccaaaaatgaaaacttatacaagtacatcaatgtttataatggctttatttgctttcatcaaaagctggaaactacccaaatatttctcacctggtaaagggataaacaaactaaaataaactatagtaactccatattatgaagtactagttagccataaaaaagaaccaagcactgatacatgtaacaaaatcactttcttgctgtcacttggatgatgccaaaacatttttaacggctttattaaaatataagttatatatcataaaattcacttgttttcagtgtacaatttaatgatttttagtaaattttaacagttatatgaccatcaccacagtctaatcttagaatattttcaccaccccagaaagattccctgcccacctccagcccaaggcaactgctaatcaactttttatctccaaaggtttgccttttctgtgtatttcatataaaaggaattatacaatatgtggtctttgagtttgacttctttgagtagtttttgagattcacccatgttgtagcatgtattggtactttgcccaactttttacataatactaccacattgtgtggaatatcacattttgttcacccattcatcagttgatgaacatttgatttgtttctactttttggcaattttgagtaatgctgctatgaacagtcatatacaaatttctatgtgaacatacatttttatttatttggggtatagacctaggagtagaattgctgggtcatatggtaaatttatgtttaacttcttaagaaactgcccagctgtttctcaaaatgaccttgcattccccagcaatgtatgacagttccagttcctccatagcctcactcccacttgttattacctgttttttttttttattacagccattctagtgaatgtgaggtaatatctcattacaatatttttttttcttttttttttgagacagagtctcgctctgtcgcccaggctggagtgcagtggcaccatctcggctcactacaagctctgcctcctgggttcacgccattctcctgccacagcctcctgagtagctgggactacaggcgctcgccaccacgcccggctaattttttgtatttttagtagagatggggtttcaccgtgttagccagagtggtctcgatctcctgacctcatgatctgcccacgttgacctcccaaagtgctgggattacaggcgtgagccacggcgcctggcctacaattttaatatatattccctagtgactaatgatattgagcatctcttcatgtatttattgaatgctaaaacatttttagatttattttaataaaacatttagtgattcattatagacacagaatttgtgttcttcatagtcaaagaagtttgtatgcccccagaattaataattttattactgatgtgcctaaatgaaatagaaaagccagtcttgcttttaaagacaaatcccctagacagtgttataccccaaattttttgaatgtaggaaaagctaataattattgttgatgagaaacctttaaataattaatgttggtataagctaaacaagcaagacctacctatatctgcagaaaatgctacattcaactagtgtgttgggtggtaatgcaatccaactaaataaactttccagataaatgaattttctagattttcctaagtgagaactttttagaagcattatggttatctgttaagttttattttatttttaattgacaattaataattgtttatatttatggggtatactgtgatcttttgatatatgtatacaagtcagaatagttagcatatccatcacctcaaatatttatcattgctttgtggtaagaacatttaaaatatattttaaaaatatatatatttacatatatatataaataattaactacagtcactttgctgtgcaatagaacaccagagtttattcctcctaactgtaactgcaccattgaccaacatttcccctttccctatccatatctcccatcagcctctggtaaccaccattctactcactacttctatgagtttgacttttttagattccatacataagtgagatcatacattatttgtatctctgtgcctggcctattttatttaacataatatcctccaggttcatccatgttgccacaaatgacagaatttcctgttatttcttaaagctgaatatcatttcattgtttatatataccatatttttaaaatccattcattcgttggtagacacttaggttgcttccatatcctggctattatgaataatgctgcagggaacatgagaatgcaaatatccctttagcatactgatttcagttactttgggtaaatacctagtgggatggctggattatatggtaattctatttttagttgtttttgtttgtttgtttgtttgtttgtttgttttgagacagtgtctcactcttgcccagactgaagtgcagtggtgcaatcagtgaccactgcagccttgaactcccgggctcaagtgatcctcccacctcagcctcccaagtagctgggagcacaggtgcatgccaccacacccagctaatttttaaatttgttatagagatggaagagtcttgaactcttgggctcaagtaatcctcccacctcagcctcccaaaatgctgggattacaggcatgagccaccaagccaggcctatttttagttttttgaggaatctccaaattgttttccaaaatggctttactaatttatgccactactaacagcgtagttgttccccttttctccacatctttgccaacacttatctttcatcttttttataatagccaatctaacaggtataaggttatatctcactgtggctttaacttgcatttttctgatgattagagatgttgaacattttctcatatgtccattggccatttgtatgtcttcttttgagaaatatttatttaaattctttgcccatttttaataggattatttgtttccttgttgagtagtttcggttccttgtattatggttatctttctaaaatttattactactttgttccctgcccttttatacaaggaatgatacttcattttttacttaaaaaagtcaagtttatcatcctgagtacccattgttattccatgaagtgatataattccatatctattattttctactttcttcttcaggttgtcagctatcagtacagttccctttaatagccctcagccataccaatgaaaattggttgtttacaatctcttctagactacaaaaccagataattcattgtatcaagcccttattataaggcttaagaatcagtcaagtgctcagtgaggccgtagaggaaatgtgaattttgtagctctgatagggagtgactttagcctctacctcaagtttcactggccactgctgatttggaagttgtgtatcaacagatgaagtgacaaaaccatccttagtaaattaatgtaactacaggcagcaccaggttaacacttcttcttacatgcaaacagctatctggctggcctaaggcattcttctcccctagtatagctgcttgcatttgtttctcctctttcctcattccaagacttaactgctgacaactgctgcaaatcagaatggataccctaatcttagccaccttaccccataccctagtgatagtcctgagtcatcctgatatgaaggttgaccaggatatcataatggcaatgatagtgcttgtaggacatgccatttgagtgtgtattctgtgccagatactgtgctagaacttcaggtgcatcattgttttaatccttaaaaaatcactttcagaggccaaggcagatcgatcgcttgagaccaggagttcaaggaccagcctgggcaacatgttgaaaccccatctctactaaaaatacaaaaaaaaaaaaaacaaaaaaaaattaacaaggcatggtggtacatagtcccagttactcgggaggctgagtgagagaatcacttgagcccaggtggacagtgaggcaacatcacaccattgcactccagcctaggtgacagaataagaccctgtctcaaaaaaaaaaaaaaaaaaaattagctgaggagttattgacctgaaacccattgaggtaaaaatatattttttttgagacagagtcttactctgttgccctggctggagtgcagtggcacgatctcagctcactgcaacctccgcctcctgggttcaagtgattctcctgcctcacccttccgagtagctgggattataggcatgcaccaccacgcccggctaattttttgtatttttaatagagacagggtctcaccatgttggccagcctggtcttgaactcctgacctcaggtgatccgcctgcctcagcctccaaaagtgctgggattacaggcctgagccaccatgctcggccccattgaggtaaatttacatgccaaataccaccaccttatcaaggtgtcagtgttcttattcacagtctccaggataggtaagtggtggtggcaggcaagaggagccgtggaggagaggagaaaggagaagagaaggaaatccgaagccagctccgtagggtgagcagaagatgggaagagatgagaattcagcatggtccagccccagcagcttttagggcctgactgtctatggtccctgtttctatatcttttaccctccacccttacccgtaaggcttcctttcactgccaggaaaccctgaacttacagctgaggaagtgccagctctctctgcccatctggtatgagaggaagtgtgtcctccttcaattctacaaatggaagaaatgatattcatttacattctaagctttgtagtcatgggattttagaactggaatacacctttatttgaatgaggagtctgaggcctaggaaggcaaagtggttcatggaaactctgaacccaagtgcttttctaactaaccatgcttggtgtcacaagttggaactctgaatgtagtgtccccttgttccgtcttaaagtctgtaaaattccacctgtattttgaattaaatttaatttatagattgacctgcgaacaaaaccatagtagaataatactgtttctactgcaatatatattccaatcaccaaattataaagaaactttggaatatcctgtttgttatttgcaaactgtctgtatctgtgcttagatggcctccaaacacctaattgtgacccagacttaaaattcagttttcctcagtgacactctggtctgtctcagtacacatgtgatcaatacacaggttttcttttaaaaagtctctttaaaaaacctgattctcaccagatggtttcatgacatttgggttttagagaattaacagattattcattgaaaggaatagcctgaaaaattgtataatactataaagacaatttaaactctgaagtaggttttccctcttactgtaagagagaataaaacacatgaatacaaattctgagtaacaatttttaaaatttataattgctcagagtacttatattgcacataaattaaatataacaaataatttactcctgatactaatatgaccagtttaagaactgacttctgtttatatatacttcttacctgttataacttgtctttttaacatctaaagtgctgataagcagactttattcaaagtgtgcttctttaaaataagcctcacggtgtagcatccctgtaaatacatattaatccagccagctgtgtgcaatgcactaggaactgtaaggattcatatgtaattcagtgaagccactgttcctcaaatatttactctcgcagattcagaagaattaagttttacaactaatatatgaaggatacatattgtgcatctctggaaatataaaacattctcagaaatgaatagtccattttaattgtaagtagtaagttccaacttgtgttcatgaaggaatgagagaagcaaggcactgcagtttccctatgttctaaaccaaattcctgttatttcatcataggaattaatggatctggtaagacttgtgaactgaaactttattccatggagcgaaaggctttatacaaaattctgcatattcaggataattaaactgccccagtctgtgttctctgcatcacctggaagcagtgccgggtgaaatggatcacgtgtaggagtgcctcacttgaaaagtgcttattgtttctgtgttgtgcttctgggttttccttgaaggaagcctacggaatagaaagggaaagctaccttgtgtgtcaacaaaaagctgtatccataacagctatagcagccattcttagttgcttcagaattagagctaaaggaaaagcccacactgctgcctctgagaactgtcttaagcatcaacgctacgcaaagacatctcgtgaaatgtggctgcatgattctgcagctgctcgtctctcagtgtctcctgtgctgcttcaacttgaagttttccttcatagcacctttttcatagtttctgttgctccaactcctggtcggttttctcatcctactactaggaaatgatcatactgatctcttgcagaaataatgtcagatatctgtgttaaaactaaaaagtttaaccagttatctacatatgttcatacttgctgaaggaatgtttatttggtgagtatttatgtaatatacaaagtctaggcactcatataaaatatcaagtatttaaattttccataaattccttgaatataggctgtattttttatgttgttttgtaactttaaaagtttctaactttatattggctgggtaattcatacaggatttagttcttatgaaatagctttagagaaaatgtgctctagtatatttataattttgactaggattatcttcagttatttgaaagagttctttgtaatgagcctaaagtataaaatgaaaatgtcatatattccaaagagatgacattcacagtggtaaaaaacctccatttctttgtatggattagtattctgtacctatgagtattccctccttctttcaaactgtcattaagaaattcaaggcaaagatgacaaaatattataaaaagtgatatcattgatgattaaatgcccagctttattactgcatgccagcaattgaacagcaggtatttgatgcatttgtagcagactttacatgtctacaacctaatttcattttttatttttttaaaaaatgaagcagtactttgttgtttaagttatggacaataacatgtatgtaattggttagaattgtttgttttgtaaatacagtgccaagagttatgtttcgctgtgaaatacaaagtttactctcactagaaaacctggaaaagcgatacagacacatttagtagacatttcaatgcattctaaggtcattaagtttatacgtcaagaattggtttaatttatccacatgaagctaggcttattagactgacttactcatgaaacattaataaagcattgtgtttagttctaacctgattataatctgaccttctgacaaaggacagaaatagaaagtatctgataacattaccctaatgctgggttcatccatcataatctacccttttaaaaatttgttttagaaaaaggccctttcacggatgtgcattgataatctcatctcgccctcagcccagcagattcctggtgctgctgggccaagtacaggctgtctgcagtcagcagagcatgcacagcaactgaggcaggggaagccaagctccagtgtggctctgctcatattgtattataacctttacagaatgtccgtatttcaaagaaaatgtttcctttttaagctgggttttttttttaagtagattataccccaaatgcaaatgtaaaaatttgcatttggggtataatctacttttaaaaaccccagcttaaaaaagaattttaagcaaataacataagaatttttggaagtcttatgtaggaattcaaaatatcaagatagacatcttgtgtttgagtgccatctctggaacacctgttagccatgtgttgtgctgaacccctattaacttcaacagggatggcaccaggttctagaggccaaagaagagacccagagccagtgagcatgacatagagttttactggggacttacctatcggggaaagtccagtggtagcaggctggacaggagacccatatggctcagtggcagcagactggacagcagaactgcaaccgcttgcaaaaaacctgctgtttatatcacatttttatttaacactcccccacccaaccacaacatcctgtatctggcaaccttcatttaacccaaaacaaagggccttgattcccattatggcctgagttccaagagatgggccagagggggctcagatattcttcacagataaggaatggatctccaggttggccaccccaattccctagcttgagactctcaactgcattcaggtgtgtctgccatacagggtctttctcaaggtttgttcaagtcatcactgtcaggtgcagcttaccgcacaccatgacacttggaagtaagacaccctatctcttggaactgcagtgtcctccttatttctcaaattgaggacttgttcattccataagtctttactgagagctagttatgagcaaagcattatggaaaatacaaagaatggccatggatcctactctaagtgaagttagagtagagaaattccttcgttcattccgtaattatgaaggggctatcatgcacttcatcctgctctgggctctgggaacacaaggatgagcaactcagtgagtggcttcagaaggtgcactctagttagggacacagacaaataaacaaacagtcccagtaaacactgatagtgtttattcaacagatacctgttgagtgttccgggtgatgttttatgtgtttgcaaggatccctgccgtcctggagctcacttttgatcaaagggagacaggcgatagacaattttttaaaagtgaaatatctagtatcttagaaggtgaccggtggtagaaaataccactgcaagaaaaggagactgtgagtacctgcaggggagagaggtcaggacagcctccctatgaagggagattagaggtaggcctggaggagcagagggagggagccaagtgactctcttggggaaagagcatggtgggcaaagggaacattagagcaaaggccttatggcagggatgtggttggcaaggaggccagtgggccaggaaagggtgggcaagtgggcacacagtaggacaagaggactgagtagtagtgggggagcatcacacagggtcttgaaggccatcataagtactttgcctttttaccctgagtaaaatgtaaagtccttgcaatcttttgagtggaagtgtgactgatcttccttatgttttgaagggatcactctggctgcagtgttgggaatgaatgattctgcaagggtagaatcagggagatctgctagaaggtaatttgagagatgatggtggcttggaccaggggtagcagtaaaagtagtaagaaattattgattctgggtgtattttaaaatttgagcctatagtctccctgggacttcctaccagtggccattttccctcaggtatctctagtcttacagaggcaggtgaagggctggggatgagcatgcggagtagtgatggctacagcagcagagatagataaatccatcttagcagaacattttagagagttcagctaaaatgaaagcgtgggtgtttagtgcctgttgtcaacttggccctttagcagaaattctaagcagcggaaaaagccagagtcaacatgtttatcctccgctagactgtaatctttttcaggacatcgaatgcttattcatctatgtgtcctctaaggctaatgtctgacatatggttggtggtcagtaatctggggcaggagagatattagactatattcaccttgtttatttgcatttcagtgggatctgctcccaaagatcagaggttttgtcttgtttgtcacagcatcccagggcctagaacactgcctggcacataacaggtgctccatgttgaatgaatgaatgctccctctgtttgaaatgcccttctcccagatgtctttatagttcatttcttcactggggtccttaattgtcacaaactcagagaagccttccctgacctcctcccctaaactagcaatcctcccccactacacatacaccctactccccatcctgcttttctgtttccttcgcacttgtcacctgctgacacaccctgtatcttactaattatgttagtttttgttggtctcctcccagtacaatgtaaactctcttgcagggactttgggtttttttgttcactgctataatcttacaatctagaagagggtctgtcacaaagcagatggccaatcaatatttgctgagtgaatgaatgagcttcttccccagccccgccctcattactgacatttcctttattccttcctcttgtgatcatcacatcttttccactgctttaattaataaacctataaatatttattaaacagttattatccaatgataggttaagagttgtgggaaatgcaagataagaattagataaagtccctatcttcaaaaggcttacattctaattgaggatatagtattaactttggaaacaatgaagtgctaattggcaatcatcccattcatttgtacagtacctcacagtttgttgtaaaatgatttcacaagtaaatttgcatgtgttatcttactctattaagtaacaagaggatactgatgaaaagtgttgggtagaaattcatagaaaaaaacaagtgagagctgagaacacaggaagcaaacactgaacttgagtaagaaggatgagtaggtcttcaaaaagcaggaagacaatgctttcaagctagagagaaagaaagcaaaagctctgaggtcataccagctgctgtgtgcccaagggctgtgaagtgtctgtgctggggaagctaaggatttatatcaggaagtcctgagaaacagtggggaaaggtgggatggaggtttgaaaggcctgagtcacataggttatgctgggaggagcagtggcagctttgaaaaagagaatggcaatgtggacatgatggcttgacaagtctgtcccacaagcaggacaccagacagactggattcagaagaagtttgaagtatgttgtagtaacccatgtggagagctgtgagggttagaaataatcttctgtcttatacatccagaaacagtcaagtactggaataatttaagccccttaaaataaacatcaaagacaactatattgtctctacttaaaacagttgaattattgaagttgtaatagctacaacttcagtcaaattatgaaaagaagatggcatagacactacagaagtgacaatatggctttctgattatctacttgaatatatgcaactctatttagagaattttttaatctcaaaagcagatttttgacgtaatgagaaaaagggatgggaaatatttttgctctgatctagaagaagacatgggtatttaatattcttaaattttaaaattcaggagaaatattgtctcctcacagttaaatttggtagtctactttcttttttttcataaatttcggagaagctttaccccaaacctgctagagaaagaattctgtaccatccaatactcatgggagaaaatagaaattagaatgagggaaatattatccatctaagagatatcctctctagtttaaatatcactctttatttccttctttccagatccccagggtagagctctggattgggaattggtttatctaggcttaacgcaattgcttctgcctttagatatgcaagtagagggtaaagaaagctattaagaccattatgacactaatagcttagtaatcaagtatttctttacatttttccaatgtaagtattgtactaaaaatcccgtttcaaagtgccaaataggtttgtatataaaaatggttctgaaaagaacaaaataaacagataccaatgaccggtcaatactgtttatagtaaagagtcttaatgtcaggcttcagctttagacaagttgttatattttaattattgatagctaatgttccattcttagatattcatttaattttgaactagatttagcttttaaatgtgtaaactgtatcttcttttctttctgcacagtaagtggcaagataaaaaatcgacaagactttgtttaacctcttacctcattgttcctttgccatttaattttataataaaaaagacaaaattatttaactataattaattatttattgattcactatgctgcctctctaagatatagaatagggtaaataactatagacataaatattttttaatttaattaaagactattatgagcatctatgagctaataaatcttaaaactgagatgaaatggatgaatactgagaaaaatatttaaaatgtcaaaattgagacttacaaggcttatggaaatttaaatggtaaaatcttcccatcccctcctcaaaattcaaggcccatattacattacacgtaaattctaccaaattttcaacagataatgaattcattttcttatacaaattgttccaggaaacatggaaagctatccagctaattttatgaggctagaattccaaaaacagtgaaggggaggaaaaagaaataaggcttatttcatgtacggctataaatataaaaattctaaatgaattcttatcaatgttattaaatgtgtgtgtatatgcctgtgtgtgtgtgggtgtgtgtgtgtgtgtgtgtgtgtgagaattgcatcaggactaagtagagtttaacccttaagatcaggaaaaagatagggattttccacatcaccactgctgttttacatagttcttaaggctaagaacaattctataagaaaacaaaaagttgtaggtgtaactactaagagtggctacaaacacaatcaacttctagaaatcagtatcattgttctacatcattaataaccaagtataaaatatagtttcaaagtattacagttgcatcaaaatttatgaagtatctgggaataaacttaaccaagaacactaagataaaacttttatggagaaaattttattttttaactctaataaaggacatagaaaatgatctgtataaatcaagatatttggggaccttggatagtaaaacctagtgtcagtgttcacaaattaatgtataaattgattggcattccaatcaaattcttttgatatatctatgcacttaatgtaaaagttacaaagaagaataaatgttcctgaatagcctagtttatcctgaaaaaaagaataaattctagcacatattgagatatgtaagaaataagataattaagataaggtaataatagaaatgaaaaatatagaaagctggacacacatacgttgacatgataggtacatagaagagagagcaaaagaatataaagataaaataaattaagataataatagaaatgaaaaatatagaaagctgggcacacacatatctagacatgataaatacataggagagagagcaaaagaaaaggaggaaggagactgggcttctatgtagattatgatattatctgtaaataacggcagctttatgtcttcgtttcaaatatatatttacacagtaaagataataccatacatctctgagaaaaggaatttttgtttaatagatggtattggaaaaactcactcactttataaacaaaaataagactggacccatatctaatatcatatatgaatgaaagtagatgtagattaattaaagatcaaaatatgaaaagtaaaaccataaatataaagctaaatgatacaaatatatttatctctataattcaagacaaaacctcaaagcataaacatttttaaaacatgatttgatgatctcaaaattaagaaaatatatccaacaaagaacatggataaagttaatagatatatgacatttgggagaatgcatttgcagtgtttcaaaccaacaaggaactcttatctaaaatatataaatcaggccaggtgcagttgctcacatttgtaattccagcactttgggaggccgaggcaggcggatcacgtgagctcaggagtttgagaccagcctgggcaacatggcgaaaccctgtccctgcaatacaaaaatacaaaaattagccaggcacggtggcgcatgtctgtagtcccacccagctactcgggaggctgagatggaaggatcactggagcccaggagacggaggttgtagtgagctgagatcgcaacactgcactccaccctgggccatagagtgagatcctgtctaaaaaataataataataaaattaaatatataaatcaacaatataaagacaagaacctccagtgtttaaatgggtaagggatatgaacaggaaatttacagaagaggaaacccaaaagaccaacaagcatattaaaaagatgtcaaatctgttagtaatttgaggaatacaaattaaaacaatgagatattattttgtatctcttatactggccaaaattagaaacctggataatactaacagttgatggagataaggacgtatagaaactgtcatgcattgctagagagtgggcacggatgactcacattaagtatgcactcccagttctactccagattataaatcccaaagaaattctcagaaagatccaaaaggggcatttatcacaggcttgtgtcatggggattagaggtagcctggtgtttgttaccaggggagttttgtgcagccatgagaagcaatgggctagtcacacagtgacacaggtagatttttaaaataatactaagtgagaaaagtaaggaacaaaatgaaatttttaaccctatatatttttatagttcaaaagtatatccacaaaagaatgagtaatattttataagggcacatgcaaacaaaaggagaaacattaaatacattatagttattgcccatggtggtggaaggaaatgaaaataggagatggagataaaagagaaaaaacacattttaaaagctcaaattattgaaaagtcatcattcccactaccactcatgattccattaggtattttattcaataatggttttactctaatagagataatagtaaatttcatcaaacctttctttagtggtatctataagatatatttgtaatgaatgcgcttagctgatcatgttggtaaaatcttcctttaaattatttatctgattccataactaaattgaattcctgtgaatagacttgagcagtagttactcaataatgaacctctatttactcattttttaaatcccttcatttattgcatcagacactgaaaatattactaaataattagactgacattttttcttaattgaatagttatagagaattgacaaaatcatttatacaaattgaccaaactaatatagacataatacagaattttaaccatctcttctttcagactcatttcctgtgttctactctgaactgttatttcaagatcgatgagatagacaatatagaaattctgtttgcctttagtatggaaactgttctttcataaaatgtcattgtttacattgctgaatgagaaacatccacactaattggtgtagatgaaatacaaaaaattttgaaaggaataaatcaggaaagggattgaagggaataaattactagttaaatgtgatcacaggaaaagttgaaaagtattatttataatattttatatacttaaaaaatgaaaagcagtttttggcaatcttaattcaagaaatcatttattcattaagtgaattccaaattggtttcaacaccatggaaatcacagagaatgactttgttcacatatttagtgaccgccgtaatttagaaaattgtcttacatggctctgcaatagctgaaatttacaaagctagatgtacagctcttttccatgttgttgaaatcagtgtcctctttaaatcactaggaagttgatgataaatgactgcagtaagtgagaggcgtagtgagccatgcaccatcactacttatttcacggacctgagcaagactccctacctacctgtcaagacacctctaggaagcttctgatggcttcttaggaaataaaaaggccttttttttttcttttttctgtttatggaaacttagtatgggccttgactctcagtaatttatatttctttcccattagctagcaaacatccaaaattgcccagtgattcccaaactgtgtaatagctgagttaattcatagtggaagaaagatattcccttctagtcatctcagaggtaagctggaggacttcaggcaggaaaataaatgtatatcagagtttctcataaaattgcttaatttcaaactaatatttaaaaatgagaaatgaaactgtaacatggtattaaaaaaggtaatttaaattatttttcttttaaacatgagtgtgttttaataagaaatttatttatgttaaatcatattatgtacctaatggagccaagagaaagtttagcattttagaaagggaaaattttcatttaggtctctgtactttcatttaggtgtctgtaaaatactactgaggtagtatttttccatttctaggaactgaagatctgatacatataaatcaagtacagaaatttaaagagcatattctcctttttatatatatttcaaagtaaaaaaaaaataaaaggatatgaaggtgtactaagttttgatggtctctcatttctttcttgactcatttcaggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggtaggtgttaaatcccatattattccaaaaatttctgtcatctctcaaacacaaatttgacatttcatctctttctgtataattttgttttcaacataacttcttacaaaacagatttcaggttcttgacatatgtggaaaaattgaaaagtcccaaaacaagtaatgcaaccagtatgtggttcctttttaaatttcagacactttaaatatacttctatatctgtatatttgtttttcttacttcaaaatttacattaaaatatgtaatgctttacgtattttagtaataagtgaaacctagctgaatatttaaataggaatattccacattaacataatctgccactgtggctattcttaaaaataacagcacaagtgctaggattacaggttcagtggctcttgcctgtaattccagcactttgggaggccaaggtgagtgaatggcttgagcccaggagttcgagaccagcctggccaatatgctgaaaccccatctctacaaaaaatacaaaaattagcagggtgtggtggcgcagctgtgtggtcccagctactgtgggggctgaggtgagaagatcacttgaacccaggaggcagaggttgccatgagccaagattgcaccactgcactccagcctgggtgacagagcgagaccctatctcaaaaaaataataaatataaataaaaggaatatttctaccttttagacagaatactcaaaaacatgcatgaatgaaatagatgcagttatgctattttattcttatgtgttttcaatctgaaatgtttatagctaacagttgggaattatgtgctgtagtatgtatatagtatttttagtgaaaatattcatataaaatattacttaaatcatttctacattgcacaaaatgatttcagataagtggaaagagtgaagatgcaacagctgctacataagtgttgcttcaaggaagtgatatcccagtcttccattctaccagatatctgccatctgtcgtatgcaaaacaagtaatcatttctgcatctccagccagtggaatgcttttcttattttttattttaaaggtggaaaacttggagatgggcgcaatgaagctctacagaaaaatttgcattcataagtttatttcttatatacctctataaaattaaaatgactccatttgtatggttcaagcaaagaagaggaaaaggaagggaagagcctcataatcattgatccttggacccttagggcaaaatattctgagaacacgttgcaagcgtattattaggggcaatattgtaccatattgtgtgcacacaagataaaattattgcctgaagccaagagaaaaacatagagacagaatgaatgaatgagagagaaggcaggtgttatgaaatggctggtgaaataaggaattttctctacaaatcattacactcacccaactgagtatccccagttgtgtataaattgtaatcagattatttggtaggagataattctgagcttaattagtctcaactgtacacccttgcttattacatgcctgttttattaaatactttataaactattcttttaaggctaataccttttagaatcagaaaaaaagaaaacagttgtaatagttcatccttatattctaagatcaactgaattgtcttttgacttctaaatgtcataggcatttttgcttttggatattttgttatacatttttacccattataataaagtcctgttcttataaagaaagttgcaagttaatcctgttgggcaaaacaaattaaatacattaaacacaaaataaaataaattaaataaattaaatacaaaataaaatacattaagcatcttatatgtgatgaaagtgcaaggcagcattaaaattgacagaaaaatagcaggtttgtccaatttaaatgagggtttaaaaagagataactgaaagaatttgaaaatgaaattaaaatggaaattttctttacatggatacagtgttcattatttgaatcttatcaaaatacctgtttctacaaaataacatcattgctttggacagtgaaagaattgtgtataaggctttgttaatgtagaacttcttaatgaaacattacatagaaatgtaaaatttaaaatgtaaaaattaaaaattaaaaattgtcttctgttgaatgggaatgattcaagcatatgttggcatattatatagatggtctgaacaatatcttgtattacagcttcatgaccttctagtgatgcagactctctgctactagggtgcctcagctcaggactctgtctcctttcagcatgctcattcgaagcacataattgccagacactcaggtttcattagagagacccagagtcatactgtgaaatgttatgttctttctccccagaccccttgcccacttcctcaaccctataattctgtgtcagttcttagaacacgatacatgtgaaggagcgcatacctggaatactcttacttcccttcccccagcccccagaggcctgagcacacatcagcagagaggtttaccatgaccctgtggacctgtgtggactcaagattgcttaggaagagcctctatctccttgtgaccactagggggccatttagtacagtgtagacataacagattaaatgatttcaaggaatgctagttaatttcccctttcccacttcccaccattcccccctctaacatattcccattgctgttaatgccagttagccaagtagaagctaacagattcccacaaagacagttctgcactaacatttaagaatgtgaggaatagtgtcctccaaaggacgagagcccacctgaatcctgtgagctgggtaagtgaggccgagtcattcaatctcactttacctcagttgctctctctgtaaatacatctattgttataagaaagaacccagataaaatggagtgaagtacagcatattcattatttagtggtcatttatgcacccttacctatatacaacccctatgagtagaccatgtgggaggcacaatacctttttttaaaacattcttgttgagttcctggaggtcttgtactgctgtgttgcgacttgagagagttgattcccacctaagtggttggacacagactcttggaaaaagcagagtttaagatattaacccttttattgagctcaatacatttattttatttgataatgtttatcttagtatttttaaaatacaaagattgtacatttcatatagataaaaccaaaggaaggctaattatggctacactaaactccatctagcctaagatggattttttcatgcttaaattaaacactaatttaaaaagagaaatatttaatatatgaatatctatatatgtctcctttgtaaaaaaaaaaaaaaaaaaaaaaattctactacttgcctataactttgagttttgaagttagtgctaaagtttgagaaatggcttaaggttattgattcattctttcttgacaggtgaaatcatgaagcagcactaaccacagcaattatggcattaaaatgtcaagaaattagaggtcagaataacagataattttcttctctatgtcagattgaaaattgacattctttgacagtttaggaactctggctgagaaaattatgacagcttaacttattttatacttgtaaagcagtaattgataataaactttatcatgacagcctctgggcagaaacatgacagtacagttctggtacaaagctcttcttaatatgtaaacactagatctgttggatagtagatattatttaaattgtctaaagtcttggcttacatcgtaatcttctatgcactttttttcatagatgagctgtactatttgagcagtttttcaagcattataaagaatattttttcttatcggtttttatatattaataaaaagtatatgatctgatttatatttttacttactaaatgatgaccaagaaacttcatcctatgacctgcttaggaaagagaatattctggttggtaatcatttagtcccatggttttctaacaccttgatgctcaaatgtggcccataacccagcagaatcagcatcacctgggaacttgctagaacttcagcctctcagccttccccaacctactaaatacatgtaatgagatccctaggcaacttgtttgagacattaacttttaagaagcactgctctactaaaggtgtgttagaatcatttggaaagctttttttttttcccctacaaaagtacagagaatggtataatgaacctccatgtacctatcacccaatttcaaaaatttaaaaccatttcatcaaaacctcacccctccccttgtattttttttctttctttcagagacagtctcactctgtcaccaaggctgaagtgcagcggcttactgcaccccacctcccaggttcaagcaattctcccacctcagcctcccaagtaactgagattatagacacccacaaccgcacctggctaatttttgtatttttagtagagacagggtttcaccatgttggccaggatggtcttgaactcctgacctcaggtgatctgcctgcctcagcctacaaaagtgctgggattacaggcatgagccactgtgcacggcccccctgtactatttttaatacacatgtcatacccatctaactccccatccactctatcctccccatcacatgggcatctcagaatatccagggaaaggcttcaatgaagcaagtcttattttgaaaaaaaaaaaaaaaaattatctgggaatttcacacacattcccaattaaaaaccattaatctagctaacactctcattaaataattttttgtttgtttgttttgagacagagtctcgctctgtcgcccaggctgaagtgcagtggcgcaatctgggctcactgcaagctctgcctcccgggttcacgccattctcctgcctcagcctcccaagtagctgggactacaggcgcctgctgccacgcccggctaattttttgtatttttagtagagatggggtttcaccatgttagccaggatggtctcaatttcctgatcttgtgatccgcccacctcggccttccaaagtgctgggattacaggcgtgagccaccgcgcccggcctaaataattttttcagctgggcgtgatagctcacgcctgtaatccccacactttgggagaccgaggcgggtggatcactaggtcaggagttcaagacctgtctgcctcagagtatgattatattgtatgccataggcaacaaaaatggatagaaagatgggaatgatattataagttgtatcacagctcaaccattagtatttgagtgacattaagtcagtcacttgaattttatgtacctgtattttctcacctaaaaaattgatgacagagatgatacctaattcatgggagaaaaatatgtgaaaatacttaaactataaagcactacacaggcattattacctaaaggcataattaaatgaagttatcttagaagaacttttgttttaataatttcattatatatgacaccaaaactatcaatttaattttaaaaaatctgttagcaacagagaaaataagttaatttgtttttaatattatttagtaaaaagaagcagttgtggcttttaaatttattttcaatactgtctccaaaattttataaagatggcctaattgcagcccacttattgcctgtaacattctttcttgatctaaattagtattagcatttatatcctttattatcctttatatttttaaaagttttacattaggccaggcgctgtggctcatgcctgtaatcccagcactttggaaagccgaggcaggcagatcacgaggtcaggagattgagactatcctggctaacacggtgaaaccccatctctactaaaaatacaaaaaatagctgggcgtggtggcgggcacctgtagtcccagctactcgggaggctgaggcaggagaatggtgtgaacccgggaggcgcagcttgtagtgagccaagatcataccactgcactccagcctgggcgacagagtgagactatctgaaaaaaaagttttactttagtgtcattagttttgtattcatattatcaaatgaattagcaacactattactggcattaaagttgtactggttcagcaagagaaaaaaattgagtcagtatttcaacagaagctgtaagcatataccagacaagttattaacaagatactaagttctgaacttgtcataatacttgtcatcattctatagttgacgttgccagactgaaaatgatttcaatggcttctttttaacggtgagaggtatgcacataagtctatcataaaaggctgttttgctggcagctattagaacatgtgagccattgcaatatttatttatagatatacacatttatttatgctggaaatattaaaatattaagtagtttttaatattaccaacagtcataaaaatgtggcatttttagtctaattttctgttaatatttcttggctttcttagcttatagtttctttttctatctttttctcaatctgacagggataacactgcctccctttggatcggctatggtgaaaatatgcccataggaagtaggctagattacttcagtttttactttattttcttgctgaaatattccttgctactacagagaattgacatgatagggctgtcaagaaccagaagatagatgtgtctttaaccaaaacagctgcaatgctggcttttctgagaagatgaattcataaaatttataagacaaaaaattaacacactttttcatcctgatgatgtaaatgaagggtaatttaagggcccataatgacaacattgaggacctctacaatcattgtcttccttgaattctttctattattctttattctttctatgaatcctttattcctcagcctttcctccccccatttctgattctctttgatatgacaaggaatatcaacaccacctgcccgatctgcgtgaatgagttgtagcacaaggttatccatttacaactgccatgatgcctaattgtcttcatatgggggatatccagggttcttctcctgggcagttattctgagaagtgattgcaacaaatgatcacaaagtgggtgattaagatttcttaaaaccatcttaatttccccctataattactgcatgttttactgggatgaaaattttaacagattcaaaagccaaattaaaatggaaagaaaacccctacattttaattagtggagtgaaaatacgtatttggtgttctttaaagctaaaggatcattttgggaacatgaaaaataccatgattcctaaaactaataaggatataggttcaaatatatttgttatgtgtttctcactgcaaaggttttcattgagagccataaggcttgcattgcaaaggtttgatgaataaggttttaatatagaaattagtatcaaggaaattaatgacacacatttaattttgattagtgaataaatctttaatttaggtctatcttacctgctcataattactgcagtacttcactaggccatggtcatcaatcgtccactagaaaagcataaataatgcagctagtcaaagttggatgtatgtcatttatgtgacttgtgcttctttcttcgctttgtgttatttttattgtgtggtgttgagaagtgctaattattgattttcagaaattaacagcaagtactttcacaagcatctaaagccatattttactcaagggaagaagggtgaaaattgcagcctgctgtttataatagaaatagctggaagggatttccttatcttctattaacatagatttcacttctataacacagttgttacctcagcataaattaacaattattcaaaacatattgcatacttcaatttgttgaaatagatattactcaatctaagtacctagacatttcagttagatatttagaactcatttttaaacattttaaacatattgataatgagcctatttaaagccatttgaagtctcagtacagtatatctaaattactgttgcccatttatgtcaaaatcaagaatattttgttctgctgaatacgtccaataatactttattctcactttagtatactaaaagtatatgatttcaatttggaatatttataccagcacctggtaaacctgtgtctcaatgtcattccacataccaaacaaatctatttcagctttttaaaaaaatattttcccatgattaaacacttctagtgaacttataaaggccaccacttctctctcgttcctgctcctacaccaccacctccccctcaacttgttttcctcctccttcacctcctgaatcagccagcatagagtttagtttatataaacttattcaaccagggaaaatttggcagggatgtcatactgattgttctcacctgtggtaaaggatttgtggattgagtcctctacttaggtaccatttaatgattaaccccaaagtgggcaaagaaccagaaacctggaagaatccttaagcgatcatctgctaaaatcttcgcttccaggtaggcgaatccctaagtcatctagaaaagagtatttcagttctcttcctgagtatcaacaaatatttattgcaatgagactctacagcctttcctatctgcttacaatgtttatctctgaaatatttaaaatcctcagtgaaaatgccccttgcttggatataatctttttttggtcattcctaccccaacatgtagcaaaaggtaaccagcatttctctcatttgttgtgcctgaataacaatcctatttgtatcagtcaggatctcagcacattacctttcaaagcgataatgaagactccaaagaagacatacacatgaccaacaagtatgtgccagcatcattcatctttagggaaatgcaaatcaaagctgcagtgagataccacctcacacccattaggttagctactatcaaaatagaaaataacaagtgttagtgaggatgtagagaaactggaaactttgtgcaccattgataggaatataaaatgctaccactggcgtagctgctaggaaaaacaatatggcaatcgttcaaaaattaaaaatagaattccctatgacccagcaaattctacttccggatatatatccaaaagaattgagagaaagggcttcaaagagacatttgtatacctatgtccacaggagcacttttcacaatagtcaaaagtcgaggccaggcgcagtggctcacacctgtaatcccagcactttgggaggctgaggcaggcggatcacaaggtcagggatttgaaaccagcttggccaatatggtgaaactccgtctctactaaaaatacaaaaattagccgggcatggtggcaggcacctgtagtcccagctactcgggaggctgaggcaggagaatcacttgaacccgggaggcggaggttgcagtgagctgagattgcgccactgcactccagcctgggttacagagcaagactccatctcaaaaaagaaaaaaaaaaaaagttgaaagcaacccaagtgtccgtggatagatgaatggataaacaaaatgtggggtggtgtatgtgtgtgtaatgcattattagtcaaccttaaaaaggaaggaaattctgacacatgctacaacatggatgaaccttaaggacattaatactaagtgaaacaagccagtcacaaaaagacaaatcctgtatgattccacttctatgaggtatcttaacgagtcaaaatcatagagaaagaaagtggaatagtgacccccagggactagagggagtggcgagtttttgtttaataaatatagcgttttagttttagaagatgaaaagagttctggagattggttacacaatagtgtgaatgtacttaacactactgaactgtactcttaaaaatggttaagatggtaaattttgtgttatatatattctaccacaattaactttttttaaaggataatgaagagagtttaataatggttctatttacaaaggtatagacatggtaaagtggatgaacaagggaaagcgacaaggaaagggagccattcccagaatctggcaataaaagtgctcacccaacaagagctgtggccttaggtagaggagtactggccaggcactgccaaaacgggacttggcagagaggggccatataatcctgtctctgctcctgagctctgtcattggctgaacccactgggaaggtagagagcaagggagcacaggtctatggaggcgcatcttccagagccaaagaaggtgtccagctcactggtctgttccccctgggttgttcatttctctaggccaagaagacttatttaaggcttccaggcttgctcagccacaatcagctacattaaaatgcactcactcttcctacctgagttgacttatacttattttaagtggagaaattgagtgagcttgtcattgatggcactgatctgatttggacagaaaatattctggatggagcattttctctccggaggaaatgatgcttactttttcacattcatttgttaagtcagttatgtaatatcaccattataattcaacatgccaaggaggaaacagggatcagcaagaggataagtcacatcttaattctacttagatttacgctaaaagaaagaaaccaagaattaaggcaggtaactggacaaatcagaatctctctctcaaatattgtctaagtgcatctactaattaaggcaattgtggtccctttttactcggattaccaaatatttgcttaaatattctaataattttgccaggataattttagccttaatgcagttgaaggttaaaacaaaaggaaaaatatttattctcctattttgtggtttctatgaaaaactagaagcagttgaatataaaatagcattttaattttttatatagtttaatatttataaagcaagaaacaacaaagtgcagatattatttgcttgatttattttgctcctgtttttccagcattaaaaagtaatgctttatatgatcttgttttattacaacaataaaccagaagcaaaagcttatcagttaaaatgtagtctgccattaagtaacctttccttttatcatttcagacttaaaattccattgtttttgtttatttttttcctatttggcattggtagaattgcaggtggaacagaaagatgatatcaatcacatgtatttttttattttgtgtcaagcttgtattttttggtttaaaaaagagcacttttaagtattaaaagccttgtaagtaagagctatacagtgagataaacaaaatgctaaggaaactttgaaaatctttttctgttttctcaagcaaccacttttactacttttttcttgaattttctgaaaattgttagtgaatttactggtatttggacgtagtttgatattttgcattgtgggtaccataacctatagtactttataaaatgctgatttttctgaaaaacaatttaaaagtttatacagaccagggagatggatgaataggtcatttgagagcctgtattattagctccttcatgctgtttgtcatggctctgtagacctgacggcatttcatctgaaagataatactgaattacatttaccaaaaaaaaaaaaaaaaaaagcagttgtaatcattctatggagaaaaatgtaaatgggttaaatctacctgcaatgtggaaaagacaagattaacgaaagtttttgcctaccacacaccagagaaggtatggcttctgaattctggcttacttggttgccacatttaattttaccttagtaggaagtcttttatatgaataagcaaatgtgcaacacataagcacacattatatttatcgatttccttttctgaggattcaattccaggtatgtatctttattcatagaggaggtagaacttccttggaaggaaagccaaaaaggaaagaaaacaattaagagatacggaggtcaaagaaagaaggcatgtgtcacatcatagctaacacacatgcccctttgtgcacactttagaggacaccttctctaaatggatgaattacaaaaggcactcctttctctggctctccaggtagattctattacttatttgccttccaactgggcatctttgtacagggcataaacagcatacccatgcacggtggccctgacctatgagaaagaagaaagactcaagagaacttgttaagtaaggaaaaaggggactcccatgaagatgtcataatttcgtaacttagtaggtgggtcctgcagaattgtataaaggagagcctcatcagactaaggaatgggataatcaggaagtagggaggggacaaaagagaaagtgtccctaatcgaaacttttccttaatgggagctctatatacagataagcaggtaaaactgagttatgtgtcatatatgtgtttgtaacctgaaaatcatttatgctgttcagattttcttattttgttcatttgtgcataactcacttcacatttatctttacttctctgcctatacctacaaaattccatgttttagaacttcctcaaggtgttcaacctacctatttctcggtgagtcttagctggagagaaaaataaatgctaagtgcatgatgtcagttcaataaatattcagcaaacaattttataatcagtaagaatccatataacaattaaaatttaacactctttaacttaattttcatttctactttaacaattccaggtaaagaaataattattataattattttatgagacaattgagttttgatatatacaagttttattaataagttatcagtaccctaaaagattacataatgtaaatcattactttatttacagcttcgaccattacattttgggttcacaaatacttacagaaaataaatacacaaaaccattttggagaaacactttggcagtaaaactaaacttactcctaccctatgactcaccaatcccatatctaggtatagaccctccaaaaactggctgctaacctccatcaaaagacatgtacaagaatcttctaagcaactttattcacagtaacctgaaactgttaacaacccaaatatccatcaacagaattgataaattgtgttaggttaatacaggggaatactatacagcaaaagaaaaatgaacaaactaccgatacatacaacaaggttgaatcttgcagacataaagttgatcaaaaaaggcagaaacaggaaatatgtagtgtataactcaatttatcaaaaattcaagaataaaaaataattgatgataaacatcagaataattattagcttgacagggtgatggggctagatagggggaataattggctggggaggcacacaaggttaccagtatctatgtattctctcatgtacccaccacccagaccaagatatggaaccttctagttccattccaaagtcctctgtcttaatgtagatggtggttagaagaactgaaaaaatgtatatacatacatatatacattcatcaagctgtacacttaagattagtgtaccttatacacttttatcttaaaccttaaaaaatgagtaatttgaataaataaataaaagtgaatgcacataataagcttaacttcaggataccaaaatcagtgatttcttaataacattaagaaagaatattatttaagtacaagcaaatctatattttcatgttattctaccaaagtgttgtctaccaatggctgcatggtcttttgtatttgtgaaacatcaaacgttttgttagccacatttgttttaaaaaatctagtggtttaagcctattacctatgctggctttgtatgaaatatgtaagactcatgataccactgtttaagtaaaaagtcactatgatttattgattctaagatgcacaccattttcatatctcaatactccaaaatcataatgtgtcttacaatcaatcaatcatagcatattttaattgatagcatattttacttattaatagtatataaaataatggagcttctaataatggataacatagatttaatgaagttggattgatggacatttccaaagttttagtctctttccatatacattatacatgctcatgagctcacgtgttcaatgttaactcattttgggtttactggaaagtacaacagatacacaaagcaactgatatcttgtaatacaaattaaagttttcattattatattttaaaaggattcacaagccccaaagcatataagaaccagacagggaatagatgagtgacacaagccagtggcagtgcccaggtcatgtgagtggtgggcgttacaaaagggcagttgtgcaggaatgctgatgtggtattgcctgatctgcgaagtttttaagagaagccaaaaaatccaatttcttgtatgccatttactgacctgtaaattttggctcaaatagaaaccatgtctgtgagctgaatctagcccatgggatgccagtgtgtgactttgggctgaatgtaagctctttgagggcaggaatctttatctgtttcattttaccagtatcattaatatctagaatggaatctagtatgtagtaggtactcaacaaatacatgttttgtgaataaataaagttaacgttaaatctcactgacccttgcagaccaatgtatagagaaatagatacatgtagaatttttttaatgacatttctggataatatagaaggaattcatctcacagttccagtagtttctttttttttttaacttgatatatttggaaatttttaagggaaaatttctatatggtagaaaaccttttcatgctgtggacaagctaattcttacttaatcttcaaacctgagctctgtcctttttccaaaagtctctttcctaagaacctattccccttcccctctgtcactcgtctgggctcccagggcagcctgggcttgtctcccctgtgtcctgctccctaccatgtgcactgacacactcatcgtctttattttgggggctgctaacttcctgaggtcagcctggtatctgactttgtatcccttggcatagagtaagcattcaacaaatgtctgttaattgtttttgtggtattgaattgtaaaagtaaaaaattctgaagtgcttttctttttctagaccaggtttcagttttatacaaatgccctgcttctgtattcaccaaatatttttagaatctctgttaagactaagtcaccatcctgacctgcagagattcagtctgaacaaacagacatacataaataattgtgtgttaaaatctatagtaaaggagaaaaatgtgctgtgagaatatgcagggcattcattatgatttagaaggatttagatccttgcccaaggaggtgaaggatttagatccttgcccaaggttagcattcggggaggattttctcctacacagggagtagctctcagaacaactacttcattgtaacaattcatgggttgcagaatgagttctgcgtgtcaccaggcaaccctcccattcacaggacctgcacacttgacaagaaagtcattgatgacccccttaaagtgggaaaggacagaaaatcttacatggggagcaggtgaagaaagatagtaggtgctcactctcccctcaaacgttttagtaatgacaagaagtagaacttaaaggagacagcatgcttttcaagatcagaaagatctgtacatttttaaatcagagggtaaggaattactggaaggcaggactaccagatagctaaaaggtaaatattggactgagatcctttgggtcatgaaggcatgtaaagtagatcacaaggaagagggagtcagtatagtctcaaaagaaataaacgttcagtgtcgagaactgactgtcttaatgaaaggataaagttagtcacaatctcgtctttatcctgatgcctgattggggaactcttttaaatatatatgcatatgtattctgccttagtccaaaatggtcagagttgggactcactgaagagaactgcacagaagatttctagaaattttatccatttcataacattttctagtacaatgttaatactttcctttaagaaacaaaactagagtcaagcaaagcatgtttgttgactaattccttcaataaacatttaaaggctccctactaagtgcaagacactgatctagagattaaaacatgtttaattttacccccggctcctcgcccccacttgtgtcctttttctggggaagtaaaaacaggagtagtagtatctgttgttagagagacgtttagctgttcatgatacatgaagctaggtattaagcacttgctaaccagggcagcgttaacaataaaattaccacttttctttgcaaataattctcaagagttagttattaaaaatgtgaacctaaccagaaatggtctcttcccccttttataatcataaatcttgcactggggagacaaaagtaggatgtaaatgcatcatatgtgaataaaatttagttaaatagtcacacttgtgagtagacaccatgcaaataaatgtatacataaaaattggacagcacttaaagagatttaataattcatcccattgcctctgcagataaaagaaccaaagtcccatttacgcgatggctaaaatatggcagataatgatgcattcatatttaatattgctaataaatttgcaggttcgcatttttattgataaacattttcttgaaatacagtgtaggaggacagatttttaaatttaagtactttataaattagaattgtagatagcgatgagattagtggtggtgctatgtcaagagccatctaccaactcacctgtgcttctacaagcacctagctatgattttcctatttcacttttacgtgcaaccaaattgcacacaatttagggaaaaaattagcatggtagcagagtaatgatcatagtaaatatcatgcttctccttgttgacataaattacatataatatttcagaaaaagatttttgttagtctagcttaatatatggaaatattttgcctatagaatttatgtatcgaggaaatacttaagtttcttttaagatgatctctttgacacacacaagaaaggtatattgtacagtccagacagtttgagggctaaaattatttctattccttggaggctataaaatctcatttccagctacacaggctttaatgaaatattgtatagcttaggatacaggaagatttatttcttttttgggtgagttctctctaaaatttcagggaaaatttttgagaaaatgaatttataccttaaaaataatattccagaattcatcttaaaatagcatagaaagctaaaatatatttttgtaacaaaagttttgttatatttaataattctataaaatcttggtgttctttctgctgatcaccctctgaattaattggaacctataactttctgaattttattttgtataattggtagacttcatgtctcattcttttttttccccattaagattccagaagcttatttcattagagacccccacactttccttcttacaaaggactttattaaggtatatgttctgtatttagtgtggaaagtgttctttggtctttagctgcatgcatgtattcacaggttagattttccacatttaaccccagcttctgggaataagaatagtgactgggttaactgaagcatgtttggaaggagaagcaaagcttgtctacaaaatactaacacttggatgattctgcaccctgagaaaagagcacccgttgaattttctggactttttttcatggctgacttgggatacacttgcgttgtcaaagagtgtgttggcctctctctttgatgcatattgattatgacaatcaccctccttcccctgcaggccatggaggcacagatacagaactttggacagacgccatctcagttgcttattgagccacatccgcctcggagctctgccatgcacctggtaagacatatcagcatgttgagatttttttttctttcctttttacctgggaatagagcaaataaaattgtgattttaacagcatattttaaaaggcttctcgatttattggttaactcttcagcctaagtacaaactaataccccagggagagacagagaaggaagtgtaaatctacctttaagtcctacttaagctgtcccacttttggattcacaaaaatagccatcttctctatgtatgactctacataaactcattcatgcacacacaggcatagagacacacactgacaccagaattagactatatttgtaaattacaatgaaaaatgtattgcagacacaatatgatattgccaaatttcgtggcaagatacagtaggggaagtagttcatttgaataaaaggaaagaaatataaaggtaatttgtggttattacagagaggttgttgaacagagtggttaagagtaagggccccagagccggacagggcaaacaccatctctgcactagctagtaaatgacttgggcaaggtatttaacctctctgtttttgcatttcagcatcttcaaaatagaggtaaaaatagtacctactactgagaattgaatgattcaatactgtatagcacttagaccagcacctgtcatacaataagttcttaataaatgtgagctgacatcatcataattagctactggttaaacctcttattcccactttgcaagggagtcatattcttttcattttaatctgaatttaaaagtccatttccataaaaaagtttctttacagtttattagcaaatagtaaacattttcttctttaagtaatttgaagaaggtaaaatttttatgagcaatttctttagaattttttttaaaactgatttttcactatttttttactgaagtaaacaattcttgaaggtaaaaatgcgttcacaagatgaacttcaagacaacaagtactctaattttagagtaaagagctctggaatatggtccataatatatgtgtaaacaaatgtataaggtgttattttgtgatggaagtattaatcacacctttcatttactctgtcatttaacgaatttttattgagccccttctgtatgtcagatctgatgctaagcactggagatacagtgacaaataagtcctctaaactttcaagaaatcagtagtcgaacttttgggaaacacataaatgctttttgttgttgttgttttgagacagaatctcactgtcacccaggctggagtgcagtggcgcaatctcagctcactgcaaccttcgcctccctggttcaagcaattctcctgccttagcctcccgagtagccgggattacaggtgtgcgccaccacccctggctaatttttgtatttttagtaaagatggggtttcaccatgttggtcaggctagtctcaaactcctgacctcgtgatctgcctgcctcagcctcccaaagtgctgggattacaggtgtgagtcaccacgcccgacctaaatgcatttgtttttaaatttttttttaagatagggtctcactctgttgcacaggctagaatatagcgccatgatcatggctcactgcagcctcaaactcctaggctcacacgatctttcttcctcagtcttcctagtagctgggactacgggtgtgtgccaccatgcctggctaaatttttaaaattttttgtagagattgggttttgctgtgtttcccaggctggtcttgaactcctggggaccctcagtctcccaaagcgctgggaatacaggcataagccaccatgcctgcctggtgtgtgtttaaactctttttttttttttttttttttttttttaccttccttcaacagctcagccaaacagcttcagcctccttggttagtcactagtgaactcttttgactgcagttggtctttctgtgtaactaaacagaaaggtttgcaccaagctcaggctgttgccgtataaacccctcagccacattgtagacatagagatgtggcctcggagcctcaccgtttttaataaactgtccagaagaatatctctaacactttattttatgaaatgctttggcagaagagttttattcccgtgttagttttctgtgtttaataataataataaaaatatttatcctggagatatgcccagtcagaattcattactttcctagaggaagttgttagagactgaattggcatgaaactgtttataaagaaactctaagctttctaagttcatgtagcagagaattcatatatactgcaaaccattaagaaacatgtatgaaagctaaataatggttatttccagcctccctactttatgtttttaatatggtggtatttgtagtgttttgtaggacttacagtatctactttctgtcaagtcatatgctagatgttgacaaaacagacgctaaaaacagaaagaagaaaacacatggacacgtgacagggaacaacacgcactggggcctgtcatgggggtgggggtggtgggaggggagcatcaggaagaacagctaatgtatgcagggcttactaccaaggtgatgggttgatctgtgcagcaaaccaccatggcacacgtttacctatgtaacaacctgcgtgtcctgcacatgtatcctggaacttaaaataattaaaaaaaaagaagaagaagaagaaaaagcattggccctccataagctcccagcctagaagggagaaacaaggcttcaaccataaacagtcagtgccagagcagaacctggggagaactgccagggaagcgctcggctgctttatggggctactgtattttaattatttagactgtagtcatgaccccagatcaaccagatagaaatgaaagtattagtcaattcactttatatttcgtgtaaaaaatgggagtcactaatttgactaactttcccaccaaactgatttttaagctgcattgcataactgtgttacgtcatgtgggtgtgtctatgagctaacttttcacattgcattgtggtgatatttgaattgaggctggtctttaatgattctgtgtccctgtatcagtgccttcacagaattcttattctctactctctgtgccattccccagtcaaagctgctcgatttggggcagacattcaccagtatgaaagtttaggtggcttttcctccttgtgtgtgctcgtgctagccttgtctgtttaacctcattctccctagacctttcactaactatgttattccttttgtcttcctctgttctcttccctttctattcaacagtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggtatgtgtgcctgagcaaatcacttactaaagatttcttaaaagctacaattaaagtaaaaaagtgtactgggactgggattagctcatatcccacattatctacaaaaaacagcagactaaataaataattgtcaaatccaactaagggacttctatctgtctccttcatttctgctgtatgttagtgcctcataggatgcttggatcatagtcaactactcagtaactatttgacaaattgaagcagttctaccaataattcaggttctcctactctattctgctattgcctaactgcaaaaaaatacacccttcttttttcctatatcaaacagaagagagtttgaatatgggtttctggatgctggcttcacatcctcttgtctctatatcagtaatttatttagcaaatatttgaatgactattatgtgtcaagtagtcccaagcactgtatatacagcaataaacaaaacaagcaccaactctatttttgcagagcttagaatctttgcaaaaagacaaaatctaaattctccagtgatttcacacttcacatgtgtttctccaaactctttcctgaaagtaccagccagtacatcttgaagcgacataacgttgtggcaaacatttagacatattgcaggagttcaagaccagcctggccaagatggtgaaaccccgtctctactaaaactacaaaaattaaccaggcacagtggcaggcacctgtaatcccagctactcgggaggctgaggcaggagaaacgcttgaacccgggcagcagaggttgcagtgagctgagatcgcgccactgcactccagcctggacgacaaagtgagactttgtctcaaaataaacaaaccaacaaatcaaaacacatttagacatatggatgcttaaccagggcagagtggatgtgaccaaatgatttagttggcccagtttaccacttgggatctcccaggaagccgaggactccccgtctccagagttgaatagctgagccatgccgaagtaacctgaatctttctattttactgacctctacattgctctaaaaaatacagtgatttatatcctagctttatctcctaagagtttctaagtgcacctattttaaggttattggtgatattatcaacgtaaggtaacgctacttccattccatcagagataggcagcacatatcttaaggaaaatatatgactgtattattctcaggagacagcctctagaaatgttttgcattgagaaaaactacaaaggactaaatttttatttaaaattgtttgaaagtgttgtatatattgtataatcacgtgtgaaaaactatgactaatgaacttcatcaagctctaaacattaatcctctgaaagtagcttttagtgagattaagattttaggtgtggcccaatttttataccttccatttacttgtcacatgttgaaaaaaaggccccattggatgggagccccagcttcctgtgtcctgccccaggtgagcgcaggctcatacccatccctgcttggaagcatagccctttcattgatttctgcttcctgtgtcctgccccaggtgagcccagcctcatacccatccctgcttggaagcatagccctttcattgatttcaggctcattgattgctcatgaccttagctttttgatgggttcaataaatgttacaatcttctatttatccagctttttctcatcattagaacagaaacaaaactcttcccagccttgtacatcgtaagtggaaacctgaagtccctgttgtgattattttgtaaggctgtctacagagacacatagtatcagaacaatttatcaaatcatttttaagcaaatatgcattttgtaaaatcatcataaaacactacccattaggaaatcccttctttctgagaattttatgttagtttttctctctttttttaatctttaggcctcagaggagctccaggatactccttggatcaagcccaccatcttcccattgaaatggatccattaataggtatgttaataaaaaagaataaattttcatggatactatccatatattcatatatagttatttttcataagatagttgaacaatattttttctaccacaagattaaaatgctaataatatcaaattatcatcaaggagctgtgtaaatcataatatgccatctaagaactttttggtattaaagcaatcgtttcttgatatttttggaggtcatttaagttggttataaataaggcaaataattccaaactgtattttctttcagcctaaagtgttctctaacagctcagtattatttaaaatataaggattcaaaaagattactaaaggctgggggaggaatagcattaggagaaatacctgatgtaaatgacaagttgatgggtgcagcaaaccaacatggcacatgtatacctatgtaacaaacctgcacattgtgcacatgtaccccagaacttaaatttaaaaaaaaaaaaaaaaagggccgggcatggtggctcactcctgtaatcccagtactttgggagtccaagacgggcggatcacgaggtcaggagatcgagaccatcctggctaacacggtgaaaccccgtctctactaaaaatataaaaaaattagccaggcgcggtggcgggcacctgtagtcccagctactcgggaggctgagggaggagaatggcgtgaacctgggaggcggagcttgcagtgagccaagatggcaccactgcactccagcctgggtgacagagcgagactccatctcaaaaaaaaaaaaggaagctaatattgaagaacatcttttctggcagtcttttttttttttttttttttttttgaggcggagtctcgctctgtcgcccaggctggagtacagtggcgcgatctcggctcactgcaacctccgcctcccgggttcacgccattctcctgcctcagcctcccgagtagctgggattacaggcgcccgccaccgcgcccggctaatttttggtatttttagtggagtcagggtttcaccgtgttagccaggatggtctcgatctcctgacctcgtgatctgcccatctctgcctcccaaagtgctgggattacaggcgtgagccaccgcgcccggccacctctggcagtctttatcactgaatttttttaaactgacatgttgtaaagcaaatgtttcatatgaattgcaaactgatgagctataactctttgcagcagacattcaaaatatttttaaataatcgtgtacatatttattagccattggatccagagctagcatcttagtctttcgaggcccttccggtttcatatatgtaagacagtttttaataatgtttgttctatctgtatcactggatgattagtaagataaattagaaaaaaattgaaaatgctacgaaaaattattaagctacatattaaagtcaaggtgttttattcttgggttcttttttttttttttttttttgagatggagtctcattatgtcacccaggctggagtgcagtgatgcaatctcagaccactgcaacctccgcctcccaggttaaaccaattcccccacctcagcctcctgagtagctgggattacaggcgtgcaccaccacgcctgtctaatttttgtatttttagtagagacagggtttcaccgtgttggccaggctggtctcgaactcctgaccttaagtgatctgcctgcctggccctcccagagtcctgggattacagacgtgagccaccacgcgcagcctcttattcttagattcaaattcatccttcgtctttgaacctggaaataagataagatacagacgtttcaattagttacttatacccatacacaaaataccatttacatgtctttgggagcttataagctttaggattaagaatattattagtctagtctagctatttctctttccagtagacattgacaatgaaatatacagctagtgtgtaaccatggaaaaattaataggtctattctaattagtaaaggaccaactgtatagttttcaagtggcctgggacccttggtcttcttgtccttactgacttttgtgtataatatttttattgcttatgtttcttagtaattatttttatactgttagtagatatctacagatagtagtacttaatatttaactggtgttagagagtggtggtgaccttctacatctgcatttctgtttaagaattcagcccagtgatttatcctgaaaggatggtgcgcagtaagggacaggctggcatgcagacaggcactggggaaatcagatggtgtctctgagttcctgactttattcagattcaatcccagggctctgcactgattctttgcctgtctctttcctccccagtccctctctcatcttttttgttcctctcctcccctgctagccctttctggaaaggccttctgtctgttgacaatccaggcctgtaaagctgctgacctgaagctccctgtggggctgcccacgtaacaacatcccttgctcaaatctctaccctcctttttcacaggaattataaataccatctgaaaatgacagacttggggcaaatattaatatatctcttccttaataacatacttcatacaatatttagttttcatgtgattcttataaactaatgaacttgtatatagtgaacatctaaagaattaaatgcattaaaatattgtattatgttttaaattaattgtcttgaattcctcatattgtttttattggtggagggagaactaaaatttctggcataattttaaaatacataatgtggttcataaataattactgcgaaggaaatttatattcctcaagggagaatcttaataatctcataccattaaaaaaactatttctggataaatgaagcatgaaagtattgttttccttctttgagtgcttggcaaaactcatatggaatctttcttcaaatgcttttttccatttacttttagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacaggtaatcctaactatgaaacaccatattctcttcaaaatgactattgttaaaaccaaagctgaatatgaaatcatacttaatgtaggcatttttatcatttgccaacttgagtagtcaagattcaaattaaatgttcacattgtaagcaaagtaactaactataacttcatgtattccgaacgttagcatgatcccagaattcataggacaaatggggctattgttcctttcccacaaattcatatgcagtaaaagatcctaaaactccccttggtctggcccaaaccctgaagagaaaaatcgtgattgtgttattttataaagtcttttctttaaaaatctcaagtgacattcttgtatcagtttccaaaagcaatgcaagaaagcaacctgtagccagatttgaataacattgtaactttgtcagcccatagatgaacttttcacaaaactggtaaaataaaattaaaaatatggtaaaattttttaaaaaatctgataaagttacacttattaccatttgaagaaaaagactaaatgaagcaaacctgtcatttctgtgttgcagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgagtgtttgtatcaaatttgtcctatcaaactatagtttatttaaatatattttgcctttttgattttcctaatagttttttcctgaggtgtaaggattttaaaatatgaaagcttaagtggccaaaatctgtactggaacgtagctatgttcaaagtgttaaaatgatcagtactatcacctacaacatggagagacttccagatcccctcaccagtcccctacccagaccctctgctcagcagcccagtcaccaaatgtccccatccttcagaaattttcttcagcttcaccttatccattaaacctcatattatttctttcagctgaaaataatctctccctgctctgaatttttagaagattttgcctgtgtctcattcagggcactaactgctatctaccatatatactgtagtaaatttctccatttattcgtttagcaaacagtgagtgagtacccccttcacatgaggcattgtgggagatgcaaaaactgaataagacagtttccttgcttgggaggattcctcaagtgatagttattccacagtgcaccctaagatatcccataggaagaaagcgttgggagaggctggactccttcgtgaaataattttggagtacagtgtttatactcaaactttctacataagctctgaaagtcttacacaaataaatttgttgatgcttgtttaatccgcagcctctcaaacttctttttccaatgaaacttttatttatgtaagagaagttagttattagttgttggactgctgccccaagaaaacactaaagtagataatgagtgtctgtctttccatcttcagttcctgtcatagtaatatacataataggtttccaataaattaaatgactgaagagctggataagagattggctagaaataattactgcttttaattactaagctttcaatagttcactcaaatgcatgactttcctgtataatatagaaaggtttctgtgaagtgataatggcaagtactcaaaccaggattattcaaattgtcacagcttacacagcactccaaaataaactgaaacatgaatttggggaatacttataacccaacagagataaaaatttttcaggaaacctgtgcatctacaactaaaatactataagagtagataagaaatctacaagatgccatgttacattgcgtggctggctgctgcctctctggttagttccaacctgtgagacagctaggggtggaaactgaattgcacatccacccttcatgtcccactccatccccccaacccttatgcattttgacaggaataccgcaaaaataggaaatggctttggatggataagaacaaaggccccatcatagtacaggagagaatggagaaatacatttgtatgagaagatagtggaagattggattagatgtccaaatgttatgtgaagttttattcctgttgcccatagctagagttgaacagtggatgaagaaactaggtgtgttgtaaaatagcatatgcctcttggcatagctactgaacaagagagtgtctattgtacatacgagtctctgttctaaatttgaacaagatgtgatctttatttgagggaaaagatattcaatgttgcttgatttccaaccagttcaaataattagttaccaattctgttattaacaaacattatgctctaaataccagtaagataatctccctatttactcttttgtaaagccatgtccgtaaacaattcatttttaacagaattctagtatgcctatgtatgcgtatgtgtacatgtgtataagacatatgacctaccagcgatggctttattattctcaagaatggtacattatcaagtatattttatctaaatatatgttcacatatttccaaattgtctttatttccataatagtgtagcatttctttaaaaagtttaattaagcagcaggtctgtgtagtatctttcatatacattgataaaaattagaacttgttagaaaaaatttaaaagaaacagaatagagctttaaatctaattaattaccgtcttcaaaatgaagcccagaaatgatgcaagtgttatttccaaaaaggggatttatttcttaaaagctgccatctggtagctgagataagatgttttatataatatactgctaggaggtaaagaatattaaagaaaaatattaaattatagtaattatctatgttcactactgtgttttctaatgatctcttaaaccaaaagatggctaactatcaattgtagctttggtacatcagttagcaagaaaagttaaatacaataatatttaaattatttaaagctccttacaacaggagctgtgtaaatacaaaatgcttttttaattcttaagaacaaaaatatggatattatatttgttaaaaagcagtgtcatattttagttttaagtaaggacaagattatcttaaagatattatgacaaaattatcaatatgtatttttcagtattacctccatctataggaatttatttttagtgaaaagctgttgtcatcattatgaacctaaaccacttccatagaatccatcctgtcaagactttattagatatttaatgtgaacatacgtagtatggtacattaataaaagggaaaagtgctcttctagaataaacaagataagcacctaaagtattagtcaagcaacagtatgtgttgggtgcctactgtgtgcctactgtgagcctggtactatcccagcagctgggaatgctgcaaagtcacaacctctgactttctagagtttacaagaatctacttttatactgatcacaaactgtttctcctgcttggatatactgaggatgtcaagtatttgttaaatgaatcatgaattgttatccgataatattttgtaccatactttaaggattcgtaaaatgcttaactttacatcaaattgatgattatgaaaaaaactggttttagcttttttccataaggatgatcacagtagtaaaaaagtgatctcaggtttagtattgattgactgactgatttgtgacccacttatctatttaaaaagctaacctagtagcatatatatgcctgactagggcaaccatctgtgtcggtctcttcactcttttttcaggcagtcacagcacacactgaattgactgccatatcagtgccctgcctgtggtttgacatagacatagttgttgccatcagaaaactcacaatgtgaaagagattttcttctgttccagtttaatctactctagcttccaattcacaggtcagagaagcaggccatatgtgttttctatctcataatacattgatactcaagaccagaaagctagttatgtctaaatttgtattaaagtgtgtgacacaatgcccttaggttttggaggttgtatgtattaacctatccttgacgtgggaagtcctggcatgtaacataatatcctagtagctgttataatgaagggattggccttggtgtggacatggaactgctttgtgtgtcaccgaggccaaatcacacctgttcatcacaacatcatgaaatgataggatttatcatttaacctttacatgcatatcactaaaatcttctcaagataaaattcaactgactttaacatatttgtttctcttgcattgtcattattatattgtaatagatagctctattaattccacgaagaaaaaatgtcatgtttgtgaaatctttttggcaggtatagaaagtatgtatggttttattgtgtcaaatatattgtgaagaatgcagacatctcagaaatattagtctttttctaatcattttgaccattgtgatgaattggtcacaaagataatgaatatttgtaagcagactatcagatatagagtctcagaccataaaagagataagcaaagtctacctagtgcaggttagagttgaattatcattgctttattaatgtattttataatattattcattgttattctttcaaactcgcggctttgaacgtataaattatcttggagactttaaataggtccctaactagataacagaattgcaaagatgtgaaggacagatgctttcatccgaaacagacttttacacaaattctgaaactaatttggaagtgataaaaattaatttgcgcactttaattggaagcagcctactgcatgaaagagagcagagcagagcaggcaatttgtgctaaaagctgattgaattttttgtcaggtaggtatcttggacttggccgcttatcctcttgagcctctctttgcaatatattacaacccatctctgactggtgttctttaaaaggatcaatggtattcctttggaatccctagagtccaaaatttcattgatcttaggacttgacatttctcattacgtgctgtagcttccaacaagatagtcacaatagaggcaagttaacattgttgtctcttcaacagacactcaaaatacattgggacttcagctcaaaagccaatctgcttttaaagaatgtagttttaatgtttataccacatacaaggtgctttatagagagtttgatatacatacatacaaaaatttttaaatcatagccatgtgaaactttgaaagaggatttaccgttcatcttttcaactcaaatctacaaatattcattgggtagtttgtataacacattgttattatgcttttctattccactttttaaaaataagtattttagctcgtgtacgggcattatgcagactgtcaaaggagaagccaattgcaaaggagactccagctgtgcacacacaccttctctgggctcccattgtgtatgcctcagctctggacgctgaccctcctgccagccacaacctgtcaccaaacatctgccaaatcacatccctctctttgttggcatccaggcttcttttaaaaagactatcctggtgcccagctccacaactgccactaaccagtgctattataagaaatgaaagcatggccgatggatagcccagagagatttgtagagtatatttagatttagatacattaaacaagtttgtatcacttctcggagcaaagaatcttagctaggatttagcatatgttaaaccatctttgtaagatcagaggaagtgtagctccatatgcaatagttctcaccttgcagggctttttgaggaccaaatggtaatggatgtattggaacatcgatggcacagagtccattctgcagtagaccactcatccaccccatcccctcattctaacaccagtagactttccagggttccagactgagaagggagctgcttgctactcggcctcggcttttcctttccttttatgggactaaggcttcaagaaaggtctttggcctagattggaagcaatatatacagagtgactaatgtgttctgatcagagagcttcaggttccaaccagggggtgtctgggctttacgcagagcccagcttcctgaggaaggggaggtggatgatactattagttgtttttaggtgagcgtaggacagtaatgtactgtgacctagatctgggctcaggacttcaagagaagaggttgtcctgcagtggcagtgctcagaggaaaatgtagtcattgttatctctgaagaggaaaaagaagttagaatgaatgaataaataatttcaccgtatctgtcttccattcttcactgaatactctatgagtacataaggaaatgaaaccacatcatgggtgaatttgacattttccaacccacagaatgtttttacttgcattatcttgggaccttgggaaatgcgggtccaagtgtatttgatacttggaacagacctccacagcacctgcctgtggctgaggagttggggtcttgataagggactcctgaccgataccgctcttctcagctattccagcaaatttctaacataatatgttgaaataaatcttgaaatcatagtagtaatgaaactaccataccctttgactaaatcccttattctgggattttaactttcaaaactccatcatattttatctaagtataaacatgaataaaaatatcttctgccatgattctgcagtgacttccccagggtcagaaataaaatctgaatcagattttatcaggaggttcatcctctcactgtgcagcggaggtcttagaaactccactggctttgtttagttctaaatcagaaagaccacagcttcccctgcatatcagtgtcccacaaatgaggtttaaaataagaaccatgagttctttactttggccatttctctaaaagccagagaccatctcactaaaaaacctctcctgtctatgtgaataagcagcatctaatactagtatatttttttatcatccattttgagaatattgaaatgacctttgataaaaggaggatggaatttgtttattttaagccttttaatattcggagtttccaaatgcatgtctataaggaatctaaaaattggacgtgtttgttcttcatcagttctagtcattccagcacacggtgagtgcttctgtggaggcagtggtgggcctgagggcaacggcggtggccctcagaggggcggtccacctgcacctccctctgcactgggccctttaaccctgggctacatccatcaactgtgatgtgacagtgacagaatattcctaggattttgaatgattgttggggtgtgtgacatctgtccctagcaacgaaatgaaatataggaaacaagctttcccgccgctgcaggtttcccaactcagaaagcctggaatggcattttatttgcctttcacttaaagaaggaaacagtgctttcaggggccctaaaaaataccccctaatagttaagttccacagtttattcagatgatctggggaaatcgtaatgaaaaaaataaaatattttaaactctctaaatcagacatgagcctttgaaaaactcatttcctagcagaaaatgtataacatgcataaggaatatttttatacattttttttctcaattccctgcaataggatcagattgctttttattttttctatagcatattagggaaaggtcccaaaactattcattttatataaatgaattaagtgtataatttcagggttttccagtgtgctagtctctccaagataaaattatcatttagaaaaattaaacctgatattacacataaaatcttacaaatacttttttagagatttaatttttatggatacataatagttgtacatattgatgggatatgttatacaaggatacaatgtgtaatgatcaaattggggtaattaggatatccaacacctcagacattcatcacttctttgcattaggaacattctaaatcttctcttctagttattttgaaatgtacaataaattattagccgtagtcaccctattttgctaccaaacactagattttattccttctgcctaactttatctatctaactgtattgttctacccattaaccaacaccttcccaccacccttgccagcctctggtaaccactattctgtttatttcctctgtgagatcaatttcttcagctcccacatatgagtaagaagatgggacagttgtctttctgtgcctggctaatttcacttaacctcatgtccttcagttccatctatgttgttgcaaatgacaggatttctttttttttatagcagaataatattcaattatgtaaatatatctcattttctttatcttttcattatttgttggacacttaggttgattctatatctgagctattgtgaatagtgctgcagtcaacacaggggtgcagatatctctgatttgctgatttcctttgtttggaaaactcttatcaatgcttaaagcttattttaccaggaagcccagggcatctttgaaacaatttttttttctttttcacctttttcctgcagtgtgaaacataattttataaattatataaatatgtttcagacaaatccaggactgctgacattataaatggacactctaccaatagtcaaaacacattatagcaatatccatgtattcagaagaagatggcaaactagcatgagctgctgtcccccttctcccacactccatctaagagatgcctcaaaaacaaaattggagctgatgggtctgagaaaatgcaaataaaacggagaaatccttggggagacagaagataggcaggtcttaagagaagataggcaggtcttaaggaaggggctcttggccgaccagagtggaagatgtgggtcgtcttactgggtaaggccttgtgattatgcactttcctcatgaactctctgtggcttccctcttgccactgtgggcagagaactggagcagcagtccagctagccagcacccagaggtcccataagtgccaaagaaggggctattcagggggaggtgcatctgccagccctggaacatttaacttcccccaaccccagtgagggccagtagttcaacctaggaggcagctctaggaaagaggggcaccaagaccaaagtacagagtggttctctgagagacaagataggggatcgggggtggttaccccaccaaaaataggaattcacaaaggaaaacaggcaagcatgcaaagaacacaagtgctagaaaagaaagaccgcaaacagaacaacctatatgggtgatgcagaataagctcatttctttctgataaaagaagagaaaaatatagaactttttacaaaaggcataacattctctaagtccttcaatttatgaaagcagttagcagtgaaaatgcttctgggatataattcagctggactttttagctaggttcgcactaataaagtgaagtaggttcaattccaacccttagctgtatgaacttgggcaagttgaatcaccttgcaaagccttgggtgtctaggctatagactagggatagtaagagttcctacctcatagagcatgaccataaatacatgatgtaacacagataaatgccttagcaggcattgtacctgtttcataacaataatggaagaaaaagaatagccattaccactctcgttacgttctaagcatgttacatacgttaacttgtcctgtcatctaaacagcatgtataatagattcgctagttatgcgcatttcacaaaagaggagagcagagaggttaagtaactggctcatggtcacacagcttaataataatgcccttaataaacatgggtattttttgaatattgcattgctggtgtagctctctccccctgctattggtctgtagtgcctcactgctgctgttttcttgcaggtgactatccggcaccaagagccgtcctcacaggccatgaccatgaagttgtctgtgtttctgtctgtgcagaacttgggcttgttatcagtggtgctaaaggtcagaagtcatttctttcattttcaatgtctagaagatgactgttttctcacactaagcgtgattgtcagtttatttcttccaggaagcttcccatagacaaatggtatcccaaagttatttgtagatgtttagttttatgattaatatttactggcactaatataaaatatgtataaaattttatgtagtattttgtggtcaacagtgttctaagcagaacactgataaattacagtgtattcttatgatgcagccattgtaaaggacatgtaaaagacaaggggaaagtatccctgatgtagtgggggaggtggggggtcatgtcactcatcagacacggcctaggatcccctccctcttcaagtccctttctttataaggccaggggctgtgtagaggttggtggaaaggaaacaaagattacttggttctttggaggttttgttttgtttttgaggcataccttcactcttgtcacgcaggctggggtgcaatggtgcaatccaggctccctgcaacttccgcctcctgggttcaggtgattctcctgcctcaccctccctagtagctgggattacaggcgcccgcaaccaagcctggctaattttttgtattttcagtagagatggggtttcaccatgttggccaggctggtctttaactcctgacctcaggtgatccacccacctcagcctcccaaattgctgggattacaggcgtgagccaccacacccagcctctttggagtttttgtagaagatctttcatttcaggaagtcaggaaacttaggtcctagttctggctcaaatagcagttctctgtgggaagactcccaggcagaaaggagcctgatgcttggagaaactgaaaggagccctgggtgctgctggagtatcaccgtggtgccacaacctggaggaatgagaaggctgaagggatgggaggggcctggggcacaagcatttgcaatttttttttaaatgagtatagtaggaaactattgaagttttttaatcgaggtgatgagatagataggtttggttgttagagctcatttcagcctttctacggagaatggatagagtctgaaggctggcaccatgtttttaaaattttggtatctaagaataaataacccagaaatggacacataggatattttcagtcttttaattttaaaaagtaataatatgtgtaatatcattttaccctgtgaagttaaaaaaaaaaaaaaaaaggaaaataagtgacacatagtaggcgccaagaaagagacatttcctgcaggggctgtgtgatattagagatgattgctggtgttttcctaattttctatagggcaagtctattactttagtaatcaggacaaaatttaatcatgtcacttgctttgtaaaatatgtgtctattcagctcaattaaaaataaacacgtaattcatacattgttttgtggaaatctttttgggacaagggaatagatatataacaccaaactatagtgaccaatttttatgaattgatcagtgaattttttactttatcaacactattttataagggcaaaaaaacccagaaaccatcagagccaaatgtcactccttaccctcctttcacactcttgcctcactattcatttatttgaaagacaaaatatctttctgtaggctgaaatacttaagttttctcaattttgcttttacattttatgcgtatggatgacagaaaaaggtaaaatgtacttgacggcagtgtattgatgtggtacaacgcgtaaaattttgatgctacttgagaaaatgagcagctgttctgataattctattaaactttcaagaaaagtttctaaaagcgtattaagagaaaatgtctggcacataaagtcttttattgtcacgtaatctgtgagctgtaccattttactatgaatattacctgacaaaggaaaagaccaagtatctacctggtgaagaagcgtgcggcgtaggagtgtgatatgtagcaggtactctggctttgctctgtttaaatgtagcatcagcgcttggcctggccagcctacctctttcctgtcctcttccgtcacatctgagcgcacacccagcaaggttttcaggttggtgggagctagtatgtcgtttgtcgtccccaactgaccctggcattgatgtccccactttgcagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggtaaatctgcatagttcgtgctaagtaggactgaagccaagagattaaagattgattgttttacattaaataattcataatagaatgtctgtgctatccagataaatgtgttctagattaaaagtatataacttcttgcggactggtactttaaagaaacccaaagttcatttaattgcaagtaattaactcactgcattagacttcagaaatgatagctgttgtttgattaaagcttagaacctcgggagggtttttaaagctccttttataattgtttcagtgctgcaccctcacaacattaaaagtgagtttattttcaaagatttctatctctagaaccctaaacaaaaattacatatacccatttgcccttcattcatgaataaattataattgctgggttgtcattattaaacactgttttgaaatatgtttcttccatttgttctttaattctctataatattaatattcaagatttaactaaacatgttacttaatgctcaaattcttcctggattaaattgataatattctcttgggaatttaatcttggttttaataagatcttttgtatatgtaagaacttcgatgaattccacaatggaaattctgtggattgaacttgattttgttggacaaatgactgacagtaggcaataatgataagggaactgtactgagtacttttcagtagtgacagttggctatttaggaaaaattgagagaaatggttgttgtgtattttattttattttgtttttttttgtttgtttgttttaccttttctgaaggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggtgagctgcgtcaaggacaagtatcatcactgagaactgtcattgaaggctctcttcattctaccaagggtgaattgtgctgtgagtgcaattccagcatccaaatgaaagaaagactggcaaagaaaaggggaaaatgaggggaagagtaaggattctagtgagagggaaacagaggaagagaataagaaggaaaaaaagaaaaggatctgatgaagaacaggtgcctgcagacatgttttaagggcccaagacatagaacttactcccaccaagttccctgttctcaggttcctgcctagtctcagacaggccaccctggcttatatgatgtgagggaaacacgtatttttcagcagaggtgggattcagtgtgagacctacttcttgctaaccagtttccagcaaagtgcatagtgtgggccgtagctggcccccctttcaacagcatgcggcactcacgcattacccagaacaatttttttacccccatgttcttatttacctgtttctcatttatgttattttgttttattgtatgtatttccttaaaacacgttaatcctttaatccagctctttcttggaaagagttgatatggatgttaatcaattaataatgattttccattgttcctcaatttgcaataggattttattatttcctgaaatttacctttgggtttcttacaaagtgaaaataatattagaaatataaagtctaaagttcctaagcctttaaaataaactacaaccctgtaatctgaatatggcatgtgatttctaatttttgctatttaacagaaataagaaaagcttgttaatcaacgtttttcccaactacatgtaatattcctcataacagtattggttttaaaatattttaaatattaagacataataaagttaacaaagcatcttcacaatataataaaatggcactgaagtcatcaggaaaaacgctgtaagctaatttagtctgggaaaggatgtttggtctgcagcccagactgtttttaaagaaggtttaaggttattattggagtatcccaaagtgctgcagcccatacttaggaataaatgggaatggtttgttgtgttactatttgtatatatgtgtgtttccagagtgtttgaaatgatttgtgtttgtaagcagtttcaatatttccctgatattcttactcgttcgtgtattcattttgctgccatcatcataggttgagtgcagtgcaaagtactaaggatccacaacaagaaactgaccccagagagctcagatcctcataatcattgcatatgagggcaccaggaacagactaacagaagaaggaagggatgaactcttcttgagggctgggaagggcaggaaagaccttagaagaggctcatccattcaccaggcatgaacagacagggtggatggaagagcatattcaaagttgcagtagtattagggggtctcaatggaggggggaaagatactaagtttctatttctattttaacctcatccttggttttgattattttgttgttttataatgaatagtgcatgcatatcaattataaactgataaacatatattggggatattactcaaaaggtatttattggatgaggtgtctaatcaaaagtgaagcaacactttatgtagacagaaatcctgaaacctgagttcagtcagtggcagtgggactggggaggaatatccctgaaaaagaagcctcagagctgaacagctgatcagttaggagggagagggagaggagacaaggtgacttaaccagcaaaagaccagcaaggtcagaaggtaccagtgattcatggtggacatgttgaatctgagggttttgtgacacagcctggcagtgacctccacttggcaatgggaaatcagcatctggggcttcagaatgagacgtcgttgcctttacgtccagggagactgtggaccgagaggacaagaggtggagtgattcaagggggcaaagaaaagaaaggtcacagagataggaagagatgccagatatcctcagagaagccaatagatgcccaaaacaaggcagcggacaggcacgtgtgtgattgctgagagaaatggggcacccagcggaggctggaaatgtggttccgtgggcccctcacgctctgcagcagggctggctgtccaggtgtgtgcgggctaactgtgctcctctcagcagaaccaagaagaaatttcagtcctacttccatgaatacaaaattaagacttggcaaaccttgagatcgtgatattgtctagtgtaaaatgccaaactttgagatactgtctagtgtaaaatagcaaccacagaaatgattttatatcactcttaactgctgtttctgcttttccaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattcac

SEQ ID NO: 767 - DNA, 26450 bp, Homo sapiens
tcagtgaaattgaatttttattccaaatgactaatatctagaaaggcagtagctaacactcaaaacaatttgtttaagtgtaaattaaaagcagttgatttgcaggagagcaaacagtggggtagtggccatggcactctgatcatggttatatccaagaaagcataaaataaccaatgtcctgatatgcaatctggatgtgcagcatttacagcaaacaacataaaaagaaagaaagaagaatggaaaagaaaagaagaaaaaaaccaccacaaagtcccaaacctcagaaattaacattcacttaagaacacagtggtgaagacttttggtagcaaaatctgcacggttcttaaaatgggagtcttcaaaagtacttcttcaaattcaaaagctaagaaaaccaaagagggaacagttacacaggcttagtggagatgccgcctgtcatgaagatgaccatcagtcctacttcccagacacagtgagaaccggtgagcctgacgaacctgaaggaaaaggccggctgacgggtgctgatgccactgactatacaagaacacaccgggtcaactcatcattgacagcgagagacacactactgctcctcctggctgatgccaaggctgcctttctgcacctcaagctcctcggcactgaccattgatgggtcaatggccgcgtatttggttccatggaattgcagcaaatgtatctgttgaaatgcagaatcattattttatttattttttgagctggagtgtcactcttgttgcccaggctggagtgcagtggcactatcttggttcactccaacctccgcctcccgggttcacccaattctcctgcctcagcctcccgagtagctgggattacaggtgcccgccaccatgcccagctaatttttgtatttttagtagagacagggtttcaccatgttggccaggctggttttgaactcctggcctcaagtgatccatctgcctcggcctcccaaagtgccagattacaggtgtgagccactgcaccctgccagaatcattgttttaaatggctgcattacagagtaaaatgtatactgccttctataaaaagtttggtaggaaaacatcaccatagtggacaaatgttttatacttctaaaatttacagactaagacatactaaatagagaaaagtcaaacaattttttgaaaccacatttgggatctttgttcctcactccctgagcagtctccctgagtccctgcagagtctcctgagacatcttagatggtgcatgctcatgagatgtttacccttcccttctgctgctgtgagttaggtccttccaatcttctgctactgtgactagtgctgctatgatgaatatctctgggcatcaagtattcctgtttaggatcctgtcttctataaggggatgacaggatcaagggatatgactggtttttgggattacaggtgtgagccaccatgcgtggccaggatatgactggttttttaaggctcttgattcatcttgccaaactgccagggcactcacccctcactgctattctattatccatttagttagagtatgaagggatggtgtttgttagggctttcttttcttttctttttttttgagacggagtcttgttctgttgcccaggctggagtgcaatggcgtgacctcggctcactgcaacctctgcctccaggattcaagtgattcttctgcctcagcctcccgagtagctgggactacaggtgtgcaccaccacgtccagctaattttttttgtatttttagtagagacggtttcaccatattggccaggctggtcttgacctcctgaccttgtgatctgcctgcctcagcctcgcaaagtgctgagattacaggcatgagccactatgcctggtagggttttcttttaatgcattaaaattagatcaagaagtcacttcacaggactcagattgaccccatttaggtctggtgtcttgctctgatggaattcactgtgtccagagggcaaggtcacatcataccaatagtaacctcagtgtgtgaatgcaggcctgctgtccttagaaaagggatggtggccagagagtcactgggggatctctaatatacctgttcaaattctcctacaagttataaatgtaaaccacttttatcaagtcaatgcctcatttctacaaggaattctgtagttcactgattccctaactagtccattaaaagaagtctttatgttgcaaacatatgttgggctcagagtgctctgggtttcaagctaggccttacctgtacataaagattgacctctgcacttctgcacaggtatgggaaattgcctcctgttttcagatgagctcttcgggcattaggatacagcttgtacatttcttctttagcttcagttgaaagcgcactctgatcaaacacctttaaaaaacacaaagcttcagcaccataggaaaggtaaaacacacacacacatacagaaagctgtaatcaactagtgttttaatatgttcttttcacattatggaaatgttaccctaagtattcctttcatatgaagacaatcctgaacccccagcagcctgaactacctccactgctgatccctggtgacttataactccaaccgaagacattagctacagattttgctgcacagcatctcctgcattcttttggtggggggaaattctttttttttttttgaggtagagtgcagtggtgtgatctcggctcactgcaatctccacctcctgggctcaagtgattctcctgcctcagcctcctaagtacctgggactacaggcatgcgccatcacgcctggctaatttttgcatttttagtagagatggggtttcaccatgttggccaggctggtctcaaactcctgacctcaggtgatctgcccacctcggcctcccaaagtgctgggattacaggcgtgagccaccgagcccggctggggtcgggggaaattctaccatgaatttcctttttcctcaaatatagctaagtagattaacagaatattaatagagaacaatcattgcaaatgtcaataagtttcaaaaagatcacgaagccccaaaagaactttttacttttatcattaatttaaagcaataaactaagtcatttaggctcagtgaaaaaaattccaaaaaaatgtagagtacaagctattctttcttggggaaaccagtttgcagcatatgattctagacatccttcaatacccatacacatttacgtttttacatgcaacaaaatttttcaaaaagtaaaataagcaaaaaaaattgtatactaaatataccataccaaatctgtatgtttaagtgcatctccaactaaaacttacaggctgttttcagtgaccatgaacccaggcagtgagcacagctttgaaagaagggcaggcagagcaaatgtcctgtgaggaccattgaaaagcttgttctatgttatggcaaatgtcagaatgcagcgattatggcagaggatgataagaagttgtttacacgcttataatgaataatttcccaacaaaaaccaattattaaaaataccatattatggccaggtgcggtggctcacacctgtaatcccagcactttgggaggctgaggcaggcagatcatgaggtcaggagatcgagaccatcctggctaacatggtgaaaccctgcctctactaaaaatacaaaaaattagctgggcgtggtggtgggtgcctgtagtcccagctacttgggaggctgaggcaggagaatggcgtcaacccaggaggcggagcttgcagtgagccaagatcgcgccactgcactccagcctaggcaactgagtgagactttgtctcaaaaaaacaaaaacaaaaacaaaaaaccatattatttgaatttaggaacaaatccatttataaggcaaaataatcatatgatttttttttaagtaaattgaaaccatagtgagataccaattcatatccattaggataagtatcaaccaaaaaaccagaaataagggtccaggatatagagaaactggaatctttgtgcattgttggtgggaacatgaaatggtatagccactgtggaagacagtatggtggtacttcaaaaagtgtgattctacttcaaacgatatgtccaaaagaattaaaagtaggatacatctactatgtacccataaaaataaaaaacaaaaaattatttttaaaaaataatttaaaaataaataaaaaaaaattaaaagcaggaactcaaacaaatatacatatattttttgacagggtctcactctgttgcccaggctggaacgcagtggcatgatcatggctcaccccaggctcaggtgatcctcccacctcaacctcccaagtagctgggatcacagggatgtggcaccatgtccagctaattttccttttttttttttttcttttttttgagacgaagtctcactctattggcaggctggaatgcagtggtgcgatctcagctcactgcaacctccaccgcccagattcaagcaattctcctgcctcagcctcccgaatagctgggagtacaggtgtgtgccaccatgcccggctaatttttgtattttcagtagagacgggtttcaccacgttggccaggatggtctcgatctcttgacctcatgatccacccgccttggcctcccaaagttctgggattacaggggtgagccaccgcgcccggcctaattttctttattagtagtagagacagggtctcctgtattgcccagactggtctcgaattcctgggctcaagcaatcctcttgagtcagcctcccaaagtgctgggattgcaggaatgagccactgtgccctgcccaaacatatacttttacaccaatgttcatagaagcactattcacaattgccaaaagctgaacacaacccaagtgaccactgacggatgaatggataaacaaaatgtggtataaaccaacattggttttattggtagatattattcagctttaaaaagaaataggctgggcgtggtggctcatgcctgtcatagcactttgggaggcccaggcaggcagacagcttgagtcccagagtttgagtccagcatgggcaacatggtgaaaccccatctctacaaaaaattagccgaacgtagtggtgtgagcctgtggtccaagctactaaggaggctgaggagggaggattgtttgggcccgggaggcagaggttgcagtgagctgagattgcaccactgcactccagcctggggaacagagtgagaccctgtttccaaaaaaaaaaaaaaaaaaaagaaagaaatgacattctgacacatgtataacatttcaagataagtcttgtgaaacattatgctaagtgaaatggccacacaaaaggataaatgttgtatgattctacttatatgaggttctagaataggtaaatttttatagacagaaaataaaaccgttgattatcagaggccgggggaagaaagggaacaggagttattgtttaatgggtatgcaatttcttcttggaatgatgaaaatgttgtgaaaatggtgatggttgccgaactgtgaatatacttaatgccactgaactatgcacttaaaaatggttaaaatggcatattttaaatgtacattttaccacaataaaaaaataagcaagcttttgtggtaattaaactatggaattcttgattctctacccttgttacccttgtgaagcaccttctctttgctgcccatatatgtgcaatatatggtgcaatatctattgatgagaacagcaaaaatacatcaaatgggtagactcccttgtttaaatttattttgattcatttttatttttattttttttaaataaatacagacagggtctcactatgttgcccaggctggtcctgaactcttggactcaagcaatcctcctgcctcagcctcccaaagcgctgggattacaggcataagccactgtgctcggcctattttgatttcaatggtgttattcctgccagaaagaaatccaagataagcaataaacagattattttggaattgagaaagctggagggtaaaaacaaaagccaaggcagcatttgaagaggcacattgaaagttatcaaatagttttataggagatcttgacatacacattttaaaaagtaaagcagctattttacttaaaaggaagcttacatccataatagttacaggtatgtcccgaattttatgaggttccacataagaattttgacaattcaaggtaagtcttgaagccagttcactctgacccaaactttctagctgcaggaagaaacacaggtaaagtttttgaaataattttgtttttcacatttacattaaatccacagacaacatttgtgcttataaaggtggtatcatctgtggtggggccagaaaagtcatcagtgaggaaccacaacttaggtgagagaccatgaactgggcttctcaggaggttgtggcatttttctattctggaaacctgggtacaaaccaatgaaacccggccttttacagccctcagcctacactgcctactccagccaggtgcccatgggcagcaagccaattcctactgctcaaaggtgacagatatatgtttttgtttttttttttttttttaagataaacctttaagggatcttaaaagagatttgagaaatcatctagcccagcagttcctaaatgcaagccaacagacctggttcatcagatttacctggtgggtagaggaaaagtgtgaagtaaaaatagattcccagatcccatgcccagggattccagatggatgatctgctgtgaggccttacaatctgtatttttgaaagctcccctaagtgattttgatgaatagctggtgggaagcactaatgtaggcaagcccttaccagcaataatatctgctcagatgtattactctgcttagcaaatacctcttacacatacttgtgagacagatctatcttctggaaccaagtagatgtgaaaattcccaatacaatgtgtccccaacccaatgtcatgatccttaccctgtctaccatgaaatcaatggcatcagccatcatagggtccaccgggccagatgaaaaatttccaagaactatttttttgagcataaatgcaggcatcagccaaaagctgtaaaacacaaagaccttataatttaaacttccaagactacacatggcaaatattcattcaacattaaagctttgtattagcttgggatctagaaataaaaagtcctaatcccctcctccaaagagctcagcatctagtttttacacacactttcccaagcttccaaagagttatggcttcatataattaaacttttatttgaggatttaggataattataagagatatttcaaaatacctttactgagatagacattctgatgagtccaagattgttttttttctctaattggccctatttccaaggattaaactatttcttttggaaaactgaatattaagagaagtattctttccttctggttgatattatgtttttatcgattgatatttcaaaacagatttcaaaataccaatatgaaagctattgcacctccccaaatttgctactattagattcaacttggctaattcaaggcaaattgatatttatagatttattttttaaatttattattgttattattttttgagacagagtctcagtcagttacccatgctggaagtacagtggcatgatctcggctgggtgcaacctctgcctcccgggctcaagcaattctcatgcctcagcctttcgagtagctgcgactacaggcacatgccaccacgcccggctaacttctgtatttttagtaaagatgagcttttgcaatgttggccagactggtggtgaactcctggcctcaagtgatccacccacctcagcctcccacagtgctgggatcacaggcgtgagccactcctggcctctttttattttttaattaaaaaatttaaaaaaaaacttttagagacagggtctcactctgttgcccaggctgaagtgcagtattgtgatcatagctcactgtagcctcaaactcctatcaagtgatccttctaccttggcctcccgagtagctgggactacgggctcgtaccaccaggcctgactaattttttaaaaatttactgagctgggggagccggggccaggcacggtggctcatgcctgtaatcccagcactttgggaggccaaggtgggcagatcacgaggtcaggagattgagaccatcctggctaacacggtgaaaccccgtctccactaaaaatactaaaaattagccgggcttggtggcgggcgcctgtagtcccagctactcgggaggctgaggcaggagaatggcgtgaacccaggagatggagcttgcagtgagccaagatcgtgccatggcactccagcctgggcgacagagccagactccgtctccaaaaaaaaaaatttactgagccaggcgcaatggctcatgcctgtaatccagaactttgggaggccaaggtgggtgatcacaaggtcaggagttcaagaccagcctggccaagatggtgaaaccccgtctctactaaaaatacaaaaattagccaggggcggtggccagcgcctgtaatcccagctacttgggaggctgaggcaggagaatcacttgaacctggggggcagaggctgcagtgagaacgtgccactgcactccagcctgggcaacagagcgagactcccatctcaaaaaagaaaattttttttctgtagagacaggatcttgctctgttgcccaggctggtctagaactcctggactcaagcaatgctcttacctctgcctcccaaagtgctgggattacaggtgtgagccactgtgactggtcagatctttacggatttctatatatgatctttagtttatatttattccattaatttcaactgttaagagccatcatggagggcaaacactaatttctgtaaacctatgacgaaaattacttagatgaggtgcaaactaccttctgatgcttattaccactgggacagccttgctggaagttgagcttccctcaaaaggaccactaggtcaccttccagttaactttctaagttctctcccagccccatcactttcttatcttttgaaggtgatgaggtctaagtacgctctgtaaggggtggaccctgttgactttgctcactcctggatcctcagtgtgtggcacacagtaagcactcagatatttgacaataagcagctgatgtgccagagcacaaactgaatgggggctgtcttggcattctaacaattagaacagcaataaaaatcaccaaaaataatgagcattatttagtgcattatctggacgggaaggatttgtaaagtagctaatgtatacaagaaattgttgcatgaatgctgagtaattactaagataacatcagaaaaactaaaaaatagctgggcacagtggctcatgcctgtaatcccagcactttgggaggctgaggcgggcggatcacgaggtcaggagatcgagaccatactggtgaacacggtgaaaccccgtctctactaaaaacataaaaaattagccaggcatggtggcgggcgcctgtagtcccagctattcgggaggctgaggcaggagaatggcgtgaacctgggaggcagagcttgcagtgagctgagatcgtgccactgcactccagcctgggcgacagagcgagactccatctcaaaaacaaacaaacaaaaaaacaaacaacaacaaaaaaaactaaaaaatatcagagtgcaattttaagtagatgtgaaaacgatatttccctatacattatttgaaaacactgatcatacagatgtgtttactcactgggctttttttttgaagtagggtcttgctctgtcacccagcctggagtacagaggcacagttgtggctcactgcagccttgaactcttgggctcaagcgatcctcctgcctcagcctcctgagtagctaggactgcaggtgcataccatgatacctggctaatttattattattgttatttgtagagatggggtctcactatgttgctcaggctggtttcaaactcttggcctgaagtgatcctcctgtcttggcctcccaaagtgttgggagtacggcatgagccatcacacctggccactgggctttattttaaggctagagcctcgccttgccagcaatgaaagaagtgcacagtaagccagctgtatggcatcatagatacctaccaattacttaaaatgataaaatcaatgaaaggatggctcctaggaaacaagtaccccactggctgcacccaaagcatttccaccattttgtttttggtttgttttttttttgagatggagtttcgctcctgttgcctaggctggagtgcaatggcgtgatctcggctcaccacaacctccgcatcctgggttcaagtgattctcctgcctcagcctcctgagtagctgggattataggcatgtgccaccttgcccagctaattttgtatttttagtagacagggtttctccacgttggtcaggctggtctcgaactcccgacctcaggtgatccggccgcctcggcctcccaaagtgctgggattacaggtgtgagccaccgcacccagcctcatttccaccatttctatcttttggaagaacagactaatatcaagggtcatgatgtgcagaacatctgttgacagaccaaatgctctattctttccatttggagaacatatctcaaggaaataaattggaaagggaaaaaacccagtaatttgtacaaagatttactgtagaatgtgatgaagaattgggaaaagccaaatgcctaataaaactatgtcagtcaatacacggaactgtttacacataataataagtgggataaacagaacatggtattagttacatagaaatactgaataaaaacagcaaaagtatattaatgaatattaaacaaaatttaaaaatttaaggtaataaaaaaagctgaatttagagttcattcaattctttccttttgcaaaggtaattgtttctaattttaaaagccaagaaagagccgggcacagtggctcatgcctgtaatcccagaactttgggaggccaaggtgggcagatggcttgagcccgggagttagagaccagcatgggacaacatggcaaaacctcatctgtacaaaaatatacagaaattaaccaggtgtggtgccatgcatgcctgcctgtagttccagctacttgggaggctgaggtaggaggatcgcttgagcctgggaaataaaggctgcagtaagctgtgattgcaccactgcacttcagcctgggtgacagagcaagactctgtctcaaaaaaaaagccaaggaagttgcagaatatagaagtagatataagtcttcccttcctaatgtaccaaacactcaaaagccaacattttcaaaatttcactgaacaaaaaaagtaattttgttcttacctgtttgcagtccaagtttggttgaagatagaggtgtcactgaaggaattgcagaggattagggaatggactctaggagatttgtgagtgtattcagcaaatttctgggccaaaaagcctcccaaagaagcgccaaaaagatgaacctaattataaacaaatataaggcagattctgaaatactgatcaatcttgaacctgagtattaaaaagttgcttcaattatcactaaccacagaatatgttatcactagccaatagactaaaatatttacagcagctagaaatttagaaaatattgtatttaaatgcaatttatacagtccatcaagataatacaacttggcatccaagttatataattaaaaaaaatatcattcacagattgcattagaaaacaaaaccagtccaggcacggtggctcacacctgtaatcccagcactttgggaggccgaggcaggcagatcacgaggtcaggagttcgagaccagcctagccagcatggtgaaaccgtctctactaaaaatacaaaaaaactagccaggcatggtggtgcgtgcctgtagtcccagctactcgggaggctgaggcagcagaatcgcttgaacctggcaggcggaggttgcagtgagccaagatcgcaccactgcactccagcctgggcaacagagcgagactccgtcttaaaaaaaaaaaaaaaaagaaaagaaaaaaagaaaccaacaaaaccaagctagggaaatatggaaaaggcctgtatactaaaaatacaaaaattagccaggcatggtggtacgtgcctagagtcctagctacttgggaggttgaggtgggaggatcgcttgagcccaaaaggttgaggctgcagtgagccatgattgcaccaccgcactccagcctgggcaacaaagtgaaagcctgtctcaaaaaaaaaaaaaaagaaaaaactcaaaaccacttagtggtttatgtctaagaaaactgtgattcagtaattccacccctaaacacatacctaagagaactgaaaacatatgtcaacacaaaaacttgtacatgaatgttcatggcagcattattcatgatatccaaagggtaaaaacaacccaaatgtgcatcagctgatgaatcgttaaacaagatatggcatatttataaaaatatgatttaactgtaaagagaaacgaagtattgattccggcttcaacatgaatgaaccttaaactcacaatgctaaataaaaaaagccagtcaaaaagaccacatatgatacgattccacttatgtaaaatatctagaataggcaaatccatagagataaaaataaattaggttgcagggctagtaggggggaagatgaggaccgactgctaatgaatatgaggtttttggcattaaaaaaattataaaacattgactgcagtgatggttgcacatacctgggagtatactgaaaaacatggaactgtatacttaaaagggtaaattatatggtatatgaattatgttgcaataaagctattattaaaaaataaaagagggctcggcacggtggctcacgcctgtaatcccagcacttagggaggctgaggcgggcggatcacttgaggtcaggagtttgagagcagcctggccaacctggcgaaaccccatctttactaaaaatacaaaaactagccgggcatggtggcacacgcctgtaatcccagctattttggagactgaggcaggagaatcacttgaatccgggaggtggaggttgcggtgagccgagatcgcgccactgcactccagcctgggtgacagagtgagacttcatctcaaaaaataaaaaaaaaattgtatgtatgtaattagtttcagggtactcactttatccaattgtaaatggtctaaaagttttctgaatccatcacagaactcgagatggtcccaataaactggatactgcaactgaaataataacgataattttatttttaaaaatcataaaagtaaaaatgcaactcacgtatttgaaaaacttaggactcaaacactgacatttctcgtttgctcaagcgctgctccttattcaaaatatgtaaaaataagctctcactttttactaaacttcatatttcacatttttctaacagaccaaattaaaagagtataaaaagtaagcacactctaatgatattacgtgagtaacaatttcaattcccatcaatttcctttctaaatagctgaaaaagtctggggttcaaggatgaatacagcagaacccattccagtaaagaaataccgttttctcttaaatctaatttcattcagaattatggctcaggagagatggaaacaaaatttgttctaaggagagcttcctctctttttggtagcatttctttaagagggtattcagtaaaattgttcctcttcttttaaatgacttagttactctatttcatttattgtactttggggtgtctgtttgtttcttgagacagagtctcctctgttgcccaggctggagtgcagcggcgcgatctcgactcatgccacctccgcctcccgggtttgaacgattctcctacctcagcctcctgagtagctgagattacagatgtccaccaccacacccagctgatttttgtatttttagtacagacacagttttgccatgttggccaggctagtctcgaactcctgacctcaagtgatctaactgccttggcctcccaaagtgttggaattttaggcgtgagtcactccacccagcttgtttgtttttgtgatagggtctcactctctctcacccaggctggagtgcattggcacgattgtagctcactgcagccacaacctcttgggtgcaagcgattctcccacctcagccccccggtagctggaatcacaggcatgcaccaccatgcctggctaatttttatatgtatacttttttgtagaaatggggttttgccacgttgcccaggctggtcttgaactcctgggctcaagcgatttgcctgcctcaagcaatataactgccttaacttcccaaagtgctgggattacgggtgtgagccaccatgccaggctactgtacttctgtttgtgacaaaagaagtatggtacttgactatacgtagcctatctattaatgctggcaatgatgaggaaaaagaagtacaagtcacaaactcatttctaagggactcaggtttgtcccctaagaattccttttttttgtttgtttgaactggggtctcgctctgtcgcccaggctggagtgcagtggcgcgatctcggctcactgcaacctccacctcccaggttcaagcgattctcctgcctcagtctcctgagtagctgggactacaggcatgtgccaccacacccgactaattttttgttgttgttgtatttttagtagagacggggtttcaccatgttagccaggatggtctcgatctcctgatcttgtgatccgcctgcctcggcctcccaaagtgctgggattacaggcgtgagccaccgcgcctggccaagaattccttttttatatacatataaaaccaactggctgggcgtggtggctcacgcttgcaatcccagcgctttgggaggccgaggcgggtgaatcacttgaggtcaggagttcgagaccagcctggacaacatggtgaaaccccatctctactaaaaaatacaaaaattagccaggcatggtgacaggcacctgtaatcccagctactggggaagctgaggcatgagaattgcttgagcctgagaggtggaggttgcatgagccgagatcatactactgcactctagcctgagtgacagagtgagactccatctccaaaaaacaaaaacaaaaacaaaaaaactcccccaaaaacctcgtctaacaggcttactgtttaagcacttaggttcattttgttattgatgaatcactggaatggatactgccatatgaattatggaatcattttagatttgatgtatgactttcattattaaaattctatttgtggataagacttccaccattccaagaaagaatggggaactgattctacctagcagaaagtttgagaatttgagtcagatgatagcctaaaagaaaggggatgatactttcatggagtctttaatttataaatatccatgcccacacaggtgacaaaattatatgcaacttaatacatacaaacaaatgagttcaagcagaactggggaagcctgaatgagattggtagattgtagtaatatcaatatcctggttgtgattttgtactacagttttgcaaaggttcggcagaaactggggaaatgtgtaaaaggtatatttctctttactattttttacactgcatgtgaatctacaattacaacaacaaaaaaatttaaattaaaaagatctgtgcattttaactgctagatactaacaaatattaaataagttccaaaacctcatggagctgaacattctgatcacatcttgatgacaaaataattttgaagacactgttgaccttttcttgattaactctcctcctaatgaaacagggaaagcgcacaacaagaaccttgagagtgaagaagaaacatccagccagaagccaaggctctcatgacctgccactgtggagcgagaaacacactgctggacagcactcccgagtgggacgggcgcctatgggttgctcggtttccccctccctggctgatcaacaggggccaccaaaaatggtagtgtcatgtctcaggctgcagagggctgggatgagggcagttcccaccctgttctagaatgctgtttgtgaagaggaatgactgaaaatctgaacaaaggaggattatgttgcagaggctcaaacatgtcacgtgaggaatggttaaagaagctggagaaattaagccagagaagaaaagacccaggagaaaagcagcaggtagtgatgataactgttttctcaagtaagagacgggctctcaggaggaagaggaactgatttcctttgtgtggcctcagttggtggtaacctcagtagaattttcagttaccttccaaaaggagagacgtgacctgccttttcatccctttaaacagtaaataaaacgtacactaacagcagtactcccactgggagtaccacttacaagtgaatactgcaggcgactgccagctaaagagactctctccttcctggaaaattaggagaccaatgtcctgaccaatgtggaagcatgcaaaaaaaaaaaaaaaaaaaaaaatcagtcaccaggaagagtgcctttcccacacacctttctcccagagaagactcaagaatgatcagtgggaaactggatttagaccaaactcagctataaagtaacaatcaggaacaaaaaaacttcctaaccaaatgctaacatatgagctaattaatgaatctcacctcaaatatcaaagatttacatgaaaagccagcttttcaagtcacttgtatgttagcaaatccctttgttgtctaatattccatgctcagcaaccctggaagcagtgctgtgataaaatgaggagcagaaacagagccaggagacggagctcagttcctccctccaccactactggctgtgtgagccggacctcagtttcttcatctgtaaagaaggacaacgcttcctaccgctctgagttgagagaagggcgtcaggagagaatgcacgtaaatgctgggcatggagaggctgccaaaagaggtttgttccctctgaatctctgtgtgaccgtggactcacaccagcctccttcaaaaggcttcatctcacatattaaaataagcaaacagtatctttcctcaattaaaaaaactgcctggctgggcgcagtggctcgtggctgtaatctcagcactttgcgaggctgaggtggatgaatcatgaggtcaggagttcgagaccagcctggccaacacggcgaaaccccgtctctactaaaaatacaaaaaattagctgggcgtagtggcgggcgcctgtaatcccagctactcgggaggctgaggcaggagaatcgcttgaacccgggagacggaggttgcagtgagcagagatcacgccactgcactccagcccgggcgacagagtgagaatccatctcaacaaacaaacaaacaaacaaacaaacaaacaaactgtgcccattactatagctgatgagagacagaagcataaaaaaaaaaaaacacacaaaacgtgggtctgaattttaatcagtaatacttacagcgataacccggtaaccccatccagtcagagccaaaatctgccggaaaaagacatctgcagttccactgacagggggcaggaatatgagaggacacctgatacttcgggggcccgcgtcatagagcgaccatatcttactgtcatcatcatccacaataatctggagggaaggttaaaagaaaaaagtggaaaaccttataaatttgctttttatgttattttacactgtcatttcactgacaattttactactactgccttgtttgttacaaggtaacctggagctcacaccagattagcatgcatgacaaactcctctgatctccttttctttcctcagggctaacgtattccacagaactacttagaactactttataatcttccaaagggctgctgcttctctgtttcttccccctcctccttttttttttttttttttgagacagagtctcgctctgtagcccaggctggagtgcagtggcacgatcttggctcactacaacctctgcctcccaggttcaagcgattctcctgcctcagcctcccaagtagctgggattataggcacacaccctcatgcccagctaattttttgtatttttagtagagacggggtttcaccatattggtcaggctggtctcgaactcctgagctcatgatccacccgccttggcctcccaaagtgctgggattacaggcgtgagccactgcgcccggcctggatcctgtctctttaaaatacataaataaataaataaaaatacaacaacactccagcctgagcaacagagggagagatcctgtctcttaaaaaaaaaaaaggcaagctgaggtaagacaagtgctcagcagagtctggcagatgttaagtgtcctagaaatattagctattattattattcacggcatcctagtttaatttttgctttcacttttggtggtatttagaaaagtacattaactgcttaaacatttgacaatgcaaatcagtatttattctactttcatattaaaaaactcaaggcctccaggctcttttttctgagagctcctcactagcagggctatggactccacagtgtcactctgtgggtggcagcacactaaccagggtcactggcatcactaggagcagataaatggagcaaggcaaagtccagagaggcctaacagttccctttggacttccacaggtcacagatggtgataatgtatctcacgctcatgtttttgtcctgtgtatcttgccactcacattttttcttttcttttcttttttttttttttttttttgagacaaggtctggctctgtcacccaggctggagtgcagtggcacgatcacagcttactgcaagcttgtcttcctgggcttaagcaatcctcccatctcagcctcctgagtgtccgggactacaggcgtgcaccaacacgcccagttaattttttctagtttttgtagagaaagggtctcatcatattgcccaggctgatctcaaattcctaggctcaagcaatcttcctgcctcggccttccaaagtgctgggattacaggtgcacagcaccatgcctggctaattttttcatttttttatagagacagagtttcgctatgttgcccaggctggtctcaaactcctggcctcaaatgatcctcctaggtctctaaagtgctaggattacaggcatgagccatcacaaacagctgcaaaagatcttaagatcactggattctaacactcctgcaagggaatcagcaaaggttttactctactcagtgacttgaactgcctttgtctagtgtgatccccaaacatctgggattaatttgggaagcagagtcaatactcaactgcaatataagtgttttgggttttcaaacatcccaggaaaataaagcttctagaagatgactgtggcagaatgagtatgtcattgcaaacagaagctctataatgtgaccccattcttaaatctgaggaacaggaatataatctgactgtactcactatacagttgctgtaaactttccactaaactatacagaagagtacatacatacctgcttgcttgtatatgtaaaagcaattataaaaaatgagtacaggctgggtgcggtggctcacgcctgtaatcccagcactttgggaggccaaggtgggcggatcacttgtggtcaggagttcgagaccagcctggccaacatggtgaaactctgcctctactaaaaatacaaaaattagctgagtgtggtagcgcatgcctgtaatcctagctacttggcaggttgaggcaggagaatctcttgaacctgggaagcagaggttgcagtgagccgagatcatgcagtgcactgcactccagcctggacggcagagcgagactccatctcaaaaataaatataaataaataaataaataaaaatgagtacagttacacttgctttcactctaaaatgagtctcaaaagttgactgtacatgacagggaaggagtgaacttaatcctctgcaacccacagtcatgatactcggcagtaacctttactctcaaacactactaagacatgacatctaaatcacacacaaaaacaatacaagattttgcaaataagaggtatagtaaaaccatacatacctttttaaggggaactgtacctctaaaccagttataatcaggagagactttaatctctcccatgattagctgaaatggaggttaatcctgaaataaaagcatgtgatatttcacgtcaagaattcatgtttacatcagaactaaatgtagagtctcatctagctataccaacaatattttaaagaagaaagccaaggaaactggctattttgtcagtatatagtccaactacagaaaacaatttggtgaaatactacaatcacagaatcagaagcactcttttttttttttttttgagacagtctcagtcttgttgcccaggctggagtgcagtggcgtgatctcagctcactgcatcctctacctcctgcagttcaagtgattctcctgcctcagcctcccgagtatctgggattacaggtgcccgccaccacgcccaactaatttttgtatttttagtagggatgggggttcaccatgttggccaggctggtctcgaactcctgacctcaggtgatccacccacctcagcctcctaaagtgttgggattacaggcgtgagccaccatgcccggccaccagaagagctcttacagaaattattccaacacccttagttcttccagaaaaggaatctggtctagaaaatttaaatgacttacccaagatcacatggcaatgctaggaccagatgtgagacagccttttctgacaccatacttcctgtcttagttctcaactgcagtaccatcagttatcttttgacattaccttaagaatccctttaataaagatgctcctgtctgattatagggatagtccacgctagagaaaggagttgatgtttttttacttttttaatttttgagacagtcttgctctgttgtccaggctgcagttcaatggcacaatcacagctcaccacagccttaacctctgaggctcaagtgattatcccaacctcagcctcctaagtagctgagacaatgggcacacaccaccacgtcaggtgaattttttggttttgtagagatgggggcctccctgtgttgcctgcactggtctcgaattcctaggctcaagcaatcctcccatcttgcctcccaaagtgctgggattacgggtatgagctaccacacccagcctagagaaagaagtttaagttaagcctgcttcctgataaattcgcaatacaccataaatctaactgtaatagcacataaccagaaattcacatgtagttccctttttttttttttttgagacagagtctcactctgtcacccaggctggagtgcagtggcgtgatctcagctcactgcaacctccaccctccaagttcaagcgattctcctgcctcagcctcctgagtagctgggattacaggcacctgccactgcgcccggctaattttttgtatttttagtagagacggggtttcaccatcttggccaggctggccttgagctcctgacctcatgatccacccgcctcagcctcccaaagtgctgggattacaggcatgagccaccgtgccccgcctacatgtagttcttaatacaaaatacaggcaaatttgccactcatatggacgtgattaaaagttacacaatgtcctcagaaagatctataatgtaaacttgaaggcactataactaacaacaaaatgaaacatttgcccttaggaaaaaatgtgtagtcttttgttgtgagcttagtgacttctggttttcatagctctgtgatcttagataagtcttgatccttttggagtttgtttcctcatctatgactgtgttaccactgtgtccccaaagcttagatcagtgcttggcacacagcaggcattatctgttgattgaacgaataactacattctaaggagaatgaagggggccatccttctaaccctggcatctgtgagctttggcctagctgaacatcctcaactaaaaggctgcccctctttgctcaggcatctgtgctatgtcataacaggaaactgaaattatagttccctgttgcagattcttattgccaagtgaggaaattccaccaggaaggattcaaatatttgctttgtaccacttcctctacctcaagagcaagccttgatcctagcacggctaacacgaggtgagattcgtgagacctaactcccgggctgactctgaactgtcgttttagagggagttctctggactggcaaggaacaggggattctaaactcaatggaactcttccttggtggccctcgagatctgctccctcaggaacacagagccctcagtagactcaactgtgaccttggagacgtactaagctgaaccccgaggagacagcagatgtagacattctaacactaaacttgatttacaaccttgacattgtgataatggtctctcttctcaaagctaagatggtaattttagagaagtgtgttaaaatcataagttgctttaaagtaccaagaaaatcatcagccagtcttatactgaaaattagtgtgcacagatatatatagtgaaataaagaaaattctttgcatatccattttatcttaaatattaatatgttaaggccaggcacagtggctcacgcctgtaatcccagcattttgggaggctgaggcaggtggatcacgaggtcaggagttcaagaccagcctagccaaggtagtgaaaccctgtctctactaaaaatacaaaaattagcctggcgtggtggcgcacgcccgtagtcccagctactcaggagggtgaggcaggagaatcacttgaacccgggaggcagaggttgcggtgagccaagattgtgccactgcactccagcctgggcgacagagtgagactcaatctcaaaaaaacaaacaaaaaaattaatatgttaaaaaattttgccaggcgcggcggctcacacctgtaatcccagcagtttgggaggctgaggcaggtggatcacctgaggtgaggagttcaagaccagcctgaccaacatggcgaaaccccatctctactaaaaatacaaaaaaaattagccaggcatggcagtggccgcctgtaatcccaaatactcgggaggcgaggcaggagaatcgcttgaacccaggaggcggaggttgcagtgagccaagactgcactccagcctgggtgacagagtgagagtctgtctcaaaaacaaaacaaaacaaaacaaaacaaaacaaaaaacaaaaaaacaaaaaacaaaaaaaaactaagccattttaactataggctttctctaagctgattataacttttaattgaaagcaactagcacatatacttaattctggaatattttctacctggacagacttgaaatacttctatatcatctaaatacttcttaatggagacatttcctagtattgcattattagaaacaatctattctaaaggagggaaaataaaaacatgtttagcaaataacatctactcaatagatttataaaacaccttagctaactaaagccagaaagtgtgcttctagagtcaccaaatgggataaatcattcatagctttgaaatcagttgcaatgcacaaaccaaaccaccatacaaatacacacatacacaggcacacatattcacgcggtcatcctcttctttcccatagcagtaaatagaaagatgttccttaccaacagtcttcagaataattcacaaccacctcaggatgccaacgtgttaaaagtaatcttacaagatggagagattccactccgctgtgactaaatttttgtagagacaagtaattttaacacttgtgctagtttggcagtacatgaaaggtaaaatggataccaaatgttgcatctgaccaactgacgtctaagtgaaaaaaagatcactgctgcaaagggaaaacagctgtgagtggtatgaataggaaagtttgttctcctagctctctttcatccaccaaaggggtatacttttccaaatcataagaggaatattctgtatatggcaaaggttaactgagattgtgaccaaactggtcagtactgaataagaaagaatgtggaccatgagctcaaaactgattttatctctcatgattttgttcttcacaaaaacaaaagcacctgttcatgctggtgggaaaagagccacaatattagccttaatcttgcctaaggaaagccctcttcagggtgtgctgtggactccctgtcttctctggcccttgtgctgctggacaataaaaactgccagttgtggctgggtgcagtggctcacgcctataatcccagcactttgggaggctgaggcaggtggatcacctgaggtcaggagttcgagaccagcctggccaacatggtgcagccccgtctctactaaaaatacaaaattagctaggcgtggtggcacatgcctgtaatcccagctacgcaggaagctgaggcagaagaatcacttgaacccgggaggcagaggttgcggtgagccgagatcacgccattgcactccagcctgggcaacgagagcgaaactccatctcaaaaaaacaaacaaaacagcaacaacaacaaaaacaaattagctgggcgcggtgatgggctcctgtaatcccagctacttaggaggctgaggcaggagaattgcttgaacctgggtggcggaggttgcagtgagctgagatcacaccactgcactccagcctgggcgacagagtgagactctgtctcaaaaaacaaacaaacaaacaaacaaaaaaacctgccagttgtgactatgcccctatccctcatggcttcaacagaacctgccactttaaagtcaacaaaatcacctttatcaatgtttaagtcacataaccagcataattagtcagaggtttctgctactttatttcaatctatagttgatgtgcattgtggaaaatctgtgcttataaatactagccataacaaaatattagaagctgagagtctctgggagatgcaactggctttttaatgcacgtctccatccctcaccacagaagtacacagctatccttttcttagatctcttcaggggagatctatccctcttttcttcattgcattatctctaaaccttacaggaggaaaaggtgcctacctgacatctgtgacatctcttctcatgctcttgggaaaaaagcttttggaatttggacacagctattaagttactcctcagtggccagccgcgatggctcacgcctgtaatctcagccctttgggaggccgaggcgggcggatcacgaggtcaggagatcgaggccatcctggctaacacggtgaaaccccgtctctactaaaaatacaaaaaattagccgggcgtggtggcgggagcctgtagtgccagctactcgggaggctgaggcaggagaatggcgtaaacccagcagacagagcttgcagtgagctgggatggcgccactgcactccagcctgggcgacggagcgagactccgtctcaaaaaaaaaaaaaaaaaaaaagttactccttaatttgttgaatctttgtgccaaaaggagctgaaccagtgtaggtggagacaaaggaagcagcataaatgtctaacttataactccccaggaaaacgagaagaggaaaaatgagacactccggtcccgctctgttcctcatcccccgtttacaaaccttacacctggcccacactcagtaacaacaaagacatctatcactttcaggccgaggtcctgtctccaaaattactggcctctgctcacagttcttaaaagtttgctgagaaaaaaaaaaagaaagaaagaaagaaagaaatgttcctgggctgcagtcgtgtagccccaggatgggtttacaggaggatgccccggttaagccctgtgccgcccccacctcccgctggagactcacacacagctccccgccagtcccaccggtgacagccacacaaaggcagggtcacaagcacaccgaccaccc

SEQ ID NO: 768 - DNA, 26889 bp, Homo sapiens
tcagtgaaattgaatttttattccaaatgactaatatctagaaaggcagtagctaacactcaaaacaatttgtttaagtgtaaattaaaagcagttgatttgcaggagagcaaacagtggggtagtggccatggcactctgatcatggttatatccaagaaagcataaaataaccaatgtcctgatatgcaatctggatgtgcagcatttacagcaaacaacataaaaagaaagaaagaagaatggaaaagaaaagaagaaaaaaaccaccacaaagtcccaaacctcagaaattaacattcacttaagaacacagtggtgaagacttttggtagcaaaatctgcacggttcttaaaatgggagtcttcaaaagtacttcttcaaattcaaaagctaagaaaaccaaagagggaacagttacacaggcttagtggagatgccgcctgtcatgaagatgaccatcagtcctacttcccagacacagtgagaaccggtgagcctgacgaacctgaaggaaaaggccggctgacgggtgctgatgccactgactatacaagaacacaccgggtcaactcatcattgacagcgagagacacactactgctcctcctggctgatgccaaggctgcctttctgcacctcaagctcctcggcactgaccattgatgggtcaatggccgcgtatttggttccatggaattgcagcaaatgtatctgttgaaatgcagaatcattattttatttattttttgagctggagtgtcactcttgttgcccaggctggagtgcagtggcactatcttggttcactccaacctccgcctcccgggttcacccaattctcctgcctcagcctcccgagtagctgggattacaggtgcccgccaccatgcccagctaatttttgtatttttagtagagacagggtttcaccatgttggccaggctggttttgaactcctggcctcaagtgatccatctgcctcggcctcccaaagtgccagattacaggtgtgagccactgcaccctgccagaatcattgttttaaatggctgcattacagagtaaaatgtatactgccttctataaaaagtttggtaggaaaacatcaccatagtggacaaatgttttatacttctaaaatttacagactaagacatactaaatagagaaaagtcaaacaattttttgaaaccacatttgggatctttgttcctcactccctgagcagtctccctgagtccctgcagagtctcctgagacatcttagatggtgcatgctcatgagatgtttacccttcccttctgctgctgtgagttaggtccttccaatcttctgctactgtgactagtgctgctatgatgaatatctctgggcatcaagtattcctgtttaggatcctgtcttctataaggggatgacaggatcaagggatatgactggtttttgggattacaggtgtgagccaccatgcgtggccaggatatgactggttttttaaggctcttgattcatcttgccaaactgccagggcactcacccctcactgctattctattatccatttagttagagtatgaagggatggtgtttgttagggctttcttttcttttctttttttttgagacggagtcttgttctgttgcccaggctggagtgcaatggcgtgacctcggctcactgcaacctctgcctccaggattcaagtgattcttctgcctcagcctcccgagtagctgggactacaggtgtgcaccaccacgtccagctaattttttttgtatttttagtagagacggtttcaccatattggccaggctggtcttgacctcctgaccttgtgatctgcctgcctcagcctcgcaaagtgctgagattacaggcatgagccactatgcctggtagggttttcttttaatgcattaaaattagatcaagaagtcacttcacaggactcagattgaccccatttaggtctggtgtcttgctctgatggaattcactgtgtccagagggcaaggtcacatcataccaatagtaacctcagtgtgtgaatgcaggcctgctgtccttagaaaagggatggtggccagagagtcactgggggatctctaatatacctgttcaaattctcctacaagttataaatgtaaaccacttttatcaagtcaatgcctcatttctacaaggaattctgtagttcactgattccctaactagtccattaaaagaagtctttatgttgcaaacatatgttgggctcagagtgctctgggtttcaagctaggccttacctgtacataaagattgacctctgcacttctgcacaggtatgggaaattgcctcctgttttcagatgagctcttcgggcattaggatacagcttgtacatttcttctttagcttcagttgaaagcgcactctgatcaaacacctttaaaaaacacaaagcttcagcaccataggaaaggtaaaacacacacacacatacagaaagctgtaatcaactagtgttttaatatgttcttttcacattatggaaatgttaccctaagtattcctttcatatgaagacaatcctgaacccccagcagcctgaactacctccactgctgatccctggtgacttataactccaaccgaagacattagctacagattttgctgcacagcatctcctgcattcttttggtggggggaaattctttttttttttttgaggtagagtgcagtggtgtgatctcggctcactgcaatctccacctcctgggctcaagtgattctcctgcctcagcctcctaagtacctgggactacaggcatgcgccatcacgcctggctaatttttgcatttttagtagagatggggtttcaccatgttggccaggctggtctcaaactcctgacctcaggtgatctgcccacctcggcctcccaaagtgctgggattacaggcgtgagccaccgagcccggctggggtcgggggaaattctaccatgaatttcctttttcctcaaatatagctaagtagattaacagaatattaatagagaacaatcattgcaaatgtcaataagtttcaaaaagatcacgaagccccaaaagaactttttacttttatcattaatttaaagcaataaactaagtcatttaggctcagtgaaaaaaattccaaaaaaatgtagagtacaagctattctttcttggggaaaccagtttgcagcatatgattctagacatccttcaatacccatacacatttacgtttttacatgcaacaaaatttttcaaaaagtaaaataagcaaaaaaaattgtatactaaatataccataccaaatctgtatgtttaagtgcatctccaactaaaacttacaggctgttttcagtgaccatgaacccaggcagtgagcacagctttgaaagaagggcaggcagagcaaatgtcctgtgaggaccattgaaaagcttgttctatgttatggcaaatgtcagaatgcagcgattatggcagaggatgataagaagttgtttacacgcttataatgaataatttcccaacaaaaaccaattattaaaaataccatattatggccaggtgcggtggctcacacctgtaatcccagcactttgggaggctgaggcaggcagatcatgaggtcaggagatcgagaccatcctggctaacatggtgaaaccctgcctctactaaaaatacaaaaaattagctgggcgtggtggtgggtgcctgtagtcccagctacttgggaggctgaggcaggagaatggcgtcaacccaggaggcggagcttgcagtgagccaagatcgcgccactgcactccagcctaggcaactgagtgagactttgtctcaaaaaaacaaaaacaaaaacaaaaaaccatattatttgaatttaggaacaaatccatttataaggcaaaataatcatatgatttttttttaagtaaattgaaaccatagtgagataccaattcatatccattaggataagtatcaaccaaaaaaccagaaataagggtccaggatatagagaaactggaatctttgtgcattgttggtgggaacatgaaatggtatagccactgtggaagacagtatggtggtacttcaaaaagtgtgattctacttcaaacgatatgtccaaaagaattaaaagtaggatacatctactatgtacccataaaaataaaaaacaaaaaattatttttaaaaaataatttaaaaataaataaaaaaaaattaaaagcaggaactcaaacaaatatacatatattttttgacagggtctcactctgttgcccaggctggaacgcagtggcatgatcatggctcaccccaggctcaggtgatcctcccacctcaacctcccaagtagctgggatcacagggatgtggcaccatgtccagctaattttccttttttttttttttcttttttttgagacgaagtctcactctattggcaggctggaatgcagtggtgcgatctcagctcactgcaacctccaccgcccagattcaagcaattctcctgcctcagcctcccgaatagctgggagtacaggtgtgtgccaccatgcccggctaatttttgtattttcagtagagacgggtttcaccacgttggccaggatggtctcgatctcttgacctcatgatccacccgccttggcctcccaaagttctgggattacaggggtgagccaccgcgcccggcctaattttctttattagtagtagagacagggtctcctgtattgcccagactggtctcgaattcctgggctcaagcaatcctcttgagtcagcctcccaaagtgctgggattgcaggaatgagccactgtgccctgcccaaacatatacttttacaccaatgttcatagaagcactattcacaattgccaaaagctgaacacaacccaagtgaccactgacggatgaatggataaacaaaatgtggtataaaccaacattggttttattggtagatattattcagctttaaaaagaaataggctgggcgtggtggctcatgcctgtcatagcactttgggaggcccaggcaggcagacagcttgagtcccagagtttgagtccagcatgggcaacatggtgaaaccccatctctacaaaaaattagccgaacgtagtggtgtgagcctgtggtccaagctactaaggaggctgaggagggaggattgtttgggcccgggaggcagaggttgcagtgagctgagattgcaccactgcactccagcctggggaacagagtgagaccctgtttccaaaaaaaaaaaaaaaaaaaagaaagaaatgacattctgacacatgtataacatttcaagataagtcttgtgaaacattatgctaagtgaaatggccacacaaaaggataaatgttgtatgattctacttatatgaggttctagaataggtaaatttttatagacagaaaataaaaccgttgattatcagaggccgggggaagaaagggaacaggagttattgtttaatgggtatgcaatttcttcttggaatgatgaaaatgttgtgaaaatggtgatggttgccgaactgtgaatatacttaatgccactgaactatgcacttaaaaatggttaaaatggcatattttaaatgtacattttaccacaataaaaaaataagcaagcttttgtggtaattaaactatggaattcttgattctctacccttgttacccttgtgaagcaccttctctttgctgcccatatatgtgcaatatatggtgcaatatctattgatgagaacagcaaaaatacatcaaatgggtagactcccttgtttaaatttattttgattcatttttatttttattttttttaaataaatacagacagggtctcactatgttgcccaggctggtcctgaactcttggactcaagcaatcctcctgcctcagcctcccaaagcgctgggattacaggcataagccactgtgctcggcctattttgatttcaatggtgttattcctgccagaaagaaatccaagataagcaataaacagattattttggaattgagaaagctggagggtaaaaacaaaagccaaggcagcatttgaagaggcacattgaaagttatcaaatagttttataggagatcttgacatacacattttaaaaagtaaagcagctattttacttaaaaggaagcttacatccataatagttacaggtatgtcccgaattttatgaggttccacataagaattttgacaattcaaggtaagtcttgaagccagttcactctgacccaaactttctagctgcaggaagaaacacaggtaaagtttttgaaataattttgtttttcacatttacattaaatccacagacaacatttgtgcttataaaggtggtatcatctgtggtggggccagaaaagtcatcagtgaggaaccacaacttaggtgagagaccatgaactgggcttctcaggaggttgtggcatttttctattctggaaacctgggtacaaaccaatgaaacccggccttttacagccctcagcctacactgcctactccagccaggtgcccatgggcagcaagccaattcctactgctcaaaggtgacagatatatgtttttgtttttttttttttttttaagataaacctttaagggatcttaaaagagatttgagaaatcatctagcccagcagttcctaaatgcaagccaacagacctggttcatcagatttacctggtgggtagaggaaaagtgtgaagtaaaaatagattcccagatcccatgcccagggattccagatggatgatctgctgtgaggccttacaatctgtatttttgaaagctcccctaagtgattttgatgaatagctggtgggaagcactaatgtaggcaagcccttaccagcaataatatctgctcagatgtattactctgcttagcaaatacctcttacacatacttgtgagacagatctatcttctggaaccaagtagatgtgaaaattcccaatacaatgtgtccccaacccaatgtcatgatccttaccctgtctaccatgaaatcaatggcatcagccatcatagggtccaccgggccagatgaaaaatttccaagaactatttttttgagcataaatgcaggcatcagccaaaagctgtaaaacacaaagaccttataatttaaacttccaagactacacatggcaaatattcattcaacattaaagctttgtattagcttgggatctagaaataaaaagtcctaatcccctcctccaaagagctcagcatctagtttttacacacactttcccaagcttccaaagagttatggcttcatataattaaacttttatttgaggatttaggataattataagagatatttcaaaatacctttactgagatagacattctgatgagtccaagattgttttttttctctaattggccctatttccaaggattaaactatttcttttggaaaactgaatattaagagaagtattctttccttctggttgatattatgtttttatcgattgatatttcaaaacagatttcaaaataccaatatgaaagctattgcacctccccaaatttgctactattagattcaacttggctaattcaaggcaaattgatatttatagatttattttttaaatttattattgttattattttttgagacagagtctcagtcagttacccatgctggaagtacagtggcatgatctcggctgggtgcaacctctgcctcccgggctcaagcaattctcatgcctcagcctttcgagtagctgcgactacaggcacatgccaccacgcccggctaacttctgtatttttagtaaagatgagcttttgcaatgttggccagactggtggtgaactcctggcctcaagtgatccacccacctcagcctcccacagtgctgggatcacaggcgtgagccactcctggcctctttttattttttaattaaaaaatttaaaaaaaaacttttagagacagggtctcactctgttgcccaggctgaagtgcagtattgtgatcatagctcactgtagcctcaaactcctatcaagtgatccttctaccttggcctcccgagtagctgggactacgggctcgtaccaccaggcctgactaattttttaaaaatttactgagctgggggagccggggccaggcacggtggctcatgcctgtaatcccagcactttgggaggccaaggtgggcagatcacgaggtcaggagattgagaccatcctggctaacacggtgaaaccccgtctccactaaaaatactaaaaattagccgggcttggtggcgggcgcctgtagtcccagctactcgggaggctgaggcaggagaatggcgtgaacccaggagatggagcttgcagtgagccaagatcgtgccatggcactccagcctgggcgacagagccagactccgtctccaaaaaaaaaaatttactgagccaggcgcaatggctcatgcctgtaatccagaactttgggaggccaaggtgggtgatcacaaggtcaggagttcaagaccagcctggccaagatggtgaaaccccgtctctactaaaaatacaaaaattagccaggggcggtggccagcgcctgtaatcccagctacttgggaggctgaggcaggagaatcacttgaacctggggggcagaggctgcagtgagaacgtgccactgcactccagcctgggcaacagagcgagactcccatctcaaaaaagaaaattttttttctgtagagacaggatcttgctctgttgcccaggctggtctagaactcctggactcaagcaatgctcttacctctgcctcccaaagtgctgggattacaggtgtgagccactgtgactggtcagatctttacggatttctatatatgatctttagtttatatttattccattaatttcaactgttaagagccatcatggagggcaaacactaatttctgtaaacctatgacgaaaattacttagatgaggtgcaaactaccttctgatgcttattaccactgggacagccttgctggaagttgagcttccctcaaaaggaccactaggtcaccttccagttaactttctaagttctctcccagccccatcactttcttatcttttgaaggtgatgaggtctaagtacgctctgtaaggggtggaccctgttgactttgctcactcctggatcctcagtgtgtggcacacagtaagcactcagatatttgacaataagcagctgatgtgccagagcacaaactgaatgggggctgtcttggcattctaacaattagaacagcaataaaaatcaccaaaaataatgagcattatttagtgcattatctggacgggaaggatttgtaaagtagctaatgtatacaagaaattgttgcatgaatgctgagtaattactaagataacatcagaaaaactaaaaaatagctgggcacagtggctcatgcctgtaatcccagcactttgggaggctgaggcgggcggatcacgaggtcaggagatcgagaccatactggtgaacacggtgaaaccccgtctctactaaaaacataaaaaattagccaggcatggtggcgggcgcctgtagtcccagctattcgggaggctgaggcaggagaatggcgtgaacctgggaggcagagcttgcagtgagctgagatcgtgccactgcactccagcctgggcgacagagcgagactccatctcaaaaacaaacaaacaaaaaaacaaacaacaacaaaaaaaactaaaaaatatcagagtgcaattttaagtagatgtgaaaacgatatttccctatacattatttgaaaacactgatcatacagatgtgtttactcactgggctttttttttgaagtagggtcttgctctgtcacccagcctggagtacagaggcacagttgtggctcactgcagccttgaactcttgggctcaagcgatcctcctgcctcagcctcctgagtagctaggactgcaggtgcataccatgatacctggctaatttattattattgttatttgtagagatggggtctcactatgttgctcaggctggtttcaaactcttggcctgaagtgatcctcctgtcttggcctcccaaagtgttgggagtacggcatgagccatcacacctggccactgggctttattttaaggctagagcctcgccttgccagcaatgaaagaagtgcacagtaagccagctgtatggcatcatagatacctaccaattacttaaaatgataaaatcaatgaaaggatggctcctaggaaacaagtaccccactggctgcacccaaagcatttccaccattttgtttttggtttgttttttttttgagatggagtttcgctcctgttgcctaggctggagtgcaatggcgtgatctcggctcaccacaacctccgcatcctgggttcaagtgattctcctgcctcagcctcctgagtagctgggattataggcatgtgccaccttgcccagctaattttgtatttttagtagacagggtttctccacgttggtcaggctggtctcgaactcccgacctcaggtgatccggccgcctcggcctcccaaagtgctgggattacaggtgtgagccaccgcacccagcctcatttccaccatttctatcttttggaagaacagactaatatcaagggtcatgatgtgcagaacatctgttgacagaccaaatgctctattctttccatttggagaacatatctcaaggaaataaattggaaagggaaaaaacccagtaatttgtacaaagatttactgtagaatgtgatgaagaattgggaaaagccaaatgcctaataaaactatgtcagtcaatacacggaactgtttacacataataataagtgggataaacagaacatggtattagttacatagaaatactgaataaaaacagcaaaagtatattaatgaatattaaacaaaatttaaaaatttaaggtaataaaaaaagctgaatttagagttcattcaattctttccttttgcaaaggtaattgtttctaattttaaaagccaagaaagagccgggcacagtggctcatgcctgtaatcccagaactttgggaggccaaggtgggcagatggcttgagcccgggagttagagaccagcatgggacaacatggcaaaacctcatctgtacaaaaatatacagaaattaaccaggtgtggtgccatgcatgcctgcctgtagttccagctacttgggaggctgaggtaggaggatcgcttgagcctgggaaataaaggctgcagtaagctgtgattgcaccactgcacttcagcctgggtgacagagcaagactctgtctcaaaaaaaaagccaaggaagttgcagaatatagaagtagatataagtcttcccttcctaatgtaccaaacactcaaaagccaacattttcaaaatttcactgaacaaaaaaagtaattttgttcttacctgtttgcagtccaagtttggttgaagatagaggtgtcactgaaggaattgcagaggattagggaatggactctaggagatttgtgagtgtattcagcaaatttctgggccaaaaagcctcccaaagaagcgccaaaaagatgaacctaattataaacaaatataaggcagattctgaaatactgatcaatcttgaacctgagtattaaaaagttgcttcaattatcactaaccacagaatatgttatcactagccaatagactaaaatatttacagcagctagaaatttagaaaatattgtatttaaatgcaatttatacagtccatcaagataatacaacttggcatccaagttatataattaaaaaaaatatcattcacagattgcattagaaaacaaaaccagtccaggcacggtggctcacacctgtaatcccagcactttgggaggccgaggcaggcagatcacgaggtcaggagttcgagaccagcctagccagcatggtgaaaccgtctctactaaaaatacaaaaaaactagccaggcatggtggtgcgtgcctgtagtcccagctactcgggaggctgaggcagcagaatcgcttgaacctggcaggcggaggttgcagtgagccaagatcgcaccactgcactccagcctgggcaacagagcgagactccgtcttaaaaaaaaaaaaaaaaagaaaagaaaaaaagaaaccaacaaaaccaagctagggaaatatggaaaaggcctgtatactaaaaatacaaaaattagccaggcatggtggtacgtgcctagagtcctagctacttgggaggttgaggtgggaggatcgcttgagcccaaaaggttgaggctgcagtgagccatgattgcaccaccgcactccagcctgggcaacaaagtgaaagcctgtctcaaaaaaaaaaaaaaagaaaaaactcaaaaccacttagtggtttatgtctaagaaaactgtgattcagtaattccacccctaaacacatacctaagagaactgaaaacatatgtcaacacaaaaacttgtacatgaatgttcatggcagcattattcatgatatccaaagggtaaaaacaacccaaatgtgcatcagctgatgaatcgttaaacaagatatggcatatttataaaaatatgatttaactgtaaagagaaacgaagtattgattccggcttcaacatgaatgaaccttaaactcacaatgctaaataaaaaaagccagtcaaaaagaccacatatgatacgattccacttatgtaaaatatctagaataggcaaatccatagagataaaaataaattaggttgcagggctagtaggggggaagatgaggaccgactgctaatgaatatgaggtttttggcattaaaaaaattataaaacattgactgcagtgatggttgcacatacctgggagtatactgaaaaacatggaactgtatacttaaaagggtaaattatatggtatatgaattatgttgcaataaagctattattaaaaaataaaagagggctcggcacggtggctcacgcctgtaatcccagcacttagggaggctgaggcgggcggatcacttgaggtcaggagtttgagagcagcctggccaacctggcgaaaccccatctttactaaaaatacaaaaactagccgggcatggtggcacacgcctgtaatcccagctattttggagactgaggcaggagaatcacttgaatccgggaggtggaggttgcggtgagccgagatcgcgccactgcactccagcctgggtgacagagtgagacttcatctcaaaaaataaaaaaaaaattgtatgtatgtaattagtttcagggtactcactttatccaattgtaaatggtctaaaagttttctgaatccatcacagaactcgagatggtcccaataaactggatactgcaactgaaataataacgataattttatttttaaaaatcataaaagtaaaaatgcaactcacgtatttgaaaaacttaggactcaaacactgacatttctcgtttgctcaagcgctgctccttattcaaaatatgtaaaaataagctctcactttttactaaacttcatatttcacatttttctaacagaccaaattaaaagagtataaaaagtaagcacactctaatgatattacgtgagtaacaatttcaattcccatcaatttcctttctaaatagctgaaaaagtctggggttcaaggatgaatacagcagaacccattccagtaaagaaataccgttttctcttaaatctaatttcattcagaattatggctcaggagagatggaaacaaaatttgttctaaggagagcttcctctctttttggtagcatttctttaagagggtattcagtaaaattgttcctcttcttttaaatgacttagttactctatttcatttattgtactttggggtgtctgtttgtttcttgagacagagtctcctctgttgcccaggctggagtgcagcggcgcgatctcgactcatgccacctccgcctcccgggtttgaacgattctcctacctcagcctcctgagtagctgagattacagatgtccaccaccacacccagctgatttttgtatttttagtacagacacagttttgccatgttggccaggctagtctcgaactcctgacctcaagtgatctaactgccttggcctcccaaagtgttggaattttaggcgtgagtcactccacccagcttgtttgtttttgtgatagggtctcactctctctcacccaggctggagtgcattggcacgattgtagctcactgcagccacaacctcttgggtgcaagcgattctcccacctcagccccccggtagctggaatcacaggcatgcaccaccatgcctggctaatttttatatgtatacttttttgtagaaatggggttttgccacgttgcccaggctggtcttgaactcctgggctcaagcgatttgcctgcctcaagcaatataactgccttaacttcccaaagtgctgggattacgggtgtgagccaccatgccaggctactgtacttctgtttgtgacaaaagaagtatggtacttgactatacgtagcctatctattaatgctggcaatgatgaggaaaaagaagtacaagtcacaaactcatttctaagggactcaggtttgtcccctaagaattccttttttttgtttgtttgaactggggtctcgctctgtcgcccaggctggagtgcagtggcgcgatctcggctcactgcaacctccacctcccaggttcaagcgattctcctgcctcagtctcctgagtagctgggactacaggcatgtgccaccacacccgactaattttttgttgttgttgtatttttagtagagacggggtttcaccatgttagccaggatggtctcgatctcctgatcttgtgatccgcctgcctcggcctcccaaagtgctgggattacaggcgtgagccaccgcgcctggccaagaattccttttttatatacatataaaaccaactggctgggcgtggtggctcacgcttgcaatcccagcgctttgggaggccgaggcgggtgaatcacttgaggtcaggagttcgagaccagcctggacaacatggtgaaaccccatctctactaaaaaatacaaaaattagccaggcatggtgacaggcacctgtaatcccagctactggggaagctgaggcatgagaattgcttgagcctgagaggtggaggttgcatgagccgagatcatactactgcactctagcctgagtgacagagtgagactccatctccaaaaaacaaaaacaaaaacaaaaaaactcccccaaaaacctcgtctaacaggcttactgtttaagcacttaggttcattttgttattgatgaatcactggaatggatactgccatatgaattatggaatcattttagatttgatgtatgactttcattattaaaattctatttgtggataagacttccaccattccaagaaagaatggggaactgattctacctagcagaaagtttgagaatttgagtcagatgatagcctaaaagaaaggggatgatactttcatggagtctttaatttataaatatccatgcccacacaggtgacaaaattatatgcaacttaatacatacaaacaaatgagttcaagcagaactggggaagcctgaatgagattggtagattgtagtaatatcaatatcctggttgtgattttgtactacagttttgcaaaggttcggcagaaactggggaaatgtgtaaaaggtatatttctctttactattttttacactgcatgtgaatctacaattacaacaacaaaaaaatttaaattaaaaagatctgtgcattttaactgctagatactaacaaatattaaataagttccaaaacctcatggagctgaacattctgatcacatcttgatgacaaaataattttgaagacactgttgaccttttcttgattaactctcctcctaatgaaacagggaaagcgcacaacaagaaccttgagagtgaagaagaaacatccagccagaagccaaggctctcatgacctgccactgtggagcgagaaacacactgctggacagcactcccgagtgggacgggcgcctatgggttgctcggtttccccctccctggctgatcaacaggggccaccaaaaatggtagtgtcatgtctcaggctgcagagggctgggatgagggcagttcccaccctgttctagaatgctgtttgtgaagaggaatgactgaaaatctgaacaaaggaggattatgttgcagaggctcaaacatgtcacgtgaggaatggttaaagaagctggagaaattaagccagagaagaaaagacccaggagaaaagcagcaggtagtgatgataactgttttctcaagtaagagacgggctctcaggaggaagaggaactgatttcctttgtgtggcctcagttggtggtaacctcagtagaattttcagttaccttccaaaaggagagacgtgacctgccttttcatccctttaaacagtaaataaaacgtacactaacagcagtactcccactgggagtaccacttacaagtgaatactgcaggcgactgccagctaaagagactctctccttcctggaaaattaggagaccaatgtcctgaccaatgtggaagcatgcaaaaaaaaaaaaaaaaaaaaaaatcagtcaccaggaagagtgcctttcccacacacctttctcccagagaagactcaagaatgatcagtgggaaactggatttagaccaaactcagctataaagtaacaatcaggaacaaaaaaacttcctaaccaaatgctaacatatgagctaattaatgaatctcacctcaaatatcaaagatttacatgaaaagccagcttttcaagtcacttgtatgttagcaaatccctttgttgtctaatattccatgctcagcaaccctggaagcagtgctgtgataaaatgaggagcagaaacagagccaggagacggagctcagttcctccctccaccactactggctgtgtgagccggacctcagtttcttcatctgtaaagaaggacaacgcttcctaccgctctgagttgagagaagggcgtcaggagagaatgcacgtaaatgctgggcatggagaggctgccaaaagaggtttgttccctctgaatctctgtgtgaccgtggactcacaccagcctccttcaaaaggcttcatctcacatattaaaataagcaaacagtatctttcctcaattaaaaaaactgcctggctgggcgcagtggctcgtggctgtaatctcagcactttgcgaggctgaggtggatgaatcatgaggtcaggagttcgagaccagcctggccaacacggcgaaaccccgtctctactaaaaatacaaaaaattagctgggcgtagtggcgggcgcctgtaatcccagctactcgggaggctgaggcaggagaatcgcttgaacccgggagacggaggttgcagtgagcagagatcacgccactgcactccagcccgggcgacagagtgagaatccatctcaacaaacaaacaaacaaacaaacaaacaaacaaactgtgcccattactatagctgatgagagacagaagcataaaaaaaaaaaaacacacaaaacgtgggtctgaattttaatcagtaatacttacagcgataacccggtaaccccatccagtcagagccaaaatctgccggaaaaagacatctgcagttccactgacagggggcaggaatatgagaggacacctgatacttcgggggcccgcgtcatagagcgaccatatcttactgtcatcatcatccacaataatctggagggaaggttaaaagaaaaaagtggaaaaccttataaatttgctttttatgttattttacactgtcatttcactgacaattttactactactgccttgtttgttacaaggtaacctggagctcacaccagattagcatgcatgacaaactcctctgatctccttttctttcctcagggctaacgtattccacagaactacttagaactactttataatcttccaaagggctgctgcttctctgtttcttccccctcctccttttttttttttttttttgagacagagtctcgctctgtagcccaggctggagtgcagtggcacgatcttggctcactacaacctctgcctcccaggttcaagcgattctcctgcctcagcctcccaagtagctgggattataggcacacaccctcatgcccagctaattttttgtatttttagtagagacggggtttcaccatattggtcaggctggtctcgaactcctgagctcatgatccacccgccttggcctcccaaagtgctgggattacaggcgtgagccactgcgcccggcctggatcctgtctctttaaaatacataaataaataaataaaaatacaacaacactccagcctgagcaacagagggagagatcctgtctcttaaaaaaaaaaaaggcaagctgaggtaagacaagtgctcagcagagtctggcagatgttaagtgtcctagaaatattagctattattattattcacggcatcctagtttaatttttgctttcacttttggtggtatttagaaaagtacattaactgcttaaacatttgacaatgcaaatcagtatttattctactttcatattaaaaaactcaaggcctccaggctcttttttctgagagctcctcactagcagggctatggactccacagtgtcactctgtgggtggcagcacactaaccagggtcactggcatcactaggagcagataaatggagcaaggcaaagtccagagaggcctaacagttccctttggacttccacaggtcacagatggtgataatgtatctcacgctcatgtttttgtcctgtgtatcttgccactcacattttttcttttcttttcttttttttttttttttttttgagacaaggtctggctctgtcacccaggctggagtgcagtggcacgatcacagcttactgcaagcttgtcttcctgggcttaagcaatcctcccatctcagcctcctgagtgtccgggactacaggcgtgcaccaacacgcccagttaattttttctagtttttgtagagaaagggtctcatcatattgcccaggctgatctcaaattcctaggctcaagcaatcttcctgcctcggccttccaaagtgctgggattacaggtgcacagcaccatgcctggctaattttttcatttttttatagagacagagtttcgctatgttgcccaggctggtctcaaactcctggcctcaaatgatcctcctaggtctctaaagtgctaggattacaggcatgagccatcacaaacagctgcaaaagatcttaagatcactggattctaacactcctgcaagggaatcagcaaaggttttactctactcagtgacttgaactgcctttgtctagtgtgatccccaaacatctgggattaatttgggaagcagagtcaatactcaactgcaatataagtgttttgggttttcaaacatcccaggaaaataaagcttctagaagatgactgtggcagaatgagtatgtcattgcaaacagaagctctataatgtgaccccattcttaaatctgaggaacaggaatataatctgactgtactcactatacagttgctgtaaactttccactaaactatacagaagagtacatacatacctgcttgcttgtatatgtaaaagcaattataaaaaatgagtacaggctgggtgcggtggctcacgcctgtaatcccagcactttgggaggccaaggtgggcggatcacttgtggtcaggagttcgagaccagcctggccaacatggtgaaactctgcctctactaaaaatacaaaaattagctgagtgtggtagcgcatgcctgtaatcctagctacttggcaggttgaggcaggagaatctcttgaacctgggaagcagaggttgcagtgagccgagatcatgcagtgcactgcactccagcctggacggcagagcgagactccatctcaaaaataaatataaataaataaataaataaaaatgagtacagttacacttgctttcactctaaaatgagtctcaaaagttgactgtacatgacagggaaggagtgaacttaatcctctgcaacccacagtcatgatactcggcagtaacctttactctcaaacactactaagacatgacatctaaatcacacacaaaaacaatacaagattttgcaaataagaggtatagtaaaaccatacatacctttttaaggggaactgtacctctaaaccagttataatcaggagagactttaatctctcccatgattagctgaaatggaggttaatcctgaaataaaagcatgtgatatttcacgtcaagaattcatgtttacatcagaactaaatgtagagtctcatctagctataccaacaatattttaaagaagaaagccaaggaaactggctattttgtcagtatatagtccaactacagaaaacaatttggtgaaatactacaatcacagaatcagaagcactcttttttttttttttttgagacagtctcagtcttgttgcccaggctggagtgcagtggcgtgatctcagctcactgcatcctctacctcctgcagttcaagtgattctcctgcctcagcctcccgagtatctgggattacaggtgcccgccaccacgcccaactaatttttgtatttttagtagggatgggggttcaccatgttggccaggctggtctcgaactcctgacctcaggtgatccacccacctcagcctcctaaagtgttgggattacaggcgtgagccaccatgcccggccaccagaagagctcttacagaaattattccaacacccttagttcttccagaaaaggaatctggtctagaaaatttaaatgacttacccaagatcacatggcaatgctaggaccagatgtgagacagccttttctgacaccatacttcctgtcttagttctcaactgcagtaccatcagttatcttttgacattaccttaagaatccctttaataaagatgctcctgtctgattatagggatagtccacgctagagaaaggagttgatgtttttttacttttttaatttttgagacagtcttgctctgttgtccaggctgcagttcaatggcacaatcacagctcaccacagccttaacctctgaggctcaagtgattatcccaacctcagcctcctaagtagctgagacaatgggcacacaccaccacgtcaggtgaattttttggttttgtagagatgggggcctccctgtgttgcctgcactggtctcgaattcctaggctcaagcaatcctcccatcttgcctcccaaagtgctgggattacgggtatgagctaccacacccagcctagagaaagaagtttaagttaagcctgcttcctgataaattcgcaatacaccataaatctaactgtaatagcacataaccagaaattcacatgtagttccctttttttttttttttgagacagagtctcactctgtcacccaggctggagtgcagtggcgtgatctcagctcactgcaacctccaccctccaagttcaagcgattctcctgcctcagcctcctgagtagctgggattacaggcacctgccactgcgcccggctaattttttgtatttttagtagagacggggtttcaccatcttggccaggctggccttgagctcctgacctcatgatccacccgcctcagcctcccaaagtgctgggattacaggcatgagccaccgtgccccgcctacatgtagttcttaatacaaaatacaggcaaatttgccactcatatggacgtgattaaaagttacacaatgtcctcagaaagatctataatgtaaacttgaaggcactataactaacaacaaaatgaaacatttgcccttaggaaaaaatgtgtagtcttttgttgtgagcttagtgacttctggttttcatagctctgtgatcttagataagtcttgatccttttggagtttgtttcctcatctatgactgtgttaccactgtgtccccaaagcttagatcagtgcttggcacacagcaggcattatctgttgattgaacgaataactacattctaaggagaatgaagggggccatccttctaaccctggcatctgtgagctttggcctagctgaacatcctcaactaaaaggctgcccctctttgctcaggcatctgtgctatgtcataacaggaaactgaaattatagttccctgttgcagattcttattgccaagtgaggaaattccaccaggaaggattcaaatatttgctttgtaccacttcctctacctcaagagcaagccttgatcctagcacggctaacacgaggtgagattcgtgagacctaactcccgggctgactctgaactgtcgttttagagggagttctctggactggcaaggaacaggggattctaaactcaatggaactcttccttggtggccctcgagatctgctccctcaggaacacagagccctcagtagactcaactgtgaccttggagacgtactaagctgaaccccgaggagacagcagatgtagacattctaacactaaacttgatttacaaccttgacattgtgataatggtctctcttctcaaagctaagatggtaattttagagaagtgtgttaaaatcataagttgctttaaagtaccaagaaaatcatcagccagtcttatactgaaaattagtgtgcacagatatatatagtgaaataaagaaaattctttgcatatccattttatcttaaatattaatatgttaaggccaggcacagtggctcacgcctgtaatcccagcattttgggaggctgaggcaggtggatcacgaggtcaggagttcaagaccagcctagccaaggtagtgaaaccctgtctctactaaaaatacaaaaattagcctggcgtggtggcgcacgcccgtagtcccagctactcaggagggtgaggcaggagaatcacttgaacccgggaggcagaggttgcggtgagccaagattgtgccactgcactccagcctgggcgacagagtgagactcaatctcaaaaaaacaaacaaaaaaattaatatgttaaaaaattttgccaggcgcggcggctcacacctgtaatcccagcagtttgggaggctgaggcaggtggatcacctgaggtgaggagttcaagaccagcctgaccaacatggcgaaaccccatctctactaaaaatacaaaaaaaattagccaggcatggcagtggccgcctgtaatcccaaatactcgggaggcgaggcaggagaatcgcttgaacccaggaggcggaggttgcagtgagccaagactgcactccagcctgggtgacagagtgagagtctgtctcaaaaacaaaacaaaacaaaacaaaacaaaacaaaaaacaaaaaaacaaaaaacaaaaaaaaactaagccattttaactataggctttctctaagctgattataacttttaattgaaagcaactagcacatatacttaattctggaatattttctacctggacagacttgaaatacttctatatcatctaaatacttcttaatggagacatttcctagtattgcattattagaaacaatctattctaaaggagggaaaataaaaacatgtttagcaaataacatctactcaatagatttataaaacaccttagctaactaaagccagaaagtgtgcttctagagtcaccaaatgggataaatcattcatagctttgaaatcagttgcaatgcacaaaccaaaccaccatacaaatacacacatacacaggcacacatattcacgcggtcatcctcttctttcccatagcagtaaatagaaagatgttccttaccaacagtcttcagaataattcacaaccacctcaggatgccaacgtgttaaaagtaatcttacaagatggagagattccactccgctgtgactaaatttttgtagagacaagtaattttaacacttgtgctagtttggcagtacatgaaaggtaaaatggataccaaatgttgcatctgaccaactgacgtctaagtgaaaaaaagatcactgctgcaaagggaaaacagctgtgagtggtatgaataggaaagtttgttctcctagctctctttcatccaccaaaggggtatacttttccaaatcataagaggaatattctgtatatggcaaaggttaactgagattgtgaccaaactggtcagtactgaataagaaagaatgtggaccatgagctcaaaactgattttatctctcatgattttgttcttcacaaaaacaaaagcacctgttcatgctggtgggaaaagagccacaatattagccttaatcttgcctaaggaaagccctcttcagggtgtgctgtggactccctgtcttctctggcccttgtgctgctggacaataaaaactgccagttgtggctgggtgcagtggctcacgcctataatcccagcactttgggaggctgaggcaggtggatcacctgaggtcaggagttcgagaccagcctggccaacatggtgcagccccgtctctactaaaaatacaaaattagctaggcgtggtggcacatgcctgtaatcccagctacgcaggaagctgaggcagaagaatcacttgaacccgggaggcagaggttgcggtgagccgagatcacgccattgcactccagcctgggcaacgagagcgaaactccatctcaaaaaaacaaacaaaacagcaacaacaacaaaaacaaattagctgggcgcggtgatgggctcctgtaatcccagctacttaggaggctgaggcaggagaattgcttgaacctgggtggcggaggttgcagtgagctgagatcacaccactgcactccagcctgggcgacagagtgagactctgtctcaaaaaacaaacaaacaaacaaacaaaaaaacctgccagttgtgactatgcccctatccctcatggcttcaacagaacctgccactttaaagtcaacaaaatcacctttatcaatgtttaagtcacataaccagcataattagtcagaggtttctgctactttatttcaatctatagttgatgtgcattgtggaaaatctgtgcttataaatactagccataacaaaatattagaagctgagagtctctgggagatgcaactggctttttaatgcacgtctccatccctcaccacagaagtacacagctatccttttcttagatctcttcaggggagatctatccctcttttcttcattgcattatctctaaaccttacaggaggaaaaggtgcctacctgacatctgtgacatctcttctcatgctcttgggaaaaaagcttttggaatttggacacagctattaagttactcctcagtggccagccgcgatggctcacgcctgtaatctcagccctttgggaggccgaggcgggcggatcacgaggtcaggagatcgaggccatcctggctaacacggtgaaaccccgtctctactaaaaatacaaaaaattagccgggcgtggtggcgggagcctgtagtgccagctactcgggaggctgaggcaggagaatggcgtaaacccagcagacagagcttgcagtgagctgggatggcgccactgcactccagcctgggcgacggagcgagactccgtctcaaaaaaaaaaaaaaaaaaaaagttactccttaatttgttgaatctttgtgccaaaaggagctgaaccagtgtaggtggagacaaaggaagcagcataaatgtctaacttataactccccaggaaaacgagaagaggaaaaatgagacactccggtcccgctctgttcctcatcccccgtttacaaaccttacacctggcccacactcagtaacaacaaagacatctatcactttcaggccgaggtcctgtctccaaaattactggcctctgctcacagttcttaaaagtttgctgagaaaaaaaaaaagaaagaaagaaagaaagaaatgttcctgggctgcagtcgtgtagccccaggatgggtttacaggaggatgccccggttaagccctgtgccgcccccacctcccgctggagactcacacacagctccccgccagtcccaccggtgacagccacacaaaggcagggtcacaagcacaccgaccaccccacagcccagattcggccccagacacacactcacaagggcacgtgatcacgtgcgtggtcacatggaccggcccactcagaacacactcacaaagtcacaccaaccaaggcagccacgcgccacacacacacacctacaaccccgcataccgcacacccagccgcttcccagggcttcgcccaccctcacctgccgtggccgcccccacgtcccttcccctccttcaggaggccgctcttcgctccagtacgagcgcgggccgtggaggcggctgggcccgggtcggggcgggcggcggagcactcgggacccacgggcacagcaggctgcgcggtgcgtgcgggaggccggcctctgagggggcggggcgcgtggccgagcgagcttgggccgccgcgctccccccgcccgaccgccgctcagctggcgcgagactcc

SEQ ID NO: 769 - DNA, 26889 bp, Homo sapiens; identical to SEQ ID NO: 768

SEQ ID NO: 770 - DNA, 28128 bp, Homo sapiens
tgctcaataacctttattgcacaagtaagttgaaaaatgttagcacgttcctacttcaagaaaacctgggccgggtgcagtggttcatgcttgtaatcccagcactttgagaggccaaggcaggaggattgcttgggcccaggagttcaagaccagcctaagcaacatagtgagacccctatctctacaaaattttttttaaaaactaagaaagaaaattagccaggcgtggtggccccactttgggaggctgaggctggaggatcacttaagcccaggaggttgaagatgcagtaagcagtgtttcacgccactggactccagactgtgtgagagagcaagaccccatctctaaaaaaattaataaaaaaaaataaaatctggatgtaaaatgttaatttatagtacagatcaatgtggcagagattattaaatattacctacgtttactacttggttaaatctagctggtagtgaaatgtaaagagctggatttactacttataggaaataaaaaatgcagattcaatactcctaaaatgtcagtggtgacacgatttttaaaaaattaaatagatgcactgtttttaaaaaaacctcttctcggccaggcacggtggctcacagctgtaatcccagcactttgggaggccaaggcgggtggatcacgaggtcaggagatcaagaccatcctggctaacacagtgaaaccccatctctactaaaaatacaaaaaaaaaaattagccaggcatggtggcggacgcctgtagtcccagctacttgggaggctgaggcaggagaatggtgtgaacccgggaggtggagcttgcagtgagctgacatcacgccactgcactccagcctgggccacagaacaagactccgtctcaaaaaaataaaaataaaaacaaaaaacctcttctcagtatgtatgtaggtacatacatacaccagttagggttgcccttgttcttaaggaaagataatctccttgagtttcgtatcataaatacaagttttatttaaacttttttgtaattcaagtaaaaaaaaagctgttttttaactactgttacataaaaagtggaaagtgaggcaatccatcttttcggcaataatcttctcttcttataataatgccatcttctttgaaagtccagataattccaggccaggcacggtggctcacgtctgtaatcatagcactttgggaggctgaggtgggcagatcacaaggtcaggagttcgagaccagcctgaccaacatggtgaaaccccatctctactaaaaatacaaaaattagctgcgtgtggtggcgtgtgcctgtaatcccagctactcaggaggctgaggcaggagaattgcttgaacctgggaggcggaggttgcagtgagctgagatagtgccactggattccagcctgggtgacagagtgagactctgtctcaaaaaaaaaaaaaaaaaaaaaagtccagataattccttgtaaataaggtttttaataaattacaaatatgtaataggtttttatccatcttcttcctaactactcaatgcattgttgcatagcaacagtttttttctgcttcttctttgttggaagtctgagagtctgaaatctgcattggcttggttgagcttgggaatttttctggtaccaggggtgcaaatatccattgtagaagtcagtagctgttagtgatttcttgagcatcactgatcgaacaccaatccaaccatcctaaagggcaaaatacaaatagtgaataggcaggggtggcaaaactaaaaagccaagtaaatattagtttataaaatttttatcatggaaacaaacaaaccaacaaatctttactaaatgcctagctgcaaacagcactacactaagtaacatgtagaattccttgactctattaggttggtgcaaaagtcattgcggtttttgacactgaaattaaaagcttattaccaaggagcgataacaaatgtatagatctgtataaatatttaaatacaaagggagcagaataaaaggtatgtaacatgaaatacacatataggccaggcgtggtggctcacgcctgtaatcccagcactttgggaggccgaggcgggtggatcacctgaggtcaggaattcgtgaccagcctgaccaacatggcgaaaccccgtccttacaaaaatacaaaaattagccaggcgtggtggcgggtgcctgtaatcccagctacttggaagacggaggcaggagaatcgcttgaacccaggaggtggaggttgcagtgagctgagatcacaccactacactccagcctgggcaactccatctcaaaaaaaaaaaaaaaaaaaaagggaaatacatatatatagacccagaaaaggacagcaagacatatgcatccaacactgttccagaataagctggcgagagacaaagagaggttgatggagttttgtattcacagtctgtaggtcagatcaatctatcacacattttaaacattttctttttttttttgagatggagtttcgctcttattgcccaggctggagtgtgatggcacgatctcggctcaccacaacctccgcttcccgggctcaagcgattctcctgcctaagcctcccaagtagctgggattacaggcgtctgccaccacgctcgactaatttttgtactgttagtaaagacggggtttctctatgttggtcagtctggtctcgaattcccgacctcaggtgatccacccgcctcagcctcccaaagtgctgggataacatgtgtgagccaccttgcccggctaaacactcttaagtatgaaatatctcacatgaacaccatatgatgcaaaatacctaggaaatggaaggaatgtagaacacttctcagaacacaccatgatcttataaaacaataatgattccaaagttattttaaaaagttcagaaatctcctctttactactgttaagcagtaaaagcaagtaggatatgtgtgtcctgtagtagttcagtcagatattttgatatgactatcttttatgttaccaagcacaagagctgttaattaaattgggctactgaaaatacacgtgttcttttaagaaagcactcaagttactgaatcttctttctttgagtaataataatgccttggcaaaacttcatcactttcaaaaaattatgctagagacttcactatttcttaagaaaattaaatgatctcctgacccaatctatggacaggcagttaagtgaagttccaactaaaaataataaatgatacagactataacatagtaaaacaactatgataacttgaaactaatgaaaaacataccttgcaataaaccaatagtatttgtgactgtttgtggtatattactgatcctggaataagagcctgtcccgttaattttggatctgaagaatggaaaaaagaaaagatatacaagagaaaaaagcaattatgcaacttcatagtacttcttaaaaatcaaaaaacatcttgggaggcagtactgataccggagagaacacatttgctgatgttgactttgtaaaccaaaacttacaaggaaaccacagtgctctctgtacatcagaaacccaaaggaaagcttcccatgcacatacaaagctataattcctttacccagtgaccacctaaaatgctgaatctacaagttttgtgttagcgctttggtgaaataactagccaacagggggaaatacataggatgtttaggatttaggctggccctttcatccctgcccaaacaaatcctaattcctaggttcctggggaactccaactacctctaaattaaaccagcttcctctgtggctcacattccttctgtccaccgtattggcaggatgctgatgggcctcagaatggacttgtggcatgaagtatgaatacactctggcctagattttcactgatttgcccagatattttcattataatattcaccagaatgaaactaatcgagtcattctgcactctctgaaaaccttaaggcaggaaatcacagagcttaaaatgggataggaacactgctttgcctactccccagggtcctgtaatgatttttttttttttttttttgaaatggagtttcactcattgcccaggctggagtgcagcggcgcaatcttggctcactgaaacctctgcctcccaggttcaagtgactctcctgcctcagcctcccaagtagctgggattacaggcatgtgccaccatgcccagctaaatttttgtatttagtagagacggggcttcaccatgtcagtcaggctagtctcgaactcctgacctcagctgatccacccaccttggcctcccaaagtgctggaattacaggcgtgagccaccgcgcctggcctgttcttgtaatgattaaatgagaaaatatatgagaatgagtgttgcaaagaataagacaataagtgaatgtaaagtattataattactgaactgaaacaaactaaaagttatttttagtaattgtgacatatgataaaacagacgtatttccagatacactacagtgaaaacagcttccatgttagctattcaaaagttagtaccagcaaggactgaactgttaacttctaccaaatccagaagtttaatggtattcgccatccagagcgtctgcaacggaatctgcaagtaaaattaaagaaggtatgataaaggaatacactcaactcccaaacccttttcaactactattttgtgttaatctggacttttctttcaattagaggaattgggaactcagtcactaagtttgatggaacagaccgtaaacatgactctctacatcagtgtttccaggatttataagatctttttttttttttttttgagacggagtctcgttgtgtcaccaggctggagtgcagtggcgcgatcttggctcactgcaagctccgcctcccgggttcacgccattctcctgcttcagcctcccgagtagctgggactacaggcgcctgcaaccatgcccggctaattttttgtattttaagtagagacggggtttcaccatgttagccacgatggtctctatctcctgacctcatgatccgcccgccttagcctcccaaagtgctgggattacaggcgtgagccaccgcgcccggccgatttataagatcttaaatgttactttaaaatcaatgtttatatctaatatactaatatttccaattaaaaatttattatccttataaaaaatgcaagcattacattatgttaaaaaattttagaaagtgatattctgtatttattcccatccctataggtaacgactgttaagtttgatgtgcatttccctgtatttttttctacaaatattattataaaaatctagaacacagtgatagagacaggagacagccaaatgccacccaggtcattatgcacagtgggcttgactcaacatgtccatggtgaaaagttctgtcccttaacacatgcacagtaaaggaaataaatcaaggtggcgtggctcagactaagggcccgcatgagcactggaagaatgggggtggagccaccaggaatttctgccttatgcaggggaagagcctggcctcttcagctcctgtgtggtggcctggtattcaatctgtgaggtgggagcctgttggcaggaccccctctttttttgctgagagctttcttttaataaattccactctcctcacctttcaatgtgtccacgtgcctaatttttcctggttgtgagacaagaacccagattttagctgagttaaggagcaaaaagtcctgcatcaatactgttttacaaggacttttgttatgtgaccataaagcattgatgtttcatcagtacatacttatcaatttcactctatctgctgcacagtaacccattttatgaatatgtaatttatgcaactacctttatgatagatatttgttattttcaatttattgctatttataacactataaactagggtaataaccttgtcgatatatctttgagggcttacacatttctggataatagttttggggttttttgtttttaaagtggaatgcgtgggttaaacagcatcaacattttattgctaaactgcctggataagtgagaaaaaaatatgataatctcttgctgtttattattagcgaagctgagaagctgtccatatatttatgtgcacttttaatttatttatctgtaacctgcctatttatgccctttggttatattttttaaaactgggatggttatctcattaatttgcaaaaatattttctatatttaggaaattagccttttaactcttacatgtgttgtgaatattttcctcagtttgttgacttttaatcttggggacagccattttttccatgcataagttttttattttcataattatatttctaagtcttttctctcattactttggtggttcgtatcatacttaaaaaggcctaccccacactttaagattattaaatattgtcaaattattcagttgtgcttttttatagtccttgtgattttactttttatatttaaatccttgatccatctatattttgatttttttattatggtaaaaaacacataagaaaaatgtgctcaattaacaaattgtaagtataccatacagtattgttaactacatatgcattgttataatatagcacttactatgattttaaaagataggatttgagggcttcccccaccaatggttggccagttatcccaatactatttactagataatccatcttacccttccctccagtatgaaataccacctttatcatgtaacacatttccaacatacctgagatcctacagcctgatttaaatgttaataaaatttaacacacaccaggaaataagttctctaaaatttctgaattgaatgcatttatttccagactgtagttcaatcctctatttcatacatgaagagagtgaggctcagagaaatgcagctattttcccaaggttggacccagctagttagtagcaaagccaggactggcttctgttttctgattctcagtgcagtgctctttttatgacaccccttaaagagggtatttaactttcagaagagttaggttgttgtaataatttgaacattaaatcaaataagtaaatgaatttgaagaacaagttcataactgtatctatgtcatagcctcttctataacttgctagctcacttttcttttgcccgcttcaataaaagttctgaaacgattttcatatgtgcaatttttttcttttaaataactcaaaatatttttgaaacatgcttactgactaaaaaagatttctatttactgagagtaataaacatgctaggtacatactcagaatatagtcttgttcttcgggaggtaaagctcaccttatcatcagagcattgtagaaaggaaagggatggtaagaatataatcattttggtgtctgccatcattactgccaaaatagtatgtttgcatgaatttacattcacctagttcatttcctttgatcttgccagttgtgtacatggtcattaatcccactttagaggtaaaaaaagcagaagctcaaagacaagggccttcctctcattagtaaagggcaactctaggaaccaaaccccaccttctggctcagtcttttatagcacaaagcttttctccatgtacagggaagataaaccgcagagggtaagaatcatcatgtagtaagttataggtgccaagagatttcaagctactggcctaaattgcatctcaggaagttgtctacttgatatctccatatgaacgtcttctaacttaatatatgtcaaacttaacatggccaaaactattgatttctcttcccaaatgttcctccccagacatcctcatctcaattaaatggttccactattcacccagtttctcaagccaaaaatctatgaatgatcctaatttatctatctctaatttcccagattccatcagcaaattccgctgactctatctccaagcatagtctggatgtccacttctttttatccaccattatcattgttccaaactgccatcatctgtcatctggctacagtcgcagcagcttctttttatttttttaatttttttttttaaagaccggatcttgctctgtcatccaggctggaagtgcagtggtggaatcacagctcactgcagcctcaacctcccagggtcaagtgatcctcctacctcagcctcccgagtagctgggactacaggtgcatcccacaatacctagctaatttttgtatattttgtagagacagggtttcaccatgttgcccagactggtctggaactccagggctcaagcgattcactcttcttggcctcccaaagtgctggtattacaggtgtgagccaccacacccaaccaattccctaactgacctccactccactctctagcagcagccagggcaaccttttaagaatgtacatacctaatcccattactcccctgccgtggccctctgatgtcaatcctactcaatcttgcttctcccctcaccttagctactctccatcttgccagctatgctccagccacaccagcctcatttctgtccctcaaacatgtccaactcttttccatcttgggttgtttttttgttttgttttgttttttgacagctttattgagatgtaattcacataccagaaaattcacccttttgaagcttccaagtcagtggtttttagtagactcagggtcattcaaccaatgtcactcgtttttttcttgcctaatttttagaacattttcattacctctctctcccagaaaaaacgccatccattatcagaaaattcccattatcctctctcctccagcctatggatttgcctattttggacatttcatataaatggaataataacatatgtagtctgttgtgacagggttttttcacttagcatatttttcaggttcatccatgtcataagcatgtgattatggttatggctgagtattaataatattccaccgtatggctatataccacatttttttaacgcatccctcagttggatatttgggttgttttcactttttggccattctgaataatgctgctatgaagattcgggtacacatttttgtgtgagcacaatgtttccaattctcttgagtataaacctaggaaaggaaatgctgggtcataagatacttctgtgtttcactttttgaggaactgccaaactgttttccacacaggttgcaccatttttaagaggtaaacatggtaccatgaatgtatgaagtttccaaatttctccacatccttgccaacactagtttttgtctgttttttgaattatagccatcctaatgggtgtgaagtggtatctcattgtggttctgatttgcatatccctaaagacagatgaagttgctgatcttttatatgcttactggccattcatattatgtatctgcttgaaacaaatgtctactcagggccagggcagtggctcatgcctgtaatcccagcacttagggaggctgaggcaggtggatcacctgaggataggagttcgagaccagccaggtcaacatggtgaaaccccgtctctactaaaagtacaaaaattagccgggcgtggtggcgcttgcctataatcccagctactagggaggctgaggcaggagaatcgcttgaatccaggaggcagaggttgcaatgagccaaggtcgcaccattgcactccagcctgggcaacaagagcaagactccatctcaaaaacaaacaaaaaagaaatgtttactcagaatttttggccatttttaattgggttatttgtcgttttactgctgagtcattgtaagaattctttactctggatattaggcccttatcagttatatgatttgcaaatattccctcccattctgtaagctgtcttttttttttttttttttttttttttttgagacagggtctcactttgtcacccaggatgaaacacagtagtgcaatcacagctcactgcagcctcgacctccctggctcaagtgcatcctcccattccagcctcccaagtagctaggaccacaggtgtgcaccatgatgcccagctaattttttactttttgtaatgatggggactcactacattgcccagtctggtctcaaattcttgggttcaagcagtcctcctgtctcagcctcccaaagtgctgggattataggcatgagccaccatgcctggcctacctgtcttttttactttgttgatagtgtcctttgaagcacaactatttttaattttgatgaagtccaatttctctatttttagtctgattgcttatgcttcatggcatcatagctaagaaaccactgcctaattcaatgtcatgaatatttacacctatattttcttctaagagttttctagttttagctattcatttagcttctttaacttttacatatgatgtgacatagggtccaaattcattcttttgattgtggacatccagttatcccagctccatttattgagaatactattctttctccattggattgtcttggcactcttgtcaaaaaaaaaaaaaaaaaaaaaaaaaaaaaaggtgggtgggaggggagagggatagcattaggagatatacctcatgtaaatgatgagttaatgggtacagcacaccaacatggcacatgtatacatatgtaacaaacctgcacattgtgcacatgtaccctagaacttaaagtataataataataataataataaaaagaactatcttttgggaactacctttagaaaaaaaaatcaattgaccataaatgtatgggtttatttctagacttttaaaaaaatttgagacagagtctcactctgtcacccaggctggagtgcagtggtgtgatctcaggtcactgcaacctccacctcccaggttcaagtgattctcgtgccttagcctcctgagtagctgggactacaagcgtgcaccaccatatctggctaatttttgtaaatatttttagtagagatgaggtttcaccatgttggccaggctggtctcaaactcctgacctcaagtgatccacctgcctcagcctcccaaagtgctgggactacaggcataagccatcatgcctggcttatttctagacccttaattcgattctaatgagctatagccagtaccacactatcttggttactgtagttttacagcaagttttgaaactgaaaactatgagtcctccaattttgttagttttggctattctgggccccttgcaattctgtatacattttaggagcagcttgtcaatttgtacaaagaagccaattgggattttttttttaggaattgtgttgaatctgtacatcaacttggggagtagagacatcttaacaatactaagtttatccaatcaatgaatactggggtctttccatttacttgggtcttctttactgtttattagctctaatagttttttttggaacttcttcatgattttctatatgctagatcatatcatccacaaatagagacagctttacttcttcctttccaaacttttgtttggttgccttttgtttcttttttcttgtctaactgccccaacagaacaaagttgaatagaagacatttaactttgagagcgcagacatctttatcttctttgtgatcttaagggaaaggctttgtctttcttttattttctttctttcttcttcttttttttttaagagacaaagtctggctatattgtccaggctggtctcgaactcctggcctcaagcaatcctcccgctcagcctccaaaatacctgggactacaagtgtccaccactgcacttggcttctttcattaagtatgatgttagttacagggtcttcatagatgtcctttatcaagttgaggaaatgctcttctatttctagtttattgaggtttttttacatgtgttggattttgtcaaatgctttttctgcatctattgagacagtgatgtagcttttgtcctttattctactaatatgatatgttacattgactgattttcatatgttgaaccaaccttgcattcctgggataaatcccacttggggcagggtgtgatggctcacacctgtaatgccagcatgttgggaggctgaggtgggcggatcactcaagttcaggagtttgagatcagcctggccaacatggtgaaaccccatctctactaaaaatacaaaaaaatgagctgagcatggtgctgcatgcctgtaatcccagctactcaggaggctgaggtagaattgctagagcccagaaggcggaggttgcagtgagctgaaactgcacagttgcgctccagcctaggcgacagggcgagacaccatctcaaaaaaaaaaaacaaaaaacaaaaaacaaaacccaaaaaacaatcccacttagtcatcatgtataatccttttttatatgttgctggattcagtttgctaactctgtggaggacttgtgcatctatattcagggatatcagtctggagtttccttttcttgtgattctttgggttagcccaccttgggttttgtactagctgttcctctgcctggaatgctcttctctgttctaggcatggctggctccttattgtctttcagatttcagcttaagtgtcagaaagaggctttccccatcaccgatctaaaataacctccagttattctatcacatgatcctatttttattttcatcaaggaatttatcacactatttgatttttttttttttttttttgagatggagtttcgctcttgttgcccaggctggtgtgcaatgtgcaatctcggctcatcataacctccacctcctgggttcaagcaattctcctgcctcagcctcccaagtagctaggattacaggcatgcgccactaggtctggctaatttttttgtatttttagtagagacggggtttctccatgttggtcaggctggtctcgaactcctgacctcaggtgatccgcccgcctcggcctcccaaagtgctgagataacaggcgtgagccaccatgcccggtctttttttttttttttcttttgagacagagtcttgctctgtcgcccaggctggagtgcagtggtgtgatcttggctcactgcaacctctgtctcctaggttcaagcaattttcttgcctcagcctttctagtagctgggattacaggcgcatgccaccacgcccagctaatttttttgtgtgtttttagtagagacagggtttcactatgttggccaggctggtctcaaactcctgacctcaggtgatgcatctgcctcagcctcccaaagtgctgggattacacgtgtgagccaccatgcctggcctgattttttttttttttttttgcttacttgttgtctgtcctcccacaacacctgtttctatagtacctagtacactgcttgacacataataggccttcaataaatattttgtttaatgaatgaatgaataatagcagctatcatttaatgagtacctattctgtgccagatactgtacaagatgctgtaaatatattataccagccctgatattccaaggaacaaactaaagctcggaggttaaataactttcctgagtctacgacgttaggaagtagcagagtcaagatggaacccagcactgtctggccctatggtccttgtttcctgatgccattctgtggcagcaggaaaataataggatttgaagtaagatagatctcgttcaaaacctgactctgactttcattaactagcaacacgacatcgagtaacacttaataacaattcattatctactttaagcctcaatttcttcaactttaaagtgggatgataataactataacatgagtctgtgatcctccttactgaagaatttagcatgctatagatatccaatggtggttccccattttacccaacattaataacagagatggtccattaaaaaccacacacttggccaggcacagtggctcgtgcctgtaatcccagcactttgggaggctgagaagagcggatcacttgagctcagcagttcaagaccagcctgggcaacatggcaaaacctcgtctctacaaaaaaatacaaaaattagccaggtgtggtggtgtgtgcctgtggttgcagctactcaggggctgtcacaggaggctcacttgagcctgggaggcagaggttgcagtgagccaaggtttctccactgtactccaggcctgggtgacagagctagaccccgtctcaaaaaataaaacaacacacacacacaaacacacatacggtaagctcagtgttcaaataacacaagtagctattgaaatgaaaggaaaaaaccccacaaatttatcaatgaactgagaatttaactcagacattttaacaaactgttatattactacacttggtgtaccatatgtagaaatcaatgatttaacaatttgattgtaaaaaattggctaaaggcagaaagacatactggaagaagcacaggattaggagtgagaagatttaagttcattatttagtgactggacattcctgttagtcatctcatttctttcccctcacctatgaagtaggatagtaaaacttggttatgtgaaactgcaatatacatatatttaaaagtgctttgtgaattctaaggtctctataaacactttaaacagcttaaagaatttttaagaataaatttcaggttttctaggttttgttcctaagatcaaccttttatttgggatatttttatttgggattattcctaaataaaaatatttagaaagcaaattacacacatagaaaaccaactaggtagaactgcaacctgacttcccaacttactatatttccaatggcacggtaaagtctgaatatttgttctgaagtttgttcctcccattttatacaactggtaccagcagaaatcttaggggctacaagataaaaccaagagcaaaaatgaacatcagggtcagtgtccatgaattgacagctattgatactgaataagagataccagagaattcattctaacctctcaacttttctttatgttcaaaattttccatatatcaagtaaaaataataaataaataatcatataaatattaaaataaaacatgggtgaacttctttacatcctgggagtagaaaatgcccttctaactatgaaatgagactattcaaacttttttttttttttttgagatagggtcttgccctgtcacccaggctggagtgcagtggcgtgatctcagctcactgcaacctccacctcccaggctcaagagattcttgtgcctcagcctcccgagtagctgggactacaagcgtgcactaccatgcctggctaattttttgtatttttagtagagacagggttttgccatgtttgccaggctggtctcgaactcctaaccttaagtgatccacccgcctcatcctcccaaagtgctaggattagatgcatgagctaccatgcctaggcaaaataaattaaaaaaaaaaaaaaagacaaaaagaaatgccataagttaaatcaaaaaacaaatgacaaactgaatttgcaagttatctcagagaggactaatttctctattatgaaatataagtactcaaaaaactgagaagaaaaagaccaaaatgttgataggaacatgggcaaaagatatactaccacccagaaaaaagaaatgcaaatagttcttaaatatatgaaaagatcttcaacattactgacaggaataaggtacattaaaactactccaagtagttttactatactattctgaataaccatgtgcctgttatcttcctaatcttactattatttgaaatagcaaaagattggaaacaacccaaatgcccatcaataagacatctgttgggttaattatgatatattcacatagctgagaactatgccaccataaaaaacaaaaagaaggccaggcatgcctttgggaggccaaggcaggaggacggcttgagtctaggagttcaagaccaacctgagcaacatagttagaacttgtctctacaacaaattaaaaaattagccaggcatggtggaatgtacctgtagtcccagctacttgggaggctgaggtgggaggactgcttgagcctgggaggttgagactgcagtaagccatgatcacactattgcacttcagcctgggtaacagagaccctatcttaaaaaaaaaagaaagaaggaggaaaatctcttcttactaataggaagtagtctccatgatacactattaagtgaaaaaacaaaggcacagaaaaatatgtattttatgccaccttttgtgaaggaaaaataaaaaataacactatgtaggtgtttgcttattttggcaaaaggaaacactggaagactaaatcagaaactaataaaaatgttacctatagagggaggaatacgggttagataagatagagatggaagtaggacttctatgagtgtacctttttaagctgttttaacttttgaaccatgtaaatattttatgcattcaaaaaataaaatttaatcataaaagaaaataaagcaatccctaaaataaaaaaaaaaacaactgaaacttaactatgtatgaaactaggtaacaaaaccacatggaaaaaataatcattaccaggaagttttgaaggcagtaatctgactgtatatccttaggatatattctaaggatcaaaaaggaaaactgtaaagaaatcttaaatcttacttagtatttttactcttagtagtaatattggtattgtaatgctgaaatgatgttatgaatagcaaataaataggttaatatttaaaaaaagatagtgtgagaaaatataaggaaaaccctttaatgataaatttgaatcataaacaatatgagcttgaatattttttaaaaatataacttctagtttagtccactgataccttatcttgccatacattgttgtaccagatgatctctaattatcaaccccactaaaatgaacaaaagctccctggaaatcacactggttgatttcagtgtgagccagaggacacataggcgagcctgggacatactgtggtggaagcaaggaagcactccaaactagtgggaagtgaagagtgttaacagaatgtaggagccaaatttaaggggctcccactgggcaaatataaagaattatgactgtaaaacacaatcaatgaaaatctacgcgtcaaatgatactaaaaagaacgcatctgacaccaaaattgaaggcaattaatggcatcaacttcttattctaattaaagagaaagaattaagcccctgtccccattttaggatgaactaaaattcacctccaattaatgaggaaaaactcttctttccagaacaataccagctattaaatgtaaaaggaattagaaaattgccattttgtaatccatagtgaaataattcatttgggcaaggaatatcaatctgtactaaaaccatcatgtgaaaggttgttagggaacaggatatctgcacagtgccagagtattaattaccccacagattacctgctaattgcaaaagggaaaacacatcttaacactggaaagatctggtggtcaccatctcaaccaagtgatcaaacttagcttcacttgctttagtacagtctgatatcttggcttactcaagtggtaccttaagactgtaggggacaaaagtgagacttctctaggtatattaacttttgaatcagctatatgttttacatattcaaaaaataacatttaatcataaagaaaaataaaaagtaatccctaaaattaaaaacaaactgaaacaaatgtttatactcctaactctactaaaaaaaacaaaaaagaagaaaacaaatgtcactgaaacacactctttccaaaaactttaagcctgaatccagccaaacctttagaactaattataggaaatataagagatagggaacaagttaaacaacactggaagaaaacaaatcaaacaactggcctggtctcttcaaaaagtcaatgacatagagagaggaaaaaaagaggaattttttttagagactaaagagacataacaactaattacaattaaatcctagtttgaaaaataaaactataaaataaatttttagacaattaggaacacttaaatatgaactgaacattggatgctatcaggaaattgttcatttttcttaggaaaggcatactaaactacttagagatgaaagatcatgattcatacttccaaatgaataagcagaatttaaaatacacgtaataaatacataaagagaaagaaaatatggacaaacattaataattgttgactctggggtaaactggtgtttattataccagtctttctatttaatattttcaaaatcaagaagttggaaaaaaatgctcaatccttcatgaggctatatgctaagagggagaaagaatgctttctaccattctttggaaaagcacacaaaagtgggcactcaatcaaaattaagggaaaagtacagctaagaagtcagaatgttcagatgctatcgtgacaagcagaacctttagaaagatgagagtctctgcagccttcactcaccgtaagtcgccccctccattggctgctgccttccattgctcagactttcaggcaaatttttcaaaactgaaatgagctacaaaaaaaaaaaaaagagtgtgatatattcaaaatgaagggaagaacaaaagcagaaacacattacaattcagcaccatgaaataacctataactttttttctttttcttttttcaaattaaaaaaaaaatctttactattggctcttcaaggctgaacctataactttaaaagatctatgtggcagggtaaggtagtacattggcttaagctgtgaggataggtgtctacttggggaaacctcagtagagattctgctttctgtagagtacaggtcattgattcacttctagagaatgctgtggaagctttggcatcaggatagcccgggcttggctatacacactctcaccccatgggggccaaggcagtgaaacctcacaggacaatgtactatggagtcacccagctctgggttcaagtcctagttctaccacctaccagctgtctcattgtggaaaagttatttagcttgtctctggccttcaatgtcatcatctgtgaaacaatcaacagcaacaactacctcaaagttgagagggtaaaaagaaaaagtccatacagtatctagaacagttgtagaacacaagccaatgttcaataaacggcagtcactattataagatcatttgtgaggtaagtgcctagaataggaaataccatctctacaggtgggaaaaaaatattcctctgtataaaattaacccgttcatatggaaaacataagtttagtcattaaacatttacccagactctactcatgcagtttcaatgaattatatatacaaagccacagaaaaaagaaggatcatctataggtagaatggtcagcagaattctagtgcaaatgactgaagccaggcaaagaaatggaaggaaagctaagagtcgcttagaaaattgctgttagttcattctgacagggatgcaaggtatacataccagagtgcggagagtgaaattgagaagaatagtctaagacctcactatggcatgtagtaggtcatgtaagatcacctgtttcacttgaaagcctttattcagtacttactctttgtaaattctcaaagatttacatgagatcacaaatgccaggctaatttttaggaagccaaagatagaaattactcttttttgtttttaagaaaattagaagtcacaaaattgttcttctttttataaccacttaggaaacccactaaatgagtaaaaagcagtaggatattggggaattataccatgttggcacccagtcttgacaacactgcttccaattcctttgcagtgctcttgggtggcacaggaacagtttcttgtttgagaattgggcctacatcaaacctagcaaaaaatcaaaagcaaataatgacaatgattaccatttcctgaatcaatgtttgtctacacacaaaaagatacaagctgggtacagtggtctgcatgcctatagtcctagttgctcaggaggctgaggcagcaggattgcttgatccctggagtttgagaccagcctgggcaacacagctagcccctatctcttaaaaaaaataaataaagatagtttatcactggctattaatttggctgttagacattagcaaggaagatatgtcagtttgaaagacgggagaacaaaatatggcctgtgtttagagtctaaatttatttttccctaaagcaaagaaacgatacagttgcatatcaggaatttaattacaattacagaaaaattatatcattagtaatagcatgaaaaaatctctatttgtatatgaaaagcataaggcaaagaatttattttccatggaagtacagttaggaagttcataattatttatttctatagtcccttcctcaaaggataagagttttgcctagattatcaccataggtgattataagtagggccaggcgtagtggctcatgcctgtaatcacagcactttgggaggccaaggtgggtggatcacgaggtcaagagatcctggccaacatggtgaaaccctatctctactaaaaatacaaaaaattagccgggcatggtagcgtgtgcctgtagtcctagctattcgggaggctgcagcaggagaatcgcttgaacctgggaagcagaggttgcagtgagctgagatcaccccactacattccagccggggtgacagagtgagaccccgtctcaagaaaaaaaaaaaaaagtaaatgcaagtatatttgcattcccacaagtctgacattttatatcaagctctgtaaacactggtcataggttttcatgagcaatatgctttatttaatttttttttgctttttgtttttgttaattctatttctaacctaggagctttagtaaaatgtttattgtgaaaaattgcaaacattcacaaaaacggagtgaacagtctaatgaatcatcatatacacatcattcagatttttttttttttttttttgagacaggttcttgctccgtcgcccaggctggaatgcagtggtgcgatcttgcctcactgccgcctcaacctcctaggctgaagagatcctctcacctcagcctcctgagtagctgggactacaggtgtgtatcaccacacctggctaatttttttattttttatatgttgcccaggctggtcttgaactcccagactcaagtgatcctcccacctcggcctcccaaagtttaggattacaggcgtgagccaccatgcctggctcagattttagaactaccaaagttttgccactcttgtctcatctactctctctcttgttttctgaagtaagttaaagcaaatcccagataccacgttgttcttgcgaacttgtgaattattcttttctaaggggaaattaggtggtaacaggcagagactgaataaactcctcaagtaattctaaataattgtttctaaaaaattgttctaaattgtttctaaattgttctaaactataggtatgacaggaaaaaatgaatgttttaggacaattatattgcatattgatatacaatatattcttatttcaggttccaaaaattttttggccatagtttagaaaccaaggccagcaaaaccaagattcaaaacaattaacatacaaaaatccatctctcatttatacaatgtattttatagaaatccgagtattaataatataacctatttcaattaacaaattaaaattcacatatggactttaaagagaccccgcataaataccaaaagacatatggtttatgttagaaaccaggagaaaacagaaaggatataaaagcagaagaagcactctggagtcacagaaattagtgagcaccacccattcatccactgccccccaaacaggctgacatcaacatttaaaaatcacaaaaatctcaagaaaggaaaatatgtgctaccttttaggtctaatttgcataattgttactccagtaactgtgtctccgtgaagcactgtatggattacaggggctgggccacgccatctcgggaggcaactgggatgaacattcaatatgccactgagttagaaaatgtagaaattagtatgtcagtgggctttaccacttcgttaccactacctaagctattatgctacttttcattaggaaactttcccagaaatttggaaaaactgacagttaaatctaagtctcgtatcacctgaaaggaaaaaagttacatgtaaattcactctcttaccataagaaaccaatgacatttaattaaaaacagagctaggacaactatttgctgttctaaagatgttctgtctgggtgtggtggctcatgcctgtaatcccagcactttgagaggccgaggcgggcggatcacttgagatcgggagtttgagaccagccggaccaacatggagaaaccccatctctactaaaaagacaaaattagccaggtgtggtggcgcatgcctgtaatcccagctactcggaaggctgagacaggagaatcgcttgaacctgggaggcagaggtgcagtgaaccgagatcacgccattgcactccagcctgggcaacaagagcgaaactccgtcgcaaaatctacaacagcccatgatgtctgggagtttttaaataaaattttaaaatgcatttatgactataagagaaccactcaaaccctattatgcatctcatgaacaattctaattttatagtttagtcacataactatcctcacttcacttggtttacatacagactgcctaaaataagctttttctttttttttttaatttttttttgagacagggtctcgctctgttgcccaggctggatggctcactgcagcctcaacctcccaagctcaggagatcctcagcccaatccaacattcactgagcgcactccatgtgcagacactgttctaagtgttaggcatacaagcagcagtgaaccagacagaaaaaaaaaatcctgccctcagagagtttatgtacaaaaagtgggagataagcaagaaaaaacaaaatatgtacaaggtttgccagatgatgctgagggctatggagaaaataaagcagagaggactatgagggggacatattacaattttagtagtgatcagagaaagctttaccaacaagaaaacacttgaacaagaacatgaagaaggaaataactacgcatatatatgggagaaaagcattccaggcagagggaacattaagtacaaagatcttgaagaaggtaaatgctcggcaaattcaaggcacagctgggaggccagttaggcctggccttttattgagtaagacagaaaattaccagaggattttgagcagagtgacatgatctgacttgttttaaaaggatcactttgaggcagggtacagtggctcatgcctgtaatcccaaaactttgggaggccaaggcaggaagatcacatgcagccaggagtttgggaccaggttgggccacatagcgagatccctgtctctaaaaaaaaaaaaaaaaaaaaaagagttagctgggtgtgttggcacattcctatagtctcagctactcagaaggctgaggcaggaagatcccttgagtctggggctgcagtgagttatgatagcaacactgtactccagcctgggtgacagcaagactgtctctaaattaaacaataaaatagaaataaataaataaataaataaatacattttggctgctggattggtaaaagactgagagggccaaggacagaagtagggaccagttaggaggcttctgtagtaatgtaggcgagagtggcagcagcggaagtgatgagatacagacagattctacacagattttgaaggcagagccaataggatttactgatggattggatatgggacgtaagaaatcaagcatgactccaggattttggtgcaagcagctagaatgatggagtagccatttattgagataaagattttaggagatgctttgggtatcttgaatgtaaagtggctatcagacatccaggaagagctgtggaggcagtaggtattaggggactagagtttggggaccgagctgagctagagggaccaatttgggcgttgtcagcatatatatggaatttaaatgaaggtggatgaaagcctatagagggtgataaggagttaaatacattttgacaactcatgccacaaataaaatgttctttagtacttgaaaagaaaatatcaggccgagtcatgtgtcagccaaatatggctgtgcccaggcgagttgagcaaaggcttcagtgagcccgggcatggctgaagacgacctggggaggcaccaaccagctgctgggagaagagcataaggctcaagatggaaaatcataaatctaatactatcaaggaaaacttaacaatctttgatatcataaccagaaaaattaaccagcttccacaagcagaaaggaatctacctgaagagggatcagcatatgttggatttaatgctctctgtggcctcatagcaaatggtctttttcaatgcgtcttgaacatgacacaggctcttacagctgctggcttaccaatggcagtgatcccttttcttacaacaaacacagcttacaaaagttttgtaaattttccttcgaatacaggtgatttgaattgtgaaacgtgtaccataacacagagtggattggtcttgcttttggtggtctataccctcttttcttgtctatacctgtgactggaggcctagcagcctggtatgaatcaactctgttaccagagaaagggaacatcttaagttactggattcaaatttataagcctgtctttagaaagatgttatttcctattgtgttccagactgtgtttgcagcattccttgggtttaaacaatataaactacttctaaaggcccttcagttacctgaacctggcagagaaattcattgactttaagcaaacatgtacagaaaaataaaatggtaaaaataaaaaaagaaaatattacagaaagcatagagttcaaattatcacattttatatacaaggtccatttataaagaccaaggtttctatactgtatttccttacaaataaaacttactagggaaatttaagaataagagcctcattcaaaagtcggccaaacgaagccactactccaacatcatattctccagatcccacatccggccactcatatacgggaagctgagactgcacagcatattgcttcactggcagtccttttggtgatggggaaggcattgtgaccacctccagtttgtcgattaactcttcttctttgttttccctaaattagataggaagaaaaatgtgacagtgttaaggcaatgactcaaagctaaaactacttcacatatcgctaagtatgtttatgattaatctcatgaagcatttagggctaaatgattaaaactagtgtgagagactgagttttcattttttctttttctttttttttttttgagctggagtctcactctgtcacccaggctggagtgcagtggagcgatctcagctcactgcaacctctgccccctaggttcaagcgattatcctgcctcagtctcccgaatagctgggattacaggcatgcaccaccacacccagctaatttttgtgttttttagtggaggcagggtttccccatgttggccaggctggtctccaactcctgacctcaagtgatccgtccgcctccacctcccaaagtgctgggattacaggcgtgaacaccgtgcccagcctcagttttcattttttatttaattttaattatttaaaatgtaaagagtgacacgtggctagtggctactgtttgaacagtatcattctagggatttcctgtgcatacagaaacatatacagtatggatactttacacaactgggatattacatactgctttgcattttttttccttttaacaatgctatatatgctattatgtgtctttttgaaaaatgggttaaatatacgtatatttgtatattcactgaacatttctagaaggaactgaaaacagtggctgtctctggataaaggaactgggaactgctaaacagaggtggaaggaagtaacttttcactgtatatcctttgaatccatggaacttttttaccataaccatgatgccattcaaacactactttttaaaaaacaaacaaaaatacataacatggctatcattccatggcagtacctgtagcactacctcatcctttctacctgctgcatagcattctagtacccaggggggtacatttattaaacaggtattgtatgtacacgttgaggagttatgaggagtatgtcctggggcactataaagaaagcacaggagtaatggagctgccaagtgaagcatcatcagaagtatcaggataggccaggaatgatggctcaggcctgtaatctcagcactttgggaggccaaggtgagaggatcacttgatcccaggagtttgagataagcctgggcaacatggtgaaaacccgcctctacaaaaaatttaaaaatcaggcgtggtggtgcacgcccgtagtcctagctactctggaagctgagatgggatgattgcttgatctttgaggtcgaggctgcagtgagctatgagccggccactgcactccagcctgggggacagcgcgagacctcgcctcagaaacaaacaaaaaaagtgttggtataaatgtataaatgcagtgagagacgcatgtgacaacagcagcccatgaagggtgtgcaaagggaacatggggtttccttccgggtgtgtgcacagaggggtgtgtggaggaaggaaaaccacacaggggattgacgaaggattcaatacatgaggggctgctgtgaagtatctgtagggaaaaggagatggagatgaccaaaaaaagtggaaggaggactgcgtcagaaaaaaacagaatggggaaataaaaaacattaattgggaaaaagaggcagagaagtatatacggtattgccaccacataccatggactctcaggactggttggatttcaaataattttctttcccagtaaacaaaacttgttaaatattatgaatactaaatgtatacctaacagttctgatttataaatttattcttttgaaaacaggtcgtttttggactatgtccttgtatacaaggagcacagggggagcaaaagagcgagacacgggtgtgccgaaggatgggggtcaggaggaactgcaaagcagggaactttgaagtgggacctggttttagtccgaaccacctcggctgatgaccttgggcaatcgcataacctctctgagccacggattccccacactcaaaacgggcagggaggccgtgggactggcccgggggatgcaggcagagcgcccagccccagctcggcacagcgtgggtggcagggcgcctggagaacccacagaggcggcggggagtgaggggcgcagaccgcaggtactaggcgcccaaaggctgaccggcgggaatggcgcaccttctgggagccagaagacgccgagatctgggcccacaccgctctgccgcccatgctttccgcaaccagaagtccaaaaccctcggggccggccgcccgggcgcggcctggaggccttcagcggccgggtccccggatccctggcccgggtacctggcggcgtgcagcgcccgcagcgcctcgcgggcgaactggtccgtgccgaagaagagcacccgccagggaggcttctcgcggactctggagtcccggcagtcctcccagccgagtcgggccagtgctcgccactggggactcggcctcccacgcctggcgccatgagccagcggaggaccccaacagcgccgcaccaacaccctcatcgcctcggccgccggcggccggccct

SEQ ID NO: 771 - DNA, 8027 bp, Homo sapiens
cctgggcgtgtgctaaggccagagctaccagatgggtccagctgccgcaggctctccaggcactgtcccctaagtgacagctgttactgcctgggagagctcaagtgcaaagactatcctgttctcccataaagaggaggaaaaggaagatacagaaatcggtgctgctcccaacagcagatcaaggcagtcgtcaggaactcaggatccggggtgagtgtcctcatcttgccttggggatgggtggcccaggtctttggcagaagtcacagtccaatggcacgatggttaagccctgtttaaaatgcagagatctcccagaggggcttaaggagacaagacaactaaatgcagtatgacatcctaaatgggatcctggaacaagaaaagaacattaaaggcaaaactaacaaaatgcaaataaggcataaagtttaatttaatcatgcaaatgacaatatgatgctcactttagaagcaaactggatacgtgctttgatagaaatatgtctttggccgggcgcagtggctcacgcctgtaattccagcacttttggaggccgaggcaggccgatcacctgaggtcaggagttcgagaccaccccggctaacgtggtgaaaccccatctctactaaaaatacaaaattggccgggtgcggtggctcatgcctgtaatcccagcactttgggaggccgaggcagatggatcacctcaggtcaggagttccgagaccagcctggccaatgtggtgaaatgctgtctctactaataatacaaaaattagctggatgtggtggcgggcacctataatcccagctactcaggaagctgaggcaggaggatcacttgaactcgggaggcggaggttgcagtgagctgagatggtgccactacactccagcctgggcaacaagagtgaaactctgtctctaaataaataaatacaaaattagctgggcatggtggtggatgcctataatcacagctacttgggaggctgaggcaggagaatcacttgaacctgggaggtggaggttgcagtgagctgagatcatgccattgcactccagcctgggcaaaaagagtgaaactctgtctcaaaaaaaagaaagaaatatgtcgcttgtttctgtggcatctaacatagctgaggagggctgactctcggttctggatttgtatccaatttgtcattttggttttttgttggttggtatgtgtttactgtaacaatattaaacatattttaaacatattttggccaggcgcggtggctcatgcctgtaatcccagcattttgggaggacaaggtgggcaggtcgcttgaactcagaagttcaaggctggcctgggcaagatgatgaaaccccatcgctacaaaaaatacaaaaattagccgggcgtggtggcacatgcctgttgtaccagctgctcaggaggctgaggtgagaggatcgcctgtgcccgggagatggaggttgcagtgagccaagatggtgccattgcactccagcctgggtgacagagccagactctgtctcaaaaaacaaaaaacaaaaaaacaccactccactgtggacaatagcttacctgcgtctttgtacactgatctgattagttccattaattaaatatcaaaaattggaattgttgtctcaaaaggtataagtacaataatacctacatttaaaaatgcatacaaaggctgggtgcagtggctcacacctgtaatcccagcactttgggaggctgaggtaggcggatcaccaacctggcaaacatggtgaaatcccatctctactaaaaatacaaaaattagccaggtgtggtggcacatgcctgtagtcccagctactcaggaggctgaggcaagagaatttcttgaacctgggaggcggtggttgcagtgagccgagatcacaccattgcactccagcctgggcagcaaaaacaaaactccatctcaaaaaaaaaaaaacatacatacaaatagacaaaatatacatagaaatatatacacacattaaaaatggaattacatgtattgttctcatgaaagcagtgtatacgcataagaaaccacacaatacaggagtggtcaacatgaatatcccatgtgtctaaatctcatcccacaccctagaagaagactgtgtttggtttctcaacttcaatacttttctttgtgagttcaggggtttgcatatggcacaggggcctgtggctgatgttactaatcaatccaggcactcttacatctgagactggatggaatgtcacaatccttcttggacagtgctctggacagtcagttggagctagaacacaagatcacatctgttggccattcttgtaactttgtctttccatgattttagatgggtaggtaggcagatagatagatagacagatagatcgatagatgatagatagatagatagatagatagatagatagatagatagaatctccctcaaatgagtaagtaggcagtgtgcatgtgagtccttgaaagtctaagaaagggccaggcacggtggctcaggcctgtattcctagcattttgggaggccgaggcgagtggattacctgatgtcacgagttcaagaccagcctgggaaacatgaggaaaccccatcattactaaaaatacaaaaattagcctggcgtggtggcatgccctgtagtcccactacttgggaggcagaggcacaaacgagaaccgcttggacccaggaggcataggttgcagtgagctgagatcacgtcactgcactccagcctgggcgacagagcaagactccgtctcaaaagaaaaaaaaagaaaaaaaaaaaagtctaagaaaggtctttttttctccctgacttccatctccaccttggcatatgaatgatcattcacatatgaaaagcttaagtcagtattgtatttgtgtcaaaatattttcccttgcaatttgtagatatgcctttttagttttctcagagcatttagtgctagaggaaactctgatgtaaagctagtccttttgttgatactccaattttctgtctggctgtttgccatctagctgtttttgaatgcccctggctaagtgtccaaaggctatttggggctgagattgttgagcacctaaggcagtgacagagtgtgaggggacctgagaatgcttcgatcctccctgtacactttttttcttggtgccctatggcatgttttataattgatctgttcaaaacacttctcttgttttattttagttacgtttatctccattcctactcccttcctcctcctccccaagacacagcttaatgtgtttaatgcgtgtccttttaaaaaaatgtgttattgggtcaggcgcggtggctcactcctgtaatcccagtactttgggaggccaaggcgggtggatcacctgaggtcaagagttcgagaccagcctggccaacatggtgaaaccccatctctactaaaaatacaaaaattagtggggcggtagtgacatgcgcctgtaattccagctacttaggaggctgagacaggagaatcgcttgaacctgggaggcggaggttgcagtgagcagagatcgtgccactgcactccagcctgggcgacagagtgagactccgtctcaaaaaaaaaaaaaaaaaagcgaaataacttaacaattttaatattggcctgaataatatatgttgtcaaaattaattttacctatttctttttgttttgtaaagtatggatgctagaaaattttatattaagtagtaataatgcagttagtacaagaagacgtcaaaatgtctgactgttttgagattgactgaggttcagtttattattaatagttgggatggaaataggcctacacgaagtaagggatttatccagagagcatggattcaagttcttcccttgcaaataacagaaaccaattctgctaacttgtccaaaaaaaaaagaaaaagaaaaaaaaagctctcggggtcggggcagggggtgccctctcagcatcaggagccggcagctgcctttccctccggcacttttcccttttctcctctctgtgtcgtaggcgtgccaatccccaggagagaggcgtgataggcccagcctttgacatgtggggaaacacaggcctgtgattggctaccgcatgacacccaagggacaagttgctatggcaacgcgtgggcgcgctgtgggctcgtagaagccaggtgcggacgctgaacaggcaggcgaagacccgagatgtcctttgcaagggtcccagaactcgccagtggctcagtcctcctcactcccagaacagtgctcctccacacatgcgatggcttttaataaatatttgagtcactcccacttccagtctctgcccctccaggctccacgtgctcctgggttcgttcgggtcgtttttgtcccataactttgggccagaggagatctggatttgggcacagagggagatcaaactcgggtgggatatccagtcatgctgtctgctttgtttccaggggtcttcacggcttctctgcccaggggccagaaccgaggaggccaggagggctgctggggctaaggggtctaaggacctcgttgcacacgctaccaggagcaggggcatggagcacagtgagggggctcccggagacccagccggtactgtggtaccccaggagctgctggaagagatgctttggttttttcgtgtggaagatggtaagtggtgagagattgacggcaggggtgggggtgtgcccctcaacacagagcagagtttggctgaaggtcctgacactgtcgtcccctccaggtcaggcggtacatttcctccaagacagggaatcagtcggggtgtctcagtacccagaggggtctggctggaccgccccttccttttctcagggtgtggtcgcttatttatgcagccctccaatcatcacatttattaagctcctactctgtaccagacactgttctcagcactggggcgacaatagtgaataaaacacaaaaatctctgccttcatggaatgtacattctagtggggattaaaaataaacaactaaaacgcatagtgcgttggtgatgagtaataaaaagaaaaattaaacagagaaagagaataggaagtatgcagcaagggcagtaatgtggtcaaggaaggcctcactaaaaaggtgacatttttatcatcaggaaggtgacttgcaggaaactaaggaaataattaggtatgcaaattatttgggggaggaacattcctggagggaggacagcaaatgcaagagctctgaggctggaccctgcttcatttgggtacagcatggacaaatcttgagtagccacattcagtttagtcacttcatgtattatctgtgggcagttgccattccttccacccttctccctgccttctttctttcctttttttttctttcttcttcttcttctttttttttttttttttgccttttttttgaggcagggtcactctgttgcccaggctggagtgcagtggtgcaatcttggctcactgcaagctctgcctcctggattcaagtgattctcatgcctcagtctcctgagtagctgggattacagtgtatgccaccacacccagctaatttttgtatttttagtagagacagcatttcaccatgttggccaggctggtcttgaactcccgacctcaggtgatccacctgactcggcttcccaaagtgctgggattataggcgtgagccactgagcccagccttctttcttttccttgtgctccgcaggtccagcccaggctggcaaaactgaagattgtgaagtttatcttggcccacctgtctcctgccctccgtaggcctctgcccttcacccctgttgccccactattatttaactgcagtactgtctcctccattagattagggcttctccagagtagagactgtcttccaccctcccacctgttagactgggagtgccccagggcaaggggcccatctttgattagggtctccacgcaaaggacagttgatgctgtaagctgggtctgagcccaggccccagctgttagcgggcttgagaggtgcctggccattcctcagggctctgtcctgtgtgtccttccccagcatctccctggaatcattccatccttgccctggcagctgtggtggtcattataagcatggtcctcctgggaagaagcatccaggcaagcaggtgaggagctggtcctggggggatggggtggtctctgtggggtagaggccctgccttcccagagggaaatctagagaggggtcacttaggggtcattgctgtccaccctttgggacagcaaaattcagccttcagtgtccttcgagaaccccaagctgttaaaaacaaacaaacaaacaaacaaaaaacagcaacagtccctgattaccaccccctggccctggacaggaagcaggcatgacctggaggagtgtagccattcagaaggcgagcttgcccctctcaccctatcagcacacatgcacctcagcaaagtcaactcagagatgagtggctgtccatgggtacagcagacctgttccccctacgacccagtcagaatctctaggcagacagcttaccaccgctgggtccctccactatggccaggaagtctaggggtaccttgaataaaaccaatctggagagaggacagacacatgggagttattaaggaagtgggcagtgggagccaatgaaggtggttgggggaggggagtgatgtgtacacgatggggttttagaaacatgactggtgttgtgcctaggctggtttggagaaggaaacacctagaggcagagagattagttagaaatttcctgcagtagtgtgagggatgaggtgtgtggtgacaaggacctacgctaagtaggatgacagtccaaggtcagagacagtgtggttaggtgaaaagaacacaggattcaagagtcaggaggcttaagtgcacacactagctatgtgcatccttggctttttttttttttttttttttttgagacagtctctctattgcccaggatggagtgcagtggcacaatctcggctcactgcaacctctgcctcccaggttcaagtgattctcctgcttcagcctcccaaatagctgcaattacaggcacaaccacacccagctaatttttgtatttttagtagagatggggttttgccatgttggccagactggtctcaaacacctggcctcaagtgatccacccgcctcagcctcccaaagtgctgggattacaggtgtgagccactgcacctggtctccttgaagcacatttcctcacttggaaggtgcgggggtggcaatgatacttgagctcacaggtgacagtaaggattccttgagatgacacacactcaagggtaagccatttctctgttgaaggaatatccaaccattgccgcttctcctctagtagctcccaaactgcatagagaattttccccttagactctttaagccatttgggcgacccagtcctgccccaaccactcagcccccctcattaacactgttccctgtccccccagaaaagaaaagatgcagccaccagaaaaagaaactccagaagtcctgcatttggatgaggccaaggatcacaacagcctaaacaacctaagagaaactttgctctcagaaaagccaaacttggcccaggtggaacttgagttaaaagagagagatgtgctgtcagttttccttccggatgtaccagaaactgagagctagtgagggttcagagaagccccatcctaagccagacacatgatgtgggctcagctcagtggcctgaaacctctcaggttttagagtctctcccaagaagccgcttttttctttttctttctttctttttttttttcttagcagatacaatgaatgaactgcaagcaaactaaaattctgttattaaaaaaaatcttttattaaaatgctcctggaagggagcaggtggtattgc

SEQ ID NO: 772 - DNA, 14714 bp, Homo sapiens
ttctgttattaaaaaaaatcttttattaaaatgctcctggaagggagcaggtggtattgcatagtttgttcagatggcagtggtacacacacacatacacacacaagtggcctggagcaaaagtgcaaaatccgtagctggcctgtgggtcgggaagcctgtaggactgcaagcatgtggtcttgagtagttcacagcccccctctgacctcagctcctccatttacagaatgagtccgaagactgggtcagagatgctgtttgcaatccaacagtagtcctgagacggctgagaggggaaggagcaggcttccaggcccagaatccccttcccaatccttccacccaccaggaccctctcttttccctgcttgtctgctaagagtctgtgcaagacttccctgggacctggcgtgtggtaaacaaaatcagacaactaccacactgcctgccttggacagccttttcttgctaacagtgggatctcaaaggtgtgtcctgatcccatgtctgagccatggtgtcttggtataagctgcggtgacaccaccaaataacataagcaaaattttgctttattaacccaaaatgctttaggttctaaagtgggctttgaacactcagactcattgctgagggtcctgggtcctgccaaaccagatgacaaacgggtatactgtgtttctacctgcaggggggcaggccctgtagcccctggatgggtctgatgctgctgtgggctccctggagccctgggtaactcactggagtgacaactttcttctgcagcctggatcattaagcttgagggagctgatgctgaggttctttggacagagtccttaacagtgggaaaacacatggagaatctgtctgctggtgaaagaactctggggctccttatgctggacaacctacagtccctcccttttatcctcattgagacgccaagtgttggaaataccccttcctggggcttctgtccattggattattttaactagattttccttggataaactgtggggtttgtagcctgggccttctgtgaagtcagcagatgacaggagggccaggctctggcctctgaaactgcagccgccctgcctttcccgtccaccaggtggcacaaggaccccaggctgtcattccgcaggctgttctcgggcctgacattgacagagccatccacccagaccatccactaaggccacagctggcccaactgtagctggagcaggaagggctgatggcagcaggatagacactgcaatttcttcctacttaaggctgaccccaggtctctgggttgtcacagtggctgtttccctctacggccacagacgcggtggttaccatgaagaccaaggcctggagggaacagaagcagcatccctgcctgccactccagctcacacagtgaattgagtgtagggacactgcttggtgctggaggcggggtctgctgtccatcagacggaaaggctggtggtgagaagccagtccctgtcctgctgcagtcctgtccagccaccgagcctaggcttcctggggagggggcctcagaagatcttgaagcccttcaggagagtcagggtaggcgccttgcgcttgctctgggcccgggatgacttcacggtgaccagcttggcctgggccacagtgggcatctccttcaggttgatggtggagagcgtgttgaaggtgcagctggccagcccatgccgcgcggtgagcggggcctggtggggcagggccctctcctcggagatgaagaggggccgggtcagggggctcttctccagctcccgccgtgcctctcgcactgcctcgtggaagacatgctgcacgtgctcaaagtccagacaggcagagacctcgaaaaacaggcacccaaacctgcctgccaaagccacaccctctgccttggtgacttgcctggtgaggaagcagtgtgaggcagggagttaggagcaggctgtgccaagtcaggcagaccagctcctacacccagcgccccatggactagctgggtggcctggggtcatcttcacctctctgagtctcagcgttcttatcagtacagtgggttactgccctctgcctctcagggttgttaggattacgaaagacaatttgtttcaagtgcttagcacagtacctggcacagagtcagtgctcaataaatggtagctgatgtcacccaggccagaattttgggatgagggtaagggtaagaagctactccaaatcccctatgctagaccctgcctgtggctggaggaagcaggccattcccagccccatctcttctctaccccatcgtgggtccctggggcaggaaacaggccacccacagctctggcttgtgggatcagctctagagagaagcagtcgtttggactgaagggttagaccacagaggtgactccagaagcctgtggttggcagagttctcagggctcctggggtttgtgtttgtgaaaattcattattcaagccctcacaatgacaaagttgcagattcaagctcatcataaaagcaaataataaaaccagggcagaggcaggagagggcaggggggacaacatttcatggtgaggagggcaaaaggagagagggggcaacacctattctgccttggtcctacaccacctcccgtgaagggaggatagaatatccggaacttgggaaggtcctggaggcttctgacctgaaagccatgggaatcgaggcgggaagaaaaagaagactggccttgcataggtcggatgtctacaagagggaagagatgggggggtccctgagatcttggggccaagactccactggctggatcttcctgacctactgctgagctgtcccgctgcccattcccgaggataatggcacagccactagatgagaggaggcactcgagtgggccatggtgggaaaagtttctgagcccaaggctgacctggcaggagcaggggctgagagtgggctagcttcccagagtgccactccatggtgaggcacgcggtctcagagagagtgagtaactgggacaaaaaagagtcagaggcatcggatctattccccacccagggctgggtgccgtggtgccagtaagctcaccgcttcctgaggaacccttttggaaagaacacttgctattatttgcttttatgatgagcttgaatctgcaactttgtcattgtgggggcttgaataatgaattttcacaaacacaaaccccatgtgtgcgtgcatgtgtgtgagtgggtgacagaggcacagaacattgtcctttttcttattttgttgcatcctagggaaaattttatcagtggcttgggaagcatcaacctaaccgacattttacccttttaacagtgagacagtcgtgggagacaatggccaatgctcagctaaaagttagacttcctgtgcttcccagaatcctaatctactaaacttgggacttgatcgaagaatgaaataggaatacattgtcctgagttgtttttagggaacgggtgggatcagcttcatttgagcatgtatgctttgttatttgctcccaaaccattttagacaatccctttggcaaagattggggtcaaaagagtgatctgtgcttttttccctgtactgaaaactggcctactcacaatccagtcttctgacccctaagagggtctgcaattcctcaaagactaccttcagcagctttcaggtcacatgacttccctcattctctgagacacaatttgcctaggtctgagggcttggccacctttgaaggcctctcaccatagtcccctttcacggtcccacacctctctttttcccacggcccatctgacccgttctaaacaaagggtcccttccttgctaacaccagtcaatgtgcccttggggcctagggcagcaggactgaccaaccgtgaacagggagggatgagtggctggtggaaggggctatcccttgcaggtagactggccacagaggacaaaggtcagtgctggagaaatccagtggcattactcatcaagttcaggcatcacagtgtcaaatgcttcagggccaggcgggcaacttgaatgtgtggaaagggtggaggtaaaccacggggagtggtgaggcctggggtcggctggagagagcgtgccccacctcaaagcattccaattctaggtcttttaagacactatgccagccaagcaaaatatggctgcagtattcttcagtaatgcatcctctggcccagtctctgacctccgattcgagtccaaccctttctaagagaacctgccctcagcccagccaactgtgggagtgagagtgggaggctgcgtctgggtgaggtgagagccgattggaccagagcagacacctgaccaaggagcccatcagagcctctctccttagaattggaattgggcactagaccagtcagctgctgggagtgagatcggaaggtcagatagattcatgcaagaagggtgagtccaagagaatccacagagacccaagagcgcggaaggagtggccactcttctgactttcagggtgcagttgctgtgtgacccagaagcgtttcccttcaagtccttggctgcctggaagaccaacatctaccatacccttacaacataatccctgtggtcgggcacggtggctcacgcctgtaatcccacactttgggaggctgaggcaggcggatcatgagttcaggagttcaagaccagcctggccaaaaaggcgaaaccccatctctactaaaaacacaaaaattagcctggcatggtggcaggaacctgtaatcccagctactggggaggctgaggcaggagaatcacttgaacccaggaggtggaggttgcagtgagccgagatggtgccattgcactccagcctgggtgacacagtgagactctgtctcagaaaacaaacacacacacaaacaaacatataatcccttctaccacaattcaaggggatgactgttcttagcagcccactaatccctcaagatgccacctgaccttacaagtgaagaaagcgagctctggagataacggccaagcaggctgtgctcacctgtactgagccatgtccagcttgttgcccagcagcagggcagggatgctgcgctgtgtctccttcgcgtgcaaggcaagcagctccaggtagctgctgctgctatcaaagctctggcggctgtcgacgctgtacaccaccaggaaggcatgggcccagttcaggtagcgctcgcagttcctgggggtgtcctggggtgaaggtgagaagccccgccggggggcagaggaggttggggtaaaggccttcacctgagccgcccaatcccacctccccactccccggtctttgtatattgtttctcagcagagccctttcaaaggggcacttgagtgtggatttggcttggtgtgaaaggagacattgtctcatgaacctccctcccaccacccagccagagacttggagaccttggccccttgggcccagagccaaagactctggcatggtccctacagagacctggctgtccctgggcaccactggttttgggttgagttcatgctgcccctttggcttctgagagtaactggcatccagccttggcagggggtggtgaggacatggggggagacttgtgtgtgggagagacctgggccgaggggctctcaccaggagcatctgtgtaaacaggtgtgcacctgtctcctcgtgtgcacaggcacagagccccacagcacaggatctcagagcagatgccagcaaccatcatgtctctccaggccctgtcccatccttctcatttggcaaaggaaggattcagacccagagaggtcaagtgcctcattcagggttacacagcaaagttgagcttaaaaggcatctaaatgcctatctgaggtcccgcactctgggccaggacttctcaggaggctatactgactcacagcagtgcataggtaatggaggtaatgttaccaggtctgcagtgtccatgaccctcaggtggacaggctggtggtccacagtctcctcggagctgtaggtgtcctctacaacacagatggttagccaggtcagacacagtgccttgggtgtaagtttgagcttccctctgtgctagacccctgtgtggcctggggggaccttagcagctgctctggggctgggaccactggaaagtccttggttctcacccacatggaggctacaggcagaacctcccaccaaggagatgctgctccacctgcagggctcagcatcagtggtcactcacagaccacacctcgggggtgggtctgtgttctggatccacacacaaaaccagcaggatagagtcgagtgtgtggcccctagaccctgttagcagcacaggctggctcaggagcaacactgctagcccctctatcccagaaccccaggctttcccactctcttccccctcaaccaacctcctgtccccagtgggagaagagacaagggaaaagagaagtacacaatacaatggaaggaatggcagtcagaccccttttagaagttccgagaaggttttacaaataatccttgtcaacatgacagcaggggagtctagtgtagtcagaagttttcagttggagaatgtggtattaaacccaatgtcagctgctttttagctttgtgacttggccaaatcacttcagctctctgaggctgtttcctcattttaaaatgggaacactgtgataacattgctaacagtttccaagcctttcctttgtcccaggcgctgtgctaagtgcttgacattagctcatttaacggtcccatctcccagggctctgtaagaactggatgggccccccaggcatggggcctggctcaccatacatgcctggtgagggcagtgggaatgatggtgttccaaagttaatagggcaggatcacattcccaggtgattttttttttaacttttgaaataactttagactgacatagaagttgtaaaatagtagagttcctgtgtactcttcacccagcttcccccagtgtcatcaccttacataaccatagcccaatgagcaaaaagaaatttacattgataccatactatgaaccaaactagtgaccttatttgaatttctcgagttgttactttttttatatatatggttctcatgatctcaaatctgagaaagcaacaagtggccaggcatgcagaggaccttgcggccatgttggcagtcattctctgcacccccaatctgtgcctgtgtcattggcccacatgtgtgagtgcacttggttatcacctttccctaggtgtcccctgcccctagtgaccctaaagaagtcaccttttggcagaactggggtggtctctgccttcctggcagcatccactgtgagagggcacgcccccaaccctggctgaatttatagtcaaacacttctttctgagggccactggcagccaagctggcctggacacactccaggtccactagcatccagcatgaatcacagacagcttcttgtccccagcctgctttggggacttggataaatagctgctcttatgcaaagacaaaaaaaatctaatggaaactatgttccaaatgtttaactatatttggtccaagaagagctgcccctagatgcttacatcgctttcagatctgtctttattttccagtcaaagatgtcagatgcaccccttttaggagttcccctcaatgggcgcagtgtcctgcccagcccagtgaaaggcgctagctcaaccttggtctcctgcccacagcatgacagcctttcaaggttgctgttagctccattgtagagagatggcaaggtgaggcccagagaagggatctcacccaaggccacacagcacctaatcagcagaaggaacttgaactcagggcttccaggctgggctgtgttcacaatgggaccccctcaccccgtgactgctcagtgaatcagcccaccctccagctctgtctgggcagagtacaagggaagaccagaatcgcccagtctggtggggatgtggaacatgcctgcatgagctggaagaagccttggagctcgtactgtccagcctccctttatagaagaagtgacaggcctcaggggctggggcaggagtgaggggctcctttcccagtcacagtaatgtccagacttcctatcatcaagtccctgcctcagagtactctggtgtccttaaatatatgggtttcctaacacctggttgtaattaatatcctgtggacttttgggtagagagaagagtcatttcccaaagttttgaatttgccgatgttttcctctcatttatagtaataatttttaaatggcaccacagaagctcacgtcagagtgtatacagggtgctgcctcagaaatggtgcctatgttgggccgggcgtggtggctcacacctgtaatcccagcactttgggaggccaaggtgggcggatcacaaggtcaggagttctagaccatcctgctgaacacggtgaaaccctgtctctactaaaaatacaaaaaaattagccgggcatggtggcaggcacctgtagtaccagctactcgggtggcaggcacctgtagtcccagctactcgggaggctgaggcaggagaatggtgtgaacccgggaggtggagcttgcagtgagccgagattgcgccactgcactccagcctgggtgaccaaaaaaaaaaaaaaaaagaaatggtgcctatgtcctcgctggaggaggaggagagcaagaggagtgagaagctgacattcttccctggctgagccagatgaggcaccctcagcccttctgggagaggagaatattctcctggagacgcctgcccactcctgcgggtctcagcacaggcaaagcccttccacagacactgaatctctcagctactaccagctctaacagccacaccccagaaaacggtgcaactcttacacagccagagcacaggctattggtcccatcttccagatggggaaaccacagctcagagggccccatgccacacagacctctgactccaggccctctatgacatgaggctgctcctagcggagagcaactggagccatgcctcgtcttcctttgtgcctgagggtctccataatcttaaggcaaatcactgagccctctcttcctccatttctccacctataaaatgaggatcgtgataggagctcttctttaaagggtaatcctaaaaccaaaatttaccacccccccagttaaaccctcatctacactgaagctagtactgtgctacctgctggaaatgggaatgaatctccaccctcaaggctcaccaaatgagctcaggctctcagaagacctaggaagggcttagagagttgttttaccagcattgctgatggctagctccccaatggaatgtggagacctttatccacagaaggaaaggttctcatctgtctctgctgctgctggaaccaacaatgggacagtggccggaatgtttaggcccctcctagcagaaccttcgaggagtggcactggcctcccagagagtctgaggggagaatgtctggttggctctctgactcgtgggctgtcagtgtagtgtgagagaccacagaccaaggggactgaccattgtggggctgcccacttcccagacagtctgcccacgcattccactaccaggtcagaactccaaaattattcaatcaggaggctcaaaccaccaccctaataggctcatccggtggcaccctgtgacagtatcgattggaaggcagggaggaagacagactggaggtgagatgccaggaaaaatacaagatgcccagttaaatctgaatctcaaaaaaaaaaaaggaataatttttggtataagcatgacccatgcaatatttgaattaggccgaatatgtcttttgagtccctgcccttgggaattccccttgtcctttcccagacactgtgtctgcttgtgtgcctttccttcctgtcctcccacctcacctctgtcctcagtttctccaccccatctctattccatgctctggcctcttccaacacctcgccggccagtgcaccattgcatcctgtgtcctcctctctctggagctgacctctgctaatcaaagggcctcctctgggtgaccttggcccagagtcttcagctccttgggcctgtttcctccactgtagcactgaagggctgtgccaaggcaccgggggtcaagcagagcttcgaggaacaaatctcttagggactgtcaccatgtcacctgccctgcatccctgacttacccatgggaacccctttgctctctctgtttgacaccctggggttctgtttaaaatctggaagaagggattctgctacctaaggaaaagcttttttaaacaaggggactaaatagccctgatgtctctgcctgctgcaacactggtgctggactccagcctgaactaaggggctgggcaccactagggtaaggagctctcccctccaggtgcggcaggagcgctggatcaggggcctgctgcagggagcgcagggggtttccactgtgtcacaaagccttgggcttctttggagggctctcaggggtcccatgaatgctttaattgatttttatgaatggggaaaataatccaagactgcaacacccattttctaaaggctaagatcatccagacaccttatggctctcagtgaacagtttacaatagacaaatgttatacatgtgagctttaagcaacatttatactaataaaatcctgctttgatttgttttagaagggaatctaagctattgtgtatgggaatccatttgaggaggaaggaaaagcaaaaatgcattgagtgcctactgtgggtcaagtactaggctggatcttttacatgtgctatttctttaatcctcacagcaattctctaactattttttaatgcccattttacagatgaggaaacagtagctcagagaggttagctgactggctcaaggttgccaataaggagcagagccaggtaggattcaaacccagctctgactgacaccgaaacgttcctttttccaatataccatgatgcagcgatgaaaacaacagttgttttctcatacggttaaaaaactggttcagaagccagcaccactagagaatttctcgaatgtcctgcccaggttttctggaagagaacactgagtgaccatcttgaagaataatacctatttgtttttgagttttttttttttttagacagagtttccctctgtcgcccaggctggagtgcagtggcacgaccttggctcactgcaatctccgcctcccgggttcaagcagttctcctgcctcagcctccctagaagctgggattacaggcacacaccactatgcccagctaatttttgtatttttagagacggagtttcaccatgttggccaggctggtcattaactcctgacctcaggtgatccacccacctcagcctcccaaagtgctgagattacaggcattagccaccgcacccggcccaagaataatacctgtttggatgtggatgtcttgctatgtttatttttattttttaaagttttttcacacctcatattttagggtaaatcagcctctcttagttctgtgaattaggccaaccccccagttgtctggggtgggctgtggaaggggtatttctgacacttaaaacattttcccccatgggctgggtcatcctggcggcttctcccttctgtccccagacatgcagtcctggtcagtgcccacccacggggtgggtcccaggagagcactccagatggggcacaggcagcagaaggtacggggagtagtttcttacccaagttggggtcatattcactgataaacctcttggtcagaaacttcacggtcagggctgcaagaagcagaaagaggttggctccatctccgcggccatgtctagctgctggcccctcgtttaagggaggccttatctaacctctgtgatccccggctgacaccaagctcagctctcccagagaatgaagctagggaactgaggaattggtttgaaaggctcagaaggaaaccagaactacggggagccaagtgcctctaattgcaccgtgggaattttttttaatggcaaggaaagcaatgagtggcaagcctaaggggtgtttggaaggtatgaactcaggggtcaggacccatgcaaccattaccctagagtcagcctggtgaaacctcaactgaagggaggtgtcgcccaccccggacaagtcacagagattctgaagtgtggggctatttactccaggctttagctacaagccaaaaacacaggaagagcagagttgattgcagtggttgatctttgggaagggtataaatccccaagtgcctgggctttccaggtaaggtccaggtgaggtctgtgtcccgaagaaacacactctggtcctggtctcccacatcgcaagtcttggctttctctggggcctctacactcatcatggatatctcagcagaatgtaaaactcaagaattaagctctctttggttcagagtgtagccatataaagcaaagaccagccaactactatactggaccctcaaaaagtaatgttcgctactgcttgtttggaaagaaagaaaagaaaagagaagagaagagaagagtagagaagagaagagaagagaagagtagagaagagagagaataaaagaaagagaaggaaagagaaagaaagaagaaagagagagaaagaagaaagaaaaaaaagaaagaagaagagagggatgaagggaaggagggagggagggaaaagagaaagagaaaaaggaaggaagaaaagagaaagaaacaaagacagaaagatagaaagaaagaaagaaaaagaaaaaagaaagaaagaaaagtaatgggatgcctgtaattccagtgctttgggattgagaccagcctgggcaatgcagtgacactgttatctctaaaaaaattgaaaaattaaccaggcatggtggtatgcctgtagtcctagctactcaggaggctgagagggaagatcacttgagctcaggagtttgaggctatagtgagtcatgatcgcgccattgtactccagcctgagtgacagagacactgtcttaaaaaaaaaaaagtgacattgtgaataaaatccttaaaattctttcctaggattcctaacggtgtcagtttgcaaactaatacccagggaatacatattttaaaatttaaattctttcttttatgtagtcactggctaaacggtaccggttacagagctacggataacaatctgattttcaaagggcaaatctttcaaaggaagagggtaatcccttctgtaggaaaaccagattcagagtcccctctctgggggtggggctggcttcaaaatcagagagtaggcccccagtgagtcttacagaacactctggggaggaaacccacagccagctgagcttgggttggccatcactaacggctaaaactggaaaaacagccagtggaggaccccttctgccctccctccttcagccagccaggagtggcatagttcagtgttgacacaaattatctcaatggaagcccaagatcttggctcatcaaggacaatcccatgcacctggaaccataacccaatgtgtttccagaaagttgagaggggtctggcttgaaacgaacacatttgataagaatgcacaacttgtcccagaatcccagggaatgggggtgggagtgggggagtggaccttccctgagaaatctcaacagctagtgacttcaccagctcccttctacggggagggggtgtggagggggaggggttggacgggaagtcttcccccaagcctaatcagggagtagcaaggctgcgactaagctcaaagaggcgccttgggtagggggatcagtgcccaacaggtccctttgaagccagtcgccaggactgactgctggccccagggtaggtcataggggtgggggttggaaggttggtggcaggggagaccgaccagtaaaggactccgagacacacaagagagaggggagagacagcaggggtcactgatacggaggacagagacagtgggaagacacaaagggaagaggcaggcagggaacagaagacagagatggtggagctgagcacaaagccgagagaagagaaagcccggcaacagggaaactgaggcaaagaaaatcacggtgtcttgtgcgaccctcctgggtgaaggaagctccccaagccagtggaagaacctgcccccaagagcacagcccactgtccccccacccacgcccagctccgcacttggcggctcaggctccccggcgccactcaccagacttgccagccccgcggcgccccaggatggccaggttgacctcgaggggcgcgctctgaggcccgctgcccgcgcggggttttccaaacaccgaggacatggcgacgccctggacggccacgcaggtctgcggccggtgggccccgcgcagtgcgcccgcccgtcggggcccaggggagcgggatgcaggcttccctggagcgcgcggccccggacccgtcggcgtccgcgccctcggccccgcgtccagcgggctgccaccccgcggggaggaggggccggtggagcctggcgggcggggccaccccaagcgcc

SEQ ID NO: 773 - DNA, 2917 bp, Homo sapiens
ttaaggtaagcaattatttcatttccttggtgaaggggtggcctgcccctccacacctgtgggtatttctagtcgggtgggacaagagactgagaaaacaaataagacacagagacaaagtatagagaaacaacagtgggcccaggggaccggcactcaacacaccaaggacctgcactggcaccggcctctgagttccctcagtttttattgattattattttcattatttcagcaaaaaggaatgtagtaggagagcagggtgataataaggagaaggtcagcaaaaaacatgtgagcaaaggaatctatgtcataattaagttcaagggaatgtactatgactggacgtgcacgtaagccagatttatgtttctctccacccaaacatctcagcggagtaaagaataacaaggcagcattactgcaaacatatctcgcctcccaccatagggcggtttttctcctatctcagaattgaacaaatgtacaatcgggttttataccgagacattcagttcccaggggcagacaggagacagtggccttcctctatctcaactgcaagaggctttcctcttttactaatccacctcagcacagaccctttacgggtgtcgggctgggggacagtcaggtctttctcatcccacgaggccatatttcagactatcacacggggagaaaacttggacaataccccgctttcaagggcagaggtccctgcagctttccacagtacattgtgcccatggcttattgagactagagaatggcgatgactttcaccaagtatactgcttgtaaacattttgttaacaaggcacgtcctgcacagccctggatcacttaaaccttgattttatacaacacatgtttttgtgagctccaagttgggtcacagtggttgggtcaaagtggctggggcaaagctacaaattaacaacatctcagcaaagcaattgtttaaagtacaggtctttttcaaaatggagtctcttatgtctttcctttctacatagacacagtaacagtctgatctctcttttcccttcacttggcctgacagcattgacttcattacacaagaacttgcagctgacagaactgacacacagatttcccccaagaggaagaacccttttcatttgcagagatgaattgaaatgtcatgtctgagtgcaattcctgctccccactcccaccccacaaaatcctataagtgataataaatcaataaaatccccatgatttactaaaagtcatccctgcaaacctttctaactagcagctgcagtggataaccaagaagggaagcagctggccatcacatagcattcctgtgagtgtgagaatgaagggacagcagcatgggagcgagaatcctgaatgagtgagaggtatagataatctacctcacttcatacctgccccttccctacataagacatctctgtcctgatacatggaaaatactagaggagatggtagaagtggttttagtctgcaattggaaatgcctgaagcttattaaattccaaggtaggggtgagatgaggagcaccagagagaaagagcaggttagacagagatgctcaactcactctgtcaattccagtttaatgctatttaacaacaaaattatcttcttaatcataaccaccctcatgcctaacccctattttccaaagataagagatccctgtctaaatttctgggttggtgtctactgccgcccctggggtggtactgtgatgtttgtgagtgagattgcaactgggatgggagaaaagaagtgtgggatacggaagatcgggggccacgatgcatcaattacagtgggtctcttttcgtccccaggtatggcccactaccacaagtcccctttccctacctgtcttgtgcaactgtcaaaaacagaatctctgcccaaagagaagggagcacagggagttgctgctggactgccatcatctctgaccccaacttgtccacctcctgaccgacctttctatgaaactgcacaaaaattaaatctcaggaatgccataaaattacatcatccccattcctctatcaaagccaatccaacagctctgtcctgacatgctttctccctgggccaaggaagcaacaaaaaatatcagttgagcatgtgaaaatgcgttgacggtgtgtgcggtgtaaagtttctatatgtcttcaccttctgtctcctcacggtgggagccgccctctctttccccaagtcacacacacacccctcccctacccctaagtccaggtgcttccatctgctgggcttccaaccactcatttcccatagacactctcattactgtaggccacatacagaaaatcatcttcctcatgactgtcctcatatagttggcccatggtagcactagtgggagggatagtgttgttgacaaagaagaataaggcgtcctcaggtctcaggtggattctcttccggattaaaaggtagaactggccatcggtaaggtcggagggcactaggtacttcctcctgtccagatcaggcacccttgcttttggagccttctctacaatcaaggggaccctgtccggatatttcttccggatcttttctccttcctttttccgatactcaaagggatggacctccttgtactggaacttcatggtgaatcacagggcttccgtgatccccgcgcagggcctgcctccttcgccgctgaccgctggccacgtcccgctccctccgccgacgtgtgcttagaatagctgcagaaatgtccgcttccgggtcaacagcactggtccaagtgtgcgggagggcagaaggtggggtgggagggggacctcgggtgcgcctgcctggaggtagaggagagccaggtggagaaataccggcggcttttccaaacagctg

SEQ ID NO: 774 - DNA, 9239 bp, Homo sapiens
actttccggccgctggctgtcgaagccggagtcccacctgtgtccccacagccctgtcacgaatcccggtcgggttctgggaggcacagcctcggggttgcgggccgggtgcggctcggcggtggaggactcacttcctgctccatccccggctgggccctggggcggtgagtgattcaaggagggagaccgcggcggcagcggcgcgctgctgaggggcgtggagggggcttgcccgccacccagacgttttctcagcggggttcccgcgctggcctttgggagcccccgggtcttgctgggctgtgggagaggtagctgtggtctctataccgtcggcgggataagtcattctcttaatcagttttcttgcttctcgatggtggtcccagggtttcagctgatctgtgaccctctgaccgccgcaccccggttagggcgcgagcaccgagaagaagaacggggttcggccccacgcgtgcagtcatgttcctattaataaacccggtgaacgcactggagcttctcacagtggcacttagtcacagcccctcagcgctgtggggcctttgaggtcacctgtgcatggggaaagggacgggctgggaaacagggtttctataaccgtggctaagacgtctcccctcctcagtggcgctgtctccagcaagtgggccctgcagctgtgttttgtaatgaatgtagaaataaaaattatactcaaaactcttttttttttttagacggaatttcgctcttgttgcccaggctggaatgcaatggcgctatctcctttcactgcagtctccacctcccgggttcaggcgattctcctgcctcagcctcccaagtagttgggattacaggcgtgtgccaccacacccggctaattttgtattcttagtagagacagggtttcaccatgttggccaggctgatctcgaactcctgaccccaggtgatccgcccgtctcgtcttcccaaagtgctgggattacagtcatgagccacagcacctggccaatactgaaaactcttattacaatttttactttctaattacattattgttgtttgttaaagttttaaaccagagagatggtttttagatccttaaaaactcaatactttataaatgaccaataataatgtctgtaaatacaaaaatatttcccccaaaagtgtgtgtgtgtgtgtgtgtgtgtgtgtgtgtgtgtgtgtgttccagtagtaaataggtgatttgtagtgggacaaaagatgtgaaagagtaaaacttcttcaccacagtctggtccttcctcccttgaaatgcaatattctttgtagtgggtggtcatgctggctgcattttttttttttttaagggagagacaggggctcactctgttgctaggctggggtgcagtggcgccatcatagctcactgcagcctggaactcctgggctgaagtgatcctcccacttcagcctcctgagtagctgggaccacaagtgcatgccaccatgcctggctgatttttaaaagttctttgtagagaaagaggtctcaatatgttgctgaggctggtttattggaaactttttaagggaaaaaacattatcttaatttctatgtgactcctatgcctggcaacatattaattgttgaataaatgactgatccatccagtaattcactcttgactatcctccaaaaagtaatgtttttcatgatattgctgtcgatttattaatatattaatgattggtttcagcccctaagagttgtgttttgtgcttattcccactttcacttatttttacaacctatccatgtcttcttttttttaaaaaaaaaatgtctttttcagtcttatttctgactccattaagatcttgaaatagaatggtatccaacacagttccctttggggttctgtataatctgtcccttgaggttgacaccaaatctgcaagccaagaagttagctgctcccataactaatatgagtatagttaaggccacaatttccttgcttgctgaggaaaatgaagttggggagaatcaaaagctttccagaaatcaaattacacctgccaactctctcctttgtttaccttgttcatcgtggacaatttgttcctcaaaaagtcaatgtgtctaaaagactgggttctgtcgatgtgtttgggaggcctaggcctctcttagtaatgggaaagttggccaggagaagacgtatgtaaaaacagacttagaaaagcacccctctgtggttgacagaatttacctcaggaccattctggtcaggtgtggggggttgtttgtgtacactggtggccattttttggctttcagacaatggtgagaatatctagggagctactgatgcacattgaggtctcttgctttaggaactgatgacgcttgataatgtggctggggacttcagggaagagtgggttacctggacactgcttagagaatcctctccaggaatgccacccagcacagttagaagaatgggctctcaaagggtaagaatgctactctcctttatttcatttatttatcttgttttttttgagacggggtctcgctctgtcatccaggctggagtgcagtggcgcgatctcgattcactgcaatctgtgcctcctgggctcaagcgattctcccacctcaacctcctgagtagctgcgatcacaggcatgtgccaccatgcctagctaattttttgtgtttttagtagagacaggattttgctatgttggcaaggctggtctcactatgctgtccaggctggtctcaaactcctgagctcaagcaatccactggcctccgccttccaaagtgctaggattatgggcgccaccatgcctgaccactgctctcctttaatttgagacttagatatttggagagggcccaggtctgaggagtttctggtatgttggcatcttagagctccagacctctgtaagattaattgttgcctccttgggagaaaaacaattacttccttatgcattttatggtttgcaaatgtctttgctatttattgtccttttaatatctcatcataactttttgacttatgtattactatcccccttttccagcctgggttggactctcacctctgccacttaacttctgagacttctgaggtctttgtggaaaaggaggtaattttttctgtcacttaaaaacaggctgggggcagtggctcacgcctgtaatcccagcactttggtaggctgaggtgggcggatcataaggtcaggagttcgagaccagcctggccaacatgatgaaaccctgtctctactaaaaataaaaaaattagctgggtgtgatagcgggcgcctgtaatcccagctactttggaggttgaggcaggagaattgcttgaacctgggaggtggaggttgcagtgagctgagaccacgccattgcactccagcctgggcaatagagcaagactctgtctcaaaaaaaaaaaaaaaaaaaaaaacaaggctgggcgcggtggctcatgcctgtaatcccagcactttgggaggccaaggcagggagatcacaaggtcaggagatcgagaccatcctggctaacatggtgaaaccccgtcttactaaaaatacaaaaaattagccaggcatggtggtgggcacctgtagtcccagctactcgggaggctgaggcaggagaacagcgtgaactgggaggcggagcttgcagtgagccaagatcatgccactgcactccatcctgggcgacagagcaagactccatctcaaaaaaaaaaaaataaataaaaaaaaccaaaaacacctccaatgctctttctcaaatatcatggctacccttcctcctgctttacttctttctttctttttttttttttgtggcagagtctcgctgtgtcgcccaggctggagtgccatggcatgatctcggctcactgcaacctctgcctcctaggttcaagcgattcctggataattttttgtatttttagtagagatgggttatctccatgtggtcaggctggtctcaaactactgacctcaagtgatccgctcacttcggcctcccaaagtgctgggattataggagtgggcccagctctaatttttgtatttttagtggagtcgaggtttcaccatgttggccaggctggtcttgaactcctgacctcaagtgatccgctggccttggcctcccaaagtgctgagattagaggtgtgagccactgcgcctggcctacttcatctattatacaagtaatgtatactcattcaataaaaagtcaagcaaaatgaaaacaaacatcatccctaatcccaccaatgaagagttactatcctaccagcatttttctaagcatatatacaattttaaaagaagcacaaaagaataatattgggattatgctgtatattcagctgtacattctttcttccatgttgtattgtgagtatatctttctttacatcacttaaaataaccacctagtattttgttttatggaatacaatattattttgttgatgaagtcaaacattagattgaaccatatatctgacctttttttaacctataaaaatagcaattgcctgagctacttgggaggctgaggcaggaggatcccttcagcacaggagttcgaggctgcagtgagctatataattattcctttgttgtgggacatttaggtcatttctaaactttcaccaggttgtgataaacatcttttagctcgttttttaaaaagtattttttattgaagtataattttatcattttcttagaattctcagaattagaattggtgggtcaaagaacagatacatttctaaggtatttaatactttgcaaaatgccttccaagaagattgaatcaattgatttattcccacaaacattatatgaaagtgcgcatttctttatattctacctttcacagtgggtattataatttaaagagtctgggcctgggtgtggcagctcatgtctataatcccagcattttgggaggctgaggcaggaggaccacttgagctctggagttccagaccagcctgggcaacataatgagaccctgtctctacaaaaagttacattaaccaggtgtaggggcttgtgcctctggtcccagctacttgggaggctgaggtgagagaatcgcttgagccaggagctcgaggatgcagttaactgtgattgtaccagtgctctccagcctgggtgacagagcaagagcctgtctcaaaaacaaacaaacacacacacaaaacacaaaaaaagagtctgggaaaaatagcaataatagttaacatttattgaagttttttttggagatggagtctcaatgtgttgcccaggctggaatgcagtggtgcaatctcagctcactgcaacgtccgcctcccaggctcaagcaattcccatgcctcagcctcccaagtagctgggattacaggtgtgcaccaccacacgtggctaatttttgtatttttagtagagacaggatttctccatgttggacaggctgctcttaaactcctggcctcacaagtgatccaactgccttggtctcccaaagtgctgggattacaggtgtgagctactgcacctggccaatggatcttattcttatcccaatttttttttttttttttgagatggagtctctctctgtcgtccaggctggagtgcagtggtgtgacctcgattcaccataacctctgcctcctgggttcaagcgattctcctgcctcagcctcccgagtaactgggactacaggcctgtgccaccatgcccggctaatttttagtagagacggggtttcactatgttggccaggctggtctcaaactcctgacctcgtaatccgcctgcctcggcctcccaaagttctgggattataggtgtgagccactgagcctggcctcttatccctattttattgatgaagacattgagacacagagtttaagtaactttcttaaggccacacagcttgtaagaggcaggatgatgactcagacccaggcagtgtgactcttgagtttgcactcattacctctacactatattgcctcagtgtatcattgttataatggaatttctttgattatagtgaggttaaacatttttcgtatatttacaggctacttaacaactgtttgtctttttctcatggcttttttgactgctgccattctgggaaaattttaaagcccaacattatagttaacttccttcattgtttctaagggtgaggtcatggaggcttggtttctgataaaatcctctccatatttagctttagccttgtaccttcagaaatggttattgtatttacttcagagtttctgtcacctgagtctggttttttttctttatgggaggaaaagggcttttttttcttaacattttggggaaatcaccgtgttttatcactgtaccatggctgcacttttttaatgacaccaaatacacgttagagctccccaggtgttcttccatacctaggcagggagtagggcttggattttgctcaggccttgtgtgattggctcagactcacatcctatgtttacattcctgtgtagaatttccaggcctagtgtaatctcccagccggagcagaaagaagagccatgggtcctaccactccaaaactttgaggcgaggaagatcccgagggaaagccacacaggtgagatgtgagtgctccccagtggaaggaaatctagcatttcagccttgtttagatgaagaatttggaatgctgccttagaattttgttcttactagcagacattttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccactagcagacatttaaatttgacttaatggtcagtagttgactaaataaagtcttcattttgattaagcatttcacttttgtctaacctatgtttttttttgagatggagtctccctctgtctcccagcctggagtgcagtgacacaatctctgctcactgcaacctccgcctcccgggttcaagtgattgtcctgcctcagcctcccaagtagctgggactataggcacccgccaccacgcccagctaattttcatatttttagtagggatggagtttcaccacgttggccaggttggtctcgaactcccaacctcaagtgatctgcctgcctcggcctcccgaagtgctgggattataggcgtgagccaccacgcctggcctaaacctataatatcttctaaagaaaccgcacaatattgacaatatgtggtctccgcttgaaggatatcaagattcatctggccatcttaaaatttaaaaagtttaggaattcacgtgttctgacagctcaatgaacctcaataaacttttcacaaagtgaaaacagagcggttgaattaagtgcagtctgctgcagaaacagggattttaatctttgtcactgctttctgatattccttcctgataactgataactttattctctgttacttacattaatttttcagactgtgagcatcaggtggcaaagctcaatcaggacaattctgaaacagcagaacaatgtggaacatcctcagaaaggaccaataaagatctttctcatactcttagttggggaggaaactgggagcaaggcctagaattagaagggcaacatggaacccttccaggagagggccagctggagtccttttcacaggagagggatttaaacaagctcctggatggatatgtaggagagaagcctatgtgtgcagaatgcgggaaaagctttaaccagagttcctatctcataagacacctaagaacccacactggcgagaggccctatacgtgcattgagtgtgggaaaggcttcaaacagagctcagaccttgtcacccatcgcagaacacacacaggagagaagccctaccaatgcaaggggtgtgagaagaaattcagcgacagctcaacactcatcaaacatcagagaacccacacaggggagagaccctatgagtgcccagagtgtggaaagacttttgggcggaagccacacctcataatgcaccaaagaacccacacaggcgagaagccctacgcgtgcctggaatgtcacaaaagcttcagtcgaagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttaggagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtctatgttataacagagaggataaacttaaagggtccaaataacggtccgaatacaaaaggcattccttca

SEQ ID NO: 775 - DNA, 114003 bp, Homo sapiens
ggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctgtgagtgcggggctccgcggcgcgggggcttcgggctgggctaattgcagacgaggcgcgattttcctgggggctcggccgggcgggtggggcagggcggctgccggcagctcggacccggaagagccgtcccggtggggcggcgggcggcgggcggggaggcccctggttcgcgccccctcggggtccgaggcggcggagaggacccccgaggcctcccgccttagctggggccgcggtagggggagccccacccagcgcctctcgccgcccaggctcggccgagattggggaagacggcctagagtgaggtggcaggatgaccgcgcagggcgtgtcccggggattgggggtctgggtacgcgggctctgcccgtttcgtggaaaggcgctgccctagtgttgcctgcggggtagacccaagggatagaccagggtccagacctgtccggtcccaggctagctacgaggtgccgtcctgggcaagtcacttcagttttctcgggcttagttccctcctcaagatttcaaaagtaaaatagtaataaagaaaaaaaaaagaagcagaaaatcctctgacttcctcattttctgttgtcggccctggacgtcattgaactgcaggcaggattggctaaaggaggaccctttgggattttgaggttttcggttttattttatattgtgggaataatgttcttttttaaaggatcaacatttcacgcatcaacagttatacgtgaggtattgtgccacgtttgtgaaattaaagatgagtaagatcaggccctgtctccaaagagcgttttaatcagagagtcaggtgtgcaagctaatgattataaggtgcaataatgataaaagatgctgaacttactagccatacagagtaatgtaggtaaggagaaggggcctggggaagacagtatgagcacgggaggtgacttttttttttttttttttggagacagggggtcttgctctggtcgcccagcctggagttcagtggtgcaatctcagctcactgcaaactccacctcccaggttcaagcgattctcctgcagtctcccgagtacaggcgtcggccaccacactggctaatttttgtatttttagtagagacagggtttcactgtgttggtcaggctggtctcaaactcctgatctcaaatgatccccacgcctcgacctcccaaagtgtgagccactgcacctggcctgaaggtgacatttgaacagagccttgaagaatgctgtgtagaaagtttgacaggtggccaggcatagtgactcctgcgtgtaatcccagcactttgggagtccgaggtgagaggatagtttgaggccttgagtttgagaccagcctgggcagcacagtgagactccatctcttaaaaaaaaaaaaaaaaattagccaggcgtggtggcccatgcctgtggtcccagctgcttggggctgaggtaggaggatcatttgagcccagaaagtcgaggctgcagtaagccatgattgtgccactgcactcgagccggagtgacagaacaagaccctgtctcaaaaaaaaaaaaaaaaaagtttgatagggcatgtggaacaagagacaggacctgagggaagagcataaacaaaggtattgaaagtagagggatactgtgttgggaactgagtgatgtagactgcacagtggtgggaggaagggaagaggagagtttccaaaaatagttgggaccagactgggaaaggccttgaatgccttcccaaggagttaggaatttattccacacctggtgcccatgaaggaagcagattgcttcaaggttaagctcaggctttggagacagactctccaggtttggattcaggccctgtcacttatttgccatggggctgagttcacccagcctcagtttcttcgtctgtaaaataggagtgataatcacaggattgttgtggggtttcaatgagagaatgcgtgtaaaatgcttcgtacaattactgccacttatgtctcaataactgctggctttggtcattaataaaagagggaaacaatattatcagatctgtatttagaaggagttctggcagatagggacagatttgtgccaaaatctcaagacagtatttttcaagattacactgaaacttagtacatatttatattatcatacatttttaaaaaggtcaagatgattatagttgaaaccacatagttctttttttaagaaagtcattgtagtacacctggctggctacacactcattagttatcctgactttctaggtgagtggcaggaaattgattctgtggcaatcttttatcactcaggaaggctacagatcctggtgtttacattctttcttttatgttgtagctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaaatatttgtaattaacgtttaataaaaagggtgtttgaagtggtgctaataaacaagtgtgtgtgtatgtgtgtattttaattctgaaaatcttaaaatgctacaagaaagtccagagaacagtacaacaaacatcattgtattccagaactaacaaatgttaacatttgagatatttccctttcctctaaaaacaaaacaaaacaaaaccaacatcgctacatttaaagtcttttttgtgcccctctggtcccattcttccttctcctggggcaaacactaacctgtattttgcatgccctcttgtgtctaggcttcttttctgagcttaaaacttccaggaaactggagcttgggtttcagtgatgacttaagtgaggaggataacacttgtctttctaaataatagaagatgacatagcaaggcatgctatatcactagaaaagggggcattttctcatatgaagtttataagaaaacaaaaactgtaagatctctgccatttaaattgtggatttcaaggtttggaaggtcaaagaatttggaagctgcagctgttctgagagaccatcttgtgctctgtggagctttggtgattccactgaggtgacctgggggtgagagggaagagcttcaacacaccttccttcccccatccaaagtagctctgcttttgttttactgttgaatttcttgaataaaattcacttgttacagagggtgttttggctaacacctcccctcccccaaacactaccaataactagttcaactgctaatctagttcaaccatctcatttaatgaagaaactgaagcctgagttttttggtctacttgtagttttcttgattgaagaatgtttctatctttttttttttttttttgtacagtctcgctctgttgcccaggctggagggcagtggcgcaatcttggctcattgcaacctccacctcccgggttcaagcgattctcctgcctcagcctcctgagtagctggaattacaggcatccgccactacgcctggctaatttttgtatctttagtagagactgggtttcaccataatggccaggctggtctcaaactcctgacctcaggtgatccgcccgtctcagcctcccaaagtgctggaattacaaacgtgagctgctgtgcctggcctcatcatttttttaactatggttgttaaccaggtgtgtgcattagaatcacctggggaacttaaaaaaaaaaaaaaatacacctatctgggccctaccatagagattgtggttcagtaggtcggggtgggagatccagacacatagtagtcccttggtatctgtgggggtttggttccaggacacctgcagatatcagaatccacagttgctcaacttccttatataaaatggcatagtatttgcatataaccttagcacattgcataatatatacttgaaaacatctctagattacttatcatacctctagattactctagatatatctctagattacttatcatacctgatccaatgtaaatgctacataaatagttgttacactgtattgttttatttatatctttctttatttttttctgactgtttttgatccatagtttgttgaatccatggatgcagaacccatggataaggagggccgactgtattttaaatgtctctagtgattccgatgctccttccttggcccccactcctccccctgttgagaaacaagatttaaaactctgccttatgctgggatatcatgacctcagtagaatgttacacttcatcctatttcttcatcaggttctgcattagccaggcattttattttcagctactctagagcgtctttttttctgtcaggtgtttttttccagtataggaaagtagcccatttcctttaaagaccacccagcaggcatgatcccctgaggtgtttttttgttgagtgcttttgcatacttaaggagtaactgacctggcccggtggctcacgcctgtaatcccagcactttggaaagctgaggtgggcggatcacctggcggtcgggagttcgagaccagcctgaccaacatggagaaacccccgtctctactaaaaatacaaaattagtcgggcgtggtggcgggtgcctgtaatcccagctactcgggaggctgaggcaggagaattgcttgaacccgggaggcagagcttgcggtaagctgagacagtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattaccctagcacaccctgcccattggcctggcatcatggaaaggtgcctggtctattttatggaggcaatcataaaactgggtgtggtgatttttgttgttgtttaaggctttgattttaaaaaatcaaggttggaagcacctatttagattgtaaactagagaggacaaaggaaagaagcctgggaatgttatggtgagaaaagaggactagaatccctgtcagccacctatgtggctgctgccacccctaaaaagtgttgtgagtgcaccaaggacaaatggcatgctcttcgttattagtgagctattaacctcttccagttctttctcctaccttggtgaaccggcctgtatcttgtgtgttccgagggcccctctttcccctctagcgctagacccagtttgcctttttggtttggttccatcctgtttcctccataacctccacccctcccaagttggaggagccccaatatctgggatttacagtaactctaaggccaggaataaagatcatagagattggagggagaaaagcttcccctcttcagttctatttataatacctctacttctactaaaagctccaccttttagtacagtggccccattgtgtatcctagggcactccattttctcctctgcctgtaacagagctctttcttgggaaaagagaggagtgtgtagagagtgaatatgactgtgtagaggcagtgagtataagtaagagagtataagtgtagagagacgaaagttttctgtggctgtgggtttgtgtttccctgaaaggttaactgggaaaatttaggggtaattcctataaatgagcactgggagtggttgagaaatagaaaatgtagagatttctgcttttcttcattgtttggagagcagcttcaatattgaaattaagccgctgttctaatgagatatcacctaacgattcaaggctttttgctaagggctgcacaatagatcaaggatacatcttaaattattatttatgcttaaattgaagcttatttttatccttttgcctgttcttattgagttttacatttgtttaggctaaggagcggggttttttttgtttttttgtttttttttgaaacggagtctcgctctgtcgcccgggccagagtgcaatgacgctatctcggctcactgcaagctccgcctcccaggttaacgccattctcctggctcagcctcccgagtagctgggactacaggcgcccaccaccacgcctggctaattttttgtatttttagtagagacggggtttcaccgtgttagccaggatagtcttgatctcctgacctcgtgatccgcccgccttggcctcccacagtgctgggattacaggcgtgagccactgcgcccggccggctaaagagcagttgtataggagcaatgaataccgtttcactcagttgaaggaggtaacatttaaatatgtgaggtatgttcagtgcttaggtcttggacaggaggaagtaacagatcagaataaggttcaggtgaaaagaaccaagaagagaacgtgtcaggcaggacagaacagggaattctgcaagtgagaagaaagtacgattagtactggaaatggaagaaaattcagctaggttaaaggtcacaggaagaaagttaattccagcattctctgagtttcagacaattcctggtgtgcgctttcaagtctgtcatgggccacctttctgctgctgagtgcccgtaccctagctcaaggaatagggcacacccctcttgtagaagggaaggtaggaacgctggctggttggagactgtcagcaactccacggtgataagtcgagcttagcactaagtagaagtatgtcactttctgtaatttagaggaattgaaaaggtatcttggaaagaaattagttcttgggaacaaagtcttttttgtgcatatgtctttactgttggcatagagcattttctgggatgggctcttcagatctcctctccctgtaagtgatttcagaattccatgaatgttgggatatgtccaggctggcaccctgggatcatgaaaatagaagttaagacatttaagaagcaagaaaacaaaatgggtaggtgaggtgactaggaagaatatcatgcccagcacttctagaattctcaaaatgaggagcatcacttaaattttgagggggatcatttttaggatggtgacccaagctctctttgtacagatgagaagtctagttatctcatgagacccagtgtgactaaaggaccatagcatgtagctgcgtaatggcacggtggcactaggagctgatccattcatttatttataattaccaaggggaagtatggggtgagatttattcttaactcttaaaatggtgacatacactattttaagaataaacctccattcttttttcggatattaatttagtgcaacggccttggacaggctccaccataagaagtgggttgcatttaaaagtgtatttattaaaagtggttgaagctgagtgcttttctgtattgtaacactgttgcaaatggggagtattcattcctaatgtggctgccgaaagctttttaccctaccatgtagctgaaaatttagcaaaaaaaattttttttttttttggagacggagtctcgctctgttgcccaggctggagtgcagtggtgcgatctgggctcaccacaacctctgcctcccgggttcaaacgattctccttcctcaccctcccgagtagctgggattacaggtgcccactgccatgcctggctaatttttgtatttttagtagagatggggtttgaccatgttggccaggctggtctccaactcctgacctcaagtgatccacccgcctcggcccccgcaaagtgctgggattataggcgtgagccactgcacccagcctagcaaaatttaaaattaagaaatgtaaagagttgaactagttagtacccattattattaagaaaagtcatgtggctctatattctcatagtacgaataattaagtaaaatagaaattcaaaagtatgaataaaatttctttgaaaatcttgaatgttgagatatcttgccacagtgaaaagaatcagactttctgttttggcaggtgtgagttctgattctggttttgcaagttgcttaacgtcagggagtgagcccaaatttgtcctttgcagaatgggaacgctatgcatcttacagagctgctgtgatggttaattgcttggcacagtgaaatacagtaggcactcaacaaacttttttttttttttttttttttttgagacggagtcttgctctgtcgcccaggctggagtgcagtggtacaatcttggctcactgcaacctccgcctcccaggttctcaccattctcctgcctcagcctcccgagtagctgggactacaggcgcctgccaccacacctggctaattttttacatttttagtagagatggggtttcactgtgttagccaggatggtctcgatctcctgacctcgtgatccacctgcctcggcctcccaaagtgctgggattacaggcgtgagccaccacgcccggcctgaactcaataaacttttatccaagcacctggataaaggatatcctgaattttttcttttctttttttttttcttttttttttttgagatggagtctcactcttgttgcccaggctggagtgcagtggcactatgttggctcactgtaacctctgccttctgggttcaagcgattctcctgcctcagcctcccaagtagctgggattacaggtgcctaccaccatacccagctaatttttgtattttttagtggagacgggggtttcaccatgttggccaggctggtctcaaactcctgacctcaggtgatccacccgccttggcctcctacagtgctgggattacagacatgagccactgtgcccggcctcctgaattttcacattaaatctgcaaaaggaaaagcagatttaatgtgaagatgacaggaattttctgggcactttcaaggtcctaaggttggtagccctagttttttcacttcagaccttagcttttatctgaaggaaaacaccagaaacagaagatacttctagggagtggaatgggggtagagggtgtgagatttcctttttacttaatactgtactatatatttaaaatgctttttacagtgataattttataataaaggaaaagaagggattaagtaaaaggaaaaactgtgtatataatttttagatataatcacaaattcagatttttaagttactacacagatgttcctcgatttaggagggggttatatcccaatattgtaagtcaaaatgcatttaatacacctaacctactgagtatcatagcccagtccaccttaattgtgctgagaatactgatgttagcttacagttggacaaaattatctagcacaaagcctatattacaataaagtattaagtatcttggctgggcgcggtggctcacacctgtaatctcagcactttgggaggccaaggcaggtggatcacttgatgccaggagttcgagactagcctggccaacatggtgaaacctcatctgtactaaaaatacaaaaaacattagttgggtatggtggcgtgtgcttgtaatcccagctactctggaagctgaggcacaagaatcactggaactgggaggtggaggttgcagtgagctgagatcacgccactgtactgcagcctgggtgatagaaccagacattgtctcaaaaaaaaaaaaaaaaaaaaagtgaatataggaaatcttccttgaaaaaacaaagatactcctacctcagcttctcaagtacctgggactataggcccacttcacctcacctaactaattaaaaaaaatttttttttttgtagagatggggtttctctatgttgccaggctggtcttcatctcctggggctcaggctatccttcgctaaagtgctgggatacaggcgtgagcagccacacctggcctgtattgtcttaatttactattttcagtggccatctaatgttcataatttatttaggtttattcctgtttaaagttctattgctttgattgctggagagtttaaacattttcttacatatttgtttatcagtattattttcttatgcaaattttctgtttttgttatgtgcctggcttctagggtcatgatgttaacttttgtgagctcttttataacatggacttgactttctctcgtatttgctacaaacattttcccttgatgtttcattgtatttgttttcttcattgtagttttaaattttattgagtttaaatgtcagtctttcgatttgtaatttcttctatcaactcgaagtctagatagtttaatttctctaaaaccttgccaaaattttcagtttaataatcgattggcttactttttatatatttgtagagatggggtcttgtaatgttgattgtaaggggaacttatcccgaacttctggccttaggtgatcctcctgcctcagcctcccaaagtgatggaattacaggcctctaatatcctttaaaaaccagctgtttattacctattagcaattcatgtctgttttgtcaaatattatgtatatatatatttctagttctggacttttaaattatggtgaaccatatttcatttttttgagaaaaatatatatgactttgttatacttcttatcattgagaaacaacatctgaagctagcttaattttaactctatgacaagtaacttgatttttttttccttttttcgtgacttgaaatttgtagaattgttgttccttgaggtataaacatttccccagttaacatgttagggttgctattggcttagcaattttgcctgcaatgtggagactcttcttggtttataatgtctcttgtttgtttattttagctttaggaaattgtccattatgcctgtggtgattagttagatctgtgtagtctattttatggctcttcttcattttgtttacgttaaataagcgttctaggtatgtgtctcacatacatcttttgttgcactgacttgattttctacagtcttgatattttttccttggttctgttaatggtagttgctttgtcctattgtagtttatatttttaattaattccttttccgtctccattcttgttaatagcttaaatgatctctttttagttcatgaagaagagtgtggcacaaaagatcctttcaaggtgaaaaaaaggagcaggtagccaagatagttgggttacatagtttaccacttccctttataatccgtaggtgttgaaatagatgtggccatgaaaaaccagtgttaatcgggcagctgagtgtatggattgtccaccagtcaaggttggggaaaaaatctggctgggctaagtgtggcccgttagtttgacctcatttggcatgtatttcttctggtcttacaggtcagagcaactgtttttatatattttaatgtccctaatgacaaaatagtaaaaatacatttgaggacccaagttggcatgttctaggaatttcattttccggcttagtgtggtgacctgcctctgattgctgtacaattccttctgcttcacagtgtcacatctggggataccagttggtagtggaacctgttttggacatttttaagccttgtggtatctgatggactcttggttgtttctagctggtgctaaataaaccccttgacaagaagtatttgtgtaagaaagcgctggtaggcaaagtgagaacatccggaagtgattcatattactgtggttgtttgcttaactcaggacttggttgcctagagaccatatcgttgagttagccgagtgaagtgccagtggaacctggagggcctgtggcctaccggatcaaatcagggctctgctccttaatttttctcctgaagtctcctagcaatctgattgatctctgtggtttgacagtgcgtgaattaaaaaaatcttaaacatattaatgtttaagaaagatctggttaatggtttattttgaagagtaagagtttacttgctgaagtttgaatgttgggttaaaattttttaaaaaaatagttgtatgttgggaagaattagttatttcaataaggcattttattctagaaacctcagtactttaaggcagctaaaggaaagccaaaataatcccccaaaacaaaaaaccaaaaacctgcaatttgcaaggcagtcataatctaaaatattttctgtctgtcccaaagtcagtgtattccccttgcctctccccctcttcctcattgtcatgattagtaccgtttattgcatactttctacatgcaaggcactgtgctaagcactttatatgctttatctaattagctattcttgaagccctgtgaggtgcttattatctacatttaacagataagaaagcaaagctcagagaggttaactcattcatctaataagtggttgatccagatttcaggtttggcaagaactctgaagtcctttctcttaactgccatgttagtctgctgctgctatacttctggttctaaaaataatgacaacagtagtaactactgttaattaagcagaatgatgatgaaatttacatattacattattgtgagataggcattatttttattttaaagagggaaaaaaatagagttgataacacttttcccaaggtcatatattggaattcaagcccaggtttgtgacaccaaagctggtgctcttaacttctgcagatgctgaagtggcaacatttaagtctaacctctttaactggtgcccagagacattaagtaacttgtgtagttttcaagtcagtgagggaactccatcaatttcctgccacttattttggagtctcttccacctgccacctgagggaaagtctccagttgtcttatgtatttttgtgtctaactagcttgttggacccttcctaattgcttcccttcttcataacctggtatctgctttgaattcagcttagaaaggtgttccttcctaccactttcttgtttgttaaagagttacctcatacagacaggagtggcaaattggattggaaattgctttggatcatttggcaagaactgtatttttggggttgtgggaggaggagaggcctgtctaaaagctctatttcttctttactcagaataccttcctgttgactcattggaaatcataacaaaaagcagaaggaatattggagaggcagctgccagcctagggcttggcttctgttggggcagctgtttggggatttagacacactgggctctaagaactgtgaggtttctgcagcagaaggaaatagtattactctgataggtatttattcataaggttaaaaagtgtcagactattgcttgggattattgatgagcaacataagaaactaaaaatattttctcaaatagaattaactggtgatcctaaaaacagaatgaattgaggaatacaagagggagtgggggcaaaattagaaaaggaaaagttgaaaagaagagaaaaaaaacttacaatcattaaaaataggaaaaagataacatttaaatagaaaaagtctcacagatatgcatgcagtaggcattaatcagcaggtcattttactgtaagtaacatacatctcagatgacctttaaaacagctaaaagtaaacaaaatttgtcttttatttaaatgactattataacaaaatgtttttttgggctgggccctgtgattcacaccagtaatcccaacacttacggaggccgaggagggaggatagcatcaggccaggagttcatgaccagcctgggcaacatattaagaccctgtctctacaaaatataagaaataaaaaaaagccaaacgtggtggcacacacctgtagttccagctactcgggaggctgaggtggaaggatcacttgagcccaagagttcgaggctgcagtgagctacgatcacactgctgcacaaaaatgtgtttcttccctgaagacatgctatgtcattagtttgggcaataccttttcataattgatagtttaaaaaggtagtgtttgacaatggcttgacttttggggttttccttaaaaatttgagaatccccataggaatgttttttagatagatttggtcttaatttaaaatttttaaatttaaaacatttttttcttagaaataggtaatacacagacgtgatacataattcagagactatgcaagtatataacactgaaaaaaagtctatatccttagtcttctttctctagctattcagttattttccccacatggaactgctatcatgattgtgtctctttccggagatattctgtgcatgtaaatacaaattactttgatttgtttagaagtggttgcacactgtacattttgctttacatctttttgttgttgttttttgagatggagtcttgctctgttgcccaggctggagtgcagtggtgtgatctcggctcattacaacctccacctccagggttcaagcgattgtcccgcctcagcctcccaagtagatgggactacaggcaatccgccatcaggcctggctaatttttgtatttttagtagagacagggtttcaccatgttggccaggctggtcttgaactcctgaccttaggttatctgcccgccttggcctccctaagtgttgggcttacagacatgagccaccgttttgctttgcatcttaaaattcattccatatgagtgaatgtggaatgaagtgcctctttttttccttcacagttttagttttcggttttgaagttaacctgtcaacggacattttctcctcagcttttgctgttataaaaagtcactttgtaggtatgccattgtgcatgtatgagtattcttgcaggataaatttctaaaagtgtaatttctgggtcaaagggaatatgcatatttagttctcaaaaatattgccaatttgctctcgtaagaggttgtaccagtttgcacatctgcctgtcaataatgtacatataagaaggctgtttccgctttaattttaccaacccagagtattacagattttttacatttgccagtttcataggtgaaaatggtatttcattgtagctattttggattatctaattatgagtgaagatgagcatctttacatgtgtttaaaagccatttgtatgttcttttctgtgaactttttcggtagaatcctttgctcatttttctattggattattcatctttttcttattcattgtggtaagagctctttatatattgaggaaattggctcgttgtacaccgtgggtgttataaatattcattccactttgtcctttaattttttttttttgagaaagtctcattctgttgcccagcctggcgtgcagtggcccgatcttggccaggttcaagcgattcttgtgcctcatcctcccgaggaactgggattacaggcgcgtatcaccacactcagctaatttttgtatttttttagtagagacagggttttgccatgttggccaggctggtcttgaactcctgatctcgggtgatccacctgcctcgacctcccaaagtgctgggattacagccaagagccacctcacctggccattgtcctttaaattttgactttgtatttcaaataaagttttaaaacatatttgaacttactaatattttacttttagtttttgaattttttgcatgatttttaaagagtcttatctatactgagattatataaaaacattctcccatgttttcctctagtatgtttaggatgtaaagtgttttaatatttaactctttgatccatttggaatttattttggtgtgaggagtaagatagatcctgcttttttgacttttgaatcgtattttacattttgagtcttagcagtgtcttaggaaatgtgctctggagggtgtcttgtgctctagtttatgaactgatatcttaatttttttcagaacaaggcagcttcaactgttgagctttttgaaacatatggcttaactatcattttagggaatttggttaggattttccagagtgctttcaagcaagttatattgtaatgctaaacagattaatatcgtgtagtaaagttggcgttgagaaaacaggttttgaattaacagctttgacataaagactgtgaagagattactagacttgccaaactaacataatttattctttgtgtaaaggagagtgcaaatttggagtttgaaaaactgtgtggctgactttctagatcagtattttttgaggtatattgtgctgtgacattaaagaaagggtttagtggtgaaataagcttcagaaatactgagttaaaccaagccaaatattattcaagtggcaaattatttggaatctttgtcatagacttgtaaattctgagtctccaaggcaaaggatagtgtatgcaatattcctcaaacctactttatcaatagtgttccaggttttttttttttttctggtttgcgaacacttttttttctatcagttacggatttgagggactattttttctttcttttactttattttttatttttggactctaagactttcttcagagactatttcaaataagaatttgggagatgttcatggtcacttctcagctattttgtgttttatgatagttagtttacattctccgttgagttatcctgttcttggcttatagagcttaaattaaagccataattgtactaattggataggtataattgctcagtgatctttaaggcattgcaaaggacgggagtgtggtttttaaaaatgaggggtgcaaatgtactaattattaaaaaggaaaagataaatatgacaaattctggtctagtaaactagtttctggccaaacattggaccagaaaaattccagagcacattgtcagatgcataacttatgaacacttagcgagaaaagtgatgcttgggagccaacatgggctccctaaaaaaagccctgtcacattaacatcatttccttttggacagggtcaccagattggtgaatcagagaaaaacacacgcctggcaattttttgtatttttagtagagacggggtttcaccgtgttaaccaggatagtcttgatctcctgacctggtgatccacccgcctcagcctcccagtgctgggattagaggcgtgagccaccgtgcccggccggggtttgtttttggttgatgaaagtgttctggaattagatagtgatgacggttgtacaacattgtgaatattctaaaagcaactgaattgtatattttaaatgagtttacgttacgaatcgtatctcagcaaaaagagctgcagatttttagttcagagaaagcacttttagggcatgttatttgtaaacatttttattgggacttactagggcgtcagtgatgtgtcagtgaagttaggattttacttgtttctagagagatagttaatatattgtaaggcacattttgctttcaatgtaccgtgaatctaataatgaaattcaatagtaataagtgtgatgtcctacattggagttcaaaaagtgtataggataagggagagaagtagcgttagtgggaataacgttggtgggaaacgaaaacaaaatgaaagaaacctgagaagttcattaactcattagtagatatatggtatatgcagccaaggaaaagatggttccactgtcctctggactaatcagaggcttcctgaaattggtgtttagttctggaggccatactttaagatggatctcgtagtctagagcaaggatgttagatttgtggtaggttattttacacccacagcaagcactgctgatagatcagaatccttttcaacgtagaagctgaggaaccactcccaatcagtgggtgttggttgtccattagttgagacttagttgttgctctgggatgagagcgtgttcgatgagtatgaccaggatgataaagggtctaccaattatgatctatgaagaataattgggaatactgaggctatataaaatggaaacaagatttagaagaaatataaaatcagaatctcagaagctcaacctttcatctagtttaggaattcagtcaactgttatattaacattttacctactttactaaaaaattcctgagagatgggaggggagttcattttgtcagatgtggtgccaggggaacagaactagacaatggaaatctgcttaataggaggatagtttcttatataacaataagaaatttccaaacggtgtctgagctgctttgggaaaacccgtgttgcagattttcaggtttagactgtgtaacagtttaatggaagattgttatgttctaacctaagtattttctcgttatttaaaaacaatttttatttcatttcctgtgttattaaaaactatttttattttgaatgacttgatactattccattgctcattttttctaacatggctaagaagttgggaaaattcctccaataaaataattactttaaagcaagtaaaacacgtttttagctcctccattgttcaggacactctgggagaactgaagaagatgcgaaagtataaaacagtcctgcccttaggagcttacggattaattgaagacagggcataaacatttgaaaagttacccaacatcagagaatgagaggtctcagtgtcacaaggcaatatgtaattgctgaggaaatgatgcaaatagttaatgtgtgagagtttagacagggaaagattattttatggctgggtttttcaggataagctgacattgtatggtcaggcgtttccctttcaagggaaagcataacactatgtatacttgtcttgttctctgtgctcctttagagttgaagctctttccacttcctggtacccaatggcacctctcaccacagtgctttttacaaagtaggtgcttggggatattgttaagttgaatgagtacagagttgtgtggtatgtgggggttgtggtaggaaaaagaatttcagtgttatggtgataagagcttggggtaattttctgttttggtttttgtttttcttttattatttggttataattgagaccaggagtaatacggtccctaagcaagagagaaagagcagtgtgtgtctttcagtagagtctttctaatttattcaaagataaattagaaaaggattctacccttatgtacataaataactattaggcgataaagagatataaagtgccataagaaagtttagaggaagtttggaacgagaagagattatttctgatggtaggtcatgaaaaggttcgtggaggagaggtgacttttgaaggtaacatttgaattggcagggatgggtggggctgatcacctaaaagttatactaaaccttgtattctttgtgggcatccctgtctctaccttcctgcatcgtggcttgatgacatctattttctctcaaaacttcttcacattttggccctaacaaatttaccccatctcatttaacatgctatcacttaaaaaattaattaattaatttttagagaaagggtcttgctctcttgcccaggttggagtgcaggggtgcaatcatagctcatggcagccgggaactcttgggctccagccatccccagacctcagccttgtgagtagctgggactgcagatgcatgccaccatgctggcttaacatgccatcttgacctctttccctgtagcagtgggaaaaacgtatttttctcctaacacttaaccttctatgtgtgatctagatcctatcccttcttgtcttctagggttcttattccaatattattttcccaactataacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggcttcaagcgattctcctgcctcagcctcctgagtagctgagattatgggtgcccgccacaacagccagctaatttttgtatttttagtagagatggggtcttaccatgttggccaggctggtctcgaactcctgacctcaaatgatccacccgccttggcctcccaaagtgctgggattacagacgtgagccactgcgccaggccttaatttttacatttttttgtagaaacgggtttcactgggttgcccagcctggcctcgaacttacgaactcaagtgttctactcaccttggcttcccaaaatgctgggattgcaagtgtgagccactgtgccctgcccctatattcacttccttaacttaactcatttggatgtaattcctgtgccttccttttccccattgaaatttctcttgcttagttccaccaacagtgtaaaagtgttcctatttctccacatcctctccagcacctgttgtttcctgactttttaatgagcgacattctaactggtgtgagatggcatctcattgtggttttgatttgcatttctctgatgaccagtgatgatgagcattttttcatgtgtctgttggctgcataaatgtcttcttttgagaagtgtctgttcatatcctttgcccactttttgatagggttgtttgtttttttcttgtaaatttatttgagttctttgtaggttctggatattagccctttgtcagatgagcagattgcaaaaattttctcccattctgtaggttgcctgttcactgtgatggtagtttcttttgctgtgcagaagctctagtttaattagatcccatttctcaattttggcttttgttgccgttgcttttggtgttttagacatgaagtccttgcccatgcctatgtcctgaatggtatttcctagttcaaccattgtggaagacagtgtggcaattcctcaaggatctagaactagaaataccatttgacccagccatcccattactgggtatgtacccaaaggattataaatcatgctgctataaagacacatgcgcacgtatgtttactgcggcactattcatgatagcaaacacttggaaccaacccaaatgtccatcagtgatagactggattaagaaaatgtggcacatatacaccatggaatactatgaagccataaaaaaggatgagttcatgtcctttgtagggacatggatgaagctggaaactatcattctcagcaaactatcacaaggacagaaaaccaaacaccgcatgttctcactcataggtgggaattgaacaatgaaaacacatggacacagggtggggaacatcacacactggggcctgttgtggggtagggggaggggagaggggggagggacagcattaggagatatacctaatgctaaatgatgagttaatgggtgcagcacaccaacatggcacgtgtatacatatgtaacaaacctgcatgttgtgcacatgtaccctagaacttaaagtataataaaaaaaaaaaaaaagaaaaaacattcccaagatcccctcaaaaaaaagaaaaagaaaaagaaatttctcttgctcatatcaccaatggcctaattgctatgtcccatggaaatttttctagtacttaatctctgcagcatatgtcactctttcctgttcaattcatggagttttcttccttttaattgggtatcttttttatgctttttgaatttcgaactgtgtattgaagtattgacctgtgtaaaaaatatattgcctatctaagaaaatcagttagcattcctctgggaaactcacttggccatccatccttaccccaggtctaagttagatgttcctctctcatgtatctttattataacttttctctttcctaatgcactgttagccttagaaggcaagtactacgttctttctttctttcttttcttttcttttctttttttttggagacagggtctcactctgttacccaggctggaatgcagtggtgtgatctgggctcactgcagccacaacacccccaggctcagatgatcctccttgtctcagcctcccaaagtgctgggattataggcgtgagccacctcacctggcagtactgtgttcttaatgtatatcatagttaacccccactcccttattttcttactaaataataggtgtgaaaattaaatttttgacatatatggctctagcagaggattgcttttacagagaaataggtgcctgtcttctactttgtagaggactcttacctgttgttttcttctcaagagctgctcacaggttagtaatgattaggctgtagagctgctcacaggttagtaatgattaagctgtagcttctgagacttagctatcatctagatttaactcagttttggaatttcatttcatttcatttaagattaaaaggtctttcatgctccatggtaagtggtaaactagggatggatggatagatagacagctgaccatggtaatgtttcaccagactctggatctgaagacttgatcaaggagtaagtaatctattagccgagacttaaacaaacgaaaaactttattggagtttaatacacatcccacaaaatccacctgtttttttaatgtacaattcaataatatttagtaaatttgctgagttgtgcaacccatcactatgatctagtttccatttctccaataagaccagggactctattaaaataaaacaattagacatgtaattttgacaagtagacttgacctattctatctgattatgctaagaatgaagtgatttgctcaggggtctgtattagatataaatacacacagaagttaaatatataacttgaagcaaaaacatttccctgtttttcacttattcctatagcttttcagattggcctaatttatactcaggtttcctttaaaacagatactatcaagatttctcattttgcttgtatggtttgaaaaacaagccttttttgttccttggctggattactgcaatactttctttagtgtctcctcacttctctctagccctttctcctacaactgctcagaatggtcttttgaattaaatcttattctttaattcctgtgtaaatccttccaagggtctgcacattctctgcccttggcctgacgtattctcccttatcagcacataccacaagtctttcaagacctataaaatcagtaccattttctctgggaagtcatcctgattcccctctttctgcgtatggtgaagaatgctttatggaatactctgcattcctttctctcaagacttagatttaccattaccatatggaaatttctaggctgtttccaatgcctaggtggtgctcagaagtgttagtggtttagtagaatcctaattgtggagaaagacagccaaatttgggaggtttttagcatagagtaaccctggcattcagggatgtttgctgtgcaagatgggtgtggtaccagaggagctgttcctggaggaactgaatctcagtggcttgaagtggtcagttccggcattggtatgttccccttctgtattgcacagagctgggaaaccactgaagtcatgtgctctgcagaacttgttcaactggtttcctctccacagacccctaattcagatttccacccttattcttttctgcatatgctcttagtctgggcttgttttaaggtttaccacagtagagttctcagtatagttatttatttgtcttgctgagtgtagagtgggtagggccaagtatgtactccctttgaaaagtgttatcagtaagacaagatagacaggtattatgtaaatcatggagtgtcagactccattagcaggtttatttctgtggatctaaccatttcacccccacactcatgtgtacatacacatatacatagctatcattatttagagcctactactagttgctgggtgaggtgtcagagccccggcattggaaagtagtcaactcacaggttggtaggaagaatttactgacagcagtataggtttgaaaaaggaaagttttattagaaagaaggaactctgcagaagaatgcctcagcaagagagaactgagctcgcggtggatttttccttagggtatttatggaacttaaagcaggagcttaagggtagtttggaccatattagccaataggtcatgataaatgattacatttttagacgtaatgtcagcaagggttgcacagggagtttcggcatggcattccagagatgtatagaaagtctagttgcttacaaattttaggttgaaaagagagctggaaccaggtgccgattttagataacagggaagttaattacttctaaattcctcagataagaagttttgcctctgaatggtctccttagtggactccaggtgatcactagtatttggtatgtatcatctcatttaatccttacaacaaccttatgaagtttggtgtgttgctaatcctgctttatatatgggaaatggaagctcagagaagttagcgggtaacatgtcattcttggtttttcttatgtccttccctcttatctcagggaggaagtggggtatattcctttctgtagctggctgccgcctctgctcttcagaaccttgctttcttttgttcttattcctgtatctttagcccctccttcacgtgttcttttcttgcagactataaaaatatgctttttccacaatcatttaaaaaaaataaaaagacactttcccaggacatgtcaccatctcagactaactccttctccgttccccctagtttttcctcttcctttcttacacttctagaaaaagaagttggctgggtgcagtgactcatgcctgtaatcccagtactttgggagatggagaagggggcggggagggagttgggggttggaagtcaagaatctcttgagttcaggagttccataccagcctggacaacatagtgaaaccttgtctccattataaaaaaagtaataataataaaataaaaattagaaaaagaagcctacatttgctgcctctccttcctacttttagttacttttctagttattttaaatggactcctgtgtcaccactccactaagactccccttacaggagccaaagatgaccttgcttgtgtgccacattcttttctcttcaccacccgcctctctgcagcattgaaagctggtgacctctaccagtttgctgattttttccttccgtgattgccattgtgtgattctctcctggttcttaacttgatcacagacgctatctttgtctctttcacctcttaagtgttggtgttctctgaggcacagtgcttcagcttttacatttttctccacagcctctttctctgtgggcttatctactcttgtggtgccattttccagatttaggtcttcagcaacaggtctccctcctgagacctgtgtttccaactgcctacaagatgccactgtctggacgtcccgttgacatttcaagctgaacatgtttcaaccgtgaattgctcatcctctccggcttttgtgggtgtccccattcttgtttaatggcatcatcttttatgtagtcatccatgccgcaagtcaccaaatcatcttttaaaaaataagaaaaaaaccttctcttttcgttttatagaagtgtttgtaagtttgctgtagatggtatatggtgccggattttctcctagaattgtgtgtcagaatgtggggcttctcgacacactggacaacaatgttattttaaaaaatctttgctagtctgatagctgaagatggtgatattgttactttactttgtatttctttggttagtagtaagattgagaaattttcttataaattactggctatatgtatattttatgaatttttaaatttgtgtttctagcatatttttctagggaaatgtttgccattttatttcaagtgtttaaaatgtatatacatgtaaagattatggaatattgttagctctttgttatatgttgtgattttttttcctccagtaacctttcctgttaaagttttatttagttttttaaaaatggccttacagaagtttaaatactagccaatttatcttttcctttctgatttctgcttctgtagtagtgtttgtaaacttctttctcattttaagagtatataactattttttcttttttaaaaaattctctaatccatttggtgtttaatgttagttgtgaaccgtgaggtctggagctaactgcttccccaccctccatgccccctgccttttcagtcatctgtgagatttcacatctttcccactgcccttctaatccccgtgcctcatctaacagattgtcaaatggggtcaattctacctttgtaattgttaatcattctctttccaccattgtcccagttaaagactgtattaccactcacctggattaccgaaatgtttgcctgatatttctcccttgaatctgtcgtccatgctgctgtccaagttctccttctaagtctacttgaaaacctcccatggctcccattcctgcaggttagattactaatccagatacttttacacctacttctctaccacagtgacttaccgttccctgaatgtgccatttgttttcagcctttttttttgtcctttgtattatgctgttccttttttgttttttaatttttttatttattatactttaagttccagggtacatgtgcacaacgtgcaggtttgttacataatgtatacaggtgccatgttgatgtgctgcacccattaactcgtcatttacattaggtatgtctcctaatgctatccctcccgcctccccctaccccacaacaggccccagtgtgtgatgttcccatgtccctacaaaggacatgaactcatccttttttatggcttcatagtattccatggtgtatatgtgccacattttcttaatccattctatcattgatggacatttgggttggttccaagtctttgctattgtgaatggtgctgcagtaaacatacgtgcgcatgtgtctttatagcagcatgatttataatcctttgggtacatacccagtaatgggatggctgggtcaaatggtatttctagttctagatccttgaggaactgccacactgtcttccccaatggttgaagcagtttacagtccctccagcagtgtaaaagtgttcctatttctccacatcctctccagcacctgttgtttcctgactttttttttttttttttgagacggagtcttgctctgttgcccaggctggagtgcagtggcacaatcttggctcactgcaggcttcacctcccgtgttcacgccattctcctgcctcagcctcccgagtagctgggattacaggtgcccgccaccacgcccagctaattttttgtatttttagtagagatgggagttctccgtgttagccaggatggtctcgatctcctgacctcatgatccacctgccttggcctcccaaagtgctgggattacagacgtgagccgctgtgcccagcctgtttcttaactttttaatgatcactattctaactggtgtgagatggtatctcgttgtggttttgatttgcatttctctgatggccagtgatgaccattttttcatgtgtctgttggctgcataaatgtcttcttttgcaaagtgtctgttcatatccttcccctactttgtgatggggttgtttgtttcttttaaatttgtttgagttctttgtagattctggatattagccctttgtcagataagtatattgcaaaaattttctcccattctgtaggttgcctgttcactctgatggtagtttcttttgctgtgcagaagctctttcgtttaattagatcccatttgtcaattttggcttttgttgccattgcttttggtgtttcagacatgaagtccttgcccatgtctatgtcctgaatggtattgcctaggttttcttctagggtttttatggttttaggtctaacatttaagtctttaatccatctcgaattaatttttgtataacgtgtaaggaagggatccagtttcagctttctacatatggctagccagttttcccagcaccatttattaaatagggaatcgtttccccatttcttgttttggtcaggtttgtcaaagatcagatggttgtggatatgtggtattatttctgagggctctgttctgttccattggtctatatctctgttttggtaccagtaccataccatgctgttttggttattgtagccttgtagtatagtttgaagtcaggtagcatgatgcttccagctttgttcttttggcttaggattgtcttggcaatgcgggctctttttgggttccatatgaactttaaagtagttttttccaattctgtgaagaaagtcattggtagcttgatggggatggcattaaatctataaattaccttgctcagtatggccattttcacgatattgattcttcctatccatgagcatggaatgttcttccatttgtttgtatcctcttttatttcattgagcagtggtttgtagttctccttgaagaggtccttcacatcccttgtaagttggattcctaagtatttttatgctgttcctttatgttacatgtctccttttcccatttttcactattggaaatagaatttatttgagcaaagcctagttcagatatcatctcctattgtagctagctgttaaagcataactgttaccagagagtaattcccttgaaggtgctgactggtattcagcacaacgttataccactgataagtgttccacacagtagtcagttcgaaatgtttcctgaatgaatacgtgggtgtcagaatagacacctttttttttttgaggaattgacttaaaatacttaggaaaaaaactttaaaaaatagaataaatatgaaaaggtataagaattactatgtaggctgagcagagtggctcaagcctataatccttgcactttgggaggctgaggtggaaggatcccttgagcccaggagttggagaccagcctgagtaacatagggagttgctgtctctacaaataattttaaaaattagcctcgtgtggtggtacacacctgtggtcccagctactcaggaggctgaggtgggagcatcactgatcccaggaggttgaggccacagtgagccgtgtgattgggccactgaactccagactgggtggcagagcgagacactgtctcaaaaaaaaaattaaaagactgtaattaaagatagccttttgtataagcattcatttttgtactaattgtatcagcttcaccaatgtgtaatactaggcctctcccttagtgcttgatagaagtaagggttgttaatgaggttatatattgtggtgtgggatacttcaggaagcccaatttcagaacttgagcatttgtaagggaatgttcagtaggtcgtaactgttgttattgttgaaggaggaagtatcctgtagcaattaagagtatcagcttcatactggttcgtggctcacgcctgtaatcccagcactttgggagggtaaggcaggtggatggcttgagcccaggagtttggaccaccctgggtaacatggtgaaaccctttctctacaaaaaaaggcaaaaattagccgggtgttgtggcacatgcttgtgaccccagcttcttgagaggctaggtaggaggatccagaggatcgcttgaaccctgaaagtcaaggctgcagtgagccatgatcacaccactacatagactctgtctcaaaaaagaaaaaaaaaaaaaaaagccagagtatgggcttcagaatcacaccaacttgggttcaagtgagagtttacttgccagataatcttggaatatactttttggaacccacagtttatctgtaaaataattacaataatacttcagaggttgttgcaaagattgagataataatgcatgtaaagtatttggcttcatgtctgccacatggtgtgaagattattttttaagtgtcatttatattgaaaatgagtcattctatgttacttctttcctgtttagtacttgtgtttcagatctgacatcacctttttaaaaattttgcatttgagtgagatttgctaaagcagttctggggttaaacttgaagagaaaatattgaatatttatatttaatatcccatgtgagaggagagattaagaaccctgttgtctgcttgttacatctcttgtgaaaaacataaaaaatataagagttttgttactgaactctacttgtggttttggtcgagtctatcatgaaggtatgttgtggagattagtgcaaataatgatttaaatatggaattataaagtttagcagctctatattcggggaaaaacgagtctctgttgattgaaaaagcataataaaataatttattctgaggctttgtggttatgcagtgtcagaatgaaaaagatgatactcctgttccatttcaggctggtcagaccatacctggaacacagtgttcagttggagaaagttcagagatgagcaaaagacgtgagggggcagagatgatgtctaacactgctaatataatacctggtaacgttttgagtacttactctgtgccaggcactgttcttagtattttatatgtactatcatctctttaatcctcataaacattctgtgggtaggtgctattattattctgtttttatgactagtgcttgaaggagctggaatcattttacttatggaattgtcagcatgtgactcatcatgaggggataggaggaaaggcacaaatatttttttcaatacccagccaagcactgtgctagctctatttcacttgcaatcttatttaatcctcaatgacaaaccttggaagatcctgttagccttttttaacaaatgaaagaactggtcaagtggcttgctgtctttctcggtaagtgcgagagacaggacatggaaccagatctttccaagtccatggccagtgctactcacattatgcttttatttttacgttctcttgctccaggaggcagcttagggtgccagtagagaattgatgccggcttagcaaaaaccttctgactactggagtccagaaatgaactaggttaccttgaatgtttgattctctgtcagtattcaggctcagcctgcttcctgatttggctgagatgttttgggaacatcaaattggggatggagtagaacatgtgaggggagtggaggaattgagatgggctgaaagatctttaatgagccttccatccttgagattctatgattattgctaggacagggttaaatatgagaattggtgaaaagttgtgttggccagtgatttttcttttgtgcatagattgattgattttgagacaagagtttcactgtcgcccaggctgggaatgcagtggtatgatcactgctcactgcatcctcaaactctcagactcaggcaaccctcccacctcagccatagttttatttttaaatgtctttataggccgggcacagtggctcacgcctataatcccagcactttgggaggccaaggtgggcggatcacttgaggtcaggagttcaaggccagcccggccaacatggcgaaaccccgtctctactaagatgtacaaaaactagccgggtgtgctgatcccagctacccagaggagacgggagaattgcttgaacccggaagccagaggttgcaatgagctgagatcgtgccattgcactctagcctgggcgacaaagcgagactccatctcaaagaaaaattttttttaataaagtcttcataaagctaaatttataaaaaagctagaggctgggcgtggtggctcatgcctataatcccagcactttgggaggccgaggctggtggatcacctgaggtcaggagttcaggaccaacctggccaacatggtgaaaccccatctctactaaaaatataaaaattagccggttgtggtggcacaagcctgtaatcccagccacttgggaggctgaggcaggagaattgcttgaacttgggagacggaggttgcagtgagctgacatcatgccactgcacttcagcctgggcaacagagcgagactccgtttcaaaaaaaaaaaaaaagctagagatatggtttagcagctctatatttggggaaaaaaggagtctctgttgattgaaaaagtgtaataaaataatttaagctgaggctttgtggttatggagtgtcataatgaagaaggtgatagtcctgttccatttcaggctggtcagaccatacttggaacacagtattcagtaggagaatgaattcagccaggtttgtttgtttgtcttttaagacagagacttgctctgctgttgcccaggctggagtgcagtgatgcaatctcagctcatgcctcagttttccaagtagtggctgggattgcaggcatactccaccacacttggctaatttttgtattttttgtagagacggggtctcaccctgttggccaggtttttctccaattcctgacctcaagtgatccacccgcgttggcctcccaaagtgctgggattacaggcgtgaaccactgcaccggttctaaatatttaagttttataagaaaggttttgtgtctaagttgagaatcactggtggatttagttaagctaaaatacctttaattattaaaaagtaggcagaatgtggagagataccagcctttttccttcttggtatttctgcgatttttccctttttagacagcctgtggagctcaaccccttttggcttttcaggtgatatagtgagagcaagagtgatactgtgaggaggattctaaacctagcaatcagtcttgttattccatctttgccactagctattggatgaccttggatcagcctcattcttatttgtaaatgggaggaagtgcaaatagattattagcctctgagcaggcttgtggccagttagattctttttcaatgtttatatttttaattttggagttgtacttctaaggacctttactaaggaattaattctaaataaagaagaacaccgtgcacaaagatattccttgcactattatttaatggttgaaaacatttagaaatgacataaatgtctaagataggtgacttattaaggacttggttaaatttttatgtaaacttaaagtcttcagaaactatataataacatggaaaatataaacatttcagaaatgtttaataattgtctcattcatatatatatatatatgtatatatatatatgtatatgtatatatatatatgtatatatatatatatatataatttttgagacagagtttgtatatataatttttgagacagagttttgctctgttgcccaggttggagtatggtggcacgatcataactcactgcagccttgacctcctgggctcaaacggtcctcctgctgcagcctctcaagtagctaggactacaggcatgtgccaccacgcctggctaatttttaaattttttgtagagacagggtctggctgtgttgccaggctggtcctgaactcttgggctcaagcaatcctcctgccttggcctcccaaagtgctgggattacaggcgtgagctactgtgcctggccatttttagatatatattatattaaaaacaaacaaagggattttccctagaagtgcatttgcttcctggctctcaggttttctgattctgtgatttagtagaagaaggggaaatctcatgtgagctgtagagaaagactgaaagaagtgtttgttgtgtcatcttggaattcgagtagaatccaaacttctgctaacattaaaaatgttaacatggcactttacttttcaaagcagtttggtcctgatttgttcgtttgtgacagggtttcactttgtcaccccagttagagtgcagtgccaccatctcaactcactgcagcttctacctcccaggttaaagtgatcctcctgtcttagcctcccaagtatctgagactataggtgcacaccaccacactggcaaatttttgtatttttagtagagatggggtttcgccatgttgtccaggctggtctggaactcctgacctcaagtgttcggcctgccttggcctcccaaagtgctgggattacaggtgtgagccactgcatcctacctagtcctgatttattttataaacaaaccaggtgatactccattgtgaaatagctcagattggtgggcaagccacatatgtggtgaggtgacttggaaggcagcttcaggtttgagcagttgtttagaaacaatgtattttgcctccctgtttattctagctcattctttctgtttaataactttcaccaaatcacagttggcctttcttctctgacctgacacctgtgttatataaagagcattctacccagctataggaaacatctaagtcaggactgttttatagcagttggactagggaaaggaaatataaagaatgctgggagatgttaccatgggctctccttttatttttgtctagaaatctcagaaaagaggaaaacctaaatacctctggtaactggctctgattcaaggcaaaagtatctactgtgctctttatccgtagttttccctgtgtgtttacttcattttaaaaagaaaaataagtaactttttttttttttggtactgttacgtgcttgagggccatttttggcttaggctgaggttgttaggttttcactgttaatgagaacccaagttagattgtcccctgagagctggagttgccagtagttgtttgccagaatgattttatcaacatcctttttagcagtaaaaagatgagatgtgtccttgaactacactattttccgtaccgacaactgccaatcttttccacattgccctttgcatctttaggctgaatagaggtatagtttagatttttgtagccatttcaaattggtatctcatttattatgacaactcttctggaaaactcatttgtttcatttttcccctttctgacaatttaagttctactatttgaaagaaagaaaagacagcagagaagcttatcatcgagtataggaaacaaccagaaaattatctggcccattcatatacccatcaggcttcatgtgttagagagtacgctgcctaatttaaaggtagagtagatttaaaagcaagactgagctgggaacggtggcttacgcctgtaatcccagcactttggaaggccgaggtgggtggatcacctgaggtcaggagttcaagaccagcctgaccaatatggtgaaaccccatctctactaaaaataccaaaaaattagccaggtgtggtggcacaggcctgtaatcccagcaactcgggaggctgaggcaggagaattgcttgaacccaggaggcagaggttgtagtgagctgagattgtaccattgcactccagcctgggcaacagagtgagactccaacttaaaaaaaaaaaaattgagtgaaataattttaaattaggagttttaaatctagggttcctagagtcaatgaagtctctgaaattacatgtaaaatttaagtatatgtatatttttccaggggaaggttctatagctttccttcgatattcacaggattctgtggctcagtggttgaaaactgttgccatggtccgggtccagtggctcacacctgtaatcccagcactttgggaggctgaggtgggcggatcacttgaggtcaggagtttgagaccagcctggtcaatatgacgaagccccgtctctactaaaaatacaaaaattagctgggcatggtggtgcatgcctggagtcccagctactcaggaagctgaggcaggagaattgcttgaacccgggaggcggaggttgcagtgagctgagatcatgccactgcactccaggctgggcaatagagtgagactttgtctcaaaagaaaaaagaagaaaaggaaaaaaaaaccattgccataaatgatctttagttacctatgtttccgttggtagaaaatacatgtaactaaactttcctttgttttatcttaggctttcttgaaatgtactaagagatatttgaaggggaaaatacagttttctttttttctttgttttattctttttctttttggaaaatagttttcttttcctatcctttttacaacctcctccctgcctccaaaaatctgagaattcattatttactgcttccataggagtttcttttaatattttagctgaaataattgagtctgttttgataacccccaagcaaccttaaaacttggacctagaaattcactgtggattctgagttctgcaactggaagagaatgtcagcaacaaattaaagcttctgaacagttgaaatggtggcttcagttaccaatggcttttcttaggatttgttaaagagcaacttaaggactgagggaaagggtctgaggttctgggagcagtcaggatctggggagccagctggctgtgttgctgcagcagaggaaagtggggtggagaagaaagtggcatttatgctcaggaattttcctaagttccccgcctctgagatctgactgggccaggcagggaaaggatgtgtgtggaactgattgtaaaagagtgctattatgttcagtttaagcttctccaaggagaatggaaataaagcttaaaatctctaaggaaaagttctgaccttccctttctttttttgcatcctctctcctttggtgcaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggtgagtccttccttgctttgtgcttagatttctgtcaacttgagaaagttagcatgttttattttgtgtaagagttattgagaagtctgtgtaaggtgtgtttgttgcaacaaattatagcctttaaaatgcctggcagaatggagaaatttgtgcaaaggcaatatgtactaggcaaatattattacatctcttttagaatttatctggaaagcccgcctcccccctaccctgtccccccacaaaaaaatatgtactaggaaaagaactttagctgtctttgtttctggtagaattcttatgatgttatatatctagaaattttcctagttgtagatgaattttttaattctttagaaggtagaagaaataactaggggaattaccactttaaatctagttttggggccgggcgcggtggctcacgccggtaatcccagtactttgggaggctgaggtgggcggatcacaaggtcaggagttcgagaccagcctgaccaacatggtgaaaccccgtctctaccaaaaatacaaaaattagccgggcgtggtggtgcatgcctgtaatcccagctactcaggaggctgaggcaggagaatcgcttgaacccgggaggcagaggttgcagtgagccgagatcatgacactgcactccagccctgggtgtcagagtgagactccatctcaaaaaaaaaaaaaaaaagaaagcctaattttaggctgggcacactgattctcacctgtaatcccagtacttggaaggccaaggtggtaggatcacttaagaccaggagtttgagagtagcctgggcaatataatgagaccctgtcttacaaaaaaaaaaattagccagacatggtcacacatgctgtagtcctggctacttgggagactgaggcaagaggattgcttgagcctaggaggttgaggctgtagggagttagtattgcgccactgcactcccacctgtctcttaaaaaaagaaatgaattttaagcactgagatttgttggcaaattgaatgcaaaagtaacttcatgaaaaaacatcaccctgcgttgctggagttcaaggtacaatgggaaagtgattcagtttcagaaaattgagataagtgagagggtttgattcctgtatctcaaggtgctataaaaaagaagactgactgcttaattaagttggaatgttgggccaggcccagtagttcatgcctgtaatcccagcactttgggaggttgaggcgggcggatcacttgaggtcaggagttcaagacaaacccggccaacttggtgaaaccccatctctactaaaaatataaaaattagccaggcttggtggcgcacacctgtaatcccagccactcaggaggctgaggcaggagaatcacttgaacccaggaggcgggggttacagtgagctgagatagcaccactgcactccagcctgggcaacagagcaagactctgtctcccaaaaaaaaaatggggatgttgacaaggaccaaattttcttgtctacagaggttacctgtgaatccttatttgaaaaatgatgactatgaaagatagtggagaattgcattaccaagaccaaatgtaagggtggtcagctgtaataactgggcccaaactcagaatgagtaaggctacaatgtcaaagagataatttttatgttttatgtttaaattcaagggaaaacaaggaacggtataggtactcagccaaaattaacatcataaacagaaactttccttaaacaaaaagacttatatgttcagtgggttttttttgttgttggttggttggttggtttttgttttgagacagggacttgctgtgtcacccaggctagagtgcagtaatgccatcatggctcactgcagccctgacctccctaggctcaagcaatcctcccacctcagcctccctagtagttgggactatgggagcatgctactacaccaggctaatttaaacaaattttagtgtagagatgggggtctcactatgttgcccaggttggtctccaactcctgggcttaagttatcctcccaccttggcctctcaaagtgccaggattacaggcatgagccactgtgcccagccctttgctcagttttgaatacacagttattctgaagacaactctggagctattctgtaggcagaatgggaagatagtgtaaaaggagagcggagactctgcagcaacaataaaaaaaaaatggctgggaggagtggctcatgcctgtaatcccagcactttgggaggctgaggtgggagccctcacttgagtctaggagtttgagatcagcctgggcaacaaggtgaaacctccgctctacaaaaaatagaaaaacaattagatgggcatggtgacatgcactcgtagtcccagctactcaggaggcaaaggtgagaatatcgcttgagcccaggaggtgaggctgcagtgagccgattgtgccagtgagccgattgtgccagtgcactgcagcctggacaacaaagtggagccctgtttcaaaaaaaagcagacattgaagtttagaggggatatctgtatatatagaatgaaagccctgattgattttttttaagacagagtctcattctgtcgcctaggctggagtgcagtggtgccgtcttggctctcactgcaacctctgcctcccaggttcaacgattctcctgcctcagcctcccgagtagctgggattacaggtgtgcaccaccacacctggctaatttttgtatttttagtagagatgggatttcaccatgttggccaggctgatctcaaactcctgacctcaggtgatctgtccacctcggcctgccaatgtgctgggattacaggaatgagccaccgtcccagcgtggtatttttatacagcattttgtgaacatctatgtattcagacaccatactaatttgttcatgtgcattatctcacttagtttttatacatacaaagcagctgttctagatggtaaaactctgtccctaaaggatgaagtggcttttccagtgtcaccagtagattactaagccagtaattgaatccaagataatttaactccaaagaccacatgttctgttgagcacactatacacaagaaggctctccaggtagttgctaagtgagaggagctgagatgtggatttggctttttggtattggaatgtgagcataatgacatcaaaattaaggaaaatttgtcaaatctcttgaggaaacttttgcgaagagagtttttatttaatatttgcttcaatacagccaataatacctaattttcttttttttttctaggcgactggcctccactttagacacactgataatgtgattcagtggttgaatgccatggatgagattggattgcctaaggtaacttacctgagataatagtttaggctttgttccagctgttgtggcataaccctcaaacaacctgttctcattctacctgtaaaattattctcagaatctttggtgtttttttaaatactaaaagatgtctttctttttgacttaggaaatagttttgttctttttcttttataatcctcatacctgtttcatcttaccctagagaaattccctgtgatgatatctacttttactacatcaaattgtagacttacattttactatttttccttagatagaattcacatgctgtgagattcaccattttaaagaataccaaatcagtggtttttatttattcacaaagttgttaacattaaaatttgacctttggaaatataaggaaatattttagaaatctgtagggagtatgaagggtcattttttattttaaattgtagaggtggtagaatgacgtttacttcctggatctgtttttggtcatggctgcagttttgtttggagtgtacatcttctgggtgttctgctcaggagtttatttagtgttgctttcagtgaaattgccatcccagtcctgtctgaatctataactgccacactgtatggtcactcttagagacatgaatggattgattgatttcattctttcttttgttctcatttttttctgtttatatcctttgacgtaagaattccgcttctgggaagttatccgaagtaaataatcagaaagcaccaaaaaaatgtatacagaaggattttttagcattgattatgatagaaaaaattgatagcaaagtacatgtttctttacaaggggtattaattgtgttacagccaaatactagtgccatttaaaaggatatcaacccaagtaaagggcctttgatgtattaagtggggaaaaacggttgaaggttataggagtttgtgttctagctaagatcagatcactatttttgtgtaaaaataaagtgagtgttcttgggaaaaatttgtaaggagataaaatggttttcatttctgtgtgatgggattaagggtggtttttattttccttgtactttcctgtagagttcaaatttttgtaaccaaaggaaaatttattttaaaaaagtgaggtgtagggtatcagaaggtggctaaaaccattttatattttgtattttgttcaatatagaaatattgtatacattttatattttgtattttgtgcaatatataaatattgtatacaaatatgtatattatatagataaatatatgacttatacaatatattacaatatagaatatattgtaatataattttacaatattatataatatacaatatataattacatattgtaatatataatcatatatacaatatattatatattatatatacacaatatattacaacatgtaattatatattacgtatatagtatattgatatgtatacaatatacaacagatatgcattgttgcatacatacctgtggaattgtgttaaatcagaactgagtctttgcagaagactagcttttctcctctttttttcagagaaagttctgaagttctcttccttgccactggtatgtttgagaattaggccccacaattgttaggaaatgcagtacgtcaagttcttacagctacgtggcctgtctgtgcacctgtaatttcctttccctgttttttaatatagtataaaatactgtgctatatagtgtaaaatattacactgtgcacctgtaacttcctgtttctgttttttatatagtatattgccagtgggcaatgacaataacctcatttgaatgttactaagagctttgttaatatttgcaattgctagtagtgttgttactacgagatgcttttttaatgatgtaattttgttaccttttttggtttactaacagtagtatattgtcctggactacaattgcaacaaacacagaatgtattaaaggctttcaggaacaacttgataatcatggctgtaagccttgaattgtccaccctacgtttaggcccagaagacttctgagtaataagaactaatgataacctaaaaatgtattgttgttcttaatataatgtataatacgtaattgacaatacgtatatggtgtttattgggatgtcttttctaatctctttatatggtacatgctggcctattatagaaaattcatgcagtcattttttggttcttatcctttttgactctttattataattggtactgttggctgccttttccctgagatatttcttagtttgatttttaaaattgtttttaatctgctcaactagtcctgttttctttaattattctaccttccatgtcctagtgatggacatactttaagatgcaatccttgttagatacattttcccattttcatggtttcatttattctcaagacttgctgacataagataaacacggtatcttcagttggctgctggacatttctccttggatagctttctgtcacctagaatttttcatatctaaaactaaatctaccttttccccaactgaacttcccttcctctataataaatggtaccatgtcatcattttcccagtcatccagtctcaaaaccttggagataccttgaacttctaaatctggtcattccctaagccttctccatttatttgaaatatctcttttatccatctactgttacaacagcctcccagcatacctccccagctcccatctcccattattcaacatatgctgtgtcctgtctccagtcagatctccccagggctctatttttatccttagctccaaagctaggctacttctttatgtcctgcttatcaagttcagacttgtctgactttcaagttgcttataataatctgattttatcctacctatccaaccttatttttctgttattttctagaacgtattctgtagattttaaaaaacaatagggtatattgccttactgtctcacaaacacatcatgattatttttgctttatttattctggctatttctcttatttggaaggccttttgctctctatcatgattcactcatttctttagtttatgatttcacagtcttaatataggcctttattgcttatccaaattcttctcacctcattattcagtcttttgcttctccgaaccactgtcaccccttatttccctaaattacagattgaattgtatggtgccacatgactgtgagaataggccttgaagttcaaggctattcccagtctaaatctactctgttcctatcctacctcattcactaactcatcgaatgtagagcttccatgaccctggctctgggcttgatatcaaagatatggcagttaataaataacatagatctagccctgccttcgtgtggcttatagtctgttggagtagccaaacagataaacacaaatgatcgattttggtaagtgctaccgtggaaaagtacttgtcttccaaattccctcatacatgctctattctagctacttcatctgtgtagcttcccatttctcctaagcattaaacacattttaatattttatagtttttttcaatgtctaaatgtagcaggttgcacaaactaaagcacttagtaaatgttcattgttgagttgtttctccatctaggcatggtagatagtaactaggagcattgtagttctgaaagcctcatactcagatcagtccagtgatttaaactggactagaacttggtcttcatatgcctgtgtctgggtctgaaataagtaaatcaccttctcacacctaatgaaattcagtgggttgtccaaatagagattttccaagtagtactttttattctgtattatagcactttattccttgcaattcttatgatgaaatgtctgttcaccctaatgaagttatttgctgaatgccaccgatgttttctaagaatgccaccgatgttttctaactgtccatagtttgatttggattattgatgattggtgaatgtcagatgaacacagtgaatggatatcttactctgtttcttttatttctccctagattttttacccagaaactacagatatctatgatcgaaagaacatgccaagatgtatctactgtatccatgcactcaggtagtcaaattttcttggcaaaataaggaaattatgaataacatctgaattgagtgtgtagttttttatccttgaggtaagaatgaaaaagttttttgattagtttcaaaagttccaaataggataaaatactattatccgaacaaaatggtgagaaacagctgtgtttttctagggagtttggagaagggatttatttatttaatagcaggtaattttcttctaaaaacatggtatctttcataattgatctagtatttctgtgaactatgcattcacttggggtgcagtctcttgtttagttaggtaggtccttgccattgttaagccatttgttcattcattcaataatttttataagccggatgcggtggctcacgcctgtaatcccagcattttgggaggccaaggcgggtggatcacctgaggtcaggagttcaagaccagcctggccaacatagtgaaaccctgtctctactaaaaatacaaaaaattagctgggcatggtggcgggtgcctgtaatcccagctactcgggaggctgaggcaggagaattgcttgaacccggaaggcagaggttgcagtgagccaagattgcaccattgcactccagcctgggcaacaagaacgaaactccatctaaaaaaaaataataataatcataataataataataatttttgtaccaacacaaacatgatagtaagaaatgatacaaaatatatttttttcccataatgtcatggtaaatttggaatgtgacttaattttcaggtccccagaacactaaattaaataggaaggaaaagatgcaagtctggaaggatggtgggatggcatattagtagatgcttatacaggttgaatatcccttctctgaaatgcttgggaccagaagtgttttggattttgaagtatttgcattatacttaccagttgagcatgccaaatctgaaatgcagaatgctccaattatagcattgagggtcatgttggtgcttaaaaatttttagattttggagcattttggattttggattttcagatttggtatactcaacctgtggtacagtagtgtagtattttagcagatttacttgatggccacaggactaaagaagaagatggcagagcaagtgggacatgagtgagatatttgcttgggctgcacttcttatatggcatcctctatgtgtgcttgctaagtgttaattacattggagtaggtatataatactgatctataagaagactattgtctccagtttcttgagcaaacatgtactagatctgtggtatcattggaatcagtgtgaaacatatgaaagaatgaatatagctgagaacttgtggatctcgtgttgagaatgtagcaatttcaaatatgtgtctgaggctgggtaggtacagtggctctcacctgtaatcccagtgctttgggagaccaaggtgggaggattgcttgaagccaggagttagagaccatcctgggcaacgtagcgagaccccatttctacaagaaataaaaaattagctaggcatggtggcattcacctgtagtcctagctactctggaggctgaggtgggaggatcacttaagccgaggagtttgagactgcagtgagctatgattgtgctactgcacttcagcctggatgacagagcgagactctgtctctaaaaaacaaaacaaaacattaccaaatatgtgtgtctgagtccagatcagattaattctgagtattttgtttggcttagtgttgcatgagatttgtccatgttgataatcttgtgaaggccttacctgcaatggatatctgaacgtggaagcagaattcctctctgctagttgtgtagccactactctgcagtgtaacctgggttccaggccctcaaattctctgtagtagagcctaaagaattaactatgccttcctagtggtagagtcagaatgagaaagagaggaagtctgctattgttttccatttctcttgaatatgtagtctgtgcttagaaagtatatatagagcagtgtgtttcgtgatttatggtttcttttttatggtgtttttcctgaagggtggattggcaacatttgataatatgtaggaagtatttataattgctgaaagtgccttcttttaccacaaaacacagccatgttcaaagcaggttcctcaccttgctatattggataaggctccatctccctttggatcaacagtgacagaaaaatactacctctctgtctcctccctgcttgcctttttttttttttttcctctaaagtcttgattggcattattccagagatagtcactgtactttaatcatactaaattacttttgtagataacattccactctcagataagaccccagttttccattctcaaaatacttgtatactaagtttggtgtaagctcatttgtctccttagtatgattatgtttgtgtgtttctctgcagaaagtaatggattggattgaggatgctgccccagggcttgctggggatactttatgataccatatacactgtaaatagaaatacactttctaatatctgagaaattcaatattcagacatatctggctccaagaatttggataagggactgtggacctgtagtagattctgtttcctaatcacctgctgtgtttcagggtctttattaataatctttgagattggcatagtgacttctaggttactcaccattcacagaaaagataattagaatccagatagattaacatagcttccttctgcccattgctacaaagtacagcttaagtaggaaataagaaaaataaatctaagtgcagttacaggctgacgcattatagtgcctaacagtatatttgtagaagtaggcatgggagagcaggagcaaagattggaaagtgctgttcaccattagggtttataagtttcagtgtgaagctaagtacttttgattgtgggtaagaggacttaactggccgttttgaatcctttcatagctccagtgtctccataaaatactcgtaataattaaagagagttaaaagaaagatggtgcccatgtctactttttatattagccagtgatacggttgtagcacctttaatttaccactgaaagacattaaaagctaagtcagtgttcctggtactgtgaaagcaactgtattagtccgttcttgtactgctataaagaaatacctgagactgggtaattcataaagaaaagaggtttaactggcttaaggttccacagcctgtacaagaagcatggctggggagacctcctcaggaaacttacaatcatggtagaagacaaagaggaagcagtcacgtctcacgtggcaggaacaagaggaagagagaggtggggaggtgcttacatacttttaaaaaaccaaatctagcgataactcactcactgttaggagaacagcaccaagggggaaacctgcccccattgatccaatcacctctcaccaggcccccacctggggattacaatttgacatgagatttggacagggacacagacccaaaccatatcagcaacattcttgaactttcttaaaatttcttgttcgctatttccaagtaggaataaatgagaaagaaattcttggagaaaaatattctcttaattaagaatgcagatgtgatgtattagtgagaaaaatatataaaaaatatataaaaatgtataaaaatatatagaaagttattagttattttgctttggaatttcttttttaaagaggcagggtcttactcttttgcctaggctggaacgcagaggtgtgatcttgactcattgtaacaacctcccaggcacaagctatcctcctgccttagcctcccaaatggctaggactacaggcatgcaccaccatacctggctaattaagaaattttttttgtagagacaagtcttgctatgttgctcaagctgttttgaattcctgacctcaagctatcctcctgcctctctttctcaaagtactggaattacaggtgtgagccactacacccagtctggagaattttttgaatacatttaaaatcttctgagacaggcgctttatatatccatcttgagtcttttacctgaaagaaaagcatttaatcatatacacatgacttatacttgcacttctctgagaaaatgtttagcttctgtggatgtataaattctagtgtgttttgagaatacttgatttttgtttttctattatacatttgggtttattatatacaatttaaattttgatcagttctgtgattgcagtgtacatgatgcgtgtttgtatttagatgatattgaggtttatagattatttacaaaaactgtataccactttaagtttctatgatttatttcttatatatttcttatttccctgcttactttaaactgtcaatatcttgcttttgtcagtatctgtaaagtacccttctgatctcttctaatttattgattctgatcagttagggctttagaatccacttaataacacaggcttatggacattaatttatccgtccatccatctgtcaaatattgattaatgtttattaatatatgctaggctctgggtaaacattagtgaatgagccctgtattgtccctgctttcatgaagcttagagtctagttgatttttttttaagtttaaaaagtaaaaataattttcaccaacctgataattaaaaagtaaaaatatatgaaatattctttatctaaaactgttaaattacctggattaaacttttccatcagtaatatgaattcagtttaagtaagatttgccatctgaatcatttttatgaagcttttctaaaatgtcttattatttaaaacttattgattacaggaaggcaaacaaatgaagagacacttcacattatattaacattaatgttaacatcttttttttttttgaaacggaatctcacactgttgcccaggctggagtacagtggtgtgatctcggctcactgcagcctttgcctcccaggttcaagcaattctcctgcctcagcctcctgaatagctgggattacaggcacatgccaccacgcctggctaatttttgtatttttagtagagacagggttttgtcatgttggccaggctggtctcaagctcctgatgtcaggtgatccgcccacctcagcctcccaaagtgctgggattacaggcatgagccactgtgcctggccattaacatctaattatgcattgagtttgtgccagaaccgggactttaatttgtgcctactgatttctcccagtccagtgctctttgcattgtgttatgtgactttttaggacaatgttgtcatgtaaactaaaaaaaaaaaactgaggtaaatagcgtattgtaactacaaaggagactgtcgtaggtactgggagtctcagtgttcagaatacttctattttatacttcatgctgattttcgccttttaagggtggcagctaggcacagctgggaggcctaaccttttgcatattgtatcttctagtttgtacctgttcaagctaggcctggcccctcagattcaagacctatatggaaaggttgacttcacaggtaaggagttagatacttggcaggaaatgcttgaattatgtggaaatagcctggagagccagcagtaccaattttgaagacctagggctttaaaaatacactggcagtggaggtgaaaaaaatacgaataacttgcttctctaatgtggggtaaagaacactaaacttgaaatttcaagctctgttctctcacttaataatgtgaacatgattagtgagtctcagttttcttatatgtaaattggggataacattaacatatataaaacataataatgttaacacataacactaaatgttcgggtatgttgaaaaaagctttataactatctttccctttccattccagcaagcatctgttgtgggcaaagcaagagggagagtggggagtgagatgacacaaagatgccaatttagtaattttaaaatttaagcttatttgggtgggtgtttctatgtgtatttgctatagccagatgcttgaagagatgaggggttggggagaaaaagggcagtggtaatactgtttaagggtaagatagattcaagtctttcaaagtggtgattattttgtaggcttgaaagtttaaaaattggtaagaaagtttttgtccatgatattttttccttccagggaagttattcaccagacctggggaaaggaccagaccttacatgttttctttatcatttggctttctgccttagaaatgaaattgttgaatagcagctaatgattgtaaagactgagataactgacttagtttgtgattcacttattgttgagctcacgttaaagctgttccatttataagttcattgtaggaaatgccataagtagcaattttgaaaaactatttcctgtaggaccttctcactttatagttatttttgatgcccttgataataataacgtttgactacattttatatactagttactgtgttaagtgctttccatacattgtatctttatatccttataaaaccctaaaaggtaaatgccattttatcccattgcatagttgaggaatatgtttccttctcttggttatggaagggtgcttagcttgattgactgattattaattccctcctgtagaagaagaaatcaacaacatgaagactgagttggagaagtatggcatccagatgcctgcctttagcaagattgggggcatcttggctaatgaactgtcagtggatgaagccgcatgtaagaagagagaaattttgtgggttcaactgggattgttgccactatttccaataattaattctatagtgatgatctaggacattatgaatcttgccagcaagtttaagtccacagatgtagttgtaaacacatagtcttccatgctgttattatttggaaatacatgattaattctgattaaagtgaaagcatttagaaaggaagtcctggctgggcgtggtggctcacgcctgtaatcccagcacttcgggaggccaaggcgggtggatcacctgaggtcaggagttcaagaccagcctggccatggtgaaaccccgtctctactaaaaatacaaaaatttagccgggcatggtggtgtgcacctgtaatcccagctactcgggaggctgaggcaggagaatcacttgaacccaagaggcagaggttgcagtgagccgagatcatgccattgcactccagactgggcaacaagagtgaaactctgtctcaaaaaaaaaaagaaaaaaaaagaaaggaagtcctacatttccgtggctcattgagtttcttattgttttatggtgtttacttggtaattaaggcagatatctccagagcaagtgttccttgcaaggctctcttatgagtgtttctctgtgagattctaaattcaccatcccagacatggatcacagatggagctgtggctttgcatactgtaaggaagaggctaggctcatagcctggcccagggagccagtcttcgaaccccagttgttatttctctgtgaaaaggagcctctgtctctaatggggggtgcaatgttgctttctgttgtgatatacatcctgtaatctatataatctcagtgtttttgttggtttgtttttttgtttttttttttagtacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacagggtaaaaatgcaacatctattctttctaattaatttatattattccgtcatttgatatggctccagtttaaacatcagttttattgagatgcagtttacatacaacaaaattcaccggattttaaatgtacagtttgagttttgaaaagtatatgtgatcatttaaccatcactcccagaaagttccttagtgcacttttgcaattagtttccaccttacccacacccctgagcccaggcaactaccagtctattttctattgctgccattgacctttttaagaattttatacaaatggaatgatgcagtatctaatcttttggtgtgaggctccattttgacctctgcttcttgaattttatataaataaaattctagagcgtagccattaaaattaatagtgccctttggaaagattatctctaaatattaacatagtctttcctctttcccagattctctggggtaaaatgtttgtgtacagttgttatgggtatgtggaagttagttaaatgattctgacttgaaaaaactgaatctgaggatctcatttcccgaggtcaggagtttgagaccagcctggccaacatggcgaaatcccatctatactaaaagtcaaaaattagcccagcgttgtgttgggctcctgtaatcccaggtacttgggaggctgaggcagcagaatctattgaacctgggaggtggaggctgcagtgagccaagactgcaccagccaggagacagggcgagactccgtctcgggggggaaaaaaaaaacttcacacaaatttatccaccccttgttaaaattagtggttgatgacaaaacgaagacaatcctgctctcagaacattctttgtatctcttatcatagagcagggatttcagtttcccagttaggtgccaaactggcctgcaggcaagtagctgctgccctgcctctgcctatgtcaccagtgagactccaggattgtggatctgtatgtgcccattctgctcagatctgaggcaaggatgtgctgcccctaatcccagcactttgggaggccaaggcgggcagatcacttgaggttaggagtttgagaccagcctggccaatatggtgaaaccctatctctactaaaaataccaaaaaaattaactgggcatgatggtgcacgcctgtagtcccagctactcaggaggctgaagcaagagaatcacgtgaacccaggaggcagagtttttaatgagccaagatggtgccattgcactgcagcctgggtgacagagtgagactctgtctcaaaaaaaagacagaatctcgctcagtcacctaggctggagtgcagtggcacggtcataactcactgcagccttgaacttctggggaaagcaatcttactgtcacagcctcctgagtagctgggactacaggcatgtgccaccacattgggctaataaaaaaaagttttttgtagagatggggtctcgctatgttgcccaggctgatctcaaactcttggcttcaagccatcttcccaccttggccttccaaagcactgggattacaggcatgagttactgtgcctgctttgttctttataaagggtcttaagctacacccatattcttggtagtgttatggtgcaggaggagcacacgtgtatttatgtggtcttcttagacaccttaagctaacttaattacgctttttactcatcctcagacagaaaactcagagagagaaagagatgtttatgaggagctgctcacgcaagctgaaattcaaggcaatataaacaaagtcaatagtaagtatgttcctgaatcaggcacctaaagggatattataatataatgtgaatgttgatctattctgggacttacaacatagtttgatttacttactttagacattcgtggatttgtttagcaataattgcttgttaacaatcttttgtgtttctatgcctccgttttaattatttatcttcagtcagccgcttgttcctacactgacagtagcatcatagtagtctgtttggctacagtttcactctttcaccctattacatgcttttaaatattattttcctggccaggcacagtggctgattaatcccagcacttacatatctgtaatcccaggactttgggaggctaaggcgggtggatcacctgaggtcagaagttcgagaccagcctagccaatatggtaaaaccccatctctactaaaaatacaaaaattagccgggcatggtggcgtgctcttgtagtcccagctacttgggaggctgaggcaggagaattgcttgaacctgggaggcataggttgcagtgagctgagatggtgccactgtactccagactgggcaacagtgagactctgtctcaaaaaaaaaaaaatatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatatatatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctccaaaacatatttaaacaaaaatgagattatacttttaatattgacttttatatatgtgttacttttgggaaattaatttattgaaattatcattttgtcactactctgctaaagaactcaccatgactacttcatacttgccagacaaaatgcagatccctagcctagtgcagttctttatgcaatatttcatgcatacagctctttgtagaagctcatttgcctaattacctcccatactcattctgtacattttatgacttaaaaggaatctgggccaggcaattccagcattttggaaggccagggcaggtggattgcctgagcttaggtttgagaccagcctgggcaatgtggcgaaaccctgtctctacaaaaaatacaaaaactagctggacgtggtgacatgcgcctgtagtcccagctacttgggggctgaagcaggaggattgcttgagcccaggaggttgaggctacagtgagctgtgttcgcaccactgcactgtagcctgggcaacagagtgagaccctgcctcaaaaaattaattaattaattttttttttttaaaaaagaatctggctctgaagtggtactgacctggtatttgatctcttgttcctctgttaaaagctgtgtaacattgggcacctgcagtagcgttgttagacatataatacgagatagtgtatgtaaattgcctgctatttagtaagtactcaatgaacattaatattatcgctatgtcatgtaatctccctactgtaatgccttcatgcctcatctcttcctaatccaaattgtacccatcattcaagatccagttcaattttcacttcagtgcctgtcacagttcaatatggttgactttcaaatctcctgtgtcgtacacaggctcatccctataaatttgcacttaattatatattgtcttgtattgcttgatctttatttctgacatctttgtaaactccttaaagtagagattacgtattctgcttcttttgaagtcctcctaattcctagcataggtttagactcaccaaaaaaactaaaaggtttgatttcaaccaactaggtcaggcttaatcttgttttgctcaagatactcataacaataataatagtaattgttctcattgttcatttggagggccaaatttctcatttgaactaatactaataactagagaggatttagaagattttaccaattgcataggattggagttttaagtcctgaccagcattctttttttttgggttttttttttttttggagacagagcccaggctggagtgcagtggcacgatctcggctcactgcaacctctgcctcctgggttcaagagatttcttctgcctcagcctcctgagtggatgaccagcattctttgtattctgctaccttctggttcatttaggataatgaccttcctagcagaataatccattcaagtgtggatggtatcttgtgctgaatctgtattaatccttaagtcagcaaatataaactggagtgtccttatggttggttctctgtgagaagaaagtccacgatgtttcctgttgcatagagtacataaaatattttttgttttactgagggatttttctctaccttactgtttggtattttataacctttatagttttaccttgctaattgtataagaatcagttgtgagcacatgtaaggaaataataatatgttcttaaaatgtcctattcatattattattatgtagtcagaggagcaaaataataaaaattccctcaaatacctttcagtatagtggggaagatagacatacaaatgagtacttttagggcagcttgattagagcaagatgccaagagcacatgtggtgcagtcatagaataaagaagggaatgatgacttctgcttagaagtttgagcaggttttcagtgtacatggatcttcacagggatccttaggatagataagagggtgaggataaggcagaattccctataaaaggacagtcttttcctaattgtagagaaagtcttgaggcaaaggaaagttagatgccaggaggatatagggacttcgggttccaggaattaatgtaattatagataagattctttgcctagagcattcgaaacagcaatgaggccattgatgctgccccaggagaaagctgcaggccaagcagttaaaaattagaaaaagtttttattttattttttgttaagtagactaaggaaaattagagttatataactaaagttcagtgagagaaagtatttaagtaatgttccacactttattatgtttgcaatataaatgtttatagatattcatttaatatttacatatttaagtagtatgtgtacacttctagaaaaagcaaaatttactagatgcttttgtagatagataatctaagactctatgctatatacctagagaaagtctagtttgttatctacattgattttattttctgtccctagctactatgaaagctccttgaggacaggatatttgtttttttcacaattatatttgcaacatatagcagatcctcagtaaatatcattgaaggaatggatgattagttggctaacagccacatatacctgcagacatgacttgagaagccaccaccttggtatggtgctcagttgaatggcaggtatgaatattaggaagaaataaacagtatcttaggagcctacagtgagacctcacatccataccaatgttttaaccttttcttccgccctttttttaaatagttctagtctcctcattgcccctacttcccattttctagtttgagactttattttcccttgggctgttttgattttctttataacagcttattaattttattttgttttttactaatgaaaacatttgcaattgataagtactattatgccccagatatttttatttttggtattttattgatttctttttgctactgtgataaaatcagatgtttatctgtgagtggtggtagggacaggcattttctcttcaaaaaataaggaaacggaaagtaaaaaagtaattatgattccttagtggctatcatttctgaaatcagaaattatcttattctgtctttcaggctaagaatacctttttgttttgttttgttttttttacaatatataaagtgcttttatgtatatgattttatttaatcttaaaaatattcctatgacggaaggtatcttcattatcattttcagatgaaggaacatctgggttttcattgtcatgtattgtattatagagcttgtgtgacctcaggttctatgattagaagagagaatgtggaaaggggaagatgacccctttcactctgcacaggttggaccacccttgatagcagggcactgactgttgtgggtggagtgtgttcaggaagtatcagggtaatgagaggattcaaaatggtgctatgtaagacatggttaaaggaaataaggctgctagtaaggcatttgctgtcatagggaggggcagtggaatgtattcagtgtgaactttagggttggagctttaaaaatatttttgaaacaaaattgtccaaagatgtagtaagtggccacgggagatactttctcctgtttggtagtctgtaagtataatctggacaactacttggcattttaagggaatttaagcgtcatgttggtctggattggtggctccatattggtgctgagctgtctacatttggaagtttttaagtaggctgggagtgtggcccaggaatctgtatgaaatctgatgaatagcttgttgggaacccctggacttgatgactctaaggttcttttccaatcccaagatcttatgcttctgagaatcacagagtaaaggctctctgagttatatttccttatctggaactgagattggttttggggaaggaaaactattctaggctcttctgttaacatagtcctttcacaagcttttgccttttttcctcagcattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacaggtaaacatagtctggattgaagctgcaagagtttgtatatatccattcgaatcccatgctgtcatttaaagatatatatgctgcctttgtttttcccccaatacgactttttcctctgcatataaattagtttaaaaaaaaatcctcaggtaaaatacacattgtcttcagctcacttttgcttttagagctatgaatcctcttttaagataaacagacaatacccacccatccccagtctaatcactccttcacttcagctgtctctctctccaactaaaagacattggggaaaacctgaatatttttgcattcttacgtcaggaatttgcactttaaaaaaaaactgcaccttattagtttgctctggccaaagctggaaaagtacttactgtgcagtcagggtagcttgtgtgggattgtatttcgtgggttttttttttttagaacaaacatgaggggctttcttttttgtctaaataagggcaagtatacattttacaaatatccagcgtacgttggtcaaagtaagtagcattaacgtgcttaagattctacaaacactttttccttagaactttttgaggcttttcatgtaatatgtttaagaatgtactggtatctgtaaagtcactctaccccagctttggcaaaggcatttggctctacctggggctgccaccttggctgcatgtagcctgagctgtcacttatgactatggctctctctgtccctagtgactgcttttgagagatgagaaccttaaggcctggagtcataggaatgagtaatctttacataattttctttgctttgctcagagtggtcagactgaccccctgcagaaggaggagctgcagtctggagtggatgctgcaaacagtgctgcccagcaatatcagagaagtaagagtccattgaaattgtatgggaggaaagttgtggctttgtgttattgaagggtctgaggttagcttctgtcatcgtcatcacccactctgagcctactagccataaccaactgccaggtacttttggtggcaggagggttcctccagtttgttgttgtggtggttttaattgctgtgtaatagttgtacatattttgagggtacatgtgttttgttttttaaaccaaccaagaagcactgacaccaaccaagaagcactgacgtatgatattttgatacatgcatacaatgtattatgatcaaatcagggtaattggaatatttgtcacctaacgcatttatcttttgttgatgttgggaacattccagttcttctgttttgaactatacattattgttaactatcatcatcctactgtgctatctaacactagacctattccttgtatctaatggtaattttgtacccgttagccaacctctctatgtcctcctccccactacccttcccagcttctgggaaccaccagtcaactctacctctgtgagatccacttttttagctcccatatatgagtgagatcaggaggtatttgcctttctgtgtctggcttatttcacttaacataatgaccttcagtttttatggctgaataatattccattatgtgtatacactacctttttttttttttttttttttttttttttttttaccatttattcattgatggacgcttaggttgatttcatatcttggctattgtgaatacagctgcagtaaacatgggagtgctgatttcctttcttttggccatatacctagcaatgggattgctgaatcatatgtagttttattttaattttttgaggactctccatcctgttttccgtagcggctatagtaatttatattcccatcaacagtgtatgagccctttctctgcagccttcccagcatttgttattttttgtctttgataaaagccattttaattggggtgagaaagtatctcattgtggttttgatgtgtatttccctgatgattaatgatgttgagcattttttcatatacctgttggccatttgtgtgtcttcttttgataaaaatctattcagcttatttgcccatgtaaaaattggattatttgtggggtttttttttgtttttttttttttggctgttgtttgaatttcttatatattatggttattgttctcttctcagatggatcgtttgcaaatgttttctcctgttctatatgttgtctcttcactttgttgttggtttcctttgctgtgcagaagctttttagcttgacatagtcctgtttgtctatttttgctttcgttgcttatgcttttaaggtcttagctaaatggctttgcttagaccagtgtcctgaagcatttccccaatgttttcttccagtcgcttcatagtttcaggtcttagatttaagtctttaatctattttgatttatttttgtatattatgagagatagggatctagctttattcttctgcatatggttatccagttttctcaacaccatttattgaagagactgtctgtctcagcccattttacgtggctataaagggatacttgaagtggggtaatttattagctcacagctctgcaggctgtgcaagaagcaaggcaccagcatctgctcagcttctggtgagggcttttgtgctgcatcaaaatatgaaggagaagatcaaagggcaagtgggctcatgtgaagagagactgatccccggggtagtgagtaggggtcctggctttataacaacccattctaatgagaactgatccgttctccccaagaaccaatccaatcttgcaagagctcactaccatgagaatggcacaaagccgttgatgagacatttgctcctatgacccacacagctcctactaggccctgcctcccaacaccaccacactggggatcaagtttcttctttttttttttcatacccttagggtgatgtcaggtatcagatttcaatgtgagatttggtagggacaaataaaccaatccaaaccatagcactgtcttttccctgatgtgtgttcttggtgtctttgtcaaaaaatgttctcctcatggctgtaaatgtgtggctttgtttctgagttctctatggtgttctgttggtctgtgtgccctttttttttttttttgagacggagtctcactctgttgccaggctggagtgcagtggcacaatttcagctcactgcaacctctgactccctggttcaagcgattctcctctctcagcctcctgaggagctgggattacaggcacgtgccaccacacctagctcatttttgcatttttagtagagacggggtttcaccgtgttgaccaggatggtctcgatctcctgacctcgtgatccacctgccttggcctcccaaagtgctgggattacaagcgtgagccaccgtgcctggccaagttactccagttttaaaggtagaactggagtcaatatagcctcactttggctcgcacacacttcatgatttgttagggaaatatctggaggaggtgagacttaagggatcgctaagatttggatggtgaaagaggtgagaaaagaacgtcctagtgcaggacaatgagggaaaaaggaggtgggagcggaagtacaggtagtgaaagatgtctttgaggaatggtggttagaatacaaattttgtaaatgttttgggctgagttgtgtaagatcaaggggtggaaagattgtagaaagctttgaatggtagcttaagaagccaggcagtaggagaaggaagaggtggtttagatgggaagtagtggtagcatataggatgaattgaacgggaagaaaatagggatgaggagaacagttaggaggctgctttttgaagaaaacatcttgattgagacatggttcacataccgtacagttcacccttcttcagacaaaggaggctgcttttttaaagacgaaagttccacttcaaacttcatggctgatagccacagaatgtgatatttttcccatgaagattggcaccttcttcccctgagggctctctaagcccactgcgtttctgactcctgttttttacacaggattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaagtgagttcactaaacctgtcctgtttgtgagcaaagttgggtggacgtgagtgtaatacccacttcttcctgtggttaggtagaacttttttgcataaacttggttttcttacagttttattaaacttataactccctgggtcttggagaatgtctttcctcactgttttcccttctgtccctttctgtacagcataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtgggtgtccagagtgaagggaataaatccattacgtagctgttaaccctgtcttttgtatgtcagtgctccgattttctttgcaggcattattactttatcatggtcatacttttgtttggttctactttgattcacttaattctttgttatgctgaaaaatatgacattccgttcctaaatatataagtaggcttaaatatgttacatagtcaaaataacactatctctgacaaagttaaataatactttttaaatatcatctaaccctagctagttcattttcattcttcatttgttcccaaactgtcctttatagctgttttgttgaaaacaagatctagcctaggaacatgtattatatctggctgttgtgtcccttgagtatcttttaatctagaattgtccctttcttcatgagactgacttgttaaagggatgggaccaattgcctattttatggatagttctagttgctttctcatatttgccttattcctgtaaattggaaattaaatttctaggcttgtcacgattcagttcaacatttttgatgatgtgtatttcatattgcctcatatcaataggcatataaaacccacttttcccaccatcccaccattagagatactaagattgatccctggattagggagaccacttatacttccattgcgtatttacgcttttccctcatcactagaacatcatctcttttgcaccgtcaaaatatctagttttccattaagcattcacgtgatatttttaacccaattgataatctttcctaaatcagtaccttcagtaaaagttgctgaatgatgatttgttgctctgtcattcctcctgcatttattagctcatgtgtagcctttttttcttgtctatggaggaattgcttgaactgctgcctttaattctagagttagtcttaacatggaatttagaatatgtaacaggatattgagaataagtgatttctgttgcatttttgcactttgtttaaagtaactgtgcagttccaaaactggtcttgagaatatatcaaatggttgggataccctagcaatctttgttccttgaatatttaaacatgctgtgcttaatgctctttttacttgggggtctggggcaggtatctcgatgagttgatgaaactgaaggctcaggcacatgcagagaataatgaattcattacatggaatgatatccaagcttgcgtggaccatgtgaacctggtggtgcaagaggaacatgagagtgagttatcttcctgtcctccccaaataatgtcaccattaatgatgatgtgattccatgaagtggttcaaaatactactcctagaaggatttttgggtgagagattgaaaatatctatataacacaaaaggctaaagttggatattgttttgagaacaccaggcaattgctataattaggtatatgtccagtaagaactaaattttgggggaggtgaattgaacatgatctgttatttttaaatgctgttataacaagtagtcctgacactacatggaattaggttgaattgcacaggttgtaggcatggtcctccacaagactcctctcacttcagacacaagctgaaagctgcagggttcccaggccactgtacttctgaacaactggctgcaaatttggaggatcccttctacccgctcaggtttaataatttgctagaatgactcacagaactcaagaaaatgctagacttacgattaaaattttattacaaaatatgtaaatcaggatcagctgaaagaagagaatcatcaggcaatatctgtgagagtccccaatatgaagcttctgtgttctcaggatgtgtcactctcctggcacattgacgtgtatcaccaaccagggaaacacacctgagttttgggtgtccagagtttttatttgggttcgttacatatgcgtgattgatagtattggctttgcgattaaactcaattttcatttggcctctgctccctggagaatgggaggccaggctggtatcacgtgactctatacctcagtggttgatctttccagcatggccagcctccatccttaaactctcatgaggccaaccaggagtcattggttggcataaattcaggtgtgggcggaggggcccaccatgaatcacagaaacatacctatcactcaggatatcccaagggtcttagacgctcccccagagacaaagaccagccagactttttattatacagcagagtccttacaaaagcagtacggctgcctaagatacctggggagtgaacgttcctaattttaatttgtatttcctgggagaaatattcaactgacttggtgggaagagccttgcttcgcattagggagccctgcgcttggatctttcttctgccatttgtttgctgtgtaatcttggagaagagattgctaagccttgttatttcttctataaaagtgttgaattagatgactttttaagaacccttgaacctttttaagactcttcgtgaatcctttgtgactcaagaatgtttttgattacacattccagtgtacctgaaagctatacagtaaggccagtttcataaaaatcctcatcgcttttaagttagagcaattaaaaatgaaacaaaaggacttgagcattcaataggaatatgaatacaagtgagtttagttgaaataaatactaattaaaaaatgaaaacagtgctgcttaacggatggtaagttgcagtttgaatcatggttactcttaggtggatttatgattagttagcatgttccatgattgatttgtttatgtacttccttaattagaaaaaaaaaactttctgtctctttatatttagggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggtgagtggcatcggaattgttctttatgttcagagcacctcagccctcctagaacaaaggtagaggtaggaatatcttccttgattcattcagtgaatgccttctgggcacccttagattcaaagcactggagggacacaaaaatgtgagagacataggctccacctactaggagctcatgctgttttacacatttgggtttttgttcttttgtttgttgttgacagtcttttgtgtctctttcagtaaattctttactgaaatataagatccagggctgggcgcagtggctcacgccttgtaatcccacagcactttgagaggccaaggcaggcagatcccttgaggccaggagttcaagaccagcctggccaacatggtgaaacctcatctctactaaaaaaaaaaaaaaaaatacaaaaattagctgggcgtggtggtgcatgcctgtaatcccagctacttggtaggctgaggcacaggaattacttgagcctgagaggtggaggttgcagtgagccgagattgcgccactgcactccagtctgggggacagagtaagactccgtctcaaaaaaatatatatatatatatatgtgtgtgtgtgtgtatatatatatatacgtatatatataatatacgtatatatacatatatacgatccagaaaaaaaaatatatatatatgatccagaaaaatgaacaaggtagatgggtatgcaattgcataaattttcaaaaggaggcacacctgtgtatttggcagtcagattgtagaacccattaccagcaccacagagaccttcctcatatccccttccacccttagccaccctccatttggtggtaagcactattctgatttctattaataacaccacagttcatttccgtccacttttgagctgtatttaagtgggatcataccttatgtgctcttttgtgtctggcttctgttgccctaaataatgttaatgatatgcatccatgtggttgcatggagccatcctttgctcattctcattgttgtgtactatttcattgtgtggttatatgttattggtgaagttttttgttgttttgtttgttttttcagactgttgtaaatagggcttctttgttttttttttgagacggagtcttgctctgtcacccaggctagagtgcaatgacgcaatctcagctcactgcaacttctgcctcccaggttcaagcaattctcctgcctctgcctccccagtacctaggattacaggcgagagccaccatgcctggctaaaattttttttttttttttttgtattttttgtagagatggggtttcaccatgttggccagtttggtctcgaactcctgacctcaagtgatctgcccgcctcagcctcccaaagtgttgggaattacaggcatgagccactgcccatggcctgtaaatagtgcttctatgaatttttaattttggttaaaaacatatatgtgcatttctgttaggtatacattttggagaggagttatggccatagggaacacatatatgaagctttaatagataatgtcatgaaggttttttgtgacaacttaattgaaacgtaattcacgtatcaggtaattcagcgtcagtggactttagtacgttgatagaattgtgcagtcatcaccacagtcaatttttgaacatttcatcaccccaagagaaactcagtacccattagtagtcactcattttcccttaatctcccccagccctgggcaaccatcagactgctggtttgtctatgggtttgtctattctgaacatttcatataaatggagttatgcaatgtatggtcgtttgtgactggcttcttttagcttagtttatccaagctgtagcagtagcacttcatttctttttgttgctgaataatattccattgtatgactgtaccacattttatttatttattcatgagttgatgacacatggattatttccactttaccacattttatttatccattcatgagttgatgacatatgaattatttgcactttattcgtgatttgatagacacttagcatgagtgacagctatataagttgtatcttcaatctacttccctttttagatatggaagccgacctagcttattctccgaaaccccactcctctgacagtcagatataaggctccctttggactttcttagcagcaaaaacaaacattactaccactagcatacatagaatcattgcagcctgacacattagagattctgaatcagtagaattagactttaagcttaggaatctgtattttaaaaatgactttttcattgttctgatgaccagccaagtttgggaaacactaatctaataaaatgaatcaaagacagagacttccatttctagcttccctagagccaactacttcttatccgagtaagtaaaatcagttgatctcaatttcctggctatgaaatagcagttgtgattcaaccctctccacagcatcaagtgacattctgcataattatatctcttaaatgaaacctggtagtatctatcagatactacacttacatgattaggacatggtaatgtcaactactgccatgccaatgtaatcaaaggagatcagtcaacatcataatattaccaacatataaaattgcccactcctctacccttcaccaaaacttacagagcccacacgagtgtcagtgtgcaaaaagctccaatacactaaagccttggtctgtttttatacgtctggctactcagaattaaaaatttcttttagcccttccgcttgctgcctcacttcaggagtcttctgaaggctatggttctatccagttgttgttacttagtaagcactgaaaaggaggtcaatcacaattagaaaacagatgttaattatgctttaatcaacaattatttgagggcctactacatacaaggcaacttcctagacagcaacagcataaaaagaggcataaaccttgtcaatttcctcagcaaactaggtagcgggtaagacaaacattttaaaagatgagtttatgttacaattactttaacaactttatcttcatagtagcattattcctgatagccacagtggaaaaaaacagtatgtctatcaagtcaggaatagataaagtgtaaataattcaaaaggctgtgtgtgcgttttgtttgggtcatcggagtaaaactttttgaggatgtgactatagagtttgaagcatttcctttgctgtggaataacttttcagacttcatcaaaggcggaggaagtcgggggagttaaaggaaaaattgcttaacattgccaggcccagctgggtgaactacacattgggtggaattgttttttgtttgtttgtttttggtttgggttttttgttttgttttgttttgttttttgtttttggcatcacctgagcatctaagtctccatcagccatttgggagtgtttttaaaaatatttatcactgagttacaaatttagagagcaaaagatcttaatttaaatttggtctgtagttttattttcttctgatatctttgtgtttggttttggtatcagggtaatactggcctcatgacttgaagtgttccttttatattttcaaagagtttgtaaaggattagctagttctttaaacatttgttacaagtcaccagtgaggccacgtggtccggagttttttgtgtgggggatattttttgttttgttttgagctgcagtactgtgtaggaaaggggtcccgatgcagaccccaagagatggttcttggatctcacacaagaaagaattcagagagagtccatagagtgaagtggaagcaagtttattaagaaagtaaaggaataaaagaatggcttctccatagacagagcagccctgagggccgctggttgcccattttatatttcatgatgatatgctaaacaagagctttatcagatcttttctgagcatgtgcacagcccacacatgcactgtggcctcctagatcccatccaggaatatgtcaagttgtcagagctctccatgaacatctcattctccagcttttccttataaggtttttagttagtctcttgtttgcctaaactgttatccttaatgtttttgacaattgcttttggagaaaaggctgtttgcagtggatgagctcttggtcaggtcaaataaagacagccatgcgagtgtgacctctgaacaggtcagctaatgacagttctttgggaatggggctttgaagggatggtaggaggggcagattggaataggggagtttaaagcaccacagaactcactgttcttactgagtttcagctgtttttcttgaatgcattctccaatttctgcaagcctttggttaatttctaccgtattgaaaaaactggccgggtgcagtggctcatgcttgtaatcccagcacgttgggatgccaaggcgggtggatagtttgagcccaggaatttgagaccaggctgggcaagatggtaaaaccctgtcttaacgaaaaataaaaatattagctggacacggtggtgtgcacctgtggtcccaggcacttgggaggttgagatggaaggatcacttgggcctagggggctgaggttgcggtgagccaagattgcaccactgcactccagcctgagtgacaaagcaagaccctgtctttaaaaaaaaaaaaaaaaaaaaaaaagggctgggcgcagtgcctcatccctgtaatcccagcactttgggagtcccaggtgggcagatcacctgtggtcaggagttcgagaccagcctggccaacatggtgaaactccatctctactaaaaatacaaaaaattagccaggcgtggtggcaggcacctgtaatcgcagctacccaggaggctgaggcaggagaatcacttgaacccaggaggtggaggttgcaatgagcaccactgcactccagcttgggtgacaagagtgaaactccgtctcaaaaaaagaaaaactgatgctggtgattgtttgccagtgtaccaatgttttttgtttgtttgtttttcatggtggagaggattttcagaggtctttaccattttcactaatgtcacgtttctcttcattaaatttagtgtttgtgggactcttgataaaagtggattactagtcgtgagtagtacagtctgaatgcaagacatggatatcagggctcctcaagaactcattttataattaagaatatgaatgacttaggccgtgtgtggtggcttacgcctataatcccggcactttgggaggtcaaggcaggcggatcacttgaggtcaggagtttgagaccagcctggctgacatggcgaaactccatctctactaaaaatacaggtgtggtgtacacccctgtagtcccagctactcaggaggctgaggcaggaggattgcttgaacccgggagtaggaggttgcagtaagctgagatcataccactgcactccagcctgggtgacagcgaagctgcatctcaaaaaggaagaaagaataagaatgacttaaatcggctgggtgcggtggcttacacctgtaatctttgtactttgggaggctgaggcaggtggatcacgaggtcaggagatcaagaccatcttggctaacacagtgaaaccccatctctactaaaaacacaaaaaaaaaaaaaaaagaaaaaaaaaaaattagcccggcatggtggtaggcgcctgcgcctttagtcccagctactcgggaggctgaggcaggagaatggcatgaacccaggaggtggagcttgcagtgagccaagatcgggccactgcactccagtctgggcgacagagcgagactctgtctcaaaaaaaaagaatgacttaaatctctctctgacctccatgtgtgtatatgcacttatgcacacatgcttatatacatgtagctagtaatcagctggttcacaccagcacagctgtaccagttgttaggacattgaaattcttttattttgtttggtacattgttactgtcccaaccctcccatatctttgccatcactccccaactctaattgaaatcccactatatggcaactaaaccagcagtgaccataaggactctgctccatcctgattggtcagtgcttatgttgtgtagttgataaacgtgttgtacagatttgtgtatgtgtgtttatgtgtgtatgtggtatatatgtggttatatatttatatatgtaatattgggtctatcatcacacatgcaaaccaagccacatagtaagtaaagtctttttaaaaagttttgagtgatgagaagtgccctttagaggggtgtgtgagtgtgtgctttccatatatacatgtacataacatagtcattcctttgcctcttcccccttttcctgtgtttgtggcttcttcacctcttctacctccaatcattgcccactctttttttaaattctgacttctggtccctatctctttacctcttctgaaatgcaatcagcgtgtttctaagtgtcagagttgttagggagctgtgcttgaatatatcttagatagcatttttacagcaaatctgttttctctccataatatctagcctgggctttaacactctgctcagtcatttgagttaatctttaggtaatctctttaaaacaaattttaccagaaggatttgggttttgtcattttattcagtctaattggagcagaaagaacctgttctttcttcttacactgggatgaggtgtagtgtatgctgtctctctttccttcttcattctggtgaggggcttttctgtattaatgtttccctgaaacacctgagacacccatccattcactttttcttgcctttcatactattgctctattgcttatttcttaaggagtatgtatgaaaggttttactttaatctgcatggggcagggaagaaagaattctgaatgcttagaaaggttctacctttctcaatgcaagggaggttgtgctaagtctcacaactttgcttacagcagattctgctcagatatctgttgtatgattatcccagaagtgaacccaaaatggcttgattctgtggaaatgcttctgtttttatgatacgaggatttttctgctgcttctcttggagactagaccatcagccctctcgcttatgacttcacaatttaagttgtcacaagcctgcagctgactcattgtattgtctcacattggaactattgtctagtatttccagtagttattcttaggactctaggggatggtgtgtggtcattttctattttcagtaatagaaagcgactagtggtaggaaggtactaggttctgcagcttttaagtgatttatttgttcttgcattctatttatctgtttactctttccctttcccaagactgtgagcttcttaaaattgggacagtgcctcttagaattgtaaggccagcacctaccataattaggttaaatgatctttctaaaagactgcatttaagagaaatcactgctttcaatttcagatgctttcctttggccttatcctgtcacctgcactctttataaattgcagggattgtggctgcttcactatatggagtgaaatgttgtgtctttctctaataaaacaggaggaaagccaagccttccctaaggttttgtgacttcaactgttgggcagtgaaacgtttcactttgcctcaaagctcagaccctgcctcatttaggcacatagttatggtgatttactaagttctttattctgcctcattcatgccttggcaaattatattcacatcgagcaatctaaatgaatttttgagctgctatttataccaactgctgttagctcaagcctcaggagtatgttaattttgttgggtctgcgtagatcaccacaaacatgactctcacaacctggccactttaaaacctgaagtgccttgtcttttctagagaagattgccccagtaatctgctgaattgatgctctctgtaaagaccttacaggcatcttaataaagaacccccactcttttgagatcgttgaaacctacataacctcagtatgaccatggaaatctaatggggtatcagcagtggtttctgattctatcacactgagagtaggtagaagtagaatcctattgtgctaactctcagtaacagtagtgactacctggggctaatccataagctacttccccaaattgaaatatggcagccacattcttgaaaattggaagataacggccaggcgcagtggctcacacctgtaatcccagcactatgggaggccaggacgtgcagatcacaaggtcaggagattgagaccatcctggctaacatggtgaaaccccgtctctactaaaaaaatacaaaaaattagctgggcgtggtggcgggtgcacgtagtcccagctactcgggaggctgaggcaggagaatggcgtgaacctggaaggcagagcttgcagtgagccgagatcacgccactgcactccagtctgagtgacagagcgagactctgtctcaaaaaaaaaaaaaattggaagatattagaggaaggtatttctactaatctaattctgtttaaaatgccattcagagcaaatggtcaccaataagcgcctttaaaaaagaaacttgtcttaacgaatttaggaagaggaaagtaagtcacctccactacatcatacatcatctctatccacaatagtcaactcagactatgctgtgaggcttttgttagctgtactaaggaaagtaatcacaacattcattatatttctgtgtgaaaatttgcttttaagttcccagcaactgatttaacattcaagttttaggatatcagctagtgagaaatgtagattgcctgtagtgacttctggctttaaatgtgatgagtcaaagattctggttaaagtaagacttgacagtcttaaaaacattagtagtcatagagaacgttaacttcctctgaacattgttggcaaaggaggctttcaaataagtactgcatattcatatatataccctggcccttgtcaccctgttaaagtctctggaccccttcccagtctgtctgggcctcttgccccttctagctgttcacaacttcctgaaccacttaaattcatctttatataatcttcacctacatgtgagccatttcccttatcttatgacctttaccagtttgtttgtttttggagaccggtctatactcttgactggagtgcagtggtaagaacatggctcactgcagcctaacctcctgggctcaagcaatcctgcctcagcctccctagtagctgggactataggcgtgcaccaccatgcctggccaagctatgtttgtttgtttgtttgtttgtttgtttgtttgtttttagagagacggggtctcactatgttgcccaggctggtctcgagctcctgggctcaagcattccttctgcctcagcgcccccaaagtgttggattacaggtgtgagtcactgcatccaactttttaccagttttttgatgcctccttcttccatttgactaacccacgtgtctcatattttttaagcctgttcttccatatttaattgagtctaggaagcccccttcttcacatgtatgttacatgtaccctgatttcatgactttaatattttgcttttaatgatatgtaggaaatccaggatgagtcagctgtgttatggttggatgaaattcaaggtggaatctggcagtccaacaaagacacccaagaagcacagaagtgtatgtatcacctgttttatttctgttttggtggaggctggggtgacaaggtgctccgtacagcttgaccaagataggtatgggggaacaatttgccagtagatatagttaggtgaagcagtatgtgaatttagacactctctaaactattctggtaacagttctttcccgaaatagttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggtgagttctgggataatacatatgtgccctgaagctaacccttgagtatatgaggggacagatgtagaggaaagggataagctatagggaaagaccttttagcatagatgtacagtacttaggctcattttaaaggagataaaatccctatttttgaaaatatccttccccccccccttgtggacagctgtgttaataaggccaattttctgagaatgtgggaaagattaaaatatttaactgtttatctttcacagagtagcagtagctctgattaagcctataggcaattaaaagtagtttgtctgtaaaaagagggaaagaaataagatttcttaccccattttatggacttttaaaaattaaaaaactgggccgggtgcggtggcacacgcctgtaatcccagcactttgggaggctgaggcgggcagatcgcctgaggtcaggagttcaagactagcctggccaacatggtaaaaccctgtctctactaaaaatacaaaaattagctgagtgtggtggcgtgtgcctgtaatcccagctacccgggaggctggggccggagaatcgcctgaacccgggaggcagaggctgccgtgagccaagatcatgccactgcattccagcctgggcaacagagcaagactctgtctgaaaaaaaaaataataataataaattgaaaaactggagaggctgaatggttgcacattttttaagacagacaggccttaaactttggctttggagtgaacaaagttaatcatggttaattccataattggacttcataggtattttcttcttatagacataaatgagctaaattagtcattacaaagccataatttaatgggagcttagcatgcccctttactctcacagatccaaggagcagcttttggagtggtcttcatttagactgtgagactaactaataatcctgcagttctggacgtacagctggggagtgtggctctggatgtcttctatctttcctttattttctgccaggagataataacagcaagtgggtgaagcactgggtaaaaggtggatattattattaccacaatctggagacccaggaaggaggatgggatgaacctccaaattttgtgcaaaattctatgcagctttctcgggaggagatccaggtaggttacctttcttcacgtaagaagaagctgagagaaagtgttttcaagctataatattaattaagaggaacagggcatgtggtcagaagccctagactaaaattgaggttatgtaatgagctgttttgcggtaatttttttgtagtagttgggggagtgactgaggcctgaatttgtaaaacatctgaattatagaattaagtgatataaaccatatgctaagaaaagttagatgatctataaaagaaaaatgaaaagttgctaactccattaaatgcaactattttaatctctcccagtttatattttcagtctctcttctaactgttccacaaattatattagctacaacctgcactttcaaataaagttagcattttcatagagcttttaaagtactttttcatcttctgtgtctttgtgtctttgcttatactgttccattcaacagtttttgtttgtttgtttgtttgttttttgttttttttttgaaacagagtctcactgtgtcacctaggctggagtgcagtggtgcattctcggctcactgcaacctccacctccctgggttcaagcgattcttctgcctcagcctcccgaatacctgggattacaggcatgcaccacacctggctaattttgtaattttagtagagacgaggttttgccctgttggccaggctggtcttgaactcctggcctcaagtggtccacccgcctcagcctcccaaagtactgggattacaggcgtgagccagcacacccagcccattcaacagttatttgttgaatacctcaaatgtagcaggtactcttctaaggaatggggatatagtcatgaaccaaacaaagtctctgctgtcatgagatgtctctcccctgccatctatatctgtcaaaattctttccttccctttgtactgattgttggtatcataaaagaaaaaaattcaggctgggcatggtggctcacacctgtaatcccagcactttgagaggctaaggcaaaaagactgcttgagcccaggagttcaagacaagcctgggcaacatggtgaaacctcatctctgcaaaaaatacaaaaattagctgggcatagtggtgtgtgtctgtgattccagctacttgggaggatgaggcagaaggatcacttgagcccgggaggtcaaggctgtaacgagccatgatcacagcagtgcactccagcctgggcaacagagcaagaccctgtctcaaaaaaaggaatatttaatttaaaaattcagtcctccaagcacacccatctcaagtcacctcctctatgaatctttttaaaatttcctttccttacccccttcatcttcctttgaagctcccaaagaacttggtattcattcagaatttaatgtacttggattcgaattttagtgacatttgtgcttgtctatgccccctagtagtttttaaggtgagctgctaagtttgcagtactttctcaaaggggaagttacattgtcattgatggactgttgaggacttttaagttttaacttggtgctgcactcctgttacttaaaccagagttgtttaatgaatgttaaaggggaggaatatatactgggggaagatgctcagtaagctcctgtaggtcgttagacatattactaacagacattcaggattcctagagaaaaacgacagtaaaagattttcaaaaggtcatttacttccctttggcaatatttcccaaatcgtgtgtggaacaagtcaaaaatacacctgtggaaaaactgaaatagtccctttatttaggagttaacatcagatgggtgatttctaccttgtggttaaagttctctttatatggtgggttacagtctcttacccttccagtgtttcatcttcattgctaatgatttcacaggtgatgaaatttaaattcattgaactctgttctgggcattgagaagacagaaatatgtatcagagagtctctaccttccattgtttcacagtgttgtgaaaacagcagacacaaaaccgagtactgtaatgtaaggcagagagaagtggtgctctaatcacagcacaataagggaagtcttaagggaatttttcattttgtcctggagtaacatagcgtagataatattttagcagctgaggaaaaaaagaaaaggctgttctagacagaaagggaaagttaaggatgagcttgctgaaattataaaaaggaagtaggagagaaaatagaaaaggaaaaagcacagagtactgaaaggacatggaccactgaaggagaggcgaatggtgtattacctggcacgtggtaggagtggcaggacaagaggcccaggttgaagcttgagggcctaatgtgctgtgctaaggaattcagggtacaacttctagcagagtgatttttaactcttgttagttcagggacacctttgagaatcttattaacctccacagaaacactcatgtttgaatagtgttttgcatatatggacctaagaatttaaacagggaagggatgctacctcattttcagcatgtgacctgacctcttacctctcctgccaacaatagtggcgatcacatatagatcctcccactctactcaccactctgtactttgaacttacttggattttcactgattccttcttcattttctctctggaggaaacagctatcctttctaaagctcattattgatcttactgcttgatttcatcctctcccagttccttgcagaccttgtactttttgtgctcttcctccagtgcttgtcaggatttaatgtctgtctgaatcacctgggatcttgttaaaatgaaggctctgattctagtgcgaggtctgagaaaatctgtttctgacaagctttcaggtgatgttgatgctgctggcccaaggactgtattttaagtagcagcctacatacttaagcatctttatttcccacatctttgaaaaaataataatacaaaatttttttaaagcccatggaatttccctgatctggcctcacctacattcatactcttgctaagggccttgaaagttagtctactcgtcactaattcactctctgttaccatccacttcttggctcacagcagtgtggtttcctgtccagcttttacttagtaaaactcttattttagaattcatcaataaccttttaattgccaaattcaattctgagcactcatcatatttgacttgtcaaaagtctcttcctcaaaccctcaattcctttggcttctgccatccaactctcttctaattttcctgcttctaaatgttccttcttaatctctcttgctaccttcctttctcgacctctgcttgaattatacaaagagtccattggctgccttctcctacacattcttcctgagtgatctctttcaagcctgtggctctagcccttacccttgtgcttgtgactcctaaatctgtacctccagacgttagcccttttccccaccaccaggtttttgcccttcattttgcagtccagaagtccagcagacacctcaaacacagtttaacaggaaaaaaccagaggctgcaatagtgtataaggttgtatttttatctcacatgaaatgattctgcagttcagcagtccagggaaaatgtggcttcatggtatcatctgtcccaggatccttcatctttgtgctctgtcattcttagcatgtggcttccattctcaaggtcaccttgtcacctataatgacagtttggagctttgaccatcaagttagcagtccaagcaggaagtaggaagaaggggaaggagagcaaaaaaggtgtactgtcagctgtctgtttctctcaaggagctttctcaaaggtcttgccatactactactgctcacagcgcatgacctcgctctacctcatgaagtcttttttttttttttgaagcggagtttcgctcttgttgcccaggctggaatgcaatggcgcgatcttggctcaccacagcttccgcctcccaggttcaagcgattctcctgcctcagcctccccagtagctgggattacaggcatgcgccaccacacctggctaatttttgtatttttagtagagatggggtttctccatgttggtcaggctggtctcgaactcctgacctcaggtgatccacccacctcagcctcccaaagtgctgggattacaggcgtgagccaccacgcctggccactcgtggagtcttttaagtgcatacagtgttgcccagaaaaaaaaaaaaatcgaggctctggtaccaaggagaaaggagaaggtagatgtggataagtaactagatgttcctaaccattcttactgctgctgcccttgttcaagcccaggccatctgtcacttggatcacaatagcagcattgtaattcacccacttggttgaagtctcttctcactctaatctgtcagctgctttcctaacagtattgtttttctaaaaataatctccaccctgggcaatataatgaggactcacctctacaaaaaatattttttaaaaaattaaaattagccaggtatggtggtacacttgtagccccagctactcaggaggtgaggtgggaggattgcttgagcccaggagtttgaggctgcagcgagctgagattgtaccactgcactccagcctggatgacagaatgaaaccttgtctctaaagtaaataataaacatctgattgttttattcctttgcttgacaaaatttcctggctgtccagtatctttagtaacagtccaaaccctctaggctacttttcaagaccatttgcaatctgcctggagaagcaattttcagtcctcacctctggtctctccccctgagatgtcctgcattgtgacattctaggggtccctcggtacgtggcacacagccctgttgggtacctgtcactctgttcttgtctacagtgaccccagatcagccagcacagtgcccagcctagtcagtgttggataggtagataagtgagatgacatatgaagtaaaagaagatcaagtttttgtttatgaagtgttttctaggtgggaggacgtgtgtgagaacaacctagtcctaaaaaacagacctgagggctttattcctgttatgtagctaatgatctagtatagacttaggaagcaggaggtgttagcttgtgtgctgtggatgatacttcgtgaaaacctgcatccattcttgcctgtgaatgtctttgaatgtgaccactgctttttcagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcaggtatttcagaacctatcacacagacagcaagcgggcatctagagcaggggtaataaacggtcagctgtcaccattgactgtctgagtgtgttttttgagtgctggactcttagtcttctctttcctttgacaggtacctcctctttactaccatttaactgtagtgtgcctacaggtgtttaatgctggcacagtggcagttcttgggtacctcttcctctcttcttctaagactgtacctttctgtaagatttgaaccttgagggaaacaactgtggtctggcttcaatgataaggtagcacaatgtcctggaaagaattctgagttaggaatgatggctgcactactgccagacagtggtgaatctccaagtctttgtccccatctgtaaaaggggaatgccccattgtatcttatcttcctcacctggtttgttgtaagaagccagtaaatgaatctgtatggctgcactgtaaaaggtgtgcagggctgtgctgacgttggggaagtagaatgtagccatcgtgttcttccagtggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttctgtaacatttgactgtttcagtcacagtggagaggatacaagcagaagaaggcatatcaagatcggttagcttacctgcgctcccacaaagatgaagttgtaaaggtatggtagcctgaacagggtttctccatgaggggcacaggtataacacgtgttgagatgaaggactcttctaatttccaggatcccttttccacagattcagtccctggcaaggatgcaccaagctcgaaagcgctatcgagatcgcctgcagtacttccgggaccatgtaagcacccttggatcatacaggccattaggggcaattttgccatatttttggtagacagatgaacagagaaatttcttcttttttgttccttagataaatgacattatcaaaatccaggcttttattcgggcaaacaaagctcgggatgactacaagactctcagtgagtaactggctccgcatgaagagttgaggcagtggctgggagccaccaagttcagggtattctccacagacctcttttgttatcctgaaggcaaggcttgggggagagggtgtgacctgtgacataagcccctttgctaacatgtggctaggtgtcttgttggcttgttgcattaacctttatcataacatagcaatagcctgacacagaagactgcacctgatagttgtcttagcacatctcaaaattaaatgtttatgaatagactactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgtagtgcgatgtgatctcagctcactgcaacctctgcctcccaggttcaagcaattctcctccctcaacctcctaagtatctgggattacaggcacgtgacactatacctggctaatgttttttgatttttggctttttttttttttttttttttgctgacggagtttccctctcgtcgctcaggctggagtgcagtggcgtgatctcggctcactgcaacctctgcctcgcaggttcagcgattctcctgcctcagcctcccaagtagctgggattacaggcgcatgccactacaccctggtaatttttgtatttttactggagatggcgtttcgccatgttgaccaggctggtcttgaagtcctgacctcgggtgatccacccgcctcagcctcccaaagtgctgggattacaggcgtgagccacgacacccggcttttttgcatttttagtagagacgggggtttcaccatgttggccaggctggtctggaactcctggcctcaagtgattgatccactcaccttggcttcccaaagtgctgggattacaaacatgagccaccatgcccggccatcataagcttttaaaaaagttatgtaagacaggtcaggcatgatggctcacacctataatcccagcactttgggaggccgagaagggcggatcacttgaagccaggagtttgagaccagccaggccaacatggtgaaaccctgtctctactaaaaattaaaaaaaattagctggacatggtagtacatgcctgtaatttcagctactcaggaggctgaggtggaagaatcgcttgaacctgggaggcagaggttgcagtgagccaagattgcatgactgcactccggactgggtgacagagtgaaactctatctccaaaaaaaaaaaaaaaaaaaaaattatttaagacataaaacaacttaattgacaaaattttgatagagaaaagaagataaatgtcttcccctaatttcacctaccccagtcattttgtatcttacattcttacttcatattaaaggataagactctttccctatgataagtagtcataatttttttttaattttattttttgaaacagagtttccctctgtaccccaggctggagtgcagtggcatgatcatgactcactgcaacctcgacctcctaggctcaagtgattctcccacttcagcctctcaagtagctaggacgacaggtgcatgccaccacgtctggcaaattatatttttataagagatagggtatctttgtattgcccaggctggtctcaaaactcctgggctcaggtgatcctcctgcctcagcctcccaaagtgctgggattacaggtgtgagccgctgcacccagccataaatattatttttaacagtagcatattagatttttagaagatatactatgatttacctctttttcccctagtatttgacatttaggttgttttccaagcgtttattataaataacattgcaattaatgtttcaatatatatgtagcttttattgtatttaagacttatttttataatagactgctggaagttggtttgccaattcagtggacattcttatggctcagattctttgttggaacataggaatggatttgactggtgtactgaaaacaggataaagtgtagtggtttttaaatattcagtgggaatctgccagtgcagtacaccttcatgtgagtttgcacatgctgcaaaacctttcctcaatgcccagaggttcatctttgaaagctttctgatctatttattggtttttgtttataggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaagtaagtggctcctggaatcagtgttataaaaatttagtgaatttatttttccacaagaaagccttaccatcgatctctctggaagtatttttgacttccactgaggggtgagtgaggggcactgtaacatgttaatttattaatcttttttctcatatgtattgtagtccttcaattttaaataattgaatatatcttgccagcctttatattacctacaaatgacttatcccttggttttatttcagaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtatgaacagatttcctcagggcacaggccccttcccactatcagaggggctcccagtttgagattcatgccttcctgatcttttcttgatctcaattaatttatgaaaaatacttactctaaagaagcatctaatttttaaataactgatataaaatcttgctgcttctagggaagggataaattaactttaggaacattctgtattaaggtataatttcaaaaagtaatctgaacagaaagaattcacatttttatctagtagcggacccaatcatgaccacgattgagcgtgcagctgcaggaacattctgtgagtgctggggaatgtttcgagagaaactgtttcagggagataggatctttaagcaggaaggatcttttaagttgatgggttttgtgacaagtttaaatttttatctgatgttttataggtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaaggtatgttaaccataatgacacttttctttcatgttgttatagtctttccctcttttttcccctctctttatttataaactaatattagttcaaatagtttttcttttcttttctttttttagacagagtttcactcttgtcgtccaggctggagtacagtggcataatctcagctcactgcagcctccacctcccaggtctaagcaattctcatgccccagcctcccgagtagctgggattacagttgcacgctaccacacctgtctgatttttgtatttttagtaagactgggtttcaccatgttggccagactggtctcgaactcctgacctcaggcaatccatctgcctcggcctcccaaagtgctgtgattacagctgtgagccaccacacccagcctcaaatagtttttctttagaaaactgtgctttctaagttgttgacctagtaataaattcacttatttagcaaatatttattgagtattaactatgtgccaggcattgtgttagagatgtgtacagtaatgcaataatgagtgaaacagacatgcttcctgccctctcttcatagttcattgggtggaagagacaccaaccaggtacataaaaataaaagcataattaaacattgaagaaagttttatgaagttttatgtacggttctttaatggagactttataagagggagctaacataaggtggttagggaaagcctatcccggaagataaaatttcatttagctgaggccctaaagctaagatgaacccagccttactaagagctaggtgcagagtgtttatgtctgaacactctaagctggagggtgtaggacttaaatggaccctggcataactagggatacagttgaatgagaaggttcatatagattgggtgagatcactgtgtttcattaaaggaaaaagaaaacggtgtggagtgagcttccctgaaatatcgtgagttgggctaattaaattaacgtattacaggagatagctgagctagggccatagcgtaaccaccaacattcatttatctaaagcaaaagtgtgccaatcaaatattggtaatgctgggaaaagggagttcagaatgccaaaacgtttctggttttatttgtcttgggtgaggacccagaggggtgggagatggaggtgtgagcagcatggtctgttgtggttttttcttgttgtggagtagagttagatcatgcatgaagctctctgggcataggtggagtagcagctgtccacaccattgctattcaaagtgtggtttgcacaccagtaatggaaaatcatctgtgcacactgtttagtttaactgatactttttttttcatagcaagattttcttaatgaaggaagtaatgtattgatttacattctgactcattgtctttatcttgtctttgatcagtttgtagactggcactggtccacactttgaataacactattcttcattctactttccatgtacccggatgccaggcaaacagggagttttacgctgggtggagaacggaacattctgctgactccttgaaagggcttatctcaccagccatggtagctcacgactgtaatcccagctctttgggaggctgaggtgggaggattgcttgagctcaggagtttgagaccagcctgggtaacatagggataccttgtccctacttaaaaaaaaaaaaaaaaaaaattagctgggtgtggttgtgcacacctgtagttccagctattccagaggctgaggcaggaggataggttgagcatgggaggttgaggctgcagtgtgccttgatggcgccactgcactccatcctggttgacaaaaaaagaaagaaggggcgtttccttattaggaatcatttggcatctgattggttctcagtaccatgtaggtctgttatcaggactcagatcattgcaaaagtctttttaatttttttgcctgcatacctgaggcccacatccaggaatgtggtcagccaagtgcaatacttgtctgggaagttttgcctgcaacccagggcattccttgccgatagccccatgtacactggctccgggcttctcagttatttcctctgatggtccatgagtcagtcattttcagatccaaagcccgctggacatttcaggattggttttcttgtgggtacctataagaaactggtgtcttattttgcctttcataaaatggaaattgagccaggcatggtggcatgcaccagtagtcccagttgctcaggaggccaagacaggaagatcgcttgagcccaggagtttgagcactgcctgggcaatgtagaccccatatcttaaaaaaaaaaaaaaaaaaaaaggaaattgatttgaactctttttaagataccagtgactgtgagggatggtggtgtggtggggatctgtcctgcaggtaagcatcacaggtcccttagctttcttcttttacttcagccaccatacacgtagcaaactggaatcttgtcacctcttgggaatgttctttcctaaaatctcaaagttaatgttctgttctatcaccaacgttttttagcatattgattcccttgctggttactacttttaaaactcatataaataataaaatatacaatattctttattgttaagttccatgtatttatttatttctcatagaatgtttctgttgatttttgcagaatttttgtgttcatagtctaccaattttaatttagccatgctatgacaaatgaagaggggtatccctatctacttgtatttttctttttgttgttgtggttgagacagagtctcgttctgttggtcaggctggagtgcaatggtgtaatctcagctcactgcaacctctgcctccctggttcaagcgattctgctgcctcagcctcccgaatagctgggattacaggcatgcgccacacgcctggctaatttttgtatttatagtaaagatggggtttctccatgttggccaggctggtctcaaactcctgacctcaggtgatccacccgcctcggcctcccaaagtgctaggatgacaggcgtgagccaccacacccggcctctacttgtattttctaaggctgccataacaaatcacctcaaattgggtggcttaaaacaaccgaaagtcatggtctcacaattgtggaggccagaaatttgaaaccattatcatgaagtcgaggtgctggaagagccacgctccctgcagaggctctagtggaaactctgtttcttgactcttagagcttgtggtgactgttgacatccctcaacttgtggctgtgtggttccagcctctgcctttgtggtcacattgccttctcttccccttctgtgtgtaccaaagctctctctgcctcttttttttttttttttttttttttttaagacaaggtcttgctcaagcagtcctcccacctcagccttcctagtagctgggaatgctagcatgtgctgctgtgcctggcatagcactcctatccttgaagacctccttctggtttctaacaaagtccagatttgtcagtatcatatacggggtctgtcatggcctgctccctgtctgcttttccactgtcatttctcctgtctccccttccttcctagaagactcttcctctccttttttcctgagttcaagcatcccttcgttttggaagctttccttgctttttccattctgagttgaagccctttccctatggtcctgtggcacttttggtgaactgatttacagcacaataggtttataatcatctgtttgtgtgtcgctcccaccagactgtaaaagactgaagagaaggtgtcatgtcttgtataacttttattcccaagtgcctgttattgtgcctggcacacaattcaggcacctgattcacagttaaaaacctgcgttcagattctagacttatcacttaccagccccgtgaggatgagcttaagctatctaatatttctgggtcttatagtttatgaaagataagacacttgcttcaggctgttcctggctgttagtctaacatagttgggtataatttctgtcttcccagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccgtgagtgccatcagttgtcatgacccccagtagaacccagcactaagtgcctttctgctccttggcccttctcactaagttttgtccatcccgcagttatgggatgcgcttcattgccaaagtgctgaaggactcgttgcatgagaagttccctgatgctggtgaggatgagctgctgaaggtaagaatctcatagccggcagactcctgccctttgaggacaaagcaataaaaccagggctgaccatagatcattactaactgcctaagtgtaggttctggcagtagcttaccattgattgtgagcttttgaaagcaattgtaattggtaaatggtacctctcttaggatgaaacacttcctatagtttggcacacaaacatcaaacaagtagaaagatggatttttcctgttttcagatgagtttctttgagtcctatcttttcgctgtagtattgttccctctgctggtgacctggcgaatagtagcaggcacagttgtttctgctaaggctgttgctgataactctttcttactcagctatgctcttctcttttctttttttttttaatctgaatgcttttttcttctctctcctagttctgtgctttcctacagtgaggcctcgattctagactttctgttcaggtgaattaattttatttcttctgaatgaaactctaggggaaatgctgtgactgcccctgaattcttctgtggaagagatgtgtgttaagtgaatttaatttcagaggcatgaacttggcctttgaagtctgcagcatgagaatgttgggaggtggggttactctatgctgattgggtcatgttaaggaatttagctatgtttgttagctttttataaggaaagcccatctacatgaaagtacaaagtgcatgtgggtgacagcagccttatttgctaccatgatatgtgaacaaaagatgccctgaaatacttaataacagactttaagtgtgtcatttttaccttctgaatctgctctttcattaactactggcagtagttttcagttctgttctcattgttttcctgtattgaacaaagggatatttcatttagttccaggccatgagagagagtgtgtatatgtgcatgcatgcgtgtgtatatgtattttttatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcaggtaaggggaaaggcacaagtgcttaagagagtctgtggatgtatttttattgttgaggggaaaaataagattaaaaaccacctctcactttccccggactgccatatgtagaagacgtgtttgatgtgcccaggattccagaagatgatccatttactttgaagagaattttcatatgaaatagatagtagttaacacttatgaaatagatagtagttaacataaaaataatgatgattatgcatttagtacatgttaccttgtaatcagagaagaattggagaatgcttttaatttttgtaaattaacatctagttttgaattcagtgcttcagagcactgtcttagagatagaattggttctcctaatggtgtctggaaacttttaagtcatggtgcaatggttcttatgggtaaaactaaaactacaaactaggtggagaaagaagttattcgaaccactatcccaaggttgtcaagcacagcaaacacacagcactttctcttgaagtaactgttgactggcttctgtttgcactcattgtgtgagaggtttgtgaaatgtcctcttgccaacttcatgtgtatgtccctttttggggggctgcctcctgtgcttatttcagacggtttttccaaactgcttgtgatgtcccagagcttcaggataaatttaatgtggatgagtactctgatttagtaaccctcaccaaaccagtaatctacatttccattggtgaaatcatcaacacccacactgtaagtatttttctttaattacttaatttcattgtccttaattattatccctggctgctgcttatcatctctggtagccaggtgtctaaccttcctgtaatctaactgacaatgcatctccttgatgtctctttttttgcttgttattcttttttgtttatttatttattttttgagacagagtctcactgtgttgcccaggctggagtgcagtggcgcgatctcggctcactgcaagctccacctcctgggttcacaccattctcctgcctcagcctcccgagtagctgggactacaggcacccgccaccgtgcctggctaaattttttgaatttttggtagagacggggtttcactgtgttagccagcatggtgtcgatatcctgacctcatgatctgcccacctcggcccccaaaagtgctgggattacaggcgtgagccaccacgcctggccttttgcttgttattcttaacagtatctactgctaagtttctaaaaggtcttcccaggccacctgcatcagaatcctatgggctgatagttaaaaatgaagtttcctggacaccgccccaggcctactgaatcaaaatcccactaaatttatctattgccttaataaaatagtgcttttactcttctttctttttaccctagctctctgcgttatttttctaacatgatctagaatactagctttctctgtgtagccttggagtggatttttcccttggaagctggagctccatgtttcttcagatttttcaaatcattttttcccctctggggacatggacatgtaaaacaggaacaagggcatatgttaaaatgtaaatgaaatttcaggttactgtcatttctgagggcatcactggggataatggcaccttgaagactttgttgagtgcccctacaataattataacattgatttggtatacttttctctgaattaaatcatgtcatacactggaaacattaagtaaaagcgtgcacgtgacttatttgaactggcagtagggtacattgatgactttgggtattgaactttgagtttcagtgttttgtgggttttttgtgtttgtttgttttgttttgtttttttgagatggagtcttgctctgtcactcaggctggagtgcaatggcgcaatcttggctcactgcaacctccacctactgggttcaagcaattcttctgcatcagcctccctagtagctgggattacaggcacacaccagcacgcccagctaatttttgtatttttagtagagacagggtttcatcatgttgtccaggctggtcttgaacgcctgacctcaggtgatccacccgccttggcttcccaaaatgctagaattacagacgtgagccactgcacccagccagtgttctttctcaaacagggcacatttgaatcctttatggccatgaggttaagagaataccagtatttcctcttcttatatcataacataagtcattcaacagagcctggtgtggtgccttatatatcatattgtttatttgggttagtttgctgaggatttgcttgttgtttctttgaatataggaactttgttggaacctctttgtgcagatcattgttagacattctagggagggacgggctgaagagttgaatgtataaatggagttgatcattggtgtttgcagctcctgttggatcaccaggatgccattgctccggagcacaatgatccaatccacgaactgctggacgacctcggcgaggtgcccaccatcgagtccctgataggtagagttctaacttttgcctggaagatcaaaagggaatgtgacagaaaagtgttgtaattgtcacctcctctattttttgcactataccaaactctggatatacattgagaaataaaatagatgtgatcctgatagtttcataagagagaaaacaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagttgttttttttttttttaatagagatggagtctcactatgttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatcttatatttgtattatttccccccaatatctcctctctttattacgctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaagtgagtatcaaaagaaggaagaatgaaatgaatgtaatctgaaggtttcttggcctttggagaggaacctgctgggtcctacctgaaatgaccatcctgacctctcgtacttgtcataatcccagtcaccaatcacctcgcatattgtacttggtacaggacttatctgccttattttgctaatatgctacagtgaaatgtaaatcttggaaatcctaaccctcgtacctacttatggaatggctgggtaaataagccttgtgccttgagtactgtgtactggcagctgccgcttgggacttctgtgaggtactgtttgtgctgctgctgctgctgctgcttcggtccacttgagaggaactagaacactggtaatatttaaatgcctcccccatctcgtttcagtacaaaacgtttaattgtggatgtcatccggttccagccaggagagaccttgactgaaatcctagaaacaccagccaccagtgaacaggtaaaatttagggtctaacatactcctttgtttggtagataagctctcccgataggcgcatgtcagagaaaggaggggagacacaaataacagttggtagcctaggggtgagcatgaatgtaactgggggacagtggtagttatggctcgtctgagaaagtttttgcttcctgagtccaggtgatgtcctttggacaggaagctcactggcacttgcatgcagaatcattgtgcccatcccgtatatccatcccttggtatccacaggcgattctttccagcacccattctccccacccccggccaataccaaaatccatagatgttgaagtcccttatataaaatggtgtagtatttggccgggcatggtggctcatgcctgtaatcccagcactttgggaggctgaggtgggtagttcacgaggtcaggagattgtgaccatcctggctaacacgtgaaaccccgtctctactaaaaatacaaaaaattagccaggctaggtggtagatgcctgtagtcccagctacttgggaggctgaggcaggagaatggcatgtacccaggaggcggagcctgcattgagccaagatcgcaccactgcactccagcctgggcgacagagcgagactccgtctcaaaaaataataataaataaataaataaataaataaataaataaaatgttgtagtatttgcatatacttacgttctcccatatactttaaatcatctctagactacttataatacctactacaatataaatgctgtgtaaatagttgttactgtatttttaaaatttgtattattttgtattgttgtatttttttttcaaacagtttcagggttggttgaaaccatgaatgtgtagggttcactgcaatttattgaatattatatattttgaattctgttacatgccttggtagatagaagaaaagtacagaatgtggctcctaaactcagtgaacccatggtcttgttggggaaatgtgacatatatacctgaaacagtgatgaactgtttcaaaattaactatgttactgactgaaaaataagagaagtttcaggaaagaggccagtgaagcagtgcattaggaagcttcctaaaagaagtggaaccggagccagatgtataaaggtggaaaggatttgggtgtgcatgtaagacaagagagggcattcgaggcaggagagcgatgtgaacaaaggtacaaaggagggaagagcatgatgcgactagactacatgtctagaatggagctgtgggtggaggtgagtagtgagaaataaaacatgagaccaaattatttagaactcacaaactagatgggaatttgtcactgcagagataaggaataaagagcctctgtaaggttgaagaccatttaataaaagttaattaattcagcagtgctattagagcagatgtagttgagtcatataggtgtgtgataaggtccagtggggtgggcagatggttgggtcctggcattttgtagggttggatgagtcatgtcatatctaagacccttgtttcttttttttttttttttttaatttgagacagagtctcactctcactcaggctggactgcagtggcgtgatcttggctcactgcaacctccgcctcctgggttcaagcgattctcctgcctcagcctcccgagtagctggactacaggtgtgaaccaccacacctggctaatttttgtatttttagtagagacaggatttcacgatgttggccaggctggtctcaaactcttgacctcaaatgacccacccactgtggcctctcaaagtgctgggattacaggtgtgagccactgcacccggccatagacctctgttctcatttgtcaagtaaggaaagtaggtcaagtcattcattctcaaattttaagcatggtaatctgtttcattaaatgacaacttagctaaaagcccagtatatagagcaggtactctgctactctggagctactctgatagccagcaatagggcatctgaaatccagccctataggactctgtgatgcctctggcaaactcttgaggctgcacagagaactatttggaaaccattgttttcaatgaagtctcagctgtcagttgctatgactgattactgattagatatgtgtgaaaggcaagtaaggacatgtaaaccaatacttgaaacatgttgaacctagaaagaaatttgaaataaggaaggaggagccagtctttattgagaacctagtatgtgtttggtgctctcacctctgttctttaatttaatccttacaatattcccatgagtcgagtcttttcatccttattttgcagatgaggaaaccaagacccttacaggttaactggctaagatcatcagcttgcagtgacagaaccggaggtggatccagttctgtctgcctccaaagcttatgctgtttacattatgtgatgcagagtagtcttgacattagaaaaaaggggactattgggaaagggaattgctccagttagggggaattacaagtttgaactatgagccatcccgaatgtaaacatcccagtacaaacagctcagaatatggcaccagagccatggtcacaaagatttaggatctgtcaacacagaggcagtcaatgaagtattgagagtaaacagagagaaatggtcacagatcacatagaagtaccaaaccatgcatagagcaagaagacagtgcagagaagatgagcaaggtgacagaaaaggctttggattttggacaggggaatggtaattggtgataagagcagtaaagaagaaagtgctgaaagaacgaaacagtgagtgtagatcatatgttggacagggacagacaatggacggtgactatgaaggatggcgactatgaaggatggcagtatcaagggaaggtgtttccctgttagattgtggtgtctgcagaatgtttgaaagcagaggcaaggctcgagcatgattccaccttgtgacaaagtgacacaaagaattagcaaggatttactaagcactggtcttgttgtattagtatagttataacatttatacagctatgtttttaataaaattaaatggcttccatgtctcaaaatgtggtagagaaaaatgactttgtagccagtagagtccagtctcggtgattgtacctggagtccaggaaagaagccctaagcacctaagcagttgtgtgatttgtttgtttgcttgttttttgtttttttgagacggagtctcgctctgtcgcccagactggagtgcagtggcgcgatcttggctcactgcaagctccacctcctgggttcacgccattctcctgcctcagcctcctgagtagctgggactacaggcactcgccccatgctcggctaattttgtttttgtacttttagtagagacggtttcaccgtgttagtcaggatggtcttgaactcctgacctcatgatccgcctaccttggcctcccaaagtgctgggattacaggcatgagccaccgcgcctagcccagttgtgtgattttgtagatatcatctcttctaggtggaaagagatgtgcctctgcttcatgcaatttttcatctatcatttggcagggggcagaatttgtttccttctgtttcaaggttggagtttaagaactgtataagttcaggtgcaaatgtgctatataaattcaagtttaggattagtgtggtaaacttgctaagaacttctttttcccatccgtaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggtactgcattcgggggacagaggggacccggccttgttcaaagctgagaggctcgagagacagtagctgttcacataacagcatagcttcagttcatgggcaaattagtgccctcctctatgagaaaccatatctgactctccagcatgagggccttgcccgacctgaggtggcttattccatggcctaaattactagggagaggaccttaactggagcctcctatgaccttaaagaatttgtcttcagccttaaagaattcttccagatctttttcatgattactgtgaaatataaattcacatcaagctgattaaatcgttgatttgtatgaatcatctcaagcgaggggctttggtgaggactaagagtttaggtgttctgtgctgttgcactaagataatattatgcacacctgagaactggtagttgatgtattatagttctctttttctccctttcccaacaaaatatttaagaggtccaaaccagctttgcaagtaaattctaaaaatgtgtaagtctaaatgtaacacatttccctgctagaagatacaaatgggggaagaaaatttgagatctgaatttctctgttaatttgtgaaaacaaattactgcctgttgaatgtatggttaggtcaggcaccgtggctcacatctggaatctcagcactttctgagaccaaggcaggaggatcgcttgagaccccatctctacaaaaaaaagttttttaattagccagatgtggtggcatgtgcctgtaagtcctggctactctggaggctgaggtgggaggatcattttagcctgggaggctgaggctacaggaagccgtcaaccactgcacactcgagcctgggcaacagagtgtctaaaaaaaaaaaaaaaaaaaaaagtaggtagtcatatttaaggcagagttaagcattgctgggttgtagtgtgaaatgataatgataactgtcgttatttttctaactttaataattatgtctcaggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaagtgagtattttttctttttaaagaatcaatgtcagaattagagtgaggaaaaagcagaggcaactgaaatgacactggaaatttttacttaaaatacactggatctatttattgcattagtcttttattttacctctaatcatttgtgtaattgcctaattccatttgtaagtgtatgatgtgaatagtgggtgggggatttcatggatgcttatcgctaagtattccttttgcaaaatatcttcttggggcctgtcaaggtggctcacacctatcatcccagcactttgggaggccgaggcgggtgtgtcacttgatgtcaggagttcaagaccagcctggtcaacatggtgataccccatctctactaaaaatatacaaattagctgggtgtggtggcacgcacctatagtcccagctacttgggaggctgaggcaggagaattacctgaacctgggagatggaggttgcagtgagccacgattgcatcactacactccagcctgggcgacagaacaagactctggaaaaaaaaaaaaatcttcttggccttagaaattaaaatcatgaaaggagatcatctgctggtcccagaatcacttaaggaatattatacaaatttgggtccccttgctcctctctatacttcctggggacaagatcacaggctctgattttttttcctgggtgctgaggaaagtctgatccagccttcttggcactggccacaaactatcagcatgcccatgttacagggagggaattgaaaacccagagaggtgggtgataagagcaggttttacttgcagggtagtttattatttattcctaactttttattttaagagttttcaaatctcagatcgaatgaatagaacaataagcacccatgtgcccttcacctagattcacccatttttaatattttgccatatctgcttcccatttccctggctcttgcatgtcctctgtttctctctttccatggaagactctctggggtcaggcatgggtgatggaagggatgaaaaacaggcccacctaaccctgcttgcagatctgactcctgtgagcttttgatgtgttttcattgttccttgtgcacttcctgactttctgacacaagatgtttcatgttcaacctgtagtttcccctccccagggccagaatgaactgtttctccaagcatgcctggtttctttgaatgaagaatggtatttagaaaccaagatctagaactaggtgtgttcactgccagatttgtcatggcctccaggccttctaagcagacagacctagattctcatttttttttaatgctgcatattattccattatgcagatagatataacagttgacttcagcagttctccattgatggacatttaagttgtttccagttgtttgttattattttttaaattctgcagcaaataacctcttgtacatatgtcattttgcaaatgtgggcatatttctgaagttagcacttcttgccttgattatcctaatagcctcctaacctgtttctttttccttattttcattcatctgtaattgctgtgctggcttaaacgcttttaaaaagtatttgatgacattttaattttttccctacacagctgaggggcgtagagtaactccttcactcctgggattcagtaccattccctcagctggcatacgaagctctcctagttacttgttaggtacttaagttcccagaaggacatgggaggattaagacactgttaaattcatgggagtgttctcaaatataatttaaactaaaaatagaagcaatttagtaatatttcccctgttttgcagagatattgcttaggctaattctaacatttgtttgccattttagagttggtatgttacttatgcttatgtctggaagtttggtttctgacatgtttccttcagttaccaatgatgaagattcagagtagatggttacttatagaaagtgacatgatgtgatttttacagagtctccaaaaagcctagggaaatgaaaggaaagaaaagcaaaaagatttctctgaaatatacagcagcaagactacatgaaaaaggagttcttctggaaattgaggacctgcaagtgaatcagtgagtctttgctttttgttttataagttgatttttatttctacatttatcacatctttgcctttttgtcttcatttctcttttctggatggttacttttagtattttttatgtatttatatatttttatgtgtagaattaggcctcatactcagagttaatttgtcataaaagagtttttcttttccttgtttgtagaacatttgtctcaggtcatgttcacttatttgggtctgatcttaatttttcctcattaaagcaggaagccattccttggatttcttctgtttctgaaccaagaataaattaagagtaacaataagaggagtttgctttattccacttatagctaggaaccaggcacttatcttcatttgcttttctgggaagtatcagcttgctttgcacgtggttcatggacctgacatgtcatcctcccacaggtcctgggcccagcgtcattagcaagcatttattgagcatctgctcagtcagccctgtgacctcaggctactgatctttctcttcttttgtctgtttagggggggaaaaaaaacaacttttaaaaaaagaaccttttacatttttctaattctaaaataatatgtattcgttattaaactttgaaaatacagtaaagcataaaaaagaaaacacctgtaattccacaagccagagataaccactgaaatcgttttaatgtatttttttctattcacataaagattatacacgactcacccacttatgtatttaactactttatatataaatacatatatatatatttttttcttcttcttctttttcttcttcttttttttttttcacggagtctctctgtcacccaagagtacagtggcgcgatctcagctcactgcagccttggcctcccaggttcaagcaattctcccacctcagcctcccaattaggtgggactacaggcatgcaccaccacacccagctaagtttttgtatttttagtagagatggggtttcaccatgttggccaggctaatctcaaactcctgacctcatgtgattcacccacctcagcctcctttgggattacaggcctttattattatgttattattattattattattattatttattattataggtcattatcttccactactgttcaagtgcctacctctatttgcctttctgtcttctttttaatttgctcctatgggcttagaaactaaatagccaactaaatctggtaaaattatttatcacttaagataaatatgtttaaggaataacccgtgaggcgttccagttgaataagatgcatgtgtgtttcagtgcatgggtttttgtgacttctttaactctcagtgacctttttgcatctttcatggttctcagccctgttcgtaataggtaaggcagctccatagttgagttctggaaatctggggtgctatactttgatcatccagagaacagcataatccctttttttttttttttttttttttttttttgagacggagtctcgccctatcaccagactggactgcagtggtgatagggtatggtactcagctcactacaacctctgcctcccgggttcaatcaattctcctgcctcagccttctgagtagctgggactgcaggtgcatgccactatgcccagctaatttttgtatttttaatagagatagggtttcaccatgttggccaggatggcctcgatctgacctcgtgatccgcccgcctcggtctcccaaagtgctgggattacagatgtgagccactgtgcccggctgcataataccttttccttttggccccccaaaatttcctggcacgtaacatattgtgaatgagtgataacttaaatacgttcaataataacaatttatctttggtaatactgagtgtgcttatatacacagcacctactctttctagaaaacctcctcccttggtgctttttatacggacccccttttgtttatttacttctcccagtcctcaaacatgcatgtattcaaacacatacaccctctccttccccagtgtcctccgttttctccttttatcattaggtttcctttttggccatgtggaagtgaagagaattcctatgatgtcatcccttcacacgccacttgtggaactcctcagtggttcctctttgataggatgtaagtgctgcaggcagagagaggttgccattcctctctccaagtcccagagcagatggtacttgggcttggcaatctgtgctgcttcagctgcagaagtacttttgacctgtattttctgcagcccttttcactcttgaagacttggttcatctcctttccccatttcacagaatatttttatatgagaatataaaaaccatacccttacgatgttatctttcaacaggtttaaaaatgttatatttgaaatcagtccaacagaagaagttggagacttcgaagtgaaagccaaattcatgggagttcaaatggagacttttatgttacattatcaggtgggtatgcaccagcaggaaccaaaaactttctggatgagattcttgtccaagtaggagaaatagataaagaggagactcatctgaggaaagctgtctacattcagcagtgagctaggctccacactgcggggaaagaagctgagggtttcagcatgtctggtttggtgtgtgcgctctggagagcttttgcagatgtcactcttcagaaaacatttagctgaagcttccacttagtgctgccactaaatcgagctgacaccttggacttgaacaaaatgcagaagtacacatgctgacactgcagaattctaagcccactcagtagcttgaaatctttttgtcattttgatttgatataggtacttaaaagttagatacattctgacaaggtgtgtgtaaagtttatgtttgtaaactgaattctatcttaaatccaaaaagaactcgggagtaattcatttttgtagcataaagatccctaagttttattttgaaatatctgatttttacacgttaaaaaataacagggcatcgagaggattcctaggtgacatccagactcctttagctttgtgtgtgtggcaccggttagtctgcttctctctcctttcttgcactgcttcacacagccatgccctgccagcccgggcaggtgccttcctgtcaatgtacatttgggcttctgctcatgctgccctccctcccctcccctgcctcccaaccccgccccttttgttcctccatggagtacttccatgggtgtgcctcccccagccaagccataataggtggtttccccttcgcttctgtagcccttgcagacatcctctgtttacagtaggtgttgacttacttcccctctccccgctaaagccataaactccttaaggacaggtagcatttcttagtcatcttcgtttccttctcaatgaccagtagaccattaaaacatgttagctaaacaaatgtgaaatgattttgtgatgcacacagctaactaaagtacttccaccaaaaaaaaaaaaagaataggaacctcttattccctcagtttcaccaaattatttttttaatttaaaattttttatttacgtggagttatcagaacatatttttatttttaaattttttaaccaaatcatgttaggccaaccagtctgcctgtggtaatttattaatttatgtacaaattcattaaatgtggggtaactgccaggtgtggggtattctgttaggcacaggtcccagcagccctcatggagctgctaggatttttccaacagataattgaacttgtggggtcctttctttttttggaggggggggcagagtctcgccctgtctcccagactggagtgtagtggcgtgttctccattcactgcaacctccacctcgtgggttcaagtgattctcctgcctcagcctcctgagtggctgggattacaggcgcacaccatcacgcccggctaattttttttttttttgagacagtttcgctcttattgcccaagctgcagtgcaatggcacaatctcggctcactgcaacctccgcctcctgggttcaagtgattctcctgcctcagcctcctgagtagctgagaatataggcgtgcaccaccacgccccaacgcccagctaatttttgtatttttagtagaaacagggtttcgccatgttggccaggctggtctctaactcgtgacttcgtgatccgcctgcctcggcctcccaaagtgctgggatgacaggcgtgagccaccacacccggccttgtggggtcctttcaagacttttgacccttgctttctcatcaccactcttataaagttcagaagtgagaccactcagatttcttaaacttgttcaggacaatggtgaaagtagcaggaaaagcgggagcattgcagtcagatctggatttatcgcctccatctctgtcctgttgtgcaagtcatttaacatctctgagtctcagtagctcatctttaaagttagaataatcgcacctcataaaaatttttgtgaggactttaaaagatactatgtaatgtgcttacacaatgccaagcacatggcagacacctaataaaacatcaagttctctcttttccccttgccttcgggatagaaagtgttctcatatggaatagaaattaagaatctatcagatagtattaaggtgacattactagccttatctcatttccccgtgcttagtatatttcatcataggtttaaatgcttcaccttttccagatttattaaaactagtgacccataacatggatgaaatgggaaaatgtcattgtgacttctgaaataaaaagcttagatgtgtgtggcaattgaacatgtttctttttctttccatgtatgatgaattttgatatgaacaacatgacttcctaactccaaatcaaccagaagcctcccttggccaatgtgccctattgctccagctctcaggctggttgtgcagtgggtagttgcctagcgtggaacttttctttcgccccagttcacatctggcacacaaggcaggcctcagtccatctggatccctccctacattgtgtcctttttccttgttccacagacttgattaactgtcaaaatgttttgttttgttttgttttgttttgttaataggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgtt

SEQ ID NO: 776 - DNA, 126248 bp, Homo sapiens
atgttgtttttcctgtacctaagttcccgctgtaggtggtacctttgcagacggtgcgatgggggaagcagagaagtttcactacatctatagttgtgacctggatatcaacgtccagcttaagatgtaagagaacactcgggacagggagtgggattgctggggcgtagggacgtgggggcaggggcctgttgggagtgagaggcagaaagtacgtgactcgtctcaaggcccagattgggggcggctgtgagggctgtagccagggaggcgcgagagagtggatcgtggagaggggctcttttggaaaaggatttaatacgtggtctccgtgagaagcacagcagtaggaatagcccttaagttccgctgtattttacagtctttaaagtttttgctgttcagccttttgagagtttattactatttcattgtaaattaagaaatcaagtctcgtcgtaagtaagaggacgatctttattttggaacggggcttgtagggtggaatgaaggcttcagaaattatggagaggtagacacaggcagatgcgatagttgagaataagatgagcacatggtgtattagcacgggaggtgatagaggcctagagtgaatctttgggtagtatggcagtgtttagtcagggaagttgggagtaagtcgaagatgagggttccagtttcaaaggtaccaagaagataggagaaaagagtctttgcaggaaaacgttggggcaccacggctgaagtaaaggtcaagggcgtgatatcttgagatgaggataatagaactggtataatgacgagggatgcacaagacagagttggaaattatgtcccttttaaggtggtcatgtaggagtgttgtcaaagctatcacaaattattgaccatagcatcatccataattaataaacatttcttgtgtatgttcaattaatattcaacaaatatgtgtcggtcaaaggcctgcagtaagtgatagataaattttctcagttgtctgatgtacctttgaatgatcatttcattttattttcagaagtcccttattcgctgacaaatactttactttttagtttgtggtggtggtggtaaaagtaatatgtcaacaaccaccttgtacctttgtatgatactttatacactcatttaaggtattttccatagcatacaccactagtagtttatacaggatcaatattgataaagggctttccttcagcttgatgctcagtatttcttggatatatgaatgcattttttgaaatgtttgaacattaaaaataaagaaaaagccaaaaaaaccggtcccttttttttttttttttttttttggagacagggtctcactctgtctcctttccctttgggatgacgttctgcttcttttgcttcaactctcatgcattgttcaggatcatttcagacatctatctggggtactaagtcccttccccatgccagcctaagtactcttgagactctgatttatcttactgtaatgggaagaatattggctttggcctccctgccctagtgtttattctcagctctgttacttacgttgtgactgtggataaggagtttagtttataagtctctgtttcctcatttataaaatgagaatatggtgaaaattatgtaagaaagaaaatataaaatgcctggcacagtatctgatgtaatcttgatgtctaaaaaatgttcctccctctgtgatagtatcctgtgcatatctatttatgacttataccactgttttaaagaaatgatcagacaatgcatatgcatagtaaaagaaaaaaatggaaagagtagaataaaaacatgcagttaaaagtaaatttttttccccagaagcaatgacttaatattttattgtaatactgtattgcttatcttttctttcttctgggcttctttgtccactatggtaaatgtttcctgaaagaatagatgaatatgtggtcaacttgaaatgaagaaaatgaaaccaaggcctagaaagctggtgacttccagagggtagatcaagggtcaatggcagcgtttaaaattcagaagtataaaatagagaaatgtgttgatgaagatgggactgatattaggtatgttaggattttaagaaacccttatcatatataaaaatgacattaatttcatatacaggaaaatgttgtttaggtagcataccttaacacaaaggtaaactttttagtacttatgcatatatgtacatgcttaaagcatatatgtacatgcttagtacttatgtatatatgtacatgcttaaaaaattcatgtctgaaacattgttggtcttgtgctttcagaggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaagtaagtttttttgtggcatatggtatgttacagactgttcttacctttctttatggatgctgcaagtataatttagtaggattatagaggaatttcttaatacctataggcattgatcaaatcatttgaagtagaaacatactcagataaagtattatgcatgtcagtattataactgcaattgaaatagaaatggatttatgtttgtagttagcatattgacattttgataagcacttgactgatttacatgaccaaaaacaaaaacacgtctgtggcattttaaaattctttaccatcctgtgctcttgaatgcataaatacttctggatagtctgaaatattgtccaacctgatgtttggagctcagatttttagagatagatctattgccatcggttcagataaaatttttattattattttacatatgaaactaatttatttagattcatagtttattcagcatggcacattagcaagaccttgtcaagatgcagggtaaatataatgaacatgaagttcctgtttttttcagaagagtattgtggatccttaatctgacttcttgacacttcttatttgatagactatgtagtgcagttctgatgtttgatcagcgagtgttattcagcactctggtaggctcagtgtaggatacacaggctgtatgcttttaaggaaggagtgttcatggaagacaggatgtgaccacatggacagccagactgtgccatagagggttcaaccctgtgtgtcccaggtgtcacccagtgtagctggaaagggttttcaaacagcagaagcctgaactctggtgatctggccatatcgaaaccaagtattttaatggtgtaatttcttcagtagtctttgtggagagatatctgtctgtctgtctgtctatctagcctatctatctgtatatatatatgtgtgtatatagatatagatatatatgtatatagatatgtgtgtatgtgtatgtagatatacacacacacataaaaaatatatatatatacttaatactttttattctggaaaattttaaacctacaaaaatagaataatacagtgaacgcctaagtttctgttacatacctactgttaactcatggccaatcttgtattctcaccattttgtaacaaacctcaaacgttataacaccttaactgtaagtatttctgtatatctgtttttaaagcataactacagtatcatcatcatcacacctaaaacaatggagcagaattccttaattgtatcagagattcttaaactggaatcaggaagtcttcaaacccctgaaggtgtatgcagaattttgtgttttgtgtactttttcagggacagagctcaaagctttaattagatttttgaggtcacctattactctcagaagagttaaaacaaatttaggtctagaaggccaaaaacattttggtaaggaaaaatgtatagtggcttctgttgcatgacttgacaaaaaaggaaattacaacaaaagcaaattctcaattacaagattaaaggttttctcctcctcctcccatttgccaactcttctctgcattagtttttatattatatgtttgcaagaatataaaaacttccatgtttgatctctaaaagttgaatttttaacgtttgtagtttttaaattgtgaaagtactggaaagtacgctaaaattatttaaaacgactttgaaattaaaatgtctaagctatgtagacaatagatttagaaaaacaccttattttggataaaataccacgagaataggctttttaaaaaaatactgtacaggtggatcacttgaggtcaggagttcaagaccagcctggcccacatggtgaaaccccctattaaaaatacaaaaattgcctggacatggtggcaggtacctgtaatcccagctacttgggaggctaaggcaggagaatcgccggaacccaggaggcagaggttgcagtgagctgagattgagccattgcactccagcctgggcaacagaacgagactccatctcaaaaaaaaagaatagtctttaggagactaagagaaaacatttgcacattttatacatcctgctctttagtattcgaaagttgaatttattggtagttcatcaaaacaaaaattgccatcctaaagtgagtggaggtaaaaaccttaaatagtccttatttataagtatttgcttaaaagagatattctataaaccttggaaagaagaaattagatcataaagggatctcttgctatccaaatttttgcattccttagttcagatagtattttagggccagtatgagattctaaattatttaaatctgtttgatttctgactttctgatagtgagttgtgagagttctaataatgaggaactcatccgaaatttattcaagtctatcatatcatgtcctattctgtcctacactaagagatcccatgagggacacttgtacttcctttaattacacttaaggtaaattctcatttttaggtgtatgtactgcaaatttctaagtttttttcttatgtgaatattattctttagggaagtagtttacatttttaagaacacttatatttcacattgtctcataaaggttttgaaaatggctttagagagacatataatacaatctaattcaaaaattacaaagttaggattcagaagtattttaatcagattcgagtgctagcacaatggtatgcggtgatggcggtacctggtggggattggagcatccagatttaggctttgcagtctggtgatgttttgattgttgccaagtgaatgtaatcttaaggttaatgagggttagcggatggggtagggatgattcgtgaagaggaggagaacgaagtggtgtccaaaatatatacctttttggtgtctgactagatttttctataacttctagaatatctagagcagttttcaaactttttgactgaaggatcattttttcttttttctttttttttttgagatggcgtctcgctctgtcgccaggctggagtgcagtggcatgatcttggctcactgcagtcttcaccctctgggttcaagcaatctcctgcctcagcctcccaagtagctgggactacaggcgcgcaccaccatgcccggctgatttttgtatttttagtagagacacggtttcaccatgttggcgaagctcatcttgaactcctgacctcaagtgatctgcctgcctcggcctcccaaagtaggatcatttttttcaaaagaactcttctgcagaagcctcgtatataaaacatattaagtgcagttgctttgattgaaagtggtgttgcctggtattggatagcaaaaggtttgagacaaatgattagttggtcattggtgttgtctggtagtcattaaaggacagaatacagaataataaattccacaatattatccaaaaagaaatttggataatatccaaaacattattttggatgttatcgcttattgttgtcttcaactttagccagtgttaattaacttctgtggtttattcattggcaaaagttggcactgcttagtgtttttctttctagcctgccctaccatgtggctagtaattagataattttatttagttgtttgagcctatttgtagtagatactggctttcttaagcatgtgattaaaaaagtatttcatagaagaaaaggatttaataactcctttttcttgaaattgatagccatctctaatttatatggcgtatataaatgatttgttgtttaagtttttggaaattttgttaaatgttttagcaatacagatgtatttaacatagactaggatatgtcccttagataataactttgaatgaacagaataattttgagtaaacagaaatagaattctatgtgtctgctaggtattagtttggcatattgttggcacagtattcttttggaatttaaaagccagctcctcttgaagagggttgaaattatcaaatgaatacagtgtgaaatttaaaagtataagaaaatttacataaatatatagagggtttaaaaaaaaagagctgtggtgtcattaactatattattattaacaaacattcctcagtgaaagaatatatacagatgtgctttgaaagcataaagcactaatagcttaatgttatcagtattaatgaaatcatttgaggaacagaaaattctcgcataagaagtcacatatctgtctggagcagtctggtaacttcatgtgataaaggtagtagattttctactttgagtttttgttttgattgttttttttcctgatttattctcagaagtgcttttgagtatgagtaattttgattattttatcttcataatgtaaattgggttttgaagagtggttaaagaaaatcatggtttgtttaaaaagttctaacaggttgaaatgttttcccaggtttttttcgccattatattatctggtgtcttggtgttttctgagttttattaaaaaatttaacagagctgtttttcatgagctctattaaaacaattatgtttttatttaaaatggaaagttgcctttagcaaaattgaggtgactgccatattattttttagagtctaacaacatttttggaaccttttcctctggccaaaactttttgtgtggtttgttaatttaaaagaaagatatatatatatgtatttctgatttatgttaacttcatttccatagctggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacgggtaagcattctgttggtctcatctgtaggagtgtagcagctttctgacccttttctttttcggaatgagggaaggctttaatagtttatgctcagtctccagtgtaaaccagttaggtacatatgatttgatcattccttacactgattttaacatatatttcctacaggatatacagatagattaggaaatacaatttatattgctcttctgttggtgatttaatgtgatttctagtagaaaatagaagtcattgggaaatagaaccttgcttttagggaaaagtgactatgacatataactgctttgttacagggtttatctgctttttttataatattgacagaaaggatgaaaaacaggattaaaaagcattcattagctaatgatggtaatgattgtgatagaaaagataattcagtttttgaaacatttgcaaatactagatgttaattgttaaaaaaaaaatcccatagtcccaaaggatattttctctatatcgtttttctcctgggacagaggactcagtctgtctttagagaatttgtgacattctgttattattctgcatttactaataggaatttttcactaaagaacttggtccttcatcaagtatttacttagttcatataggaaagacagataaatattttaactttctttccctttaccgattttaagactaatgagtttgtgccctagtaacttgcaaaggtggtgatcgatggcttttgtgcattttgttttttatgtgttttagtccattgctgtctttactctttataatgctcaaaaaatctcatttttggtcagtaggagacccttcaagtagaccccgtgtccttttggcagtacactactagtgattggtagcttctttgctttctggtagacaagtttttccaggctcatttggtaattttctgctccagacctggaatctctgaaagaagttctggttcctttcagtgtgaaatgctatagatctgtctggatattacaaatgtcttaatttttgtctactttaaagttaaaaaatgttatttaatttttacatcattaagtatgaggaggattgtattttggagtgtttattgactatttgtgtttatgtttccatgaactgctttttgatgtactttgtcctttttagaaattgagatataattcacatatcataaaattctttgcttttttttttttttgagttgtcgttttcttattgatatataaggagtctttgtagatgaatggaattagccctttgtgggttatgttacaaatactgcttttctggtttggtttgttcttttgaattagtatgtatttgtttgctcttcatggattttaaattattatcttgaatctatcagtttttagtttttgggctgtgaatttaatgttttaggaagttcccatttaagattctttaaaatggtttcttctgttgtgcttttattcctttatattaaaatctttgatttatctaaaattacttttgtgaaagagtggtatagtgagaatagctttttagagaaaaccaaaacaaatggtttgaatatttgtcccaacactgcttattaaataagtcatcttatccagctattttaaaatagcatccttatatactcaattcatcatgtgttgaagtctaagagaggcattatagtgtatagtgctatagtggttaggaaagcaagttgtagattatctggcttcaaatcttggcttctttgcttagtatctgtgtatccttgggcagattatttaatcttatgcctcaatgtcttcatatgttaaatgaaagaacaatagtatccacctcattgagtagtttatgattgttacattactaaatacatttaatgggcctgataaatattatatcatatatttatgtattgaataaatattataatgaccttaataaatactaggtatccttcctgggctattctgtcagttaggatagtattataaaatgtttaagtattaggtaaggataattcttattagtctttcttttaaaatatttccaggtttgttttggcagatacattttaatattttctcaattaaaaaactcaatgttattttgttagaaaatcttactgaattatatatgttaattaaagagagaattgatgcctttataatattaaattttcctatccaggaaaagagtgtgtcagaaaggcttctaaactcatgaatgaaatctagatgtaatcccatttggaatagcttggttgcttacaaatacctaggtattttagtttaatgtggctattaaagagatatttgttattaaaattcatacaggaaaaataacttagatgtagtctgaaacattgtaactttcagttttaaaatatactttttgataaaatagcatgttacagcagaatggacatattgctaaatcagtattgtttcttttacagagtgtttaccccttattttttgttactagggaggggcttgtttgcaacagagaagaaaaagaaaaatgtacagctcttcttagtggctaaatatttttgagaaataaccagacattcctcttggtttttcctcccagattcatcacaagtggtttaccttctggaatatcaacaggaggttccctcataaaaacacctgcgttagtactcatgcattttaggggactttaggatctagtttcagaggattttctgactaggatgtagttgtgggagggacaattgaaatttccacagatgcagtgaaatgaactgcgtacatctaaacaaactctcagattgatttttggtactgtttagtttggcttctggcacgtttttttaaaaagtactacatcaaatcagtaataatcaacctgtgtttaagaaccatcctggaagcctatgagaaaagcatcttcctgggttctcactaactcagtgtgtctgtggtggggcccaagaatcagcattttaaacaagcatcctgagtgagtctgtaaagggagcctatgaaccacattttgagaagcactgaactgacctttgtgatagtttattaatatgacttacacgtgcattcatgcgttcctcttctttactccttctcttggtgcccactttatttgtaattctgtgtatatcccagtgaaaggaaaattcctttacctcccatccaaaccaagctggcagcgtgcctaaagacaaatcagtagcacttgttctactttaaaaagtcattaaaccccaaggatttctataaagggagcagtagcaataagtgagtggttacttaaatttgttttctgccattaactaaaataagactttgaatcttggaaagtcatctgttttctcttaactctaactggaaaataggtcatcctacactccttcatgtcccgaacacatcagatgcccgatataaatgaaacctgttagagagaagcactgattgcgtgaaattatctcacttagagcttgatttctccaacttgagtcatttacttatcacttttagaattccattcatatctctttgctaagtatattgttcctttttttttttttttttttttttgagatggattctctgtcgccctgctgtggggtgatctgagctcactgcaacctccgcctcctgggttcaagcgattctcctgcctcagcctcctgagtagccgggattacaggcccatgccaccgtgcccagctaatttttgtatttttagtataggcggggtttcaccgtgttggccaggctggtcttgagctcctgacctcagctgatccgcctgcctcgccctcccaaagtgttgggattacaggtatgagccactatgcctggcctattgttctttacttgatatctttatttaccccaacttactttttttaaacttccacttattttaaaagaaaagcttgatatccctgttatacatggaaaacaagtattatttaacattagtgggtaatagcaagactaaatataatgacaaaaactatgctattaaattttagaaattgaagcaaaagaatccctagtgaatacaaatgatatgaaattcatttgatttgcaaaatatgcatacaatatctgcaaaaaagtcctttaattagaatggttctgttttccatagtcagatatacacggaatattcagctcactctcagattaaggtgaagatcaggctttacatcattttcatttttaatcagttcaactcctatatagttgtagggcagttatccaaacataactaacataacgtaagattttaatataggtctaagatattttgagggggtggagtgcaaaaagactaaatcaccaactcctgttccccctgtactggcgcttgtactgaccttcacctcagaagaaggaattctaagaaaccctatgaaattaaaacaactttttttttttcctctctgtcctgtagccttgccatgtgggtgagctgcctcgcattggagaaaagccaggcatttcctagtcctaagcagctacaggtcttcttgtgcagctttggattgtgaaagatgatgttcaggatgttcctggtgctacagcagagtgcagacatctccttatgctgttggctcacagctacttccttgcatggtgctgccatccagggagtcagggcaatatgagtattctgggtggtctcagcaagaagcgcgtgcagattttcttccacctgtcctcaaaaaccatgccatgtgccactaccattctcataacttagggaaacgctgcctttaaccatagttttctcagatgtttcttatgcagtgaaataacaccaaccatccctcgccttttcccctaaagggttctgatgtgtacttagtagctgttaaaagtgatcctcaagacatctagtattgtagtattgtagtattggtaatcttgtgactatcagctcttgctgtttgctaatatctgttttgtttacatgagtcagtatgaggcagaacttcttggagaatagtctaattaataattgaaatactgatttgttagggataaggctagaataatttgtcgtccttaatttggaagtctagcatatgaaatttcaaagtagctaaagaatggattgattgttaggttgacctggcaaagaaccacatgcaagctgtagatttctcttgcagttgttttttctaaatgtgaatcctggaagtcaaggcagttggtgctgtagtggcttggcactgcaagctggaatatcaacagcagctgttgctggggcctctgctggagtcagaaggagatcctgctgtgctgtttcttctctctcgcctgtttggcttaatttcccaagtggacacgatgctctgagcatcttctgccttgccacctggaggctgtgtaactctgcaaagttccattagtgtcaaaagaaagtaatatgttcacttgctcatttgagtcacttggcatcacccataccctccacgtcccctatccttaaatctcttctctagatccatcccaaggcacctaaatcatttagtaaactgacttcttgccaaatgtgcttatttttgatttagttcagccagccaaagtattcactgggggatgggaaggtagagagaaggaagggaagccttctgctatttctgaaggtacatttaaggatatttatttaaagtgatattatcatctcactgtacgtagttccttagagactgctctaagcaggcctgcttaatgttgaatctatatctcagttgaaagagaaagaaaattaactttataagagacatgtatatatgtggtttttgtactgtaattttcttttgatgtttaacatgataaataaatattgagaattttgatttatcacagctagtcaatgcattttgtatgggtccataaggtaagcttttgcaaatacagttactagaattatctgttttattgccaactttagagaccttttaacagatatggtctttgatcttattgtgctcatgagtttgtagctgtcttttatagttcccaatctaaatgtttatggcatcattacttatacacattatataatgttgagtgaaaatctttattaccttaggaaaatctatgaagaaagtttttattagccagaacattataataatgatttgaaaaaatttatgtaaaccgttagcagttaaggagacaatttttttttgttgttttttttttaagttttgaaacagggtctcactttctcacccaggctggagtacagtggtgcaaacatggctcactatagcctggtcttcccaggcttaagcaatcctcctgcctcagccccctaaaaactacaggcatatgccactgtacccacctaattttagtttttttttttattttttagagatggggtttcgccatgttgcccaggctagtctcaaactcttgagctcaagtggtctgcctgcctcagcctctcaaaatgctgagattacaggtgtgagccaccatgcccagtctgtaccttgttttttttttaaagtattaaatgtgaaaatgtatgaaatgctttagatttgcctgtccatctacacacacttctagtttttttctttctattgtaatttctatagtctttttatttctaagagtaagaaataacttattgagctttgagtagatgctgtttgagtagactttatgtttgaaaattcttgttcaaaaatatttttttgaaaagaaaccgcattaacagaagaacatctttaacctccccatcagaaagaaacatgggaacttggcagcagcataattaaaacacatagttatctaaagctctttatgagtttgtttcatctttatatgttcttggtagctttttgacaaaaacaagacaaaggttatatattgtttcactttgaagcaggataaccaaacttaggctgaattctggctatgtgctaaatttctgatttatagacatgggaaatgtttttgtatgaatctactattgtattcacttttagaacatgccttttatggaaaagaaaggagaaatcaatttgtacagcaaaaagactagtaatagctaacatttattgaatactaactgtatgccagccactgttctaagtactttttacttgtattgatttatttaatttttccagttaccttgtgggatacaagtccttttatcctattttataaaagaggaaaccgaggtacagagaggttaagtagtttaccctaggttatgtgggtaatagcacagctgtgattcaagtacaggcagtttgactatatagtctactgtaatgtcatttaaagaaaacagttatgtaattatttaaattttgattttagtcattgtaaatgtggcattcttcagttggttaggaatttgatctctgttattccttagatcttcaccaaagtgatgaaatgtgtgtgctcatttctcatccttctctccttccactctctgtgtagaattctctgtcatagttctgagcgcttggaggagaaaagaatggcatgtgcaaagcagtgtgacatggattttagttgcttggttaattgctttacattccattgggggcttaaagcttggcagtggagatatacatttccatgtatagaattctctttatttttaggaatctaaaatttcctgtaatgaactgtattaatttacttctaccctgaacattctctttttccctagcatgtttcgccaagggatgcatgacttgaaagtctggcctaatgtagaagcagatggatcagaacccacaaaaactcctggcagaacaagtagcactctctcagaagatcagatgagccgtcttgccaaggtaaaaaaagtcatttggaacaggtgcaaagctctgactgatgtctattgtagtatatataccttgacattatgaactctgtcagatttttaaaaaatctaaatcttaacttttaaataattgttttattgagatataattcacataccataaagttcacccttggaaagcatacagtctgatggtttagtaaatttacagacttgtataatcatcaccactatataattttagaattttttcatcacccctaaaagaaaccgcaccattaacagtcactcccattttctgctccctgcagttagttccaggcaagtactaatctacttactatctgtatggatttgcctgttctggaaatttcatataaatggaatcattcagtatgtgaccttatgtctggaaatctgtcaggtttgaaaatgtggagcgttggtgatattttcaagatgaccacccactttttctggtgacatagccttaaagttgttagtgtaacattctagagaagcttatgccacttggaagtgaagatgactcagacaattaactagtataaagtttctttgtaagcaaatgaagttattacctttttctttcaaaattgttttaatcaagtgttttcacttagaaatataaaaactaaattctattccgtgcattaattgcaacgctgtcatttattttgtgaacttcctttcacaaagcactgtgttagatactgtttaaggatccctttacagttatctgattaggacactttcttgtagttataatacatactttttttttgcaatcttattagtaggagtgcctctttaatgtctggaggaagttttgttgctaagcttttaacagcttgttgcctttacccacatatagaagaaatcttcaagaataagtacttgggttggctaggcttcatgcttcaacacagaatttttgtcaagttcattttgtcttttgtattgctcttttaaggaaaaatggtgttgtagcaacctgataactatattgaccaatatactattgtctgcttctcccatccataattaaataaaatttaatattcatttcttctactcattctgagattttgtttgcattctgacgtgggatataggaaaggtctcaagcttttcatatgtctacctttaagactttatcttagtgatgatctttcatttgagctactctctgtcccttttacaaaccttgaatagttaatataaattttattagaatcaattcatttatagcctgtgggtcactataatatgaaaaaggttaaattaaaaaagaataaagaataatatttttaaaaaagctcttaaattgtcttttaagagtagccattatgattcatattgtaggtgaaattctaagtctgagggggaatggccagagtcaagaaatataaagctttatagttgcacagtgtaactacattgtttctctgttaaacacattatttaggcttctgttcacctaaaaagttaggtttctaatttttttccctaattctttttgatggaaggtttaaaaaataatttttgtaacaactatgacatttttcaggcatcggtgtatggagtataatcattggaattagtcccagttggactgctggttttttaatgtagcacaacgttaatagtatatctttttcattttaatcttttgaattttatactagaaaaaagatgtgacttaatgatcaccttttttatgattgaaacagtaacccttcatgcttgttcatatttgtcttttagttatttgtgcacattaacaactctagaaatgatgactaagcatgtgcagagctcaatgaggtgtaggaaagaagccttcttaatgtttttgttaattggtagcaatcattatccccagtttaaattccttagagtagccaagtggatcctactttttcaagagatagttattaaaatttatgtgctgtttgtattgttcagaatggttagcagttttcagataagtttttattggtttgtaaatctttaaaatgggaataaaaattaatgagagtgagcagcttacagtcctcctgatagtaattggagcctagctcttttccacattctttcatccctaatagaattgtacttttaacttctgaatggagtggagacatctgagcttgccgtgctgtgacagcttgcattagtattaacttatgttccccaaagactaaacagaaaccatcaaaatgagtaattacttttttaaggggaaaaatgtgtcctgtttgtagctttgttaaggaattgctccctctttgaaggaagctctttttattttttgatgtattgtgctaactcgatattcccctcttcttgatatagcagttgcttgtggtttttgaggtttcagaactgttgtatatcccagctgctattgaagagaaatgttttaaaaatgatgtcttaagatttgacaaaattggaaggttgggcacttggaaatgcattatagtgggaagagcactgtactgcgagtcagagttttggccattctgctaacttggggaaaataatttttgagtttgcaaaatcaggtgtttagaatggatgatttttatggtctcatgtagctctttaattgattctaaaagtactgatataggaaataattgggattatctacctgggtttcatagttattatcttactagggaataaaattgtgattattaatttgcaactttgaatgtattgtttgcaggtcattcctttttttctgcaatgtgtatgcctagggtaaagtgttacatagggcttgcctaatgtgaataatggggctttgctcttaattttgttgtttgattagtgcttgcttcttaaatttttagagaggcttcctgaaaaacaactctttcctcacctaaaacatggtcttgccttatacttgagaaaatatattttgatacttgtatggtcttaatttactctcttactctttagttaattaattaattaagttagttaatttactaacttaccggagagagtatacttcggtacttacattcttaaaattatattcttaacttaaaattattttgactgaatttattattattattcttaaattcttaaaattatgcttagatacttaacttgttcttacagttgtgccacaatagtgtctgctgtctttcactctttttctgatgacacattttaaaaagttgttcagttagattgtcactctctttctcaaaacgttttgaaattgtattaggtataataaacttttaaacatgggaaagtatttgtatgcctcctgcttccattttcatacagaaggaacagagatggtagatgtaatgtctgtatttctcacgctaccattttaagaaaaaaaattagtattcaaatagatgagggttaagtagttagaaccaaatggtttatttcttgttgcaacttttattttccatccagtgaatttactatgattgtttctaatttttgagaagacagttggcttaagactaaaaagatatacataaatcttaataatagcaaagcatttttactatgcatggtacccatgagcctaaataagtagcatagtagtaacagttttcaaactgcagtatgagagagtttactcacttatagaactacttcagtcttgattgtctagggataatggacaagaggactgtgaaatgaagattaactatttaatggcctgtgaaaagacggtgttagataattattaagcaaagaacttccactacaagccagacttaaccctcttctgatttattgctcacctattacagttgaattctaattacagtatgaatagctgaagtttgaaagcctgcttttcaagtttgagagtttttaaaagtccagttctttcaggatgaatttagcggaattaacctctctcatgattttacctgattttgtgaacatgcctagttttgctttaaggaaaaatgagtatgaaaaaaggaaacataatcattttccttaatttttattttttataacttgaatttcttagacttctagtagggaatgaaagaaatgaataatttaaatacactattacccccccaccccctgccccattttcttctttttcccatttctaagtttccctaattaatttttagtatagtgtctttccgtttgaattgatttgtgaaaataataaaagaccagacttctagagcatttattaaactttccttgtccatgacccaggcttttggtggctgtgggccttacttgagcaaatttacccattgttcccatctgctctgtttttcagcttgtcatattataagagttttatgactagaatgcatatccacctggggttttggatgtgactaccaagctttagtgtttgatttatatttgaatccatgtctttagacatgaaaggttagtgcaaaagcatgcttctccactgtctccttttcattttagcagctctgcttgatgcctttggaatgtgctttagtttctgtcagtttgattaagaggaggcaaagagaaagtaacaactagatgaaaaatgctttgtactctgtgtgacacagataggtatgggaatgttgttgagtagagtatagaggtgaacactgttgcagggaagatgtggtaagatgtggtggtgtttcaggctgaaccacagagtgcctgtgtggcgtcactgtgggtccagggtctagatctcaggtttaaataggagctggattttttaagttcatttagttattgtttcttgagaataggttcatgccaaccacttcaaagagtcatttataatctggagctgcagtgtctaatatcagagccacaagtcgcatgtagcaatttagatttaggttaattaagatgaaataacattaaaaattcagttgctctgtcactttaactacatttcaaatgcttagacgcccctggtggctacaagatatctattggacagtgcacatgtcgaacgtttctattattgccaaaagttctactgacagcattgatctagagtgccaatttacaaatttgtggtgggtgagtacatctttctggtaaccatattacttgtgcctgctatctaggacaccgtatttcaagatactttggaaatgtaagtagtcttcatgatattgttgatttcttagtgaaccatgaaggagctggaaaggtttctcagatatttttctcagttttgggaaatctaaaacggactgtttttttttttttttttctgagatggagtcttgctctgtcgcccaggctggagtgcagtggcacgatgtcagctcactgcaagctccacctcccaagttcatgccattctcctgcctcagcctcccaggtagctgtgactacaggcacccgccatcatgcctggctaatttttctgtatttttagtagaaatggggcttcattgtgttagccaggctggtcttgaactcctgacctcgtgatctgcctgccttggcctcccaaagtgctgggattgcaggcgtgagccaccacgcctggccaaaaggactttctttatagtatccttttaatttaaatttacttgaatatgctggttgtactgcatcttttgaataaacgttgacaaattatcacaatcccaaaataatccttgaaaatcaagattaagatagcaaggaattttctggtcacataattaattttctaaagtgggattgaagtagtttgacccactataatatttacccttgaaagaaagtattttgcattaatctattgcatcaaatgggtacttgtcctagagcattgattagaggagctccctgagattttagttttatgtacatgtagaagtcctctttcatcttcaccattgtcaaaggcacacttctaaatgttgaagaccaaaaaaaaaaaaaattgtattactaagttcctgatgtcattattgttagtgttattatgactaataatagtaactacatttataatcaccttgtatgtgtaaagtgctttaatatcaacaaaacctcttagcatagattgcaaactaaaatagagaagggattaagatcatggctttagagaccattttttattcaaatcccagctgtgatcttgaactagctatttaacctttactaagtcatgaaatcctcttctgtaaagtaggaatagtagttatatctgtttttggagattattgtgaagactaagtgtaaatgataaaatgtttaaaggatttagcatactgctcagcaaatactgagcactaataaatgttagctgttgttattactttttttacttgcttttatttgagtctgacaagtgtaggattgggacttatgcactacattgtttttaaattcatgaaaagatgaaagcgtagagaagttaagctgtttatttatggttacatatttggtaacttgcagaaccagcacctaaaaccacgtctttaaattctttatggaaatctcttccaaaataagtatcagtgacatatgcttaagatctgaggattgagaggaatgtgtttgcatgaagaatgtattgttcttatttagaagattaaaattgaaaataggagaaaaggtagatagaatatgaagcagtgtctacactgcaggtcctcaagtatggcataaaagatgatgcccgttaagtcagtaaacagtgacctgcctatggtaagcacccattacatatctatgctatgaaagaattggagttatgaatgatatatggcttcagttgttacgaatacatacttcaaaagcaattaaaaaaacagtagatcttaagatttatttcatcatagtcagtgcaacctcaaaggacaaaggcctaggaggaaaggaaacattactgaaaaaggtgtatgttgttcaaaggaactattaataggataggaacctcagtgtacaaacatatgagagaaccccttagtaagtatacaagagacgtacaacagatgctgcaaaattgcggaaacgttttagagccatgagaggaagtggctatatagatatatgtgtatttttttttttttgagacacagtctcactctgtcgtccagactggagtgcagtggtgcaatctcggctcactgcaactcctgggttcaagcgattctctgcctcagcctgctgagtagctgggattacaggtgcgtgccgccatgcccggctaatttttgtaattgtagagacagggtttcaccatgttggccaggcaggtctcgaactcctaacctcaagtgatcaacccgcctcggcctcccaaagcattggaattagaagtgtgagccaccatgcctgggccagaaatggctattttctttgtgtgatcacaaaaaatgatgcagctatgatggtaacgaagtctcattcattcagctcaggcttttgtcagattattgacttgatcacaggattatttttcagaagtttgaggaaaaaaggacactgcttctctagaccaattttttgtttgtttttgtttgtttgtttgttttggggacagggtctcgccttttttcccaggctggagtgcagtggcacactcacagctcactgcagcctcagtctcccggactcaagtgatcctcccacatcctctggaggagcaggaactacagttgtgcaccaccatgtttgaatagtttcttttatatagagatggtgcctcacttggttgcccatgctggtctcaaactcctaggctcaagcagtcctcctgcctcagcctcccaaactgctgggattacaggcataagccaccatgctggacctctaggctaatttacaccactataaaagaagtgattaatgaaaagggagtaacaggaattttggaaaaaactaaagatgtcacattatactttgggattgcaattataatcaaggagtgcgataatggaccaagttagggatatgtcagttctcacaaagtttgagaaaggcaagatgttccattcaattgagaacctataagggaagataacccaaaaggaccaaggggttctttggttcttttggtcccattctcaaggggacaatttggcatggactaaagaaggtcttggattaaaatttgaaaggaaaaatccctaaatataacaatattttaaaattttctttcttttgaatgcattaaacgcacattgaagaagtaagcctgtgttagacactgaattgatttagttgagttataatcttcatccaagtgcccttcagcctaggagagttagccaaataatttagttaagtagtaattgaaaaccaagattgttgagaagggtagcaaaaaggcactcattgatctattcagttttcctagtcctggaaagttaactgtcagggttttaacatttacatgatgaatgaatattgaaacttaccccccagaaagaaaaaattgggattcttttgatcttaccttttttcccttttaattttacatgtagaagagttactagctaggcatgttggtgtgcacctgtagtttcagccactcagctacatggaaggctgaggcaggaggattgcttgagtccaggagtttgacaccaggctgagtaacataagagaccccgtctcttaaaaaaaaaaaaaaaaaaaaaaagagttcacatagcaggcctaaggctgctgtgcttagaagggcctgcttgcaaggttggcccttggctgatgtctgagaactgagcttctgaaacaattcctaactgatacagatgtttcactgtgtctagactgtttccacatgtgatttatgatgagcacttgctctctttctggaagtctaaaattttggtagttgtaaggcagagattgcctttgtgaccagctcccagtaaaatccctaaactctcattcggaaatgggctttttagagctgcatttttcccgctagagatgtgaatatacttgcatgttatctctgaaagactaagatcagtcaatgttttggattttagagatatgatttaagaagtgatttttattatatagtggacatcagttcttattacaaatcctataatgggttatcaaattgatgatttatatgaatttctaaacctgtacccacgtaatgatattttgtagttagattttggagaaatgagaaacattaaagtatccaaggaggaggtgttttgaaaaatgaaggcattatgttttattttacgcttttaagattagtagaactataaaaactgatgaaagatttaaataataatgagatacattataactggggttgaagactgacagtcaagattcctgaattacagctctcactgatggcagcttattgaatagctagctgtttctgtattcctgggtatttttcattgttaaaatgtggtcagatctccattatctctgctaattataggaatcatgccattattattattattattattattattattagctattctgaaaaggaaaattaacctcagactattttgtttataaattacagcaagctgattaagtgtacttctcctggattctgaatacacttccttccgccttgaataaattatgtgaaataatgttgatgaataaactgacattctggatcaaattactttaacagaataaattgtttagaaggacctattagtgatcttttccccttattattgttacataatttattgttttcagaatttaacacttaagttcctaaaattgctttcaattgattatatatgttagcacttttcttgggaagtttgtattctttgtaagaaatatctatacttggttaagtcttcacttggttaggtatatcacataaagaaagtgtcctttctccatagctgaatcacttaatgatttaggttatagctcaagtagcttgataatcttcggttttctattttctaatcaactgcccttagttatgatgtctacagtacatgcagtgcaatattagactaagtatagtaatttaggagggtgaatctatcatccctaatgatgtaaccattaccccatttaggtaaatgaatatacaaaatatagacagtgttctgttaatatgtatgtatattacatttactttttacccacaatataaaacaattcactttgggaggctgatggaggaggatcacttgtgctcaggagttcgaagccagcctgggcaacatgatgaaactttgtctctgtaaataaaaaaaaaacaaaaaacaacaattgggacttgaccatttgtaataatgactatagtaaaaataatctcattttctcaaaaacagtaagaacacccttatttatttaatcactaggaacaaaagaaaacttccgtcttttaaatgtatgtgttttagaggaagaaaaacggtgtcctaaagagttgaagaatgcatttgttactttacaaatcaaaatataggatcctagatataacatttgggttgagcagaagagtcttatatttttttcttcctcgaatgttttgtaaatgacaataataaacaacagaattatgataaatgctgaaattattcaaggctatcaaatttattcattgatgtcattgatatcaccaaatatacctcctagatataggtttttgtataaatatctggtatagcttttataaacatatcttattgctttgattctgtgtcgccattgaattgtgttataacaagcgtttgggaatatctcgtaaatttatttttaatgctaccttctgttttattaatcactttggtttgcttactgctaagactgtcagaagttttggatttgtctggaaaccaatgatagcaagtagactaaattagtttttgccagtgccctaaaacagtattgatttatgttctgtaaatctattttctgtctttacagttatagtttctgccagaaaaatagtaagacacttttaagactagatttatcttcaagaagtttaactaaatgaaacttttatgaagcaaatactactcttcctgaataataagatttacatgtacagtttgaaagtaaaattggagatttgtgaccaagacttcattaatcaggaagatagaagaaacttctatgcttgccaagaattaaatacataggcatatgcaaagtctctaaaacatgcacacgtacatgattctttttctaatctcagtagttcaaataaattattttatacaactgcattttgtctgaagttataaattacggcatagcttggccgggcctggtggctcacacctgtaatcccagtactttgggaggctgagaagggtggatcatttgaggtcaggagttcgagaccagcctggtcaacatggtgaaaccccttctgtactaaaaatacaaaaaaaaaaaaaagaaaaaattagccaggcatggtggtgcatgcctgtaatcccagctactcgggaggctgaggcaggaaaataggaaaatctcttcagcctgggaggcggaggttgtggtgagccgagatcacgccactgcactccagtctaggcaacagagtgagaccctgtctcaaaaaaaaaaaggtactgcatagtttatatttgatttgagacgcttattgtctttttttgaagaattacacttttttagtaatataattctagtgcaccatgcaactatattagcagacaaagatattgtcttcaagtatttattaatttagctcagttctattttagactcagagaggcattagagtcaaaagagttaagctatggcctttaacctgagggagtttagaggaatgagatgggaggtaattgacaaaatgcaaccctgtacaatcatataaagggttactggaaaaacagtcttttgtatatagtagtaccagacattattaaacacctattgaaaaatggtaacatcttctaatttatatggttttgtagttggatctagttgaagggcccttggaagaaagtgagagagcaatcaagtttatacttggattttatttcaggtggttaagttaaattaatgagatagggctttattctttgagcttttattatgaagtgaaattgctttatttagcattatctttataaaggctaatctttagtggttttcccaacggagctttctccacaattaattgtttcttaaattactttagcttttaaatgacttttattttttcttactacaaagataatatacatcttctacagtggtagaatattgttaaagcacaaagaggactatgaaagtcaccccagtctacctaccactcaaagataatcactagcactttggtttatatgctttcagtaaattaataaatgtatgtgtgttatagatgaatatgtgaacatttattttaaaattagaatcataccgtatctgtgtgcttaattgaatcttgcttttacatttaatggtgtctcagaattgttccaggttatttaagatacttctaccacataatttgtaaaggctggagggttttgcatagtgtagataagtcataattgatttcagcagtcttctatggttggatattaaaaatgtttgaaattcttggttcattttctatttatttgaaatgaaaagtgaggattatatttttaagttgtttttagacaacttacttggtttgctcatatcctgtatttccaagttatcagtcataaggtattactttcatatcactgtttcaatttgtagttacacttttaagtgcttactatattgaatgactcacttatttccaccttgatgttctgttagggcagagaacttgcttcttttgttcaacattctatgctcatctgaaggacagaggacatgatggaagtttgttacttaatagccagcaagttacatatatttgtattgagagtgtataaagattagggaagagtgaccaagggcaggaatcttttttttttttctctctccagcttcctttttagtgtcactcccacctcttcccctgaagccccaaagctctttgggcagaatatcagagtatacttacatttgttttccattatgtctgtcaccctttcacatagaaagcctttcaataagtataaatagacattgaatgaataaatgctagcttctattgaacattcatagctcttatactcaagaagctcatttgtctagtaaaatagagaagagtacggagcaatgaactgtgagttctaatgatcgtggaagtctgtctatttccaaggatcactatctgctctgaaatttgttttccctgctggtcttattcttacacagtgcagcaagttggcctacttttggctctgtccttgatacttttattaaacacctactaatctgagacatcttcctcaaacacatctttttgttctttcattaaatctgacaatacagaattagtactccaagaagtttcccaggcatgttgttatttggttcttgtggattcttttatttaaatagcttttaaaactccttgctttttaattcttggagaagttagggctaaattatgccttttttttttttttgtgacagtgtacttttcttccaaactctttgtgacttcctgtgaattctgttaagaaacctgtgttcctttaaaaagagagaatgaatttttttttttcctgtttcttgacctatccccatcctagaatgggcatcctagtgaggattatttcttcatgagtaattgaaacagtttgtcctacttttacctttctgcttaacagaatgcagattttctctttggaaagatgtaaatcactgacattacagacccaaaattaaatataaattgttatgccacctgtgtctattgttcatttttggtctttagtatctatagaagttcgtggattggagataactagaagttgctttgaactgatgaaaaccactcaagtatatctacattgttatcagcacccataagagatgaagtgacataggttatgggctaattagaatagctgttacaacttacatagtgctttatagttttataaaattaataaaaaaatttaatataattaataactaattatttcacttacattgagcagtaaaggtaaacggctttatggtttgaagagccagaagagactgtgttagctggagtttagtgagttcgttggagaggtgaaggagattattctgaagaggaaggcagctatggatcatttagcaattgtgatagctagttctagactttttctgctgcctaaagtccagccaagagctgactttgccatctctaaactctacacacctgctcccttgcagtggaacaattaattgtattatttgcttggactctctgataagtaagcgctgtgctagctagtctcttaggatggccctcaatgaaatatgccttctgatagtcacactcttccacattatattaccttgtgactgattttaactgttataatgcagcagaagtgatgctgcgtctgttccaggcaagacagcgtgacagctttggtttcttcacatgttaggaacattaagccatcatgtaagaagtccagctattctgttggagtgaccaagttgaaaaaccacttggagagggagcagcactgagaatacgtggggaaagagaggccctaccaccctggtatcccggctaagcccaccctttatcaccaaggtgttagaaatgtgagtaaagccagcttggatgttccagctctaaccacccaatgaatacaatattatgactactgataagtgagactacaagaaaaaattatttaaatgtctctcaagaagatgattttgccaaaaaaaagataatgagaaacaataaaatgaatgtcgttttaggccactaagttttagggtggttcgttatgtagtaataggtaaataggacaggcatctaggagacattttgagtggtaactgtacaattctgtggaaatcataaaattagctcaaagaaatacacagaatttttgctgtcaatctcaaagtcaggtacaggagacagacatgcaaacaatttccatagcataaatggtacctttaattttgcaatcggttttgcactcaacaatatctttcctgtgaaggcatacagatttttctcattctttttgattatagcatttcatagtgtgtgtgtactctagtttacttaacagttctcactattgatgaacattttcattcttttgtgtctaatttttctgtattgcaaatatggtgcacaaatgtgaatttctctagtataatttaaacttattttcatagtgactgtaccagttttagtactggcatgctgtccatacattctttagtagctcttatacaattgagataggtcatatttggtattcaaataggaaagctaatcatatgctatatgggagataatatatattagcagcaaacataaattctagagctagtgaaaatggctttagaacatttctaatttgtctggatagttttagtaaaggaggaaaaaagttcccaccacattctcccacatccaaacttaatttaccattgccagttctttgctcataggaaattagcagtggatcaactattgtatcataaatacaaaactaatattcgagaaacgacagaattgagtttcacttaaagctcttagtacatcagtagagaggatagcagactggtggtaggagtataggctttagaatcatatagtctggggtttaaaccctagcttggccacttcatagtagtagttgatagtcatctgcaaactggggtcaaaatagtctacaaaatagtgtggttataaaaagtgcctataatttggcatgtaaataaatgttatttttttctccattcctataggaagtatataaactcttattactaatttttactgttacttcgttcgtacaagcaaaggatgtaaaatgaccttttacattttcatttattttgaaaaccagtttggagcatattgcgaagtgagtaagaatagaggcttccaatgactgcatgaaataataccacctgttatattttgcatctattactttatttgagttttgggagtaagaatagatgttaatacttgaattttattgatgtgggttcagaaaggacatagtttgaaaatggagtattaaggttggaactctggtcttccagctcctactctagcactcttttctgtaggtcacattgtctgatcttcttttggtttccttgtgactatttctaggtctctttccatgttgctagcatatttgtctattattccaccagagccaccacgatatttagttcctgctttttgtaatcatgctaagcttattaataacttttcatacattttcatatagaaattacctcacatgaaagggaattattggaagaaagctaaattgatattacttttttttattacaatgaacttcagactttttgtgtgacattagtatttttatttctgaaatagtatgaccacatagttgtgatgagttgaggaagagaaagaagattgatagtgaagatttttaattctgcaagagagatgaaattggtggcagtgtttgctgttcttataggaaagctgtcatgatatggacaatgaagcagaagaaactgatatagataagctactatgtaaagctttgatgtccagttttgctttatactgtcaatttgtttagaaggaatgagaggggtgttgatttttagtattacagtttctaattcaaaacctggttctaatttgaggtccttggaacttaccaggaattctctatggatttgaagagtcaatgaattattaaagttataaaactaaggttagattggtatgtaagacctcacaggactctaccaactgctattctagaaaattgaagtcttttatcaccgttgcctaaaattaaagcatacatgcatatgtgtgagcttaaaccttagagtattaatgtgcaaacccagaaaaataccttattacctgtaactgtcattttttcatgttggttagatacattgaaagatgggaagaaaagagaaaaagtggtttatttcccattcatgaaactattattataatttcatctctttgtaatagtcaaaatacaagaaatataggaacacggagataatttcaggaacaacttcattattctttatcatgtcaaaatatggcaaattatggacctttttaaaaaaaatttaattgtttttctttaaaaaataatgatttgtctcttgccaagtttcttatcctgctaattgcgtatggtttctattgtgtataggaaagtatcatatgtgaagtgtacattgccattctgacatttttggtccttctttctactagatgtatattaaaattttcgtcattgtatttattctgcagctcaccaaagctcatcgacaaggacacatggtgaaagtagattggctggatagattgacatttagagaaatagaaatgataaatgaggtgggttatatcactcttttattttaaaatattttctgtaaatttttaaattaacaattttttgataagaattattattaggtatcttacaaatataggattatcagggttaacccctgtagctgggaattctatgctaataactggaaaattggagatatcagccttccctatattttaacgtaatgtcaaactatgaagtaggtagtggatattcaaagatgttctaaatatcatatgagtgaagcctatgcagacttaatgcctcagtggtgtgttctctgtcatatcagctcatgttcaagtcagcgttggataaatcttccatcagcacagtgccagcttttcacttcagttaccataaatcatttcagcaagttctctcttcaattaatttattacttgtctatgtactacatataggactccgcaccctctataaagttacatgatttaggtgatttttttcttgaccttgtatgtgagccagtgtgtatgtttaaataaagatggcttcaatgagagtcctgccaaaagttgtaacaagaatagtttacttttttgtatatttgctctaaaatgccagatgttaggcctaatgttccacatctagagaacagaaacaataattatattaatcaaattaggagagaaggacatcaatttgtgatttgtctaatttataatgaccataaggcacaacttacttaatttatattctccaaataattttcagcaggtagaaagagagaagtttttaattttacagtgaactattacaaaagttagattttagcattattcttttattttaaaataaaggtagtgatgtttaacaacatttatattcaattctcgtatttggtaccttttctaaatttattcataatacattcctatatacataaactggaaggaagcctttttaatttttataatagtcactttttaaaaagagtttactcataatactaacttatatttttctcttcttaaacttagatatcactgggtatagaaaacgtaatgttagagtttgcccagcctttttcatatttttacattttaatttctttgaaagaaattaccattaccaccgcattactattacaaaatagactataatatgcttcataaagctgaagaatttaagtaacctcttcagacctttatcatttattatttcttttttttgtttgttttttttgggggacaaggtcttgctgtgtcacccaggctggagtacactggtatgcttagtgcagccacaaacttctggactcaggcagtcctcctgattagcttcccaagttgctaggactacaggcctggctaatatttttaaaattttttgtagagtcagggtctggctatattgcccaggatagtctcagactcctggcttcaagcagtcctcccacctcccaacgtgctaggattacaagtgtgagccaccatgcctggtgattttatgttttagatgtaaagccatttataaaggtgttttgggtcaaggctaatcacccgcttagacttcattgtattttcactttatcatcaccttagtatagtcatgtgcctcatcatatcatttcagtcaactgcagatcacatgtacaatgatggttccgtaagattatagtactttatttttactgtactttttctcttttaggtatgtttagatacacagatacctaactattgtgttacagttgcccacagtattcagtacagtaacctgaagtaacaagtttgtagcctaggggtaatatgctacaccatataacctcggtgtgctataggctataccatctagatttgtgtgtttacatttcatgatgtttacacgactaaattgcttaatgatgcatttctcagaatgtacacctgtcgttaagtgacatgtgaccatgtttgcttttttattttaaaggggacacaattatataaataacttttttttatgttggaacaagaagtaattattccgcagtatatttaaagtgtggataaaaatttacaaatgacaaatcattttaagaccatttataaattgcgaaaaacttgtaaaggctatacttggtaaactcaaatggcctctgttcttaggttgcacacttttcttccttttgatttttgttacacatattgatttctatggtttagtcatataagttaagggtgaacttagcttaaaattgttagaaggaaaaaccattctttttatttttgaaataaaatagttctcatgaacatgtgtgcaaaataccttcaagattataaacccaaactactgaataaaccaaaaatgttaaatttgagaaagcagttataagtgcatagtagacactactgaataaacagtagtgctgtctataataaaataatagtgctgtgtaaaacacactacatgtatataataaaataaaaatgtgttatgttttgacttgtatttgatagatacatgtattactgaattaggaaaaatgatacatactgatcctttaagagaatgttgaaaataatcatttttcatgaaaatcattttttttttcagagtgaaaaacgaagttctaatttcatgtacctgatggttgaatttcgatgtgtcaagtgtgatgataaggaatatggtattgtttattatgaaaaggtatttcccttggaactgtttttggtctctaaagtagaggggagaggaaacattaaaaaaatattgttgttcctgctgggatgaattatttggttgcagggtagcagcagacagctgtcagcagcagctgtttatgtatacagaaatcaaatcatataactacaacaagattacaaaagcctatcactcatgtaatgcagttctgggttacagaattcaataagtatgcaagtgattaaaaactttgtgattaattgttctgcaaattggcaagtaggacactaagtaatggcttcatttactaatattatttatttaaaaaatgaaagggggaaattatatttctaagtggtaggctatttattgaaagttaagagtctgtttgttatttgagtgtatgtgtaatgtctatatgtggccctcactgaagtatacttatgaaatacttcagaaatgtccatttgtacaatagatgcaaaattaagacaattttaccatcaggctgggtaataacaaatatgcagttatagatttgctttgttctgcccattatgctacagaaagtagttctgtgtttattatgtacctacttgaaagtatcttccttaaatgcttgtagaaggtgcttcatttaagtactacagaaataattatatatttaagtactacagaaaataattgtatgcaggccaggtgtggtggctcatgcctgtaattccagcactgtggttggctgcgtgggaagattacttgagcccaggagtttgagacccgcctgggcaacatggcgagactccatctttatttaaaataaatataaaaaaaaatgtatgcatagtttgaaaccacataaagtatcttctattattgtgttaatagtcaacaaatgttaaatcagcataaatgatgacagacttttgatacatggcatagtagtagattaatatttcttctagcatatgaccaagctgatatgcagtgtatttgttcattagaagcagtccttttaaattaaatttacattttattgttgtttattaaagctgtcacaagtgatttttaaaatatgtatacttttataaattactatttgaaaggttttcataatgaaggtttgagtttttacagtttatttatgatcttttttcaagttactgttcatatttttgtctttaactcatatccctttcacgttagtgaaagactaggaagtgttaacttgtttctgccttttattttataaatggtactccttggatagattatttaacattgtttattaatttattagaaaaaatacatcaaaacaagggaaatgtgagtgaaactgttctgtcaccagtgcattttaataaaatcatattttacattttaaactatatgtcatttcattaaaggcagtattttctgcccatatagagtttgtattgcaaaaacatgctaatggagatggtactttcaaacactggagatgtgaaggatcctttgaaagacagcttgatagcagatgaaataataacagaatagaaattagaagaatttcaagtatttttgaaaaggttcttgacccctttctaccacttcctgaaaattgctcataaattaatgcctgtctacccaccctgtcatatttccacttagtgtaaagattgctgggccagtgtattgaatctaatggaaatagactttcttgtcacctgtcttgtgacagatagccttagtgaagattacttgtcacagctaggctgataaatgtgttttctggtgttgtgactgagaacaagcctgttaaacaacggctgtgggaatttgtggttttctgtaagactcaattactgaactgaagtaaagttacagtgcttccccgctttcagtctctcttgagtttgttgcccatatttaaaattgaaaacatactagcatttggaaattgacagaaaagcttgatgctaaatatacagtcatgagaaagtgaattttgaccttaattagtttagcctttttccagtatatttggcagtgacatttttatgttgaattacctttctcacattggagaaaaataaaagccaacattcttcaaaggtgataataccaacaaaataggatggctttatttctgaaaaactgattgattgattttattattcaagtttagattatgttgagcaggtgtccctttgagaaacaacgttgttgattctctagctgtgtgtaaatttgagtaatattaaccctacacttaaaattctgcttctttgaatggatctccattatgataccttgaaaaattaccaacatccacttagtttttgcaaatgatgcaacacatccattgtgccacattttacatatagtctgtggtttcttgttctgagtttgaaaattagcacgtttttaaaaatccactgtcattatatgaacgaagtttaaaaaaaaggaacaactcgaaacaatctaatttccagacctcatacctctaaaactttagtaagaattttgttagagtttttctcaaaacaatttcataatcaaccaaggagaggtacaaagtggacatgcattttataatattgttagaagaagataaggatttctttaaagggaagaatgatgttcatcaaatagaattaaaatacattgatgtgtacatcatatactgcttcctattgtattaaatttctttttttaaaaaattattgctctgtaatctaggacggtgatgaatcatctccaattttaacaagttttgaattagtgaaagttcctgacccccagatgtctatggtaagttattgtgcaatttttttatgaaagtacttttcttcagagtaattgtgagttagccacatcatgtactttctttaaacaaagtaatatataactgcctccgttacctaaaagtgattcataaattcactttagcatctaggcactgtttctgatggaattttatgaggaatattaacatcttaaaactaaggtaagggtagagtagggttgggcatccactttgtttgaattgctgaaagagctaggcagtatactctttttttttttcttcaggttgggggtatataatcttgaagtgaagacttggcagaactggtatttgaaagattgccatcatacagaaggagaatttgcctgttacaggaggattctataaccaggatgaatgcgtgaaagttttagggagaccaatttgttggaaaatagggaagattgctgtagccctagaactgttcaatttggaacgtggtaacttggatgatggtgggataccttcttattaacgaatttttgagatgatagctttcagggatatgaggataagaattcatacaatgcaaaagaggtttaattagatgactttagaattacaaacttgtaggcacaaaatccttttagcagcacgatagttaccatgatttttgcagttacagctcatttacatcattccaactctttttgttctaattttatacatttctaattagattagttaccttcctcatcagaccaaagtggattaaaattgggacattggatgatgaaaacatgatgattgagataagtacaggtcatgaaagcaggaacggctgatggcctaatatcaaaggaagagatgggcagcagggaaagtagagtataaaaagttaaaaagaaaaggccacttgcggatctggtaggaacattctaaagaccttgatagttcctatgcatagtatagtagaatccagttaatcccaaattggcactgaattttcagtataaaatcaaattatattttacacttttgatattcagagcacacactaagtatgaagaaattcagttcagcctgcagttatagttatttgttaaatgcagaaacacattttaaatgtaaactttgggtgggactgagatgatatacagctgtatctgacaataaaacagactataattacaataatgtggtagtgacacacatgtgtaaaccaatatactggttgaacagaattaaaagcccagaaatacatccaagtatgcatggaaatctagtatatgatataggtggcatttcttcactaagtcataatactgaggaatggaattaatttggaaaaaaataataaaattatatccataactcatgccatacataggaataaactccaaatggatctgtaatctaaatgttaggaaatgaaactaggccaaacatggtggctcatgcttgtaatcttaacacttttgagaggccaaggcaggaggatcacttgagcccatgaattctagaccagtcagggaaactgagggagaccccatctctacaaaaaaataaaataaattagccaggtagtggcacgtacctgtagtcccagctacttgggaggttgaggtaggaggattgcttgaactcaggaggtcaaggctgcagtgagctatattcatgccagtgtgctccagtttggtcaacagagcaagatcctgtctcaaaaaaagaaaccacactagtattttactgtcagtgtagggaaagactttttaactgtgactcagaatccagaggcaataaaataaatgattgataaatttaactacattttaaaaattacatggctgaagagaccaacaaagccaaaagacagttaacaaactgggagaaaatacttaactacatacattacagatatattaaggctgatacataaagaactcttaaaaatgaaggacaaaggaccataaagccattaaaaaaattaggaatatgacatagacaattcacacatgcaataaaaaataaataatataaatttatatcttgttttaggcaatgacagtatggttaaaactaataattttgtccatgggtaaaatagcaccagatgtgtatattcaagcgttgtgattattgtccttgccctcagtaactgatagcttaaataactgctaagatgataatacagtgacatcacaaggtcattagtagctgacaggaggaaggaatgctttagtctatgttgtcagggaagattttacagtgatggtgatatttgattggttagaggatatggaaaccttgaatatgtggagagtgaagggacgatgttttaagaagctgtaatgacgtgtgtattatgggactagtggagtttaaggcatacttagtttcccagtcttgagaaggatacatatttttaagatatgtagaagactgctaaagttgtatcagaacaaaacattagatattattaaatgctcctaagtaccttttctatttatgaatagcttttgaaatttccttttggtgaagtttacattgtcaatattttaaaataatttgtaggagaatttagttgagagcaaacaccacaagcttgcccggagtttaagaagtggaccttctgaccacgatctgaaacccaatgctgccacgagagatcagttaaatgtaagagaattatgaaatattaatttaaaaatagttaaatgggtgttctggttgaaactgatagctatcacctcacttaaaaattatttagatgcacattttctccaggttgatgaatcctacatcatgttcataatttcacagatcagcagttctgttatcatttggggctttccataaatgtgttatctctggagacagaactgcatatactgtatactttcatgtcagtagtattcttagaagctggccctaagacattgcctgagaggacttagtgtgtacacatgccttgttgtatgcattgactttaaaagagtttattgtgtgcacatttttcctttttctggtagaagacgttgttattttgctaggttttgtttctggttgaattaaatgaactctccagttaaatattttcctatggaatatgactttatcttcttttcttctcctttaaactgcattttggacacataattataacaaatttaaggcctacttgactgagtttacattttccttgcttgtgtaataattgtagtatagaattatttaaataaatgaaaaatattaagtgaaatggaaatatataggacatgtattgttgacaaaattagttctttttctttttttgttttagattattgtgagttatccaccaaccaagcaacttacatatgaagaacaagatcttgtttggaagtttagatattatcttacgaatcaagaaaaagtgagtgtcttgaatattttcatatatcaaatttatctaccaactttgttattaatgatcaagatgaggaaaatgccatggaaattgttattgtcactttaaagaaaagttacagagcagtatatatgagactccattttttaaaaaaattatgaaattctgcatacaaagacacctgtacctgtttgttgactcatagacaatgtctgaatgggttttgaagtcagagagacttgggttcgttttccagaagtacattttacgtttgtttggtaggatgaggcaacttactttggcagcatggtgtccttattattctaatggcgacagttctccttcacaagtaagataatacaggtaagtaacctggtagagtatctggtgcatagtaggtgcagagtaaatgctggttctcttcttcttacctctttgaacctgggtgactaggaaaatacgtatgcttttataataacgaaactacagaattctagacgagatgtggctggagagagagtatgagaaatataatttgagatgtgggaattcagttggtggagtagcatacaggttggcatacaggataacgggtaggtcaaagctcaaagctagacatttgcttcctgtaataaaaccatggagtggataaggtttctggagagagaattgtggtaaagtagtcatcactaacctgaagtctttggacacttagtcttgagtcttactgttgcccctaagaagctttttgactacaggcaaattactttgcctgtataagctttagttttcttatatttaatatgagacaatcagtgattgtgaactttgtctcctagtttttaaaatagtctgtaaaatcttaaaacagagagccaaggggtacctcttaaggtataataataatagctagcattttttaaacagatactatgtaccaggaattctttaaatcccataacaaccccacaatgtatgtattattgtaactgttctacaggtgaggaaacttgagcctcagaaagattaggggacctgtgcagactcacaaagcttatacatgctgcctcttgatatgcttgcatctacgaattagaagaaaagaaagtcagtgaagacgtagaaaagagaattatagagaaaacattttcaacatcatatacatgccttagcagacaccctgaaatgcattagaggaagagcagagaagcattaggaaaattaatatctgttcaggaagctgttacatatttatttgagaatgaatggatatgttttataatcttgtgatatggtctttactattttaagttgtttttctgaaccaaatgtcctttctttagtttctaaagtaaagataaaaatccagttacagctcatcttaactcttcagcttttctgctttgtcatttattgatgccttaggaaattctttgtaaatgaatcatatttattctcctttatatccataataagaatgagagaagaattttcaatttactatagctttgagtgtaattctcttcatcactgaagaaaaggaaatattcactaacagaaacacaggtttgtgatttgtgttttattaaaagattgagttagtgtcatgatactgtgttaaatgaagaataaccttggtcacagaaactgcatcttgaatgcagctcagtgtcgtcttaaatacacagctagatattgaattgaacctgttagaatgtataggtttaaaaagcatacaggagtagatttacagagcagaacttttttagatagaaaggtttgcaagaaaaattgtttgtttaaacaagtagtcacttcccaccgaaattcaattacttctagatatgtgcaaaagaaataaaatgttcaagtgatataaagtgtgtgacaagtttcatttaactagttgatttcaagttttcgaaaggtgagtgatgaaacttcaattctcaggatatgttataggattcttctgaccactagagtagagtgaacgatatgttttaatgttcagaagtcactatggagtaaaccaaatatatataggccttgaagtgaccaaaggaattattcacacagccacatttgtaaccttgtaataatttcagatgggttttgtgaaaaacggatactctcatactccacccattaatttatttacagaaagaaattcttttagcgtcagactctcagaaattatgatttaggttacttgacatttgggccctggggctgaaaagcttttctagagagaaggcagtgctcagaaaacaaattggaggaaattggttctcacaaagtcacactttttattttttaattaaattttgtctttctaccccctttttttttccttaatgacctaagtatttcagatgaaaaccttctagtcaggacttgatgtttcacccagaaagttcatagtaataactttgttcaattaaatttgttaccatttaaatttatgaagtattttcaaattcacagtttatagcatgtaggaagtgacccatttctgtggaacctgaaatatgaatactgtaatttttcaaaactatttgacaaaaactgcaattacttttgcaccaacctgcttttacaatggacttttttcttataaaaatactaatttaaattaactccatgccttttgattatgcttgggggaaaaaagcagttggaagagtcatgtatagtgaagataatagtgatgcactgagtgttcttataaggctgtttctgagacagtgacatgaggacaatcatcatatttgtgtctcctgacaagaaattgatggtgacccatgggataaatgaattcagttcagcaagtattcattatcacctcttggcctagcattatataagactatgagctttcaggtatcatgtccttgtattcatataaattaaaattgttttggggtaaggatatttacacataattaaaattaggaagtatagcatagtaattgattaagggtcactctcttaataaacatataagtaattaatataatataaatgtggaggatgaccagatcagtgtgctgtgacatgaggaaggtttcacagaacaaagattgcccttaaagtgtgagcagactttgatagcattttttatttggtggtcatttttttatggggcaggaaagcatgagtaaggtaggctgttaggttcaggaaacagttttgcatgaatggttatgaaatagaaaagatggcatcagattgtgacgagcctcaaattatacccttaggaattcaattttactggcgacaagaaacgactaaagcaggaaaatgtgtgttaacaagtgatattgtacttctctttttttctttggagacagagtttcactcttgttgcccaggctggactgcaatggcatgatctcggctcactgcaacctccccctcccaggttcaagtgattctcctgtctcagcctcccaagtagctgggattgcaggcgtgcaccaccacgccggctaattttgtctttttagtagagacagggtttcaccatgttggtcagcctggtcttgaactactggcctcaggtgatcaacctgcctcagcctcccaaagcgctgggattacaggtgtgagtcagcacgctggcctaacaagtgatattttaaggagtacaaactagggtagattggagcagagcagaaaatgaaaaaaagtgacataattaggagaatcatatactgacttagagaacagttttggagggcaagggatggagaagaagctatacaagtaagttgactttggagacaatggccaggggttaggcctgaacctgatggatttatatacgtgtgtgttcataccccacttttggtaccaatttactgtattattccgctttcacacttctgataaagacatacctgagactgagaagaaaaagaattttaatggacttacaatttcatgtgactggggaggcctcacaatcatgatggaaggcaaggaggagcaagtcatgtcttacgtggatggcagcaagcaaagggagcttgtgcaaggaaactcccccttatatagccatcagatctcatgagacttactcactatcatgagaacagcatgagaaagacctgcccacgtgattcagttacctcccaccatgtccctctcataacacgtgggagctgaagatgagatttgggtggggacacagccacaccatatcagtaaggatatatcgcaagtgggaagaaacgaatgagatgttttcatgtttgagtatttggaatcaaaagcattggaaaagcagcaaaatagacatttctgagaatttagttggtagaagtttaaattaggaatatatatatgagatatagtattttcagttctggggtgattgtgattctaagaataggagacaactggtgattttcagatcaaatgaataaaacatagtaacacatatagtaaagctaacatttgatgtcaacatcgaaatagaataaaaataataactgataataaactatttactataggatactgttacaaacattttacattcattaacttagtcttcaccacaagcctatgaaaaaggtctcttaaaagttaatgtgcttcaatttagtcagctaataattgatagagccaggaattataattggaacccaaacaccctggctctacagcctgtgctctccagtaatctgtggaagttacacacagagagagaattgctctttacaattctctttacatttttacatggatcagtaaagcatctttaaaagacctagggtcatttaaaaaggccattattattgctgtcttcaaattcttactttttgtctttcttattctttgactccttgttttcttcttcattctgttggctccttgtttacatttgtaacatttaacattaaaaagttgtgaaattctttgtacagtgccttatgttttttggcagcagcatacttcataaatcttgctaataagtctataaatctgagaatctaagttttagattgtttcagttattgaattgagtacatcggcatgctacaagatttgcttataataagtacatacccgcacatttctattaagactgctgatgtactgtgaaatggaaaagctttcactgtcattatttaagaagtattgctttgtttccacattcaacctagaaatacgttttagaagtggaaaataaattcatggaataagttagtagggcaatctgtgttctatacagaaagggagcattatactaaatggtgtgcaggaggtgtagaggaagtggacagctgtccttggggaatgcagactccagttatagagataaaaatgcccacaaaaacatttggcagttagaaaaacatcatttaaatgacagtagtaaaattgagccagcttctaaaggaatagctgaaagttgccgaaaacttcctgtaaaactttcaacaagatgactttagaggagatgatatccctgtttgatgaagagtatatgggaggaatgtacacaggggttagagagacattgttaatgtaagttaactgggctgaagcatggaagggcaatgagaggttaatgaaatgggtttgcattgtggtaagtggtagcaatgaaatgttttgagaaagaagccaaggttatttgtttatttacaaattagaatgtcctatcatctagttgaaaccactttgtaacagtatggcaattatcttcaaatattggaaaggttgtccacatcgtatggggctaaatttactcccattctctacaaagaatgaaactaaccaattagaaaaagcaatatgaagacatttttgtcttttggttcattatagttaaaatcaaaacaaaacaaaaatggcttagctttctatgaatataatggctattttggaaattagttcctggagtcacttaagtaaatattgggtctctttttggcattcatgttgtggggtatttctgctaacaataggaaatttgtgctaagatcacttccaacttgagcttctaagagtttgtatgaaatgattagaagagaaactcgtatttagtttcttagctagaaggctctgtccaactccagatgtgtcatataatgagaatcaggctgaagacaaatataggagatattgctaggaaataattgaaaggaactggaatggattcaggagattagtgttgtcagagtaatggctccaaggggaatgggactaactagggaatggagcgccttaatggtaaggaagcaccatctggtggaagaagtatggggctgagaattggtggacctgagttctacatctagctcatgcaccatcttgaggtgatgggcaagccatttatctttgctgaggttatatacaatttaagcattgaactagacaatctccatagtgccgtttttcttaataaaatcaagaataagttaggggatgggtttgaaggttcatttagtgtcatactaacagaaattatgttttgttgtccaagtagacattttcttgaggaattgattagtttactaataaaaagattttggttgggcagagcaggggtcttaacattttcaagttacctatttttcaacaaatagcaacagaggaagacaaagaagaagaaaacatcttgggttcagccaggaaagtgttgcctttgagacccagcaataagtattgctttttatggaaagcaagtacatgcttttctttattttcatttgtttttgtagagatgagttcttgctgtgttgctcaggctggtcttgaactcctggcctcaagcaattctcctgactgagcatctgaaagtgctgggattacaggcatgagccaccacacctggccaagaagtgtgtacctttcttaaaagaggacttactgtttgtgcaatgagtgatatactccaagacaatttgcttaactgacagtcttgtgaaaacttccgtgtgctgcctattcaagggagtgaggttgcagaaagatgtacaaccagccagatcatagactgtttgctgctgtttctgtacttacccatttttatgcttctgttttgaggttttgttggattgcctatctttttaagtagttacttcacagagatacgtacatactccacatcgtttgagtcttcatgtttaagtatctgcgaaagccggtggtcatactctagggaggtgatcgagagtgaggctattgggaatttctgccctagcatggcttccggcccttcgctcagtggttgcagtattttctgttgtaaaatataggttttctctaaggcatcttagagttcgtgagaaatgcctcaactatttccatgtcttgagccctgcagtattttaaaataacaatagcaaaatgaagaaaagccaaaacaaattaaaaaattcatagtgctcgcaaatgatttggcctggaaaatataaagatacagggaacatgctttttttctgtcctgcagtgcttctataagatcatatatataacttcatttagtgcttacacaaggagtctatcactgactccgtggctctgtcattaggacctagtggaactctgcctagtcaacttctctatcccaggaaataggctgtttctaatttttaaatattttctgattttaggccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggtgcattattatttattattctgcttcaatgggtcattttaaactagagcctaattataaactatgtgtgtatgtgtgtgtgagagtgagagagagagtgtgtgcacatgcaagagagatttttagaagggaagaggatatactaggtgtattttcagaaggaaaattaaaatatgcctcagaggactcctctgtgaaatgaaaatttacttcctgatctgttacgtggtaggacagtctctcccaggacatttacctggcagcagagcttgtattgctctgtctggaagaaggaattctagtgaaaaatggtttaatgcagcaccagctagggaataattcagatctcctctatcagtcagtatacaacaagccacatttaattgtagccttgaaaagcccttggggcctttaaagcttagagatgcatggtcatcttcctctccttcaaactcgccttttaaactttcagctgatgacaattatatgtatatgtagattttctgaaggggttttggatccttggaaagcaaagattgccaactatatgctggctatttatatacagttatttatcagttaatgacagggaagtgttctgagaaatgtgtccttaggggatttcatctttgtgcagacatcatggagtatacttacccaaacctagatggtaaagcctactacacactgaggctgtgtactcctaggttacaaacctgtatagcatgttgttgtactaaataccttaggcagttgtaacgcaatgctaagtatttgtgtatctaaacatagaaaaggtacagtaaaaacagagtattataatcttatgggattactgtcatatatgtggtcctgtcttggctgaagcattgttatgtggcacatgactgttcatgtaaggccatcagggaaggaagaacacttttttgacaaaaagcattgctggattttgggctttaataattctttatagatagactaatccagcaacttgttttcttaatttttatagggtgaatatgttcttaaacataacctaatagtttatgctagccagcagtactttatgggatgtggagtaacttctcaagcttcaatatatatagcaatgtcgatcgcatagaacaactattatcaaatacctttttaagagggaggggacagtgagatcattttgaattagtggtatctgaatttcaagaagcaaattaaatatttattaaagttgatcattgtatgtgtgtatttaattatggtgaaatttaaacactaaagtaaatagtataatgaaccccaacaaataattcatctgtcttcagcagttgccaatttataaccaatcttgtttcatctgtaacactgctcagtctctccaccccaaccccctaacctctactagattacatccttctgacttctggcctactggctttaacaaatcagggggctcccataaccctctccttgggtgtgataatttgctagaatgactcacaaaactcagggaaacattacttactattgatttattatgaagggtatcctaaaggatacagaagaacagctagatgaaatgataatttgccagaatgactcacaaaactcaggaaaacattacttactactattgatttattatgaagggtatcctaaaggttgcagatgaacagctagttgaaatgacacatgggttgaggtcctgagcacaggagcttctgtccccatggagtttgcagtatagcaccctcctggcatgtgggtgcattcttcttcaccaacccaaaagctctcagaatgctgtgcttttctgagaaaagcagaaaaaatcagagtttttgtggaagcgccattacattggcatgattgattaaatcattggctgctggccgattaagtcaatcttcagttctctctgttccccagaggttgagagggtagagcttaaagtcccaccctctaatcacatggctggcttttctctcagccaacccccatctttaggggctttccaaaagttacctcatgaacataaactcaggtgtgattgaaaggggcttgttaggaataacaaaaaaaatttcaatgccagcatgctatattttgtcctttttattttagcatgtcctgaactctgtcactgtagatctgccttattctttctaaataacagcatgatattttactgtgaatttttttgttaatttacttaaccattgggcctcttttataggctgttgttcccattcttttcctgtaactgtattttagtgaagaggtgtgtgggggagggtaggtgggtatgttttaaaaatcatattctttttttttttttttttttttgagatggagtcttgctctgtctcctaggctggaatgcagtggcgtgatctcagctcactgaaagctctgcctcccaggttcacgccattctacggcctcagcctcccaagtagctgggactgcaggtgcccgccaccacccctggatacttttttgaatttcttttttagtagagacggggtttcaccgtgttagccaggatggtcttgatctcctgacatcgtgatccgcccccatcggcctcccgaagtgctgggattacaggcatgagccaccacacccggccttaaaaatcatattcttgaataaactgcttgcgttataattattgagccaaaagatatctgctttttacattttgcagacaatccccataagtctttttacccttgtcttatacttttaaaaaatttgttcctttataatactttaaatatatgactagacaaagcttttcttctttccttttttttataattttatttacagtttttttacatttgttctttccatgaattttagaataattttatcattttcttaaaactgcaccagaatcttaagtggaattacattatgtttgcatattataaaaatattgacacctttatgacatatcttccatcacagtggcatatgattttttattcactcacttatcaattttactaaaatcatatacattcttaacattttgatttattccctggcaattatattattgttactattataaactagcctaccccatttatcttttatttacatttcttagttaaaaggaaaactgtttctgttacaatatttgttttatctcatcactttattgacttttcttactctaatagatgttaggttgcttcttatattttgtaggtatagcattatggtagctgaaaagcagtctagtttttcattgcattagctaaaagctgcaagtaataatggtgaataaaagtagttcaatattcatctttgtcttgttgctcattgtgggtacgcttttagtatttcactctaatgtgtgttgcttactggtttcagtcaaatgctctcatttatgtttaaagtttctccctgtctctgtttgttcttttctttttctgtgtgtttaaatcaagaatggcttctatatattatcaaacacgcttttgacactcgttcatatcatatagtgtctcatttttatcaatctactgtaagtatgctgatacatttcctaatgttttatcagccatacacttgtaaaataaatctcaatactgtctgaatttgatttgttaatatctgatttaggatttttttaatggctattctttatcttgcattattttgaaatttttaaatcatatttcctactgctgtgtagttcaaaaggagacagatcccatattagaatttaatgaagaagtggcatttgagttgaaggaaatgtagaatttttacgtttggagtttatattccaggtagagaaagcaatatgagcaagagcaagggaactgaaagtacaggaagaatggaaagtatgtcacttagactggagtgtgggatatatgtagtagccattgagaggcaaaatcggaacccatgtctctaactgaaaatgcctctatggagagttattcttaattcaataagaaatgggaagtcactaagtgattttgatatgggacttcacatttgcactttgaagcattagaattaactcactcttgagaaaaatggtgatcactatctagtaaaaatttcatagctcttgggaagtatttacagaattgcctgagatggaagcctggttttttttttcttttttgctttgttttactccaatgcttatgtccttcatgcttggaggacttttatatttttcaagacatgagtatataatgagaaaacagactctgtacttactattgaagttaattcattttcatacaaatgaaggaaagtatagtttgaatatagaatatgtaatgaccaagaaatcagatgatgataagtgacttagaaaagttttctactgaatttccccttcctggggaatttaataccgcagccttttttatgttatatggttaactcttttctgtaattaggaaagcacacaggtaatagattgagcagcactccgaatgaaggctggcagtgaaactgaattacttatacctccaaagagggatacctgccattaaacatattgtttaattttctgttatataatacttttttccttaggaaacaacatgtaattatatgtatagttattggatgccatgaatctcaactatgataatagaaaatcagatgtttattgctccaattaaaaagtgggttttagaaacaacactatagagagacttgatttccctgactcctgacattgacatatttgaacaagaattaataagccacataatcttccatttaatttatatttatgatgaagtcatatgtattactctttgttagtgtttgcctaatgacctttttaaaaattatttggtgtgagatacaaattctgaacaaaagagaaatatacagtcatacctcagagatactgcaggtttgatccagacctctgcaataaagcaaatgtcacaaagtgagtcatatgaattttttggtttcctagtacatgtaaaatttataaatataattttgctgtatgtttatatagtaaattatactgtagtctaagtatgtagactacattatgtaatgtacattatgtagactacattatgtaatgtacattatgtaatgcttacattatgtaatgtacattatgtaatgcttacattatgtaatgtacattatgtaatgcttacattatgtaatgtacattatgtaatgcttacattatgtaatgtacattatgtaatgcttacataatgtaagcattatgtctagaaaagcaatgtacatatctttttttaaaatattgctaaaaattttaacaatcatctgagcccttagcaagttgtagtctttttggtagtcaagggtcttgccttgatgtttatgacaactgaatgatcagggtgatggttgcagaaggttgggttacctgtggcagtttcctaaaataaaacgaacgtaaactttgccacacccattgactctttttttcacaaaagatttgtctgcagcatgcaatgctgcttgttagcattttttccacagtagaacttctttcaaaattgaagtcagtcctccctctcaaatactgtcactgctttaacaactatgtttatggagtattttgaatcttttgttgtcatttcaacaatgttcacagcatcttcaccaagcatagatcgcatctcaagaaactactctttgctgctcatccataagaagcaactcttcatctgttcaagttttagcatgagattgcagcaattcagtcacatgttcaggctgcacctctaattctagtttttttgctatttccgtgacttctgcatttacttcctccactgaagtcttttttgttgttgttgagatggagtctccttctgttgcccaggctggagtgcagtggcatgatcttggcttactgcaacctctgcctcctgggttcaagcaagtctcctgcctcagcctcccgagtagctgagattacaggcgtatgccactgcgcccacctaatttttgtatttttagtagagacagggtttcgccatgttagccaggctggccttgaactcctgacttcgggtgatccacccacctcggcctcccaaagtgctgggattacaggcactgaagtcgtcagcccctcaaagttagccaagaaagttagaatcaacttcttccaaactcctgttaatcttgctattttgaccttcccccatgaagctcaaatgttcttaatgacatctagaatgatgaatcctttccagaagcttttcaatttattttgcccagatccattacaggaatcactgtctatggaagctatgatctcacaaaatgtgtttcttaaataataagacttgaaagtcgaaatgacttcttgatttttgggcagtagaatggatgttgtgttagcaggaatgtaaatggcattcaacttctgcatctccatcggagctcttggatgatcaggtacattgtctatgagcagtaatattttgaaatcttcttttctgaacagtgggtctcaacagtgggcttaaatattcataaaccatgctctaaacagatgtgatgtcattcaggctttgttcttccgtttatagagcacaggcaatgtagatgtagcgtaattcttaagggccctaggacttctgaaatgacgaatgagcagtggcttcaacttaaagtcactgcctacgttagacccttaccaagagagtcagtctatggttgtgagagtcttagatggtgtcttattctaaaacaaggctgtttcatctgcactgaaactttgtggtgtagtatagtcacctgcatcaataacttgttgcagtttctacatcagtacttgttgctttgctttgtgcttttatgttatggaaatgacttctgtccttaaatctcatgaacaaacctcttttaacttccaacttttcttttgcagtttcctcacctttctcagcttttatagaaatggagagaattagggccttgctctggattgggctttcacccatgggaatgttgtggctagtttgatctacccagaccaccaaaacttctatatcagcaataagggtgtttacctttcttttcatttgtggttccctggaatggcatttttaatatccttcaagaacttttcctttgcattcgtaccttggctgctcagtatgagagacttagctttcaacctatcttggcttttcctgtgccttcttcactaagcttaatcatttctagcttttgatttaaagtgagagacatgcatcttttccttttacttgaacacttattgtgcactgtaggtttattaattggcctcattgcagtattactgtgtcttggaatagggaagccctaggagagggagagagacagggaaacggctggttgttggattagtcagaacacattcaacattaattgattaagtgtgccatcctatatgggtatgctttgtggcacccctggttacaatagtaacatcaaagatcactgatcacagatcaccataacagataaaataataatgaaaaagtttgaaatattatgtgaataactacagtgtgacacaaagacatggagtgaatgcatgctgttggaaaaatgatgccaatagactgcttgggtgcagggttgctacaaaccttcattctgtaaaaaaaaaaaaaaaatgcaatgtgtgcaaggtacaataaaatgagttatgcctatagtattaaataaggaaatatgggttgctggcaggtggtctctgtcctcctggtttacaaaatagtggaaaaaccaagagtaagttattacaggtgctatagttgttacaaataggaaagtgtggaccatcaaatatttacaggagacttaacctggtttgtgagcttaaagaggagactgaagttgagttggtagtcccaaagtctcagaattttctgattatgagtttcaagtgtctaacagggtgaatgacaattagaattggaagataatacgtacatttaaaaattttttgagctttgcaattttcttcactttttagttatttttaaaagtaaaattttaaaaagtacatacttgtgaagaggacaagtatgtcaagacaacctttatagagaaatactggaagcatttccatcctaaacattaaagagttttattattattaagggaaaactcagtaaagtgaaagctactttgttgactgacacctttttagtccaagttatctcattgattgtcacttatggaaaatttagtcttagcaatttgttttgttcaaatctcttggtagttggcaggaatagaaagcatgtctcttaatcaactgtttaaatgtctgttttacaggatctttcatttaagaagcaatccaaattctctaaaacttgagctttcaggaaaaaagaaaacagatgatttttaaagattctaaccagtagtagtcattaaacagaagtgctttgaaaacttgaaaatttggaatttcttgtgtaatattaaacatagaatgcactcttctgatccattactgaaaaaaaggatccttctataatttcttagttttatgcaaagcatcttgaatccttcccactttttttttttttttttttgaaactactacctaaaacacgtcatttactggccacttagtctgtgccggacactatactgtgactttcttttatttactaatttaaccctcatgctcttctctaaggtttatattatgatgtccattttaaagatgaaggggctgtggggcacagagaagttaagtaatttggtgacgtgccaaaagtaatacagctgaaaagtgatagataaaagtaaaatgtttacttgatatttaggaataaattatgtctgtaataattttgcattcttttcctaatattactttacttttttttgttttccaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagataggtatggatatccagggaggacatattttctagtttgttaatttttcccttttcaaattgttttctcttttcctttccttagatgtaccaaatgctagtgttactaattttgaagttttactagtgaatattgcatgtgtactcacagcacacagattactatattagggaatagtgttttgcaagctatcaaggctgaatacctgagttaaaaatcttgactctgccacttactagctgtataaacttgcataaattacatattctctatgtgtctccggtttcttaagagtggtgatagcaatattaactcatctttaagggttgtttaatcattaagtgaattaacactcataggaaactgtctaatacatagtgcttagtaagtcttagctactattacttatttatgttaaaatgaaatagaaggagcaggtgtggtggctcatgcttgtaatcctagcactttaaaggctgaggtgtgcagatcacttgagtcagaagttcaaaaccagcctggccaacatggtgacacccgggaggtagagggtgtagcaagctgagattgcaccagtgcgctccagcctgggcgacagagcgagactccgtctcaaaaaaaaaaaaaaaaaaaaaaaagaaatggatgaaatagaaggacggagcatgctagtgagctcaaatagtttaataaaaagttgcattttttgttaactgtttacacctctttagtagttaaactgaaaataatagcatattatttgaattaaaagttagctattaacaatataaaaattaggagttcccaaatgtatatctgacactgtaccacgtgtccacacacattatcgtgttacaactgtcctctgaggtacgtattcctgtccctaatttagagatggacttcaagtaaattgcccaaacttttatgtatcttgcaaatggtagagttgactccaaatcccacattttttctactttttgcttttcagagaatcttaaaatttgcaaatagtagtaaccattgggtgaaaaatcttagccttagtgataggaaatggttttgtgaagatcattaggtttgttattgacaaaaccaggtctaaattttagacttcctgaatcagtccagtcatttaaattattacatgagctcaagattggatttttgaatttttctttatgattatggttatgctatgctttatgttgtgtgttttatttggagaagaaccgaaaaagaggaaaataatttttctttcccaggttactttatatttttctatttttaagggaagatgctctttatattttatctcactctatattggaggtcttcagtctcaagtcatgcttatttactttcttccctatgccatgtagaacgttttgtaagtaaaagtctattcagaattttatgatggggtgaaaactgtaacctagtcttttccaacttacggtctactagtcactaattttgtgtgtttcttttttagttctttttttaagctctgttatgtttttaagaagataaaagctctattttatttttaaaaagagagaatcttggccagatatgtttgggaaatgctagtttaaagctaaatgggcttaaacaaacaaacaaacaaacaaacaaacagcacttacccaaacctttaatatgcagacttgcacataaatctcccaagaggcattacccataatctttgaccatgcgctttttccagagtacaatgtgactctagtgttgcacagaacacactttaggaagtgttgcattaactagacacaattgaagtgaactgttccataaaaaattgtgcgttctcttatggacagagtattttacatctcagtgatctcttttattactttttcagctcccaaattataaccagcccccttccttcagtctcttcacctcctcctgcatcaaaaacaaaagaagttccagatggcgaaaatctggaagtgagtacaaagcttttccagcttcctataggagagatcctactgcatgaacattttatacttgtctttaaaacctcaattttgattaaataactaaatattacaactttattaaataacttactttatgatgcacgtttataacttttccccctcagcataaagtaccagatagtcctcaatttgagtcattttattggtgctttgggcatataaatggattcatatgcaatatgaaaataaactaggcttaaatattttattagggaaacctagaatatttactgtcaatgtgtttatgaaccttactgtaattgttgtcagtgcttgtgattacatcgtagaaatgtataactttgatattagagttaatacactaagcaactttttaactatacatataagtagacacatttttgagataaaacaggcctgttagactagtgctactctgaaaagtactttggaaagtgcattgcagaagctgatgtagtacatattttttaatttgtctataagacttctaatttaaaagaaatcattaatatctctgatgttgaaaacaagtaacacatgttttattattagaacagttcaagtgatttttcagtgtgtgtatatatattacttttagtcagattttaggagtaattgttaatggctgaatgaatcttttaactattagctattgattaaagtttgtatgtttgcatatctttcggtataacaaaatattcaactgaaaaaagaatttttaagttacagaatcatagaatccttagataagccctttaagaagccaatctgctacagtctaagttttccctttcagagctaagatattgattcattgattcagtcattcattcattcacatatattttttgagctcttaacatgtatgggaactgttctacatgctggggttgatgcagcagaaaacaagacagttacaatgtttgccttcatagaggttatgttctagaaagctcttacaagttacttgttactaaaaaagtaacatccctctaaaagtgaagcaggtgagagaacaaccatatggctatctggggaagagcatttcagatagagggagtagcaagtatagaggtcctaagaccagagtttaagtgtatatgtttgaagaacaccagaaactagtgtgcctggtttgtgggagagtgagcaaaagagaacctggcagaagattggatccaggagagaattggatatcagtagtgtagggcttgtaggccattagtccgaatgagttttccatattggtagcttgaacaaagggtgatttacattctagatgctgtgaagtgattggattctgaaaacgatgttcagaatattgatttacactcccccatcactcaaaatgtttaggctaaaaatgatagtttgtatatatttctgatatttctcttgtgattgatgaacctatctgttgttattcaatgattaagccatttaactttttgtcagctgaatagttttttagagggttcaggtatccagaaaagagtggcaatcattttgagtgatatttctatcttcccctatcccttcccctattcccatagagtgtattgtacaagccattgtcacctttatgttaatacacaatcaagctgaattacctctcttcttatcacaacttgagatatcaacattcctgtctcctttttgacacctgagcagtatcttatgtccttcctcgttttattcttggagtttcaggagaacattatacgtgtctggccaaatgtttgaaaggagacagaaactcaattattccccaaatctgctcatattttatgaattccatgggtcatgagaagaagttgtatttcccagctgttgggtatagcattatacataagttactagagcaagcttattgtgttattgaaatctgtactctgtcctaacatttttttctgctttatctgtgaaagaattagggcaaaattcccctgtatgatggtagaattattaatttcttcttgtagttctgttagtgtttgctttaaatattttgaagctcttcaattaagtaaataaattgcatctttatcactgtttggtaaccctcttgatatctaataatgcttttcatcttaaaacctgttttgtctgatgttaatagagctttgtcttgattaatgttcatgtttatcttctcaatattttgttgcgtttatcttttcctttgaatttttttgtagccttatattttaggtttatgtttatatttaggtcccttgtaaatatcatgtagctaaattttgtttttaaatctagtttaacactctgttttataactggaacttttgccccatttgcttttattgtggttgtagctgtattttgactgatttcactatcttatttagtactttctatactttcttatatatatataaattacatattcttgcttgtcattggctaaatccttctccctccaccccaccccatcttatttaacttccttcagatttgataatattattgttattattgtatacactcagtaaatatttagagatacttttcttgaaggatacctgcaccttcctcaccatttcttcttatgtctgtgacctacaatatgtgatctttttttataaagcacttttttctttaaattgttttaaaaccttaaagtattgcttacacagattgagttttaacatttacaatacatacttcctgtttcacagttttttaaattcaacttttctttatgttctgtaagtaattttttatcaaaaaggcatagtatgaaatgaaacgtgtttgctattgaaatatatacatcactgtacaaaagtataatgttcttggcagatagtcaaaagagaaactttaggcctatattctgcctattaaactcatggactcagctttatataatggcttcctgattgaggagttttttaaattggatttttggtgcatatttaaaatgtacacctaagctttaaaactggagataaaattcttactgaaagcattggcacatctactttgtaacaacaccctcttattactcggactttacttaagaaaggacccctactgtgttaaaagttctaatctgttgatccctactctttcattattcatcagctcccttcaatgtttgcttttctctgaacatagcttttatcccatggctgtcattttagttattattttattagtacctgcagttcccctggcaaaaatctcaactcttgataagcctcattaattacctactttcgctatgcctgaatattgctgaagaaaagcacatagcatagcatgttggtgtcactataaattcatgatcacaaacctcagatgagcactcactgctgtctgccatcttccatttccctagacgtgttgatcttcctgctctgcagtgatttttcataccatttccactctgttcttcatgccccgcctcccaatctctagatgacaattctgcctcatacttaatggaaacaatagaaaccactaggtaagaatggtctgtttcccatcaccggttttatagacaggaatccctaccccatactttccttctgttttcttacacagaagaaacatagctctcttcaaagatgtgttattttcttttcctgatagaaatactcaagtatgtgttagaattttccatgttaaaaattcagaaaaacaaaactgtcccttgaaaccacatctcttgaaacagcaccttgttttcttacttctcttctcaaaggagttgtttatacatactcttttcttccttctttccagcctttagtccatatcattctggctcttgcttaaaacccaatttgctaagttacaaaatgaccttaatacttttggttgcacattcttttcagcttcttcagagtattcaacaaagtaaataactttcttcttgaaaaactaactcttctcatggtttaggtgatactgtatatctcttgtttttctcttcatctgtcttgccatttcttctcagtttcatttgtcagcactttcctctctccttgatatcttaatgttcctcagggtcctcttctagtctcacttgatactcttgtcctaggttgtgttaataaactcaaatttgcatttctagctcagatctttcacctgagtttcagattcatctattcaaacatgtatttgatctccattgtatgtctgacaggcattttgaacttaatatttcaaaatacaactatttcctcttactctatagataggcagctttttgtctgaaatctccgtttgtgccataacaaatcaatccagaaatttgggagttactattaatgcctttctttccttcctacttcctctccaccagcaggtcctgttaattatacttccaagatatttcttatatttgtctccttttcaccatctccactctcattatttactctcctagtctaccgtaatagcatcttaactgatctcaggtctgtacttcacaggacaaccagtcattttcctaaaatgtaaatcacatcatctcactctcctcttaagatcctttgttgggtatccattgcttttaaaataaaatccatactcaataataatgtgaccttaaaggtctcacatactttgacctttgcctatcttttcagtctcttcagtgttcactatattttatttacattacttagcattccttgaacaagccaaacttagagctttccagtgtcattttggtcttgcctgaatgtcatgtcttcattgttgccttttctaatctcccaacctaaattatttctatgaccatttcttttaatgtctctctcctctaccaatatgaagctccaggaggacaaggagtcctctgaactgcggtattctaaccacttgcatattttctgatttaaaatatgttttatgtatgtatgtaaggatagataaatggcagaaaatctgatctattacataagatatacagatgaaaactgataggcaaatgtaaacttacttattttcccccattactagtagatgataatatataatacatttcttttaattctttcagcaagatctctgtaccttcttgatatcgagagcctgcaaaaactcaacactggctaattatttatactggtatgtaaaaataattttctgtttattttcttattacccttaagaattattttttctcatgctataaacacaaagatgatttaaaataagatatgagcaatcatcaaaagtctagatatagtatttatatctaactgtattccctgacagctgggttcatggaaatgcttgttggcatcaacatttctctccctttcactaaggatataactttccaggagctaggatataactggggagggtaatgggtactttcagtttaatatctgtttggcatgtaaagtagttgagtatgatatttcacagttcttcaggagtatatattttcacattatttactaaaacattggaatcatttaaaaagaaaaagttggaattaaaagttaccttatggcattttaaacatgaggaaactgaggcagaggcttgctgtagctgaacttgatagactctgatctaggattaaatcatttatctactgctttgccattttcagggtattttcagttaccttttctcatttgtttctatgacgttaaatgggcaagcataaatatctctatttcacattaaaacaatgtcctgagtcacttgaaggaaagagagaaactaaggcacggagtggctgacttcttgaggcacagttaatatgaagcgtggtgccctttatttgccccagaatcctgaagagaaaaaggcaagtagcttaagccacaatcagaaatattttgcttcaataaaaaaaaagtactgggattaaacactagataagagggcttcatctaactttacggagcaaacaaagggcagagccaggtgggtaagacctgcctacagccttctttacctttgggagaatccttaaaactacttatatcactttttaaacttcttggcatgaggctttttactgtctaaatgatttctaatctaatcttactgctcaatttatagccttaaacaaattacaaattagtagatgtccattgtaaaagctcactacaggttgagcataccaaatccaaaaatttgaaatctgaaatgctccaaaatccaaaactctatgatcattgacatgaggtgcaaaagaaatgctctttggagcatttcagattttgaatttttggatttaaggtgctaagtataatgcaaatattcaaaaatcaaaaaaaactagaaatccaaaacatttctggttctaagcattttggctaagaaatgctgaaccagtacttttgaataatgatgaggtattttgctttttgtgagaaaattatacaaaatacgattttgttttaagactgatttgggaagctgcccttgtgggtcaagtccagccttaacttcattctcccactctccagaggtaatgctctgctgggtactgcccctgtacttaagaagtaggtaactaaattggagcactctttttccttttttcttttttattgtactttaagttttagggtacatgtgcacaacgtgcaggtttgttacatatgtatacatgtgccatgttggtgtgctgcacccggtaactcatcattaacattaggtatttctcccagtgctatccctgcccccatccccaaccccatgacatcagtgtgtgatgttccccgccctgtgtccaagtgttctcattgttcaattcccacctgtgagtgagaacatgtggtgtttggttttctgtccttgcgacagtttgctcagagtgatggtttccagcttcatccatgtccctacaaaggacatgaactcatccttttttatggagcactcttttaacacacacaatttttgatttacataaacaataaatatttgtttagtttaagcctttatggttctctttacaacaaagaaaaaccactgtcaacaatcttaagtaaatcagtgattttcccccctttggaacctgtgtttatttttttttggttgtgtttgtttttttctgttggcctctgtagtgggaagaaaaagagtttcctgcttttactttagcagtttaatataatattcataaaactacattttcctcacgttaaatttcattatgtccttgaaaatataggaggttttgactaattgttaatcactattctttctttgaaaggtttacttagaaattctcatattgccaaattgctactatttcctttaaatgccaccttttacctctaatgttctctgtgttccaatctgaatatttaaggatatgtcttgtcgccggtcttatggaaaaatatttcctcatgaaaatctaaatatttagaaggaagtaaagagaaaaaatatttgtggggtatgtttctaagtttttgagtaaatatttcaaagcttcttaggtatttttaaattaaaattttgtatatttttaaaaccatttgctaagaattcatttagagatatttttgtttccttgcaatattcacagaaacttttctctggctcagaatttatagtctagagtattcactatggtaagagctatatgtgtatatactgattatgtggtgctttcaagttacatattctttgtgtttgattgaagactagatttcattattaaatttgaaatgagttttgatagaatctttgatctcttatttcaagtaggcagaattttctgaaagcagccaaacagtaggaaatctgttcgatgaagtttccaacatagcagctgcttctgttcataaggagcacacttttttttcctataagcaaagtacagccccagttcccagtcttataaacattcaatcaaacttagatttgatttgtgttttcccactatatctctgattcattgaatcaatagcatatgctgtgtctattcattccctaaggagtaattgtttttcccatatttacagtctgcctattacatattcagaaatactcatggggagaaaagctattgatgtgtggactcttgcctttaataaacactgcttttgtgaatgtaaggtaacaataagggaaataatttcaaatagttggtttaaaatgatcattcttctcttcctttgagcatataaaaataataaaatgtgagaatttaaatgcttctctaagcctactctattataacaaatgtattaaaatagaaattttaattgtgctgtttcctttgaacacttgaatttccttttttcatttgttccctttctggtgatttaaacaggattcttgctgtagctaaatccttaggggcctatagttgtgcagacaatccttttaaaatgaatagtgtcaaccttttaagccacagaggggcgttacagtctccagtttgtaaaatgatgggcatcagaatctataaattgttgcagttttttatttttatagtcattctagggtgttgaaattgaaagtaaactttggctgctttgacatgttttctataacttttaagacctttcaaggtaataaaggttatttatgccacaaaataaaattgccaggaaacaggtagcccactgatgtcatcttacaatgggtacctggacaattttgtttgcattcctactttaagatgacagctttcaaagaaataccttagagtgctttagaatctagtttattgatgtgaacagaaacctcagaaatgattcaaatctaggtcttctagtcttgatagctaaccttgtctctcatatttggagatgacagtgtcacttttctttttttaggtggcctttttgtttgaatagatgtttggcttgaatgatttttttttttttggagatgaagtttcattcttgttgcccaggctggagtgcaatggtgcgatcttggctcactgcaacctctgcctcccaggttcaatcaattctcctgcctcagcctcccacatagctgggattacaggcatgtgccaccaagcccggctaattttgtatttttagtagaggcgaggtttctccatgttggtcagcctagtcttgaactcccaacctcaagtgattcacccgcctcggcctcccaaagtgttgggattgcaggtgtgaaccaccacacctggcagacttgaatgatttttgagaggtgtttgatacttgatgcttattatgagcatcaacatattttttttcttttttttttcttttttttgagatggagtcttgctctgtagcccaggctggagtgcagtggtgccatctcggctcactgcaagctctgcctcacgagttcacgccattcttctgcctcagcctcccgagcagctgggactacaggcacccgccactgtgcccggctaatttttttgtattttttttagtatagtagagacggggtttcaccgtgttagccaggatggtctcgatctcctgacctcatgatccgcccaccttggcctcccaaagtgctgggattacaggcatgagccaccacgcccggccaacatatattttcaataacaggaaatggctgcagccatagtgtttacttggtggtcagaaagagcaagatacagcagtgagcccctacattgtggtcagctatatgttcatttggaaataagtttgctgcataaacacaggaaaagctgaataccctaagatgacggagataatcaaggactttaacaatgaagggtagaaggggatggcttggatttgaataataccatattgacagtttcaccatttagaactgctgttttttgttttaatgttcggctttagattcatggaccacaaattgaactgagtgccaaggaaagtttgaggtagtgctatgttctctggtttggctgcagccccacttctctgtctttccttctatttaagtgattcaaacatttgtttcctgcctgccttttgagaaaatttggagtttgtgaaccctgctacatgagaattcctagcccaaataccttggatattgttagtaccttcgatagaggtagaaaaaattcaatttaatgtgataagtttggttttacatgtgttcagttagaaatgacaaacagtgtcttgaaaaggggatctggtccttgaaaattagagtgcatgaatgtgaaagcaggtcatgtaatggaattcaagattagaccttagatgtaaaaaatgaatatgtatttatatttgaaaattatcaataatgagatagtagctaaatccacaagagtggaattattcattcaacagtaatgtattaataatatgttgagcatctattatgagctagacatggacgtgctgaagatatagtggagaacaagacaggtaagccctcagctctcatgaagttgaccatctgaatggctgaatacagagtatactctcccagaaatagtggaaagcataataataagcatccgtgacttgagatttgggaaacattgtcagttaagaaggtcgaaaagtttcacatgtgttttaaagataaaacagtgtgaaagtcaacttagtaaaatcaaaaaagtctgacctgggagcccaaagtcctgggtttcaatctcagttttacaatcagtcataccaccatagacaagacacagcccctctaagtttcactattgatgaagcaagcaagttgattgagattgatggttttcaaactacacatcatcatgatccactgaaagtaatttaaagtttcacagtctagcatttgtatttaaagaaaaatgaaataaacagaatagcaaatattaacatattgctcacaggatgttgctttgtgaaacttttccgttttatacatctgtgtgcatatgtggctgtgtgtatcaagctgtgatacttttttttttctctttgagagatatcatctccctttgttgcccaagctggagtgcaatggtatgatcatagcttactgcagcttcacctgggctcaagctatcttcccacctcagcctccttagtagctgggactatagtcggcgacaccacacttggcttatatttaatttttttttaaatgtagaggctggtctcaaactcctgacctcaagtgatcctccttcctaggcctcccaaaacactgggattataggtgtgagccaccatgcccaacctgttatttgctttggtttgttcccagtggaacatttagaaacactggattagaagacctataaagtcttattcagatcattgcttatatgatttttgtaattgtataagcagatgagggttaagaagacatttaaaatgtcttttactctttaaaaccatagttttttaattggaaagttaaagattatgtatggatctttgaaaaacgggaaactggatgggaaaggaaaaattacttaaaattttattcatcttttgaaaatataagtgacaagaatagcttcagagaggttttcagaataagagagtcttatgtaataccaaagtattacacagattatgaaaataatagtttttgttctcgagttactcagtaaatatgtgagcttagatgatttctgaggatgttaatactctacctcataaataggagaaaatgcttgttttggtggcaaaagttttagaaaatttgggatattacacaaattaaggcattaccactcttagtttaccttttattgatggttgtatgtgttcctctttaagttttcacttttaaaagtgatgataaaatgtgttttattactccaattttattatttttgcatatgtaaattaatctgttttagtgaaatgatatgagtatttacaaactgaatctaagtttcatttcacatcacatgaatggctcaaactatttttaaggtatgtgatagtggaatgtgaagatcaagatactcagcagagagatccaaagacccatgagatgtacttgaacgtaatgagaagattcagccaagcattgttgaaggtaacccttaaatgtgagggttggcaaactgcagcacatgggccaaattcagcctgttgcctgtttaggaacatcccatgagctaaaaatggttttatatatttatttttatttttatttttttgagatggaggcttgctctgttacccaggccggagtacagtggtgccatctcagctcactgcagcctctgcctcctgggttcaagagattctcctgcctcagcctcccgaatagctgagattaaaggcgcccgctaccatgcccagctaatttttgtatttttagtagagacggggttttgccatgttgggccaggctattctggaactcctgacctcaggtgatgcacctgcctcggcctcccaaagtgctggcattacaggcgtgagccactatacctggcctggtttagcggttgaaaagaaatcaaaagaagaagaagaatttgtgatacatgaaaattatgtgaattcaaattttagtgttcataaatttattggaatagaatcatactcatttgtttttatattgtctatggatacttttgtactcaataggagtttaatagttggaatgaaaactgcatggccaagaagacctaaaatatttactctttgaccctttacagaagttttcttgatccctaatttaatgaaataaacctgtgcatggaattaaaaaaaagctttgcttttttattttcctttctattgtgtatctttcttatcaaggctatgtacatttccagaaatctggcaatggtcatattgcagattctttttatataatgtatttttgccttttcaacagcttttaaaagagatttatttttcctgtgttcgattcttaaagcagtgtcacagtttagccagcagagggtgcaagggcagcgaaaagaaagctaccacacattaatctgtggcttgccgcagaaatagtctatttcatggcatctttcatctgtttgatgtttcatgcttttaaaaatttaaatcacatcttattaaacactttgagactaagcttttgtattcgttcccaaagcttctcaacatcaaactgattggcaaataagcctttggtcctctcctctaatctcgtttctgttacagcctttgtcacccttgaagacatttcagtttctttaagtttaaattgcctcatctttgaaatgaggttgataacatttacccagcttcccttaccagggtaattgggaagattaaattagaaatgtattttataatattttatgaactaggaatcactacataggaccgtatagcatttagtttttatgacttatattttaagcacatattgtggtgctatttgaagttttctttttttaaaagttgatttttagttccttgaagatctatatctttgtttctgccatatacatgtatatatgtctagcacatttctgcatcataagccatcggatatttattgaatcaaataatgagtgaatgtattttaggatgaatgaattctatcttgtcacatggtttatgtgggaaaaaaatgcggttgtagatagaccagtatttgctgaagactcagataattttcgattgtggatggattagtggtgtttaactaagataagaggtttcttgttatttttgaatcaagataatctttttcagttttgctttctatttaagtttataactgtgagaaatatgaataaggattatccatgctgttaaagaaatccagatcattacgcaacatagaactaattttttctcactttgaacccttcagggtgataagtctgtcagagttatgcgttctttgctggctgcacaacagacatttgtagatcggttggtgcatctaatgaaggcagtacaacgcgaaagtggaaatcgtaagaaaaaggtaagcctatggtgtatgcttttgttcctaatagcatcttggcatcagaaaatactgaattttcactattgtctttttgggttgatacgtgaattttttttttttttttttttttttttttgacaatgtctcactctgtcgcccaggttggagtgcagtggcacgatctcggctcactgcaacccccacttcctgggttcaatcaattctcatgccccagcctcccgagtagctaggattacaggtgcccgccaccatgcccagctaatttttctatttttagtagagatgaggtttcaccatgttggtcaggctggtctcaaactcctgaccgtaggtgatccacccgcctcaacctcccaaagtgctgggattacaggtgtgagccactgcgcccggcctattgtgtgaacttcttaccatgaaattatagtaataggaatgttttatgagtttatatatatattgatatgatatttaatcttcataacaaccctataagttaggacctaatattatcccaattgtgaggagaagaaagtaaagagaggtcaagtaatttgtttaatgtcatacagctagtaaatattggagtggggatttgtactcagacattcttagtccatattgttatccacagtgctttaccacctctcattttagaatcttagcaaattagaatatacaatatatttgatatggaaagaatctctagagatcatttagactagaattcttctgagaaaacaaaagtccagattgacttgcccaaggtttcacaactggttgttagtaagtagctttgtaactgttctctcctggctagttcatcagtctgtctctcaactatgaggtttccacttgatgggtagaagtgaatgagtagatgagttcttcacgtgacattttttctgatcagtagcctaaatgatatgaaagattcgcttggtatcttttcctaattccattagataattggcaggcctttcttggtgacctttgtaaaacaacacattttagtgttcctttgacttttaaaggacagcagaaagaggaggaaaatatgaagatttgagtcagtggttcaaaagcaaagaatcaggtctaaagagaaatgctagcagagccatgcagaagaagtaatgagtaacgttcagcaggttagagaggggaaaacaggctgagaggaaacacggttctgttgagttgacattttctttgttgttgagaagaatcacaaaccttggtcaaataaatatatttctactactgttccccctgtagcacctctccccagaggtggctgtgtgggaaacagtgtgattcccagatgcccaccagcagagggagtgtctgctgctctgacctgcagtttggggcttatatttgaaagcagtttgttttagtgccaggagctcttcaatttagcaggcacaggaaccttggcaacacctcagttttagctcttctggaggctgaccacctatttgagacatcactcagagtctccccaaataaattttgtgtttctcacatagcctatattttaagccagaccatcccaagtatagtttcagtattggctaaaaatctttataggcattttatcatgatatggtaaaagacaaacaattttatttacatatatttactagaaacaagccctggcaccatgaagaaatgcagagatagcgctctactaccattattggcattaatactagtaatattgaaatggccactaatcatataaaatcatatgtagcactttttcatccctcataatttatttgcgagagctatatcacagtgggtataacagtgttagatctgtggcagagtaatccctgagttaagtgtcaaatgagtaaagaagatgataatgttgtcttctttccttcgttgatctctagtttaggaaaaattatgttagaagaggtcagtctacatatttgaattctaataaaatgcctttttcatctactttttttttgagacatagtcttgctccgtcgtccaggctgcagtaccatggtactgtggcatgatctcagctcactgcagcttctgcctcccgtcttcaagcaattaacctgcctcagcctcccaggcagctgggactgcaggcgtgcaccaccacgcctggctaatttttagtaaagatgggggggtttcactctgttggccaggctgatctcaaactgacctcaagtgatctgccagcctcggccttccaaagtgctgggattacaggcatgagccactgtgcctggccatcttttccatctatatttaaaataaattaacactttcactgttaatattataagcagtctcttttcactttatgattttttaggggatattactcatttatgtgttctacaaatacgaaatatgtattgcatgcctactctgtgcagagtgcttttctaggttcttgggatacagcagtgaatataaaaatctcttcctctatggggatcatattctcgttgaagagagtaaatgcaataaataaataaaatgtatatagtgtgctagatagtgttatatgttatggagaaaaataaaacaggaagggggattaggcagtacttgtgtccagtagtaaggcagtgtttcacttcttaatagagtggccaggtaaggcctcactgagaaattgacatttgaacaaaggcctgaagcatgtaagagagcaagccggtcttctggagaagattgttccagccagaggaatagcagtgcacagccccggaggtgggagcatgtgtggcagttgtgagaaataggaagaagcccagtgtatttggagcagagggaatgggtacagtaataggagatgaagttagagataattgggaaatggatggaatttatccttgtaaatcattatagtcaatattattttgactgaaacactgagtaagagtagaagctattggagattttgaatagcagggtaacatgaactgactttgattttagcagctgcactctggttacttttgataagaaactgtaggagggtgaaaagtttgaagaagagaagcaatcaggaggctattgcagtaatcaagatgagaaatcatggtggctgggttcttagggcttatagtggtagaggtggtaagaagtggctagatttctctccccattcttattttactttctggttattttatttatttatttatttatttatttatttatttatttattttaattagcgcatcaactagtaatttgttaaggtaggataactttactctcaaattagttgacattacttcacattagtagatctgaccatccatttagttaaggagtagatttagtgatttttgtaacacttatgtagaaattcataccagttgattttcagttgattttaacttgaacttttcatcattcaggaggagatgggattattactgaaggaaaataattttacatcttctttgtccttgaaacatactatttttttctgaacttctttcactgattccagagttctctcctttgaggcttacccagcagcacaaagcacttcaacttcccagtagcattgtagttgaagtgttttatgctgctgggattgtcatgtcgagttttccttcttaaagaacaaactcacctatttaggtgagcaagccctgctcctaaagattgcaggactctcccagcttttaaaggaaattaattgttcttttgaaattgaatagaaggggttcttctaaatagtatagatgttgcttattgatgaagctgtttcatcatgacttggatttctcagtttctggaatgttagcttaatgcattatgtatatgagctgaagaaaatgaatgatgatgatatcctaggaaaagtttgaccatacagactcagtgaaagttagaaagtagggttatagtttctccaagtgaattaagtttcctttttaaactcaaaaaatgcactggggcagcatagtgaaatttttgcttaatatttggtcatgcaaaattaaactttgaaggaaatttcagtttctctctgtggcttcacaaatccttggaaacagaaattgaatctttaggtccaacttgaataaattcctgattctttgtcagctttagcaagtgaaatgtattctgtatccttcctgtgaaaagtccaactttcacagtcaagcgattgtttggtttaaagcatgctgctgctgttgttagggattatttataagtgcttgtctctcacatacaacaccatctcctttatattattttggtgctttgcaaatacttttaagttaatggaatcaatttttatgtctttactatatgttttataaactactcttctattttaacctcattaatcctttctgatttgttctagaatgagagactacaggcattgcttggagataatgaaaagatgaatttgtcagatgtggaacttatcccgttgcctttagaaccccaagtgaaaattagaggaataattccggaaacagctacactgtttaaagtaattgtgatggatatttaatgtgtatgattggaacctaattcttaagctagatcagagatactaccttggaaaactattacattgcagagatcacatctataattctagttgatttagtaaatgctagattgaagggtaccttttatttatcagtgtgttttgatttaagatcttcttttgttaccggtacatgggcatttttatgtaacatgtgaaatacttttatatctctgggttgttttttaatatttaatttttttattgttttatttttgtagagatgggtcctcactttgttatccaggctggtctcatactcctggcttcaagcagtcttcccacctcagcctcccaaagtgttgggattacaggcatgcgccaccatacccaacataatatttagtttttcaagctaattgttaatcagagctgtaactatttttctttatgtaaatttttttagagggcagattgcaaacgtatcatgcattcattcagttcattagttcagatggttagatatgagtcccagttgacctttttaacatttctcagtctgatatctgttcctgttgaaccttaagtgttttcttatattttcacgtggcaattctctttagtccttagtagcataccaggcttggtgttttttctattgactggccaccagttcaggtagaaacagctgatgcagcagccttctctaatcatgctcaaaggaccaaaggccagagcatcattatctgtcagcatcatactgaaagatctttgtgagacatggtgctttatgttttgtgattctagtggtagaaaggcatagttgcattgaatattactttgcatgagttaagaaagggctcatagaacaacaactaatgtatatacacgggtgtaattatagtaggaaacagttcatattttttaaaaaagtgtgtttcaaggcaacctcatatttggtcatgggttgcagcccagctcatatgactaaaacataagtttcataaagcaatccctaactttaactgggtgttatggatggatagttaccattatttttaacattattctgttgctttaatttttaaatgttgcttacaacctattggttttaaaactctctaacagattacaacctgcaagttaaaaatactggtattactatatgcaatttgaaaatactggtataggagatacagtgcaattttttttttagtctgtgcttgcagtctactggagactgaaatgtaaaaagctatgcacaaggtaatatacatataacaactggcattcctttgggctagaactcccaaagaagaccagcttctaatattcttgaacactaaggactcatcaagagcagtgaattaaaaaagtaattttaccattttttttccaaccatggtgcaaaagagtatctaagacatacagcaggggttttaagagtggactataagaagatatatctccctctattggtaggtggattctagactcatactcaattataaaaaattataattatgtcttatgaaataaaatatgggaaatctttttgacctcagtattcagtcttgattatttttctttcaactcttaagtatatgggcattcttaaaaattttgagttagagtttaggaataatggttctgaggcagttgctacgtaatattagttatatagagtgtctctgtgtagggagttgctactttggctcatggatgtctttgagaatctgatgaaagtgatggattatgcacttcagaaaattgcccgtatgcttacacatacactgaaatttctgcatacacttgcagaggatctgtggactcctgttttccttgtatgagctccttagagctgaaaaggctagggacccttatttctagtagttttaaaagtaattttgtagaccttaatgtaacagccaaagctggatattcatgaagactggaccccttaaggcactgggataagtgcatgttatcctgtggttgttttcttgctttaaatttcagatgaaatctaaattagatgaaatcgtattgaatctcaaaaaagaaatcacaacaaagattctcctgcctgtcatttatctttaggaagataacttccaattactagggctcaaggtaatttataaaataacattttcaaataaaaggatattccaaatttaaggtaatttaaaattcagaattttattccaactagagtttgtaagttttaaacatacattctctgaaccattttccatgtttttgttttcccccagcattttataggaaagttttcaagcatacagcaaagttgaaggagttttacagtagacaaccgtgtatctaccactttaattctgtcatcaacattttgccatttgttttgtcacatctgttcatccatctatatgatgttttttgggccattatttctcttggttattaccattttttttgtttttgtttttaaatttctttgactcatttttttttctttggattaatatatttctccaaatttttgtcttatataatttcttctcaatgaccaaactcaatagggtctctctctctcagaacaattttctgaccatttatgtccagaatatccatcttagcatgccactttatgtgaggttttatgattccccctttctaaaaagaatataatttctttattttttttttgttgatttaaacatatacctaaactaatttagaccttcatataattaagggaaggactgtggggaaaacataatattattccagaataaaagatacagatatttgagatctcctctcattttataaatgaggaatttgagtcttaaagctgcacaactagtacagattgagcatctctaatccaaaaatccaaaatctaaaatgctccaaaatctgaaactttttgagtgctgacatgatgccgcaagtggaaaatcctccagctgactttatgtcatgcattacagtcaaaacacggtcagaactttgtttcatgcacaaaattactaaaaatattgtgtaaaattactttcagtttatgtgtgtagggtatatgtgaaacataattgaatttcaagtttaaacttgggtcacagccctaaaatattttattatgtatatgcaaatattccaaaatccggggaagtccaaaatcccaaacatttgcaagcatttctgttatgggatactcaacctgtagtatacttgccattaaaaaccagggctcttcactttgcatctggtacattgttatgttgtactgtttcaccttatttatttcagtatacctctaaaaataaaaaatgatgatagatatataaagaatgtcttctttgtattaggcatggtgccagactattgacctgtatagtttctgattgccttagcaactctgcagaagagatggtatcttattttacagatgaggaaacaagttaaaggatatgcataagactgtccagcgagtacctgggagagcttggaatgttttaaccacatgactgattgcagagcttgtgcgctttccatcgtgtagtcttctgactactagctagttcactgttctttccagtataccctaatgtatctcattgaaaacccaacttgttttttaggtcctatttacctgtgtatttatcttatatatcaacattttcttgtatgtatagtacaattttatgcattaattcatggccaaatttgaaatcaatatttttattttccagagtgcccttatgcctgcacagttgttttttaagacggaagatggaggcaaatatccagttatatttaagcatggagatgatttacgtcaagatcaacttattcttcaaatcatttcactcatggacaaggtgaacatgaccttatgttggtggggaacatttttttcgttttggaatactgtggcttagttcatttgctgtttatggaacagaagtatttgtaacattcaggtacgatcctagaaagctcaacagtctccacttgaccttgaaaaaatttagttgcttttatatacttcagaatggtttttgtgttgagtataaattggaactgtatgtgttccattaattttttttccaaattaagttctctaaataagggatttagtagtttccttcctcttagtctattaaattttttttaaatccttttaatcccatctctgtccctggcattaaaaagtacatgcttgccctagttccctttttctgagctctaaagtactttatggccagaaaggactgcatgaagtgatagcaacaaccctattgttcattgaaaacagctgacagagatttagagtagatgaaaaatttagcataccgtcatctaagtccttaatcaatttaattttgatgatcaaagttaaattaactatttttttttttgagatggagttttgctttttgcacaggctaaaatgaagtggcgcgatcttggctcactgcaacctctgccccctgggttcaagcaattctcctgcctcagcctcccgagtagttgggactacaggcatgcaccaccacgcccagctaattttttgtattttttagtagagacagggtttcaccatgttgaccaggctgatcttgaactcctgacctcaggtgatccacccgcctcggcctcccaaagtgctgggattacagtggggaaccactgtgcccagcctaagttaactaatttaaacttaatttagcttaacttcctaaatctttattacattaaactgctatactatttgcccacaaaactgtcttttaacagtctttacatttggttaatatattttaccttttgattaaaagctgttacggaaagaaaatctggacttgaaattgacaccttataaggtgttagccaccagtacaaaacatggtaagtgtattttacatcattattatttactttagtgtacattgtgtgtactttttcaaattgaaaatttttaagtatgttagagatacaaataaattccatttgtagcactgaagacaagttggaccttcctgcctgcttcccttctgtctttccttctttcctgtttctcagtaactactgattaatgtaactactggttaatgtagttactgagaaacaggatatttcagacattcctgacaatcctgtagacacacatacacatacacacacaccctcacacacacaaaccatttaagtcttttcgagatgaataatccctgggagtttggtagaagattccctaggaatgcttgcctaatgcttactgtaaattccatagtcttgctgcccttcctgctttatactagtagttactgagaaacaaaatacatgctttaggttcctatccttcctctggctactcccaaatctttttgatgccttaattactcttctcagtttcttctcagaatgatattttaaaaagtgcaaatgtgcatctttacaatcctgcaaaaagtcatttgttagctttcattttctctttggacaaagacccaaaaaacctttacctagcttctaagtgcttgcatagtgtgacacaccctgtgtctatctttcaagcctcttctttttgccactcttcccctgcatcctgggctttagccatactggctaccttctgttttatctaatgcattgtgctctaaggccttcacatacactgtgatcattgtctcaaacattctttgctccatggcctattaattttattatccttgaaaacatggctcaaatgtcagatgtccttcgatccctactgtaagttaggtctccttacactacttcctttcatagtaccctttattcatagtatttacccaagtgaagcttataagctttaagatccatgtaggcagtgtcaaacatctatttttacttacttggcaaatttcttccgacatggtcaagaaacaataaatacctgttaagtgaattagtgccaactattctgtatttatgatgcaagaataaatgagatatttcttattctacaggggtatataatctcctaatgtgcatgcaaattattatcctataggcttaccagaaccagatcatgatagtttatgatcctgaaatgttgtttgcttcatccaacttttttttttaatatatccattgttttatgtttctgttgtcttcagacttatcagactgactttttctccttcttccacatactgtctgtcccctttcctttttttttttttttttttggtagtttaagggatttacacatctgttattaccaggaaatgacagaagatggaatattagacaaaaggagccattacataacagttttacatacagcttttagggttaggtaattgtaatccacaattctagatttcttacggtgattttaaatttggaatattttaattggtatatgttgtaaatctatagaaagaagaaatttttgatgctagatttaagaagcttagtctattagttttcgtttctcatattttataatagaaattagcctagagaaacatacagactaaatcagcttaatttaaaaaaaaaaagttttcttacaggtcctatgacataaatgccagtacaaacttaatgtagtgtacactgatctttttaagttgttcagatatggaatgcatttattcagagatgaggattattcttagcagaacctttatttttatttcttaaccagtagctatgcttaatgcagtgcatacatttctgtgtaggcttcatgcagtttatccagtcagttcctgtggctgaagttcttgatacagagggaagcattcaggtatggtatcaataaagattatgcaattcatgaatatattcttgtcataaaaaattcagtctttataacatagagttaaaaatgaaagtctccttttatcatttttctttcttcaagttttttttcttcctttattcagaagtaagcatgttcgcagttgaagattcttccatttgttacatagattctcagttccttgaacagtgcattgcatatcaagggatcaggcattaattggtgaacacagcctggccaacatggtgaaacctgtctctgctaaactcacaaaaatcagccgggcatggtggcatgcacctgtagtcccagctacttgggaggctgagccaggagaatcgcttgaacccgcgaggtggagactgcagtgagctgagatcacatcattgcactccggcctgggtgacagagcaagattctgtgtcaaaaaaaaacaaaaaaaaccccaaaaaaacagagttaattggtgaacaaattaaaatttgttaacgtttatttatacttgcattatattccaaagtatggaaatgttgtaatttatttgatattaattgatgagcactttatttccagtttttgttattcagaacactgctacaatgatattgttgctcatctgtcttttgtacaattatttaagaccccctatcctctcccttcaacctattgctcccctttaaatatgagaaaaggtgagtggttctgtgacaaagtaatgtatatgtttggattttttttttttttaccctttaaatacatggattagttcttataacatgttaatggtttatttttgttatttttaaaatataattttcctgcttccctttgtaaaaaaaaaaaaaaaggtatgtaattaaaacaaaaatggatacacctgagatgaaagataatacacagaagggcttggtagatgatgtttgatacagtgtgtttttgcctttccctatttaattgttccatttattcagtatgggagtcagatttgtagaaaagtattactctgattcttttgcaaagcaagtgcttattctgttctttgatttggggtacagtcatgtgcagtggttaaaagctcaggcttaggacatcaaactgcctgggattgaattccacctgtgtaactttccagctctgtaaccttgagtgaactggttaactctttttgcagagaaaagttaacatagtagccctaaggttgcaatctttggaaaggcctgcttgccaggagattggtcattggctttcagcatgttccctttgcttcctaattgataagggtggttcgctgtgcctagattgtttgttcaaataatatgctttatactaaacaatccactttccttctgggagtctggaattttgtacttgcttgacagaggttgcctgggtcaccagttcctgataaaaccttgggttctaagtctctaatgggctttccttgtcagaaacattacacccatgttactgctttttattttttatttttggctattggaaaagaagctcactgtgtcttcataggacagagagggctaggatgcctatgtatgaatttctccagattttttctgtgtatgttttccatgttgattctactgtgtatccgttctctgtaacaaaccttagtcatggtacaactacatgtttagtctgtaagaccttctagcaagtcaaacctgtcagtggtcctggggacccgtttaacatacccttcaagacaccagtttttgcatctgtaaaatttcggtaataacccatattactccaggattgttttgaagaggacctgaagtgtacttaaagtttttaacatgggccctaattgccatcattgtttcataaagtttttcattacttacattgttttgtgtaattacgattttataaaatgaaaacagtgacagtttgtatactgattcttggctgcacatctgatctgtgtaagtgatttacctgggtcatagatcacattcagctttacttgataatgaaaagttgtttttcgataattaaaagttgttttccaaaacagtaacacttcttgtgtttctccttgctacatgtctgccaaatcgtagtgttgccaaacttcaaactcttcgtacctctttttggtttgcatttccctgattatctgtaaggttgaatgtataaaaatatatgtataggccatttgtttcttctgtgaagtgcatgttcacatcttcctgtggcccatgttcctgtcgcgttgtttgtattttttgtattgatttataggagtttttaaatatatattccagatgcaaatcctttgtcagaaatacagggtattcaaaaaaggtgaaaacataggataaactttttttttttttttgtgagacggagtcttgctctgtcgccaggctggagtgcagtggtgcgatctcggctcactgcaacctgtacctcccaggttcaagcaattctcctgcctcagcctcccgagcagctgggactacaggtgcctgccaccacgctaatttttgtattttagtagagactgggtttcaccatgttgaccaggatgttcttgatctcttgacctcatgatctgcccacctcggcctcccaaagtgctggaattacaggtgtgagccaccacatctggccaggataaactcattttttaatagtacgttaatcgtattttcagataatatgctctgtggttttgtttgtttgtttgttttttgttttgcctctaaatgtaaaagaataggtgcaattggaaatctggggtgggtggtgggggacattaaacacagtttcccctaatggaaactctagtgtatttatcgcactcttacaattcttttgttcagtcagcatctctcatactgtattttgattaagctttatgctagacacttgctggtcactatttatagtttcaaaacacctagtttgtttgtttgtacttaattctaaaacatgtaaataatgtcttttcagaacttttttagaaaatatgcaccaagtgagaatgggccaaatgggattagtgctgaggtcatggacacttacgttaaaagctgtggtaagtttttcaggctattactttccattgatcagataaagaagagcaggccatcctgatattgccataatcatatacatttagaacatgttaatatttaaatgctctataggaagagtaaaagataaatgttgattaaagtagtcattgatgctttgacataatagtattaacaaggtgtaaattctatttagtctttcatggatatatctttgtaatcactgaactattttataatcacagtttatctcttcctggaagctgttaattttccattagattttctctatttttgaataacagaaactaagtagaccatgggaaaagtttcaatcagaaatgattgtgctttagataaagtttaagagctaagataatggtgcttcattaagagggtgcccttgtggtattttagagtcagtccttatggtccattcctagaaataagaaagcagtagtagtatttcctagaaataaatagtaagtgacatagggattaatttttattcttcaggcatttatgtctaacttcacgaaggttatattctacaggattttttttttcattttctttatttttttcttttcttttcttttccttttttcctggagacaggatcacactctgtcacccgggctggctgaagtgcagtggcgcaatcacagcttactgcggcctggacctcccaggctcaggtgattcttccacctcagcccgccgagtacctgggactgtaggaggtgtgcaccaccacacttggatgatttttttgtattttttgtagaaacagggttatggcatgtttcccaggctggtctcaaactcctgggctcaaacgatcaccacctgctttggcctcccaaagtgcaaagattgaaggcatgagccaccatccccagcatgtttatttttttattttgattttttttataactagattgtttatgggaggattggtaaaggagttgacactagagttgagccctgaatgacaggatgtatgatgtgttataactattttatataagcgctatatttgtttatgtccctatttatgcctatgcttaagctgggagagcaagaagagggctttctagttagttgttaagactatatttaaacttgcatattattttctggtttagaagttgctttcttatacataatatttttgtgtttttcacaacacccctgtgaagtcaccttccaaattattttggaccttattttcaaatttattcgtgatgatacatttttgtctgaaaagcagaaagaaaatgaactttgagaatatggaaataaaattgtgttttataaattagagtcctttatagttttaattcttgtttttactataggaatataaacatatattacatgtaactgaatttgtttgtaaacgtgattacatgcagtatttaaagacttaaaaacactgaagattttgagagaaaatgtttacccttgtcctcttactctgtgtttctctctcttcccttgctcctttcttgtttctcttctttattttgccccatttctcttctgtttttctcagaccttcaagtctatgttttctgtgatctgaaaaaaaattgcatatcatctaaaggctcaactaggctgaacatccaagatggatcactcacattattggcagattatactgtcttagctaggcttattgtgaatcacctacacatgacctgtccctggcttgggcctcttagagctgggttccaagagcaaatattcagacagacaggaaatggaaaatactagtttctgaaggccagggctgggaagctggtactatatcagcttatagtataactatattttgttatattctgttgttcagagcagtcctagagccttcctggatttgaggggacggaatatatatagatccaagctctggatgaaaagggtgtcacagaatttgtggccatttccattagtacgttattacatgaggtgttttatatacccccaaataattatcttttacctttttactatagcatagttattgtaaaccttttaaagtcataaatctgtttaataaagaaatactttttccacacaaaatacatacacacacgcttgccctgtcagtattgactacaatttgaaaattctgctcattagtaaaattatcagaatggtatgttacaggtacatgcttaatgtcgtaccattgtgtcttttgtatagtggtccattttccccccaagagctactgaaaatatgactggctttttcatggggaaagaatagcaatttaaattatcttacctattggacagttaaattcacattatatcttatctctccccttttttccaacatttcacatgtattcattcctctgtaagtgatttaatggtaggccttctcttcatctagaagagccttctgttttctgtatggcttcctgtatgacaaaataatctgtttttgtgtaactttcattttagaaaataatgttttaatgtttttgcagggtgtaagaaaaaaattgataatagttttggtgacatcttttccagattatctaaagtctcaagtgtatatcatgcagctaaatgtgggaatactgtttattctcacatacacacatatctttactaagtaaagggaaataggatcagtggtctatttgtctttatatttttctttaagtcaaagtttttttataaaaacaatttcaagatgttttgtatctcacatggaataaaaaaactaacaacattgttttgacaagattttcttggacagaaatagtgtttccattgttgtatagttaaagaataacatcaatttccctaaaaattttctagcaaatttatttcaggtcatcttaaatcattctgagtattagttatctcctcaacgtttctgaggatcatcccattcttacctcaaatgttttgttgttatttttcaggatgtagccttgtttaaagtgccctactgagtattgacactttaaactattgaagcactctaaattttcatctttactattaaatatggccatatgttgatacatatatttcacttgactaaacatgtttatcagaatgaccatccaacgtatttatgaccataatccactgagccagggcaaaagacccttacttatttttgcatttccatataacaatgaaatgcactctcaaatttgatgatgagtagtttatagaaatattttgctttatcgttaggattaagcataattcatgtatatccagttacatgaaaattttaggtcagaattaactgttgcaacacaggtgaatcagtattctatagagatagctaaacttgaaacaaagtaaatagtgacaaaaactaactgtaatttataatttaaaaatgggaatagtaagtaggtctggattgaacaactcagctgcactgatgtacagtgatgttatttttcaaaattgtaggaatttcgcttgtcttcatatgcacattatcggtagtttagtacccttgagtggcaggtagatttctacgaatcacatgttagagaacctaagtgtactaagttctcatatgttctcagggtattgtacttagtttctctttaggaatatcaaatttaatatccctcagtaagtcacttagttatttttcaatggggagtctgtagtcatttttgaaattgcatgtattgtggcagttttagagcagtgctacttaaagtgtgatctgtggacccacagtattgactttacctgggagcttgtttgtattacagaatcttgggccttacccgacttctgtgatcagaatcttcattctaacaggattttcaggtgattcttatgttcatcaatacactagagtttagagaaggcttctcaacctttggtgtgcatagtaatttttgaaagcttgttaaaatggaattgtggctgctgcccctaaaaattctgattcagtaggactgaagtaaggctgaagagtttacatatttaataagctttcaagtgatagtgatactgccagtctgtgggatcacattttgtgtagcaatgctctagatcaagggtgagtaagacttttctctaaagctttgcagatagtaaatattttaggcttttcaagtcagatgatctgtgtaaccattcaaccctgccattgtaatgcttaaaccagtgtgtaaatgaatgagtatgactgtgttcaaataaactttacaaaaactgaggggaaccagatttgaccatcaggctgtagtttattctcccttcatctagataccctttaagtcctcctcagtggaccactaaatgttatcattgcatttagctgcagttaacataatgtacctatagtgatttaatcataagagtttattttctcttttgtgacaaaactagttataagaaattgctgttgttctaactatttaaggtgattaggaccaggtgaaggctctgtgtttctctgtgattctcttgcccttttccttatggtctgcaactacagtcatcatgtcgcaatctagacaggaaggagaaaaggcctaaagggctaacctcctagctgagtcagccgcttgcttaaaactgctttccttgcatctatatttgcttacatttcattggacacaaatcccagcccagtgactttgaacaatactattaattcttggagcctgaagtttttcatttgaaggatggttatctacttaactggcatcattaaacaggttagaaatgatgaatatgatatgcctagctaagagcctagtcttcagtacattgtaactgtgattattattaattaatactatttttccaataattatgccattgcttaagttgcttttggacttctggaatggccttcagaacctaagtcaaatgaactttattatttattgaatttgaacagggttataagttcattaacaggtggtcccatcttgtttttacacatgggctgaaataaacaggtttttgtaaatattgctatagttttatatgtttacaagttgtgtttgttgtcaggttattaatggtagaaataaacatagttaaaaaaacaaactccaaaagggtgctatttgctaaattctgtttaagtagtttcaataaatgctaaatttccagactttttttagaataaaaagataacagaatacagctagagccaatgtctttgcctttagccttgatcatgtaatttttcttaatgctttagaagattattgtgttaacttcataaatgtctttaccactcaaatgaatgcatttggttttctatctgcttccatttcaagattatttttccacagacttaaaaaacaatttaaccctgcatttacttatgttatcttacagataacatggttacgagttatgggataattgacggttgacttttaactgtgtccaatttgatattagaattgctaggcccatgttataatttaaggtctcctgaacctaacttaagttttgatgcaagtgacttttgtaatttaacagaattctacaagattttctcttttaaatagtactttgagtttcaagtgacagacatgaagattgcatatttgagaattcagatgagaaaccagagacattagaaaacaaattgatattaaagttgcacaaactgcttttatattcagtagaatgtataacctggtttgcatttgttttcacatattttttttaactgttactgcagctggatattgcgtgatcacctatatacttggagttggagacaggcacctggataaccttttgctaacaaaaacaggtaacaattaatgactaccagtagacatacattgtatatgcccatggtttttacccctgaatctatgtactaacaagataagttgcggcctggcgcggtggctcacgcccgtaatcccagcactttgggaggccaaggcgggtggatcacctgaggttgggagttcgagaccagcctgaccaacatggagaaaccccgtctctactaaacacacaaaatttgccgggcgtggtggtacatgcctgtaatcccaactactcaggaggctgaggcaggagaatcgcttgaacccgggaggcggaggttgcagtgagccgagattgcaccattgcactgcagactaggcaacaagatcaaaacgccatcttagaaaaaaaaaaaaaaaaagatgagttgcgtaattgaagataaatcagagagtcttaaaaattcctttaaatgttaccttggaagaacatttagggaaagtcctttcccttttaagaattgctttagtagtaatcctacagatggtcattttgcccacacttctgtactggaaaatgcctctttttatggaaagccaataatggatacaagtagcttagtctcttactgtatagctctagttagattgttaaaatgtcctttctcttacaaagtgtgcttaattcactttaatatctacctttaattatttgcttttccccttggagttctatgggataatcattctcagtcccctttgtcctgacaactctttagccctatgtatttatctttatgcagacagcttccagacttacagctttttacctcagtccatttcattaacttcaaattgaaatatcgaactgcttacttgaaattgtcattatatatggccagttgtaaaaggttgtcctttcctctactacctgcctaaaacctgtttctcacctcatttttccatttcaatagatagcaacatcacctacccagttgttcaagctctagacctcaaagtcattcttaacatgtctcttggcctcatctcatatactgaacctattagcaaatcttgtctactcctcaactccaaaatagatcatgaagttacccactgtcttcatttttactactttgaccccacttgaagcaaacaatatatgttgcctaaacaatttgaatgaaacctgaaccctttattggggccttgtggcttgtccaggcaggccatttgtctgaatgtcaaaccactcctgcctcagacaagagcctttgttgttttctctttctggaaagttatttattcagatctttgcagggctgactttagttattaagttgaagttctaatggcatctctttagagaagccctttctaactccttgatctgtaataacatatctgccctcttcctccaatgctctctacttattactgtattgtttatagcacttatcactagctgaagttaccttttttgtttaattcaacaactatttattgaacagctagtagatgctgggaataccaaagttaacagaagagacagaaatccttgctctcctagagcttgttgagttcttatcatcatcttctccccttcaggatgcaagttccatgagagcaggaacctttgtccattggggttacccccatgcctctggaccttgaacaccacctagctaaagtgttcaataaatcagtgttgaattaatgatgaataaatacttctgctcttccatgaacctgtctgggctaaataattcaagtttcttccgctttctgcagaaagcagatgtttacgttactctttaaattggtctctcaaaacattttctgttttgtttgtatttctccaaattgtgataataataatttaacataatacatcaagaataatctattaatataatggtcctattaatttataatttggaatgtcatatattcagtttttaattattacatatgaaaaatcatctgttagaacttgcatgggtgatgtcatgtctgtgtcaaagccagtcaatctccttaataaccaagaccaaaagaatataatcagagtgtcatgcagattcttggctgatttgctcatttagcagaggatatttataaaacattatggtgtatttggagagaattgtaatttggaagttttcatgtgttattttcattagctcttttttattggttgaatcttttaaccacaagaatcaagcaaccaaaatgattccatttttttccagattgtaatcatttacaactacaatggaattctttaatataaaaataatgctaaatgacgagttaatgggtgcagcacaccaacatggcacatgtatacatatgtaacaaacctgcacgttgtgcacatgtaccctaaaacttaaagtataataataataataaaataaaaaataaaataaataaaaaagaatttgccagtggaaaaaaaggtagtattacatctgtaattttatattcacaagttctacttgattctttttttggaaattgataaacaatcagacagtgtaaaaaacctttttctgttatactttgaaaagtgcccttgtgtgtatttgtgtgtgtgcgtatgtgtgttttgatgggggtatttaagagtgaaactggaaggaagaatctgcgtaatacacttttttggcccaggtctcagttacttgtttaatggaaattgaattaaatttcagaaacagaagctttaagcttttgttaacagttttccactagagggtgctccagatttgctttttcaaaaccaagattttaccctaaaacgtgcataagtaagatgcacatttttttcctattaaaacagcagttcattttttcttaactgctctgtaattatttcatccagttacattatgcagttagcattttatatctttcttactggatacatgttttcaagtttttagttttggtttggatgaaattagattctataaggagagactgagtatgtcaagacaaatagaagtataatgcattcttcaagttctaacaatttataataattttaaaaagtttgtgtctctagtcatttttactgagagtttgtatttcaaagtggttttaagttacatttcatatatgttataaatagactttgtatagttcaaagtgaattttgaatgtggttcagtgcaggaaatatattccaatgtttttagtttaaaaaatgcctcgactgtcatgaagacttgtccattgtatattttgagtttattatgccttcaaattgaaaactttgggttctcttacataactgtccaatctttcaatggctgatggagcattttttaataatcaagtaacatttttcttattctgcaaaatacaatacctttgttttctgtactcctttgccagcccaagcaggtttagagtctaagattctgctttagattaaagtggttttgaatttcaatcagacttccactgtttcatctgtgtccagttctttgatatgggggatggagcagaagaaggagccacgcagatttcatttcactgatattttttggggacttaaaccagacaaactattctaccctgtaaatatagatgaaatagaaaatgatccagctaagaactctgggcatgtgaaagaaaatgattcgctgcatatagagaatgtcaaaatctatacaagagtaatgttctcaaatgcaaaatattagtctcaattatggatttcccagacctttttttggcccatgctttgtttttgaatacttctagcttggttgaagtttactcagcttgcacagcagagggcgctgtgtatccaccataaatgtaaaagtgtagcgattgtattgtcagtgtattgtcatgtgattaattataacgctgttttcttgaaacaagtttggggtgaatgatattttacttattagtgcattactattgaattcttttttcattattactatagaattctttggacaagaaattacaaagctaggctgtggtgtggagttgaaaaataatagattttttcccaagaatcattgtccttaggagaagctttaaaaagcttacttagggcgatcagttgtgacaggattcaaatgaaacatggtttgagtttatcccagctctttggagaaaggttaatttttttgtttttatttttgggagtttgaggaaagaggggaaggcagtataactgaaaaatatgttcactgcttatggtatactttttaatgcaatcagtatttgaaattcatttgtaaataactgaaaaatgttcacaaaagtaaagagggaactggtatctgtactaaatggaaagttcattgtgagtcctaaggatggccctcctgatcttgagttgccatttgtgagagaggtagtagcttttctgtctgccttgccactttagagtaatacactttgaaacttttctcagaaagctcaacataaagaaaaatggttattcttatttttatcttaattggacattttctttcaatatagctcctgtaatacagggttctctagagggacagaactaatggtatatatatatatatatatatatatatatatatatatatatatatatatatatatatatatatataaaggggaatttattaagtattaactcatacattcacaaggtcccattataggctgtctgcaggctgaggagcaaggagagccagtctgagttccaaaactgaagaacttggagtcggatgttcgagggtaggaaacattcagcacgagagaaagatgtaggctgggaggctgggcaagtctctcttttcacatttttctgtctgcttttatcctagctgccctggcagctgattagtttgtgcccatctagattaaaggtctgcctttcccaacccactgactcaaatattaatctcctttggcagcaccctcacagacacacccaggatcaatactttgtatccttcaatccagtcaagttgacagtcagtattaacatcacagcttctatcctgattttctgtattattctttaattttatgtgaaaatgattattttttagaccaagaaacagtctttcagagtggctaatttgtttggctctaaaggcaaatttttgcatttattttgcccctcccccattgggtgactttgggtaagttacataatatgccagtaactcagtctcttcttctgaatctgtaaataataatagaacctctctcctagtggtgctgtgaggtttgaatgagataagtagacttttgcttggtattgagcacataataaacattccttaagggctattaggttttctttgcttgtttgttttaccaccatgagatgaataatgcctttttttttttaaacttatgtagttcttatttggactcatactattagagagaagaaaatagttaatatatttcaaaaatttctttttcccacttgctataatttgggtatttgactcctccaaatctcatgttgaaacttcatccccattgatggagataggatcaaatgggaagtgtttgggtcatggtggtggattcttcatgaatggcctggtactgtgctggaggtaatgagtgagctcttctgttagttcccttgaaagctggttgttaaaaaagagcttcgtacctcccctctcatgctactatgtgatctcagcacatgccagctccttttcgcctttatagattattgatctttgatactgaaaactattattgaaaaatattgcatcattgtgcttttaactgagtgaaaatactgctaaccaagtatattgtaagggtttaagtaataagtattgggaacagagagtgggagtataaatgtagggagcctttttaattctgaaaatataggttttgctataagaataaattgctgtttgctaccttctgtatttctaggtttagtgatagggcagtaggaaagatacgacattcaattaagacaaaaggcattttatggaaaaaatggtaaataaatgccaggttatatataaaaaattgaagagtgggaaactcactggagtaggatgtcagggaagaatttttggagttgggaattatatggaatctttaaataatagagtttggattataaggaacagcagaagaaagtcaagtagaaggaggagagtaagaagaggtatgaaaaacagaatgaatacagttttgatgttggacacgtttaattattaaacaaaatggaaatttaaaataaactttaccattaaatactgtcaaagagaatagtgtatgttctctttaatccaagaattacagatgcctcaaactacaattttagaaataagttcatgttatttatgcaaataacaggaaaatgtaattagcacctcttactccctatgttttacaagttggagacaaaaggaggttaacaaccagtttgttttatgtatactttatttcttgactgtttaaggtggtagattcgaataagatcatactctctgaacttcttaaacattttttttaaatttcattatgtgtattttttgaacctttacaaattgcattttcaaatattaactttaaaaaaaacattcccttcagtatttatgaagatgaattttcttaaaacattacattaataggctcttttgaaaatacatggctatttaacttgtaaagcataatataatttcattgttagatactgaatcttttacaccttttaattaagtagtaatcctgttgtttgagttttctgacaagaaggatagaaatatactcttcgtttgtaaacagtgatacatagccaatattggaattccagtaattcctgtcatgaaatgaagaaaactgggataggtttcgtattaaaagcatggagctcattaaataaaccatgcatgatggcagttttgtgtcagagattgaccggattggtcatctgttcaagtatattggtaacaaaacattatttaaataattaaataaaaccaaggaaaatgtatctacacctgtaatattgtgagcttcttatttctttacctcttttggggcagaatcatgtgtatccaacaaggtaaaagatatatgagaacttcaaaatgagaataaagtaccaaaagaattgcttagcttagttgaacagagaacacatatttagttgaaggtggtaaaatggttaacagaaattgatcatggacttttcatcagttcatggaaaactgaaatcatagcatactccccttgaaccttaagagactatagggatgctgcttttccagtgggtactgaagttgtcaaattcacttttgtaaaactggttcctcatatttgttgaattatggactttccttgggaatctggtgaagtatattgatctccccccaaaatcagtttcattgtacttagagaccattaaagcccattttgggattctgaaagagtagtttttcagtcataaatcattcagtagtttcttttaatagaaatgaacccccccccccgtgttgacattttatgatcttaaatatgtacaacgtgaaacctcataattgtgcctactcttacatactatacaatgaaaacagatttataaatcaatgtgttacagattagtaaaatttaacaacattaaaatgataggtggtatattattacaactaaattgctatttacatactatacaatgaaaacagatttatactatacattactcttactatacaatgaaaacagatttataagtcagtctttcttacatattagtaaaatttaacaggattaaagtgataggtgatatattattgtaactaaattgctatttatgctaagaatatggtttttaaaatttttcctttctaaaattttttttgagtaataataagttagcagaaggattcatctcaggaatatttaaagaaataattttctactatatgaagggcactgtgcttaaactttagcacaaaaaattttctacaagattccactttctgctgataccttaaaaagttacccaggctctgaccgtctttgattctgaagacttataaataggatttaacatttttagattaccattactgtgacatgattttaggcatagtttcgtgtgaacgaatgagttaaaatgagttaattatgttctgaaggccactctcaaacctgcagttagaaatatcgaagaatttaataggcttcatcgtgaactaatattctttatgaagagacactgtttatatcaattgtgtgacatatcacctacccagttctttaagataattctggaaacaaatgagtttcttgtcaacatccaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtaagttgatttgcttggcacagagaatttgggtaaatttattttattttatagaacaagagaatttgtttaaatgtatgcattctttagcattgatcactttttcaaaatgacaaaggcaacaatatttcctatcttacatttaataccaattttgacaaactgtcaaatatcaaaggaaaaagacataaactttcttgctttcccactatcttattactatatcccaccagctaggaagctggcatcacataagatgaagcaaacatggaggcttccaactcaatggtgttgatgtcactttaataaagtatactttgacagtactgagatagagaaaaggttaagaaacttcataccattcagatctgcctgaagacagtcctggagacttccttctccctagctgacttcctatttctttatcaaagaatataggatattttagagtgatattagttcaatcatttttattctttagcagccttagttttgggtactcttcaggaatattcagaagtttgctcaatgattgtggtaaatgttaaatatgatttttatctctttttaacacctcatcagtcattctgctacaaaaaaatgttttttctccgtccttttttcttcaacaccactaaatctgtgcttccttcttgctaatttacttaggactgactatcatatgtcatcaggaagaaaaataaaagtcatgtttggtaaatttaggacatggctctgatgattattagtcaaaaatgacaggatcatttgactcatgctattttcagcccaactatgcaaaatgaacttttcttagtccagcagaaaatcccagtccaggaaacatacatacatgctcttccaggtgaaaatataaccaatagatagccagttgcctgtgcacatgggttctgtttcctttgacttcataacctttgtgacatcaattactcatacagtgtttagtacataggcactcattgtgtgtttattcattgagaactcttcgtatttgtatgagaaccctccgaattcctgctttgagtctagtgtgaggccatgttcccagttaatgttgatgtgttggtcctaggagactggttttcttacagtaatggggtttcatttatgcactgactaggtcttcattgtaaactcagtcttttccatgtatcacaaacctgtaacaggcattttacaaatggccatgatatttatcctttgggtggcagaatggctcagttttaccttccagaaatgccaaaagaataatgagaaaatcagtgctctttagatttgtttggtgatgcagaagcactttcagagagatgagagtgccatttaatatctgcgatttttaatttaaaatagtcaaagcccatagaaaactaggtcgaaccatggatatctcagggaggtggcggacaagatggtaaggaatgataactagagaaatgtcagaggtgctctatcttattgaaagcagaaggaaaacaatgtggtttataaactgtcattggtagtggattagtagcaattcaatagaataagaaaacaggcaggttattaatggagagccaaggttgacttccttgctacaaagaaaagccacagagagattaatctaaataattttatgcagagttttaatgaaaactgtttaacttttaaaaatttccctgtacttaatattatctggacctaaattatttgatcaactttttttttttttttttgagacaggttgtcactgtcgcccaggttggagtgcagtggcatgaccatggttcactgcagtcttgacttcccaggctcagatgatccttccacctcagacttgcaggtagctggaactacaggcatatgccaccatgcccagctaattttttgtgtttttttgtagagacggggtggggtcttgctatgttgcccaggctggtcttgaactcctggattcaagctgtctgcccaccttggcctctcaaagtgctgggattacagacataaacccatcgcacctggccaacatttattttttaatgttgtatttcagagtatgttttagttggttgaaaaaatgccttcaggatataagaattaacctgatagttgtttggagctaaggttatcggcacttttattaagctattagatatgatcggccctgttattttatagtttttcttgataattgatcagtttcttcacaaagaatccactgaataacattgtaccacataagcagagtagtccatttgaacttagttataaatggttacaaaatacattatcatctcttattaatcagtacatattaagtctttctcccaacccacacttatgccaaacaccattcttagacactgatgttacaaagatgttctttttacattttttggtaaaaattttcaatagtgaaataaggaatacatttaccagctgggcacggtgactcactcctgtaatccaagcactctgggaggctgaggtgggtggatcacttgaggccaggagtttgagaccagcctggccaacatggtgaaaccctgtctctactaaaaaagaaaatacaaaaattagccaggtgtgatggtgcacgcttgtaatctcagctactagggaggctgaggtatgagaattgcttgaacccgagaggcagaggttacagtgagccaaaatcacaccactgaactccaacctagacaatagagcaagactctgtctcaaaaaaagaaaaaaaatttaaaaaaatgtgtttaactatcaagtaaggttctcatattgtctcagagatgtttgcctagtcaccaaacatcagtgaatttattggtcacatacatcattaactacattgcttcccctctttgaagtagtacacttattgaataacactttcacaggaactctgattttgctgtcatggaaaatagaatgtagaggaaatacatttgaaatactataagaacctcaatgtagttaatggatttctattttcagtaataaaggtttttcctgaaaaatttaaactatctttgtgtgactagagtgtagcacaatagttggcatgaacgtgggtaagagaaagagtgcagtttccttgaacattacatgcaacctgcttctttctaaaaatcctaattatatcacattccatcttgcaatctttgctagattttgcacgctttcccaccctattattgttattattattttttatcttacccttaggttgtctaatactggtttgttggccgggcagggtggctcatgcctgtaatcccagcacctcgggaggtcgaggcaggtagataacttgaggtcaggagttcgagaccagcctggccaacatggtgaaaccctgtctctactaaaaatacaaaaattagcctggcatagtggcactgcctgtagtcccagttacttggggggctgaggcaagagactcgcttgaacctgggaggtggaggttgcagtgacccgagatcgtgccactgcacgctagtctgggtgacagaacaagactccatctaaaaaaaaaaagtggcctttaaatttgtgtttctgagtaggacattaaatgactgtcctatgaagtaaacacttggtattttggttcacttgatgtatcttaaatggaaaattcaggttaatgacaacagatgtaaaagattaataccaaaggtagtgacaaattattcacaaagtatgtggatatctaacctttatatttatttctgtttccctttgctataacaatagaagcgtggatggttaaatttaaatcaggaggtaatccagaaagcattagtatttacttttgttaaaaggaacatcgcattctacacccgtaaaggcagatttttttttttttaacattgatcctggctgcccgttagaatcacctggggagcttgtaggtgaggtggcaaggggaaagttctggactcgctcatatttaattggtctgagattgggctcaggcattgatacatttgaaaagctaccaaggtgaatctaatgggcagccaagttggagaacttctaatatatctctttcaaaactgactttgtattctccttatgttaccttctggtagatttccccatgccaagatgggaaaaaattatgtacctatgtaatcaacaaaacagagtacgaatgatggagagttagttgaaagagcatcttttttttttttttttataatatgtaacagcggattgtacgctgctggcatcacattccttgaagccctctcaagtggatcatctctatttccatagagaagggcttatctaacctgtggcccccaggccacatgtggcccaggacagcttagaatacagcccaacacaaattcataaactttcttaaaacattatgagatttttttttttgtgattttttaaagctcatcagctatcattagtgttagtgtattttatgtatagcccaagacaattcttcttccactgtggcccagggaagccaaatattggacacctctgatgtagaaccttcattatcattataaagggtttcattctggacatttatttttgcccacccctcactccccttaccattttcatccagtcctgtgactttacgtatgatcctagtgctgatgactttaaactaatatcactagccttcatatctcctctgagatatatctgacatctctactaaaaatctagtaggcacctcagactccacatgtctaaaacgaaattcttgaatccctgcctaaaatcctgttcctcttccatttagcctctcctatcttggtgaataacactagtgtcctattaggctaaatcctttgtgtttttcagtttctctatcctctcaccctgacctccattgaaaccatcagcaaggatcatctatttcatctccaaaatatagcctgataacccccatgttggttcctgtccacctggaagtctatgatatagtttctctactttgattcttactcccttcaagatggccagtgtgaactgttaaaaatgcctatcaacgtgtgttactccactccttaaacttagttgcttctcagtgcatttcaaatacaactataccgccttaagatgcctctctctcattttcccattttcctgttgtttttttctcttttaaatcttttaatcaagcagacataaaattatcatgtttatcaattcattatattagtttacaccctcctccagaatgtaaacttcatgaatgtggggaccctgtttgttcagttcaccactgtctgtctgtatccctagtgcctacaacagtggatatagtgagtactaagtaagtgtttgttggttgaatgaataaaatgattacatgagtaggaatggaataacatctgtggtatgcatttatcaattcccacaaagaaattagtaatttaaagctaggttaaagctgtttagctattatcataactttttgttcctaagagtttaagtgggttagggcctgatttgattagactacatcaaggtagaagtttttcattataattcctcttgatttttattggcaatataaaattcagaaatgaggataaaacagataatttgaaacttatatggatagtcatttttctataaaagttccattatcattacagtttaactgttaaacatttaagtattaagtaacagttcgtattttattattattattattatcattatagataggtagatagctggaataaagatcctacatcacccagatcctgcccccatcccctagagaagacagtgcaaggcgcttggttgacatttttactgaaacagctaaaacccttcattgcctaaaaccaacgctttccttacatccatcctgaagatcaaacctgaatctctttttatcagtgctaaggaggggccactaagagcataactacccaaagtggagaggtcccagtggagatttatttaaaactttccccagaaggccccacctctggaaatgaccattcagaatagtaacatttgttctctttggaggaagaggaagagtttgaggattggtgaagagaaactgttagttcctgttggaggccagcatactctgaagatatcattatttagatatcttgcccatttttaatgcagcagagtactagcaattttttctttcttatagaattacttttatccaggtcagtcactgtagttcctgaaatgatgattggtgtatctggaagatactcaggagtgattcatgggatgattttatttccctttcattcatttagccatgacacactgaggtcatcttaaagtagcagattgttatcttcatctagcaaaaacagatagattttaattgttataaaatgtgaattgcacataaagtagatcttcctcagatcccttctaaaatatatatatatacttactaaaaaatgaaaagaatgtcattattagatgattactccaaaggtctgtcccatggtgtaggatttagaaatggtgttatacgaagaccccaaaataaaatatttgtcaaggcttgcatttcattgataccaactgatgaattttctgctggaataatagtaatcactgtagaaatccaagtaccactacttctaaagtattcttaatatgagaaagaaatgcagaattcttaatcgttgctatttttttcttttctgctcttctttaggtattctaatctgattttgaacttgttttccttgatggttgatgcaaacattccagatattgcacttgaaccagataaaactgtgaaaaaggtaatttttaagtaacataaatgaagagctcttctgtataatttttccatattccagaatacaacaacctctcaagtctctgcagccagttttatccccttccttgttcctgcccacagtcacatgaataggttctctcatctggagagacagtttgcttgctactccagccctgcagtcacagggaggaggaagcagcagcccaaagcttaaagaactgagcagagttttcagctattgtccatcatagggaggatttattttaaaattgaatttagccaagttaactgccagctacaatgaatcttcacaagaacacaacagaattcatagtctctctaacatatcatttggaatgtctattatctctcttttttttaataactagatgtgtgaataaacagaaaatgtgacactaagccaatgaaaaaataaaacaatccgtagaaacaccctgagatgacccatgaccgcagaaaaggactttaaagcagctgttacaaatgtccatgcacctaagggaaaataaatgcataattactgaacagataggactatcaatagagacattaaaactaggaaggaagaacaaaatgaaaattatggaactgaaagtacagtagctaaaatgaaatattaattgggtaggcttaacagcagattgagttatggcattagaagtcagtaaacttaaagataaatcaatagaaattatttaatttacttccacagcttcactgcctgtggaggaacaggaacgatgtcaatcattggcaaaataaactaaactagatcttctcatatgtctccattcctatagaatttccctgtatccctgtaaaggactacctcaatagatctgtagtttccaaagatggggatttttttttagttcatatttaaagttgtggttaatttacaatagccttaagtattagaacaattagtgtatgtgttaagaatcttaagaacctagaggacagcctaacataagtcagtaaatctgataccaaataactatttatatacagttaaccctttggtataaaagagaatattttcatatttggtaaataacatttttatgccaagtgtataccttctctttgtaattcaggcacttatgtaagtatgcaagctttgataaattgggctaaagtttattttgattctcctgctctgtagattttttatttccttaaaaatagttccaaaattgtcagatattctctctgtaagtagaagttaaggaaatcaaaagatcgaacttaaggaatatgtttgtcattatctgggatgcagacatgagagagctagttcattgaagatacagccttagatgttcctccaccaaattgttcttgtcttcacttcttacatttacctctcttttacctcctgctatcttgtggctcaagcactctcagatcacctggtatacctccagtacagtgaagagacaagggcactgagctggggctatggattgttgcactgtttgtcatttcttctttgtagctttctagtagtgaaaccctatacttcaaacactaaatggggaccacactttatccacttggaatccccattttctcctagcctgtctttgagaagtatatgtgggttatttacaagagaaaggagtagtctgtaatggttgtgtgtggtggcgtaggattgtctggaagcatgtgccagttaagggttcttgagccggcttcgtgaattctctgtgcctcaatttctgcatattatcgatgagatattatctactgtatgtttgcgtatcagtcggatgaaatgttgcatgtataatatttggcatggcattttgcacaaagtagttcttcagtaacattgacttttatatatatataaaatatacgcacataaatatacatactagtttttctagtacttaatgctactgaaaatcaagtgtagctttaaataagactaaaaaaattattttatctttggaaacgatagacctattgatgtagttttgtgtggggatgtagggaaattcaataggaaaggaaaccttagaagatcacatttagtttgtcagtgattgacattgttcctgttctcatatagacactgaaggtatgggagaatattaatataatctcaccttgcttcatccaattcacaaggaataacaggaataaagtggattattaataaacattccacaatttaaatcatatatagtaactctagattttagattaaaaaaaaaggcacacctttagttaaaagagcagtttttctgtttttgagatgtagggccctaagaaatatttcttcttttcttttttcttaaaaactgtttacaaccaacaagaacaaggtgatatacagagcatataacaaaaacagcaaacttccacactccaaagaatgccattcagaattctaataagttacaggtcatttatttgccataggaatagctcatgttaccttataatgtctgcatcagtttgattctgcctgttcaaaatgtgccctatttttcttcgttgtaaagactaagagtgttatcttataggttcaggataaattccgcttagacctgtcggatgaagaggctgtgcattacatgcagagtctgattgatgagagtgtccatgctctttttgctgcagtggtggaacagattcacaagtttgcccaggtaagttccctgagtgcagtgcatttttctcaccttctccgtgtactgccccagagtccttggagagccatgcatttctcctgccagttgacatcttttctgtttttctatcaagtcgttttgacatctcaccagccagctgaagtgaattgtgtttcacacgttactaattccaaaacatctgcttttcttagtaatgactaacttctggagcaccagcataggtatttttgttctttgcagtcagtggtgattatacgtcctcttgagaatgattttggatccagcagaggccttagcaattgaaacttggacacttgttgggttttggtgaatgatgaagtgctgggaaagtttagaagctaagaaaagcaatccacatcacacaccagaaaggtctatccatagacttactattagcagtatccacagataagtgagggattacccctttatggtaaacttcagatttaaaacccattttaattatgaattgcataataaggatgactatgaaaatggttagcaaacggaaaaattaggctgcttttttcttctatgccctcacctctcctgtgaactccttcctggtgttacacattcacttaatgattttcctaatcatccaagcttaaagcttgtctgctttgaattttccctcagccagtgaccagtatctcaccaagccgtgtttgtttctttaacctttttaacccagtttttttaaactttatgatacctaggtgtgtgcagtttcctcattgcctaacagcgaagtcaaatctctggcaacttaaggccttctagaatattgtgttctatgctgcttttcaagctgttgtgtaatactctctttctctaaatattttgttgtctttcatcatagtggacaactttgctgctgtcatttcttcagcccagaaatcaatcttcttaataatgtatcttctgtaaacttctacatggcaaaatccaacctgtcctccaagagctcttaatgctctttgattgatctttctctaaatttctgtatgttttctacctttattacgacttgcacttatgttttgctttctttttttccttccccccacctcccacttttcccacattagctgatgttttgctttttattatagatatttagattcccggggccaggcgcggtggctcacgcctgtaatcccagcactttgggaggccaaggagggtgtatcacgagatcaggagatcgagaccatcctgactaacacagtgaaaccctgtctctactaaaaatacaaaaaattagccaggtgtgatggcgggcgcctgtagtcccagctactcaggaggctgaggcaggagaatggcatgaacctgggaggcggaggttgcggtgagctgagattgtgccactgtactccagcctgggcaacagagcgagactccgtctcaaaaaaaaaaaaaaaaaaagaaatagatatttagattccgttataactcttcaaatacagacttcctgaaggctgggctttgtctatcagtcacctagtagtgcaatgccttatatacttaaaaaatatttaatgaacataaaggaattcctgcctctagatgttagcttatactctttttctagctcaataaaaaggtgtttttccctgaacaccagtcttgatcatatttttattacaagggctgcctcagggtctgcttcatgggtcattaattgtaaccaatcatttgttgagaataaattgtgattcaaatagtatgtgactcatcaaagtcaaccagctagctaaaggtggaccttgctctacatatagcagaacagaatattttagaggtatagggggaaaaaggccagagagatatcatgaccacttgacatctgtgacaaacaagggacaaaaccaagacttaaacccaaatattttgactcccatatttagtattttttaaaccagatcttttcagtgtcttgctcatcactatactacattagtgtcaatcaaacttttcctggccacggcccatctctgtgtgtgtacaccttatttttttctttttttaagctcaactagttaaaacatgcttgaagtcagaaactcttaacttctgtgtctttgcatttctgtagcaggggatttacccgttgtagttggtcatttatattttatcttactccatctctatctacaagtgtagaaatatctctccatcatgggttttccttattccatacttgtagattctggtttttctcctttgttttcctggagaatgatataatggagctaaaactccaaacttgaaattagtgctgctgcctaacactgatttcagtaatctatagctacacaagcatctccagacttagtagctgaaaaagcaataatgatttgttatttcttacttaggatgcttcagtcaggaatttagctagagcccagctatgaggtttttttgtttgctgtaatgttagctggcttcactccttcagctgtattcgactggtagttgggtttgtcttggaggtccagcaaagcttcactcaataggtctggcacttaggtgttctctgcatggactatctctctccacttcctctgtcatcatttcagactcctgcccaaactgctgctctacagcatggtgactgatttccccaagaggatatgaaggcagacgtggcagtcctcttaaaataagtcccaagagcagcccagattcacagagagaaaaaatagattctgcctcttgacaggaggagagagttgcatatgcagaaaagagaggaattaagtagcatttttgaagatttcactgccactcagctaatgtgctccagcttaaagttgagccttcaagttctgtaaaatgaattagtggcatgctttattttagtggtctagttttgaaattctattgttaatttgcataagatgcccattttgcttgctggatctaaaaatagaagggccatttttcttaattctctttattaaaaatggaggagaaaaagaggttgataaaaagtagtagtttttagggggccatagtattatttaggggagctagtaatagaaggactttggtttaccaaagtctctgggcctcagttttcacacctataaagtgattgacattgaggttaaaacatctgtttttgatataaatttaatataatgtcaaaggttaattgctttataaagctaatgttgactactgcaagggttggtaaatgaaatctgcctctcccctctccccatcttagggatggttacattgtgaaagttgctgagagctctttgagttattggcgtgtacctattcttctattcatagagaaaataaaatatgaatggcaaaacgaattggtaaaattgcagtgggcatgctcttaaattagggagggatcattttatacacattaacagattattataattcttgagaagaaacattaagtctgtttcctaggttcctgttttctagttcttcattacaatagtagatacgatgtagaaatcctgtaattaacattactttagccttggttgttacaggctcttttggactaggatagattgttgataaccttgataatcaaagttactgccacatgaaaataagagttaagaacaaatatttgaattattctaacagtctaaggatcaccatcttagatttgtaaaactggaggtttattgcagcatgaatatgtagatgaactttttaaatatcatttcttagctctccagtttacagtgatggacagtgtttgggacaataacagcttcaacatttattggaatgtatttcatacaatgcttcccatttttaattaaataaccattactgtgataatacaagtatgttttagtgttatccctattttatagatgagaaaactgaaccacataaaaagttgttttcagcctggctcagtggctcatgcctgtaatcccagcactttgcaaggccaaggcaggcgaatcacatgaggtcaggagtttgacaccagcctgaccaacatggtgaaaccctgtctctactaaaaatacaaaaattagccagacgtggtggcgggcacctgtaatcccagctagtcgggaggctgaggcaggagaatcacttgaacccaggaggcagaggttgcagtgagccaagatcactccactgccctccagcctgggcaacagagtgagattctgtctcaaaaaaaaaaaaaaaattaataaaataaaagaaaacttagttagttgttctaacttatcagacagattcagttcttttttaccagaatttcatactctttatcctaagggatgaacttaaaaatgtttgtgatatttcttagatttccttaaatatataatttgtgctccaaaataagggttacctatggatgtttaattttactggaacttgtttaggcactgaagcatacatgggatgctaaataaggtcttagcttcatacaaatcttttcaaataacaattataaaagcatagttgtttcttaattgatctctggagtttattttctctttgaaactcacttgtctacatatattgtctaagtattgatactaataaatcacataggcattcaaattcagatgactggcatctatttttttgtcacttgtagtcatctattataatgatgcaatattgttaatcgatttatggtaattttagtacattcccattaatcattgtggatagtagaaccaactttttaaaaaatgggagtagattaatacatgcttaaagaattacagatatttcagcataaaagaaacaacattcaaaaagaagactaagagttactagatacaactattatatccaaatgctacaaaagcttgttttctttcatcatgcaattccttaggaagggtagagattaaacactgcaatatttgtttcctagcaacacccacatattagtgatacaaattttccactggaaaacaattttattttggtcattgtctttgaaattgcatcattgtaacccttctctatgccaaaatgatcttttttggcatcttgttctgtcgccccccactggagtgcagtggtacaataatggttcactgcagccttgacctcctgggcttgagtgatcctcctgcctcagcctccctggtagctaggagtacaggcatgcaccaccatacccagctaatttttaatttatttttttgtagagatgaggtccgactatgttgcccaagcggttctcaaactcctggcctcaagcaatcctcctgcctcggccttttgagtgctgggattacaagcacgagccaccatgtctggccttgaagtgatctttacagtgctttcgagggttgtatacgtgggaaagatagaggtcatatagtttgggtcatgtacagttgcacaagtaggcctttcactggtgatctcttacactgcagtccatttcctgtttctgcttctccctgtcatcctttcttttcatttatggtagtaaaaatcttgagaaaggggtgtgttttccagtaatgttaatacatactaaatctaattaattaaatcttggcagattaactagagacagaggtttttgtttttcagaatgactgtaaaaaaataaataaccaatagattgggttcagaaggttcagaagttccagctcaagatactaggaacatagcactgctgtccatttaaagggaatccttactcatcacttgcagtgttcaaggaggaaaagcacacgtctaggcagagagacacctgattctatagtcacttattcttaagttagagaccagttgcctttagcttaagggaattcaactgtgatatatttgggtggatttcaaaacaaaagaaacaaaaaaaatggaaggaggaaaatggtgtggttattctgcttgaatttcccctaaagaatacctgtcctctaaggaatgtgacagtggctctctcaaaagtgtttcagttatcaagtgcctctcatgcataacatggcatcttactacgctgaaggtgatcccaaaattgaaaattctgagtgtttggtatttatatcacagtttctaagtgcaaaccagttgctgcttaaccagagaaacagggttttcttgtgtcattgctgagggaaaagcttctgattttggactttttaagagatacatgtctcttatgtgctgcctcctcaagggcttttcttgagtaatttttttttttttaatttgtattcctgtttttcctttctatgttgactttagcacctaaacccagtgtagagtgatttcactttatttgctgtcctctttcatcttctttaagaaggcaaccttctaggtcagtgagtgagtctcttggttttcagaattgggaactaagaccattcaagcccatttctccttgtatttctctaggtaaagtacaagcattttctgtgttcagagtatgtataaaaacatttaccttaggtttatgtgtatattcacagcacctttgacagttaagagatcagtacttgtgctggtgttaactcttccattttttagttacttgaaagtcgctctttcctgggtcagtggaattttgtttttgtttttaagcttttgaatagtaaatgtaacaatagtaaatgtttagatatacttacaaccctagtctgttagtcttaaatataccataatgtgttttcatttgatgaactttgtttgaaatttgatcttacatgatacattagcaaagctagttctgttttaggaccatacatagctaatactctttttggaaaaggagaactatcacacacaggaatttttgtttatgttttttttctttaatttatttaaagtccttactcccagacttgtagtataattttgggtcttgatttcaggtgaacagataagtagaaaataaactatatcttaattctttaatgagaatgtactctcctttaacaaacatgtaattggctttaataataaaaatgttgataaaactctaattcatgaatttattatttcctgctgtaaatattaagtggcatttagtatttagttgtgaaaccgatacataagtatgtagctgcaaaacaaactattgcaggtttaaagcattactagtactcgtatgttaaatataagtacagatctttttatatgtgtgttttgtttttatagcattactttattcatactaactttccattttttttcttttggtgacccacttttgcctcatattctctctttgtactttttgaaacttccctttttatgtaaattgaccactaacactgaattccgttttgcaaattgaagctctttaccctttcatgttccctcatacgtgccagactagagaacatgggatgctctctagttttaaattgtgttttacttaagtacctactcatacttcccatgaggttgaaagccgtgtagccttgagtactcaaatagccatgtacaaaggtaaaaagttcatatcactcagtatatgtaattcatatagtctccctttatatttagttcttcttattttaccactttaaacaagtgtgactctttttataataactaaaatttgtttggaacatcaggttttatcctactttatggatgcaaaattgtgacctaaaaagaagagaaaaatcatcatttctgagtttccatttttagggacctaattttatcattaggaatgaagaatagcagtgtaaaatatttcagtgaacaaaacaaaaagtattgatttgggggtcaaatagaaatccttttaatctaaaacaaattatttttaatttagtaattaattttctaaagaatgagatgattcccttaccagtggcttaagtaaataatgtaacaccaatatatcacacacagctttttttcattctgtctcccagatctaatttatttgaatttttcttggcagaaataacaacaacaggaaaaatcattaatagcaaagtattgaacatttaaatgtgccaggaattatgtaaagttctttctctgtatcaactcttaattctcacacctgtgaagtaagtgtactacaagttatgtatttacagatgagaaaactaaggttaatagatgacaaagcccagattcaaactcaaaatattttgagtcccagatctagtcctatatttataagtaataatatgtatataaatacataatatacatttatatatatgtatttttatataaatgtttatatataagatatttagtaactagtgactatttccagtcaccagctgcattagcccttaccaagaaagtcagcctgtcctttgaagccagactttgacttctctgtagcatgaaagtcctctgtggcatcttattccattagaaagctgtttcatctgcactgaaaatctgttctctagtgtagtcaccttcatcagtgatcttagctagattgtagataacccgtgtgcagttcttccatcagtactgaaaatctgttctctagtgtagtcaccttcatcagtgatcttagctagatggtagataacccgtgtgcagtttctccatcagcactggctgctttaccttgcatatatatatatatatatatatatatatatatgcgcatatatatatatatatatgcgcatatatatatatatgcacatatatatatatgcacatatatatatgcacacatatatatatgcacatatatatatgcatatatatattacatattcatacacatacacacatacatacatatatcaaagtcttaatttagagacctgaatagcttttgttgtgagtagtgagtttttaaaattttacttgtaaatttaaattatcttttaacttttcttaatctttcacctacccatcaaagaaaaaaacgttagctgtgtaaacagacaagtaagtgtgatatataaaggagtcgccaggagctgttaatccaagataaataggataaatgtgggataacatttattttgcacattggccaaaactagtcttgaatttcattgacccacctgtgctctcttgttccactgcagtcagcattgctgcacaactacccattaaaacacatgatatttaaaaaacaaagaatacaggcacttgctatatgacaaatgtttgcagcttgtaagattagttaattattgtaatagcaagagtcagcagaatgccccataattttcagcccaaatgccttgcagtttatttctcattcatacaaatttaattttcttatcttctccaaagaagatttttaaacacttgaatgtcatccttgatagggtttgccatgtttgcttcattaactgcttttagtaaggttagttttatactgttgttttctttccctctgtgttctgtcaaaaccttttataaaaattcttcaaatgtacagtagttgaatattttgggactgtctctgctatatgttttttatttttatttttttcctaaagacacagacatttcaaagtatttgggaaaaagaaggcataccttaaagattttttgatctgaagtccagaccactgcaataaatgacttttttgttttcccagtgcatataaaagttatgtttacatgatactatgcagtagcattatgtctttaaaaactatgtgcctatcttaaaaatattgctaaaaaatgcttaacaatcatctgagctttcagtgagttgtaatctttttgctggtggagggtcttgccttgatgttgatagctgctgatcagggtggtggttgctaaaggttgagtagttgtaaatctgtgaagtttgccacatcagttgattcttcctttcacaaaagatctctctgtagcatgtgatgctgtttgatagcattttgcccagagtagaactttttgcagaattggagtcaaccctttcaaaacttgctgttgctttatcaactaaatttatggaatattctaaatcctttgttgtcatttcaacaatgttcaaagcatcttcaccatgaattgattccatctcaagaaaccactttgcttatccagaaggaggaactcctcatctgctcaagttttatcatgagactgcagcaattcagtcacatattcaggctccacttctaattcttgttctcttgtagtttccaccacatctgcaattacttcctctactgaactcttgaacccctcaaagtcatccatgaagaatggaatcaacttcttccgaactcctattaatgttgatattttcacctcctcctatgaatctcaaatgttctcaatggcatctagaatggtgaatcctttccagtaggttttcaatttgttttgctgagatccatcagaggaattactatctgtggcagctatagccttacgaaatgtatttcttaaataataggacttgaaagtagagtaactccatgatccatgggctgtagaatggatgttgaattagcaggcattaaaacaacattaatcttttggtatattccatcagagctcttggatgactgggtacattgtcaatgaacaatattttgaatctttttttctgagcagtaggcttcaacagtgggcttaaaattttcagtaaaccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactctgtctcaaaaaaaaaaaaaaaaaaaaaaaaaattttcagtaaaccatattataaacaaatatgatatcatccaagctactgtttcatttgtagatcaaaggcagagtagatttaacataattcttaggggccctaggattttcagagtggtaaatgaacattgacatcaactaagtcaccagctgcattagcccctaccaagaaagtcagcctgttttgaagctttgaatccagacattgacttccctgtagcgtgaaagtcctatgtggcatcttattcattagaagcctgtttcatctgcattgaaaacctgttacttagtcaccttcatcaatgatcttagctaaatggtagataacttgtgtgcagtttctttatcagcactggctgctttaccttgcacttctatgttatggagatagcttctttctttaaacctcatcaaccaacctctgctacctttagacttctcttctgcaacttcctcatctttctcagcctttatagaattgaagacagttaaggccttgctctgcattaggctttggcttatggggatgttgtagctggtttgggcttctatccagaccacaaaaacttcctccatatcagcaataaagctgttttgctctcatcattcgtgtattcactagagtagcattttaatttccttcaagaacatttctttgcatttaaaacttggctctttgatgcgagagtcttaacttttggcctatctgagcttttgatatgcctttctcactaggcttaatcatttctaggttttaatataaagccagagatatgcgactcttccctttcacttgatcacctagaggccctgatagcgttcttaattggcctaatttccatattgttgtgtcttagggaggcttaaagagaagaagagagataggggaatggccagttggtggagtagtcagaacacatgtaatatttatcaattaagtttgccatcttatgcagacacggttcgtggtgccccaaaacatttacaatagtgataacgaagatcgctgatcatagatcaccatagcaggtggaatagtaatgaaaaattttgaaatattatgagaattaccaaactatgacacagagacacaaagtgaacataagctgttggaaaaaatggctctgatagacttgcgcaagcagagttgccacaggctttcaatttgttaaaaaaaaacaaaacaaaacagtatctgtgaggtgcagtaaagctaagcacaataaaacaaggtatgctggtatattagagacctttggttcaatagcaacatttttgtcatacatagacgcatacacgtgtacatatgcagtttttcattgcgtccaaattacttccaagttatttagactccctcgtatgttagtgtagaccctttgcagtttggcttttacctgcactttcaacccttatcatcttcaaaagccttcaaaaagaaccttctttgtagctctgttgattcaccgccgctacctccaggcaacacacctcttctctttgcatggaatgagttccctcttatttccccaacttttgagtgtgtgtgtgtgtgtgtgtgtgtgtgtgtgtgtgtgtatgtaagagagagagtgtgtgtgtgtgtgtgtgtgtgtgtgtgtatgattctgtctatattaatttggtcctcgggcattttgtcttaatttgagatctcccacagaatctgagacacttcctggcacatagtaggcaccaaataaacatatgtggttttatatgagtgccgagtaccatttctttaggaagtttattttctctgataattgcctttagtaaaaatatttaaattgcttcttaaattctaaattacattatttttattcacatgaaaaataaatcttgccaatttttttctagagtgacactttaaaatgtgtcagattaaaagccatcaacatcttggcatttttcacatttgtacatgtacacatgcatgtgcacacacacacagacacacttgtcagcaaggtgttttgccttcactttttctctgagtaataatgaagtgaaggtcttagaaacagaattcatgtaagcagcattcataattcctccaagagaatgccagtatatttgtatcaaacaaaaagggcacgagttatggatgactcagtgtatattcagccaaacaaagaaatcttcgttgattttattcctactggggatatctcagtattgaacaccattaatagtgttggccccaaaacagctcttcactaggcctctcgacttcttcctttgatttgatttccagaccatttctggaatgaagtagttgcactctctgggataagctacaggttttcacagcctctcaaaatgtggcaccaagaaccaagcacactactcaaaatcactttatctaaatcactttagaattcagtggaatttttgccttcctagtgctggatgagatgatttttgcttgtctcgtgttaattacattcatcttgagcttacagtcagcagacaccctctccttgaattattttctcatataaactgatttttaagtgaagcctcaggaatcctatacagtatagttaattgcaatcctcttggtagcatttagcaaactaattaatgcactttttattttattagtagtcttttttaaaactatagactattgtttatctttgtgaataattaagtaaattattttctgtttatttctttttaatttttgtagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaacattcttatttatgtacatgttatgagagttctggaggaagtaatatgttgaaatagtaaaacattttagtttttgagtttaa

SEQ ID NO: 777 - DNA, 270203 bp, Homo sapiens
atgcgtggccgtggcggggggcgcgcccgctgtcctgcgcccctgcgctcgctgctgggcgccttcggggcccgggacgctgccgccgccgcccgagatcctgcgcaaggtaagcgcgcgctgcggggaggggacgcgggacgtggggcccggggtgcccgccgggcacgaggcgctgggggacgactcctcctgaatcccttgcccttggccgttgcgggtggccgggaggcccgctgcgcccccagccacagaggtgggcgccccgggtctcgggcttaccgcccccctcctccccctcgcagcaaagtcaccagagtctctccctaaacaagggcagtgtccgcagggtcagaagcgctggcgttggggtcgacagtctggggtttggaattcccctctgcccgctgtatgagcctgtgcgcatggcgtttgaccttgctgcgcctcagtttctgcatctgtgaaatgggggatacctgtgtcttgggggcagcagttgggatcgtatggacagcgctggccacccaagggagggctctgtgcttgatcgcccttcttccccagggagggccatgggcctccacccacgtgggactggcccctcgccccctgctgggcagacacctgaccctggagagggtccagctgcagttcaagggatgggatctaggaagaggggcctgaggaatccagaaaatggccagggccccagctgggccagggaagaggagttgaggacggggagtggcctcaggcctcctggtgacaaggctagagttttgcctgtgctcagtggccatgggtgcatgagtaccaggtgtccagcaggcagagcccggagtggggtggaggagagctaggccagtgtttccgcactggcccttggtgaggataccgggggcacttattacagattgttccaggggccccacccaggcctgccccttgcaatctcctgggagaatctgtgtttttaaccaaagcaccaggaaactctggtttagatccatccgtggttcttttcagtgcctcgaaacgggttgatcctgccttcccttgaagacatttctggttgtcacacctgggggaacgccactggcacccagtgggcagaagccggggacactgctaagcatcccgcactgccaggagccctccttccccacgaggcggtcatggtgtagtccacaggctagtgctggggttgggaaaccctgagatacagggatacatggagtcacaaagtcaagaaaggaggacatggggatttgggggacacttgagagcccgctatctgccaggccttctgtggtgcccttggaggagaagctcgtggcagaagctgagctcaggcacagaggatgggcagctgaatccactcatcaggaatattgagcccctactgagcgccagtcccagtgctgagctcccagggtggagtcgggagagggagatgaggcccctctagggtgctcccctctaatggggcagaagcccctcccccagtgcctgcacagagtaagtgcccacaagtgtcagtgccctcccctaaagcacccctgtttttggcagtgcatgagtactaagaacagtggggcatattctgggttggattttgggaaagggcgttcccagtcctaaccttcggcagcttggcagtgtgttcagggccaccaggagcccatgttctgcctgcagtaattacgcaactcctcacctgttccttgtgctcctcagtcgctgggcatttttaaaatagttctgcggcctctgtctaggccttgatggatggatggcagggctcagccactgctgacccactttccccaaggagaaagcggaatattttgtcagtgggtcagcaaatgattattcatcattgaaaatgcttcaggcactgatctagatgctgggatgctgcggggagcagggaggccctgaggtgagaattcacttgatggcactggggaataggagggtccttgaggctggaagcccatcagctaggggactggagggagctgagtttggggaggtggcccatgggccttggcctccatcagaagtccctaggggttctacatgtgcaacccgaggccaatggcaggttctaggctgaagaattgcatgtccctctgtgtctgagagaaagctcctcatggctgctgtgtggccgcaggtttatttggaggctatggcagcagagttgccagctgcttggaggacaggagggtccatcagagacggagaaagtgggaagcactgggggctgataggacctgctcatgacttgggtaccccaaatccaggatgccctgtaggtttggggtctgagcactgggtggatggtggtgctgtttatgggggtgtggaaggcttggtcggggaggagggagactggccggaggcttctgcagtgcattccttcactttccgtgggagaggggaggtctgggagaggaagcgcgcattccgtgctgaccatggtgatttggaggggctgtttacactgggccattgcacgtctgagtctggagcttggggcggtggttgttctggaggctccaatctgagattcatcagaatggggctggcacttaaaggaggtcacttgggagggggctgaggcagagagtgtggctgggtttcttggtttcaatgttgcatttcaatgttgagtcagataggaccccagtgcaaatgccaagttttgggttggagcaagggtcccggcacccaaggaagaaccaggctgtgtgcccacaactctttgggcactgtgatgccagacctcaagaaggtccctttgacttcattccttttggaaccaggaggatctgtccagctgccacctgaagctcagcttccatgatttgtgtggctacttcccggagcttgcttgggaatcttaactctcacccttaaagggataatgtgctatttctggggccagggctgcattaatttaggaacaaattaaccactcattcttccagacttcgaagtctgatttcgaagtgctgactcgtagtgggttatttctgcactaaatgagttttttttttttcctttaaaatttttgtttgaagggaaaggcgtgatcaatgatatcatgacatgtcccagctgatgctcattaaaagttgtggctttaggggctgcaaaagacagtttgaaatttaatgccttgtttcctggctcagctcagagtcggggctgggcaaggctccctggaggctataactctgaagacccagattgggtctggagttgcccaattcttttgaaatcttaatgacaaccagctggacttagcaggcttttctggtagcaagtgactgaaatggactagacacacagaagcaaaagggccatctgttaattcaggaaactgggcgtctgtagctccagctagcctctccttgtctgtcccagactcagggtgggtcatatagctggcccttgaaccacttactggagtgagggagtggggaggactggacggctgagacctagctgtctcctccggtccagaaatggagctggcatccccgccatagccagcctgagacttccagtaggaaatcaggaggatcgcagaaggacatgggtactgggggtcacaaacgccagcatggcagtgcaagaaccccacagctgtgcccacctgacctgcaaaacctgccgtgcattgcaaatcacactgcagccttcagttttctttcctgtgaccaatgggtgcttggaggcaaaaggcagagtcatgatgtcccggcagctcgagaaggccctgggagaggtgtgacctggctacacatcttcgtttctctcctttccccccagggtgctcagggcacacctgtgagagccaagcacctccccacagccagtggcccctcaggtctgcttctccttcacctgctccaagcctcacatttttctcaccacttagtccaaatccccacgcagctgtcaccccattactttaaggactgctgtctgctggtgaactttgctgatgactaagttgatcgctccgtttttgtttgaagggaaaggagtgatccccaatctttagaaatggcctaggctggacgtggtggctcacgcctgtaatccaaacactatgggaggctgaggccagcagatcacgaggtcaggagatcgagaccatcctggctaacacggtgaaatcccgtctctactaaaaatgcaaaaaattagctgggagtggtggcaggtgcctgtagtcccagctacttgggaggctgaggcaggagaaaggcgtgaacccggtaggcggagcttgcagtgagacgacattgctccactgcactccagcctgggtgacaaagcgagactccgtctcaaaaaaaaaaaaaaaagtcctagcctgtagttgggactccataaatattttatgggatgaatggataatgtggtctccagctcaggggataagtttttctggaaaaaaaattactcactcaaacacatacacgtatatatttaattacactagtatgtcatgaatacatcctccaagtgagcaattgaaaacattgcaaataaggctcaaatccctctggaacatgaatcctccccccgcccgccacctttcgcccttccccagggaagccactgttaccattcatggcatttcccaccaaactttcttgacataagcatgtgctttttaaagaaatggcatcacacagcacttctcgctgtgaagctgttttcactctgcagtgtatcttggagatttatctggcttcataggttctgtctaattgctttagaatattccatggctgttttcgcctttctgctaccgatggccatggaggtccctctcagatcctgtcacaggctgtgctgcaggggacaacctgcgtgaggcactgagcacgtctgtacaagtgtttctctataaggcacatccgaagaatggaactcctggggcttaggatgagtgcattttaaatttaagctgctattgccagactgtttcccaaagtggctgtgtcactcccaacagcagtgtcggaggtacccgtttctctcgccagcacttgatacattcacattctgaaattttgccaatcctccagagaagtgaaaattacattgttcaatttgcattgccttgattgcttgagagtttttcttatgtgacttggccatttggatttcactctctgagcgttgcctcttcatttactttttgccctctttttccaggggggtcgttcgtgtgtttccgagtggtttgtgagcgccgtcgatctgatctggaacccgatcctccgctggctgcaaatattcgtgtcctgtctgttgtgtgtcttttcactttgtttatggtgtccttggttgatagaagcttttagttctgatgtggtaaaatgtatccagctttttttttgtttttgctttttgtgtcttaagaaaccctcttctgcctcgagtttagagtgaacagtttttctcagtgtggcagggagggtcctggttttagctctgaaagtcctgcatcctgagaagtcctcagccgggggcataccaggatggctgctcaaaaacacatccctctgcgtctccttttgaggcttgtatagctttttctttgcatttatttttcttatctactataacgtgtgtgaaagaacagtatgaggtagaatgcagggttttaataaggattacaggagtcactgggtttaacccagggatctgttgattctggtggggattcctagccctgagggagcagagggaggaaaggtggtctgggggtggggacagatccagtcaatttactttacccctaactgtgaagtggaccatggcttccaaaccaaaactcagagcagattttgggcaaaaattggtctgatctggtagcctacatggttttattaatacgattgacaattggctgtacatttcccaagcagggaccagctgtgtggagaaatttggatgctccttctcgcagcctggctgctttcccagggccggccccaggagggaggctccccgcgtgcccgcctacgcaagcagcctcggactgactcccaacaaccccagggtgctggctttcccggaaccctcctctgattcgggatttctaccagacttcggtagcggtttattttaaggaaaacaacaacggtacacttcccttgcataggactcctagcctgggccggggctggctgggatgaggggatgggaggaccgggggtctggcccagggtttgcgttgtgggctttgcattgggcagggggagttgccctttggaagctggtgaccttgtggcctagatgacctggagcaatgtcgattttgcgtgattacagtattttcaggaaagctacttaggtgcaccagtcaccagggacggttcacgcgtggacatgtggaaggcctttcctggagggaattcagcagctcttgggcctcacactacgaagtgggccagaccggtgggctcgctatggaaggttcctgcaccaggcattttagtgacaaactgtgggtcaaaggaaacacaagtgagcgcgtgggcaagaaggtgtcgtactggtgcccgtgtgtgcaacggggcagccctgactcagtgcctcagtgcctcagtgccttgggtggtgcccttaaggacaagtgtgtgtgaacgtgcatgagagtgtgaggatgtacatgagtgcgtgtgcctgtgtgtgcctgattgtgtgtgtgtatgcatgtgtttgtgaggccgtgcaagagtgtgtacgtgcctgtgtgtgactgtgtgtgtgagggtgtgaagctgtgatgagtgcatgtgcctgtgtgtgcgtgattgtgtgtgtgcgtgtgagggttgaggctgtgcaggagtgtgcgtgcctgtgtgtgtatgcatgtgtgtgagggtgtgaagccgtgcaggagtgtgtgtgaaggtgtgcgtgagtgtgtatatgagcaagtgtgtgcatgaatattacatgcatgagtgtgtgcatgcacaagtgtgtgcatgagtgtgtacgtgcatgagtgtatgtgtgcatgtatatatggatgcgatctccctcaacctagtgtgccagcctcagcacagccctgctctgaccagaggcttaggaggtcctccagctcccagcccctaacactccatctaagccaggcctccaccttcactccccggccttcacccgtgctgctccttctgacggaaggctcctggcctcccgtggagtgtacccatctgtcaaggcccagcagcgagacctcgtctgtgaagcctctcaccccctattccggggggatcttttccccctgtaagctcttattgtccaaatctcttcttcatataaggacaccagtcagattggattgcccagcccccaccccctcagcagcctcattttaatgtaatcacccctttaaaaaacgccttctccaaatattgcattctgagacactggggatcaaaacttcaacatatacatattagggggagtacagttcagcccctgacagcttggctgggaacgtgagcggggcctcgggtcctttccactcgggcttttgcataggcagcttgaggtggagaagtgagcaacccgagagaaacagactcaagttctgtcaccgcttatgatctggctttggacatcacagtcccacttctgccttagaatcggccttccctgactcggggtcggcatgaacccacctctcagtgggagggtgcaaagccacgttgcaagaagaacatatgaggttggaggtgatgttgtggccatttttggggaaaatcccccaaaatgtgactgcactgggagggactctcagatgcttgtgcctggtttctggcagatttcgacccaggcacgtttttctttgctgggtgtgctttgcctgctgctgctataaatcacagttgtgagtacagctacagccgagtcctgtgagtcctctagtgaatcactcaaactgggggtggtcctggggacccccagcacagtaatcaccctgttcactctcttgttaatgatccatctgctccaccaaaggtaaacccagggcagcagtgactggcgcatttttgtgtgcagggcatgcactccgtgcctggcacctagcaggtgtgctgtaagctctgtgtccaatggagagcatgatggggaggcgatggtggggaggtggggttggtggcagggaggcctcctctcctcacccgcgtgcagaggcccttgcggctcacaggagttcctttaagtactgtcgctctgacattgagcttttcacctctccctaaaggaaagccatttagcaaaaagaatctcctaatttagcaacattatctctgtcaagttacaggaagtgggcatgtggcctctttgcgtgagtctctcagcggtggaagctggctcttcctcctgaaaacatgtcgtatttttagaccgtcttgaatgatttacacaccttttctacaagcagacctggagatgggaatgcgcaggcctgcccggacatcttctccaatacccaccctatgtgttcgtgctgtcacctgacaggtgcccttggtagcccttctccatccaagcctccctccaggtggcctgccctggcctgctctgtggtcattctgcctcctggaggccggcacagacttcctgcctcctgcacattgcacatttggacctaagttcattgccactcccccagagggcaaacactaaaaatagactcttcactggatgaggtttctaatataagctaaggactgtgtctctccacttacgagtgtccgaaacagctgtatgaactgcacattctccgtcttccatgactaaatccccttaacgaccctaattcactctaattccagtaacaaggacgctccagcactggaggcttggtgcatgttcgatttctatttttattttaatggctttgctatctgtgccttttcctataatccatgacaaatcatgataaattaactccatttttttttttactgtttggttaaacattgggatgataaaaaataaggcgatattcctcttatttgtagattactgtgatttctgacctagagtattgtggtcacgggtgaaagtgcagaatattgtacactgatcatttgcgtttgcttgggagtcactgcagtgggggattggagaggagccactctgcagtcactggacagtgatagtcacaccagccaggtcctgtcctcagtcctgctcactcatctacacatctctgtgggagatgagctccacttggtgggaccccatttgacaggtgaggaaaaccgaggctgaaagggacagagtaacgtgcccaaggtcacagctgctgagccgaatttgagcctggacagtctgctggattcttggtcgttctgtgatcctgtctctcatgaacctggatttatattatatcccattggttctggaaagtgtctgacagcaggtcaatgcttgttgttactgcctgctttggaagcccttaaaagatgccccaactctggctgtccttgtggggtgcctgtcttggaaatgagcaggctgctgactgaaaagagcctttccctgtaggtgggatgtggtgccccacaggtgggaccccgtgtgccctacaggtggacactgggatggttctctccacctgtcctcatctgtggcttcttccctttgttagagtcttgagttgatgttggatatgagcgcacctttcttccgaggatcgtctaagcagggtggaggagatgcaggttgcacagaggtgggagaaggacccttggggccaggaggcagatgtggggtgtccccagctctgccccgagtcccagtgtgaccttgtacatgttcacccttctctgagcctggctttcctcgtggatggagtgtaattctgaaacccagtgttcatggctggtcaggaggatcacaggagagatgtctattgctgccagaacaatttaccaccaactcagcagctaaagcatcaccgatttattgccacacacagcctgtgggtcaggggtgcaggtgggcttacctgcttccctctctgggtctcagcagcgctgtgctgtttgccagatgctctgggagagaattcacttcctgctcgttctggtggttgtcagaattcagttccttgaggctgtaggactgaggtccctattttcttgctggctgtcagctggagctggggctggagccggggctggggctggggctggggcctgggcccgggtcattttggttctcagctgtagaggccactgccttccctggctcacgtctaccttcaaggccagcaagggtggctgaatcctctcagccttcaaatctctcctccctcccttccaccctgtccactcctgccttcccctctgcttcctgagtgattccatgaggcccatcgggtcttccaggttcatctccatatcttcaggtctcctgattataaccctgatcccagctgcaaaggccttcacattggtgcctgcattggtgcttgatcaggtcaccgggggtcgggagtcctgagggaatgaatggctctcaaattctgctgtccttactgtgggtaagtggctgagggctgcttggaggaacctcacagtaaaacagacaacctctcacttaaacagcacataaactcatatgtgaggctctgatttgtagcagtaatagtgcacaggaagttttttcatttattacagatttagctgcagggtgcttttgataaaaagacccggttgaatatagttaaaacaaatctgggatccgcccccttgctgagcatttctgtcgcccctgtcccagtccaggctgccccatctctccctgtccgatgcagcagccccgtccccctggtccctggggccatctctgctgtcgtccactttatcctctatctggcggccccaacacccttccaggagaggtcaatctgctctcagctcttcctggctgaagaccctcctgggtttcctgtttctcccaggataaaatccacgcttctactcatgctggggcaagaggccctttgagtcctgaggcctgtccccatcctcagcctcccgccatcttcccggtactgccccacccctcacccctggctgcttctcagcccctccagctgccctgtgcttgctagtcttgccctaccacctcccacccccgctccctggcctccatgcctggcacaggccctgtgctcagtgaatactggttgaatgagtggacacgtgaattaacgaatgagagactcaaatgatcaaatataaagcagggcctgtgtctcagggacactcctccagcctggcaagtctgtggtcttcaggcccgttgccgaatgaagggtctacttcccatctttgctgtgagtcccaggtttccaggggagcaggaagtgctaatgttctaatgtctgcaccttcacttccagctgctgatggccccccaggcccatccccaggaacagggaggctccctttatgccacagtgtatagactcacaggtcccccaaagtagcaattgaaaagaaccagcagggtccgtgaccgcaaactgcagcctgaagtaccagggtaatctttgttacaccccaagttgcgggacggcagagccctctgccaaatagagaagtgaatgttattctcccgtgggctttggaagacccttgcactattattaatatctcagggcgaaggccggtgagggcgccagaatttaattgcctaaataattgctttccccaaatgcgaaatcccgatggacccaccagcttcagtgtgcgcatgggttttaatgaatggtgggcgccgagagatcacagcttctgtgcaaacacggacggccgttactatttataggtttgtacaggttgattcttgggatcatcattgctacggctgcagaacgtaagatctatttttaaagcactacctataagcctagtgctatggattttctgtaatttatagctcgggctacgagactgcttttgaatggttactctgtaaagtacttaatctacagttgctgcgacggggtgctggtggcatgaatctgtgctgtggtgagtccgtaagcccagctccacggactctgctgggaaaagaaacaactctcttaagtatataaatccagtaaacataggaaacgtccacattgaactggcagaaggagaacatgtttgggtgacaaggggcattatttaaacatgaaagatcttcctttaaaagtgaaagaaaagaagtaaacactaatagtgtgcacaacagtgccaattctagaagagggtatggatttgctcttttatttattattaacattctaacgatccaagtatttcatgatctccgcctcctggcaaaaatgaaagcattttgagtagggagctcagacagccgccgtcgtggagtctaggctcttccctccgcttctgtaggcagctgtttcaccacggagggcagagatgcccagaacatccgccctgtgcttccatagtcatatgtgtctgtgggaaatatatggtactggtgagtgtgtgcactcacgtgtgcatgtgtgtgcgtgcttgtgagtgtgtgctccatgagtgattatggcattgttatgttatgtactaacccaggaaataagagctccaatgatgttagactacaaagatcttttgcagtacaaggaagccgctgagtgctattccctagtgtggatataccgtagggcagccattctgctttgagggacatttaggttgtttccacttgatcggcctcatgcataccttcctgtgtttggggtttctctggagtagatgacaagaactggatgagctgggacaggacattttctatttgggcagatgcagccagtcatcctggttgccggtttcagtcccacccagcattcgtggtgcctgtttcaccacatcttcaccagcacttggtgttagactttcaactttgcctgtttgtttgtttattcttttcttcactggggtcaggggctaaagcctggtggttaagaaggaggcctgaggggacagatccacgccagccctcctgctccctggatctgtggcctcaaggagctctactggttcctgtcttagactttttgggctacaacaacaaaatatcttagatggataatttagaaacagcagaaatttattgctcactgttctgcagcctgcgaagtccaagatcaaggggccggcagatttgctgtctggtgagtgccggttcctcagagatggttccttgctgctacatcctcacaagcaaaaggtgtgcacaggggctccctggaccctcttttataaggcacttatcattgatgagggtggggccctcatgacctaatcaccatcatctctgagcgctgcgctgtcctgtgcaggacccatgtcccatatgtggctgttgaaatttattttaatgttaaatgaactaaaatgagatgaaattaaaaattcaggtcctctgcagcatgcaccacattttaagcactctcaacacttgtggcttccatgatgggcagtgccacgtacatcatcttcattctcgtagaatattctagcgcatggtgcagcgccagggatgaggcagcctccccagcaatttgcaccagccccagcctgcccttgacagggctctggccattctcgtccctcgcacggacacatctcatcctctccgaaggcacctgctcctccctccaggctgagccatcagagtccctcccacggggccccagtgcttcagttccccacttccagtggctcccgtcagcatccacttcacaggtctccacccgggcaaggctcctcactcatctcccagctctggccttggcctccacatcttcctgagtgacaccatgcggggaacttggtgggtattttagggtacagatgaggaaactgaggcctcaggaagacagctgaggtgtttttgggtgaggtggaccagggaccgctttgtggcaccagcaactccagctcctcatcatgggggccagggcaaattcctttctttaggggattctgccttctttttcccacagtgcagtgccactgggggagatctcatggctggtctcacccgttgagacccattgagatccattgagactccatttctgcaaagctctccagacccttcgcccatggccttgggaaaactgtgaatgttaaagggccaagagtgtcaccgcagaaaccatgtggctccccgcagcagggccaaggcgtctgttactttattttgtgttgtttttctataaagtgatagatatatatggtaaaaatataaagaatacagtaggatgtaaggcaaaaatcagcttctctcgcccctcaactctccaggcctctgggtcttctctggctgctcccagagaagtgccgtggctctaagaggtcaccagtgttgcctctgaatccttctggaaagtctacataaaacttttgtgcacggcttttgaaatacacatacacacacacagacacaacattcccattctgtgtatgctcccgcacaccttgatatttctattaacagtgtatcacagcagctgctgtctatcagcctacaaatgtcttccaagcagaacccatctcagggcctttgtgtgtgctgtttcccacgcctggcatgctctttccttagagagccctgtgcctatggctgcttcccttattccactccggcctttgcaccagtatttctaaaccatgacctttctttctaagaccagtgttaggttcacagcaaaactgagaggaaggtacaggaatattccatagacccccgtcccaacatacatagctccacacattatcaacatcccccaccagagcagtacatctgttacaactgatgcacctacatggacgcaggaagatcacccacagtccctggtttacattagggtgcattcttcgtgatgtacattcactcattctttagaccaattcattcatttttttaaagacaaaatgactaaattttcagaccgatttataatgacacctacccctcattatagtatcatacagatactgccctacaaatcctctgtgctctgcctagtcattcctctcttccttctctgcaacccctggcatccactcatctttttattgtctccataattttgcctttttcaagaacagcgtagagttggaatcacacagtgtgtggccttttcagattggtttctttcactgagcaatatgcatttacatttcctccatataatttcttggctttatagttcatttttttttgtactgaataatattccaatgtctggatctaccatagtttgtttgtctactcacctgctgaaggacatcttggttgcttccaaattttgacaattatgaataaagttgctataagaatccatgtacaggtttttgtgtagacatgagttttcgacttctttgtgtaaataccaaggaaggcaatgtctggatcgtgtggtaagagaatttttagttttgtaagaaaccacaaagctgtcttccaaagtagctgcaccattttgcattctcagcagcagtgaatgtgaatgagagttcctgttgctccacattctcgtcagcatttggtattgtcagtgttctggactttggccattctgatgggtgtgcagtggtctctcattgtggtttcagtttgcatttctctaatggcataatgtttggagcatcttctcatgtactacttagcatctgtaggttattttgatgggtgatctattcaggcttttggcccattttcaaatcaaattgttcattctcttgttgttgagtttcaagagttctctgtatattttggataacagtccttttttaggtgtcttttacaaatattttctcccagtcttcagcttctcttttcaatctcttgacagtgtctgtacaaagtagacttttttttttaatgaagtccagtatatcaattatttctttcaaggatgatgccataatattgcatctaaaatgtcctcacaaaacctaaggttttctagacttttctcctgtgttatcttctaggagttttacagttttatattttacatttagttctatgatatattttgaattaatttttgtgaagggtgtaaggcttatgtctagattcagttgcttttttgcatgtggatatccacttgtttgagaacatttgttgaaaagactttcttttctccattatattgtcttggatcctttgtcaaaaatcagttgactatatttatgtggatcaattcctgagctccctattcaattccactgatttatttggctgtttttctgccagtatcacactgtcttgattaatgtagctttatagtaagtcttaaagtcgggaatgccagtcttccaactttgttcttctccttcaacagcgtgttggggatgctaggccttttgcctctccatataaaccttagattcagtttgtgaatagtcacaactgattttgactgagattgcattgaatttacgggtcaaatagagaagaactgacatcttgacaatatccatgaacatggattctctctccatttatttggttctttgatttctttcatcagagttttgtcattttcctcaaatcttatacatattttgttaggtgtatacctaggtattttatttttgggggtgacttgctcattgctggtttatagaaagagattaacttctgtgtgttatccttgtatcttgcaaccttgctataataatttattagtttcaggaggctttttggtcgagtttttttttttttattttctacatagattttcatgtcatttgtgaacaaagacagttttatttcttccttcctaatctaggtactttttatttttccttttcctgtcttatggcattagttgaacttgaacaatgttgaacagacacacaatgttgaaaacctgtctgagttttgtcagattgtgtctttcaaggagtcggttcatttcatctaggtcatcaaatttgtggacatagaattgttcagagtattctgtcattatccttttaatgttcatgggatctgcaatgtgtgttccctctttcacttctgctattagtaacttgtgtcctctcacttattttcttagttaagctggctacagacttaacaattttattgatgtttttcaaagtaccagcttttggtttcattgattttctttattgattttctattttgaatttcattgagttatgctctaattttttattaattttgtatctgcttgctttggatttaatttgctcttctttttctagtttactaaggtagaaccttagataactgattttagatctttcttcttttctaggatataccttcagtgttataaatttcactctaaacattgttctcacagcacccacgaattttgataagttgtgttttatttttgtttagtccaaaatattttaaaatttcactcgagatttcttctttgacctatgtggcacatgaggtgtgttattcaatctccacattttgagattttccagttatctttttgttactaatttctagtttaatttcactgtggcctgagagcagatattgtataatttcttttaaatttgttaatgtgccgggcgtggtggctcacacctgtaataccagcactttgggaggccgagacgggtggatcacgaggtcaggagttcgagaccagcctgtccaatatggtgaaaccccatctctactaaaaaatacaaaacttagcccggcatggtggtgcacgcctgtagtcccggcgaatcgggcggttgaggcaggagaatggcttgaacctgggaggcagaggttgcagtgagccgagattgcgccactgcactccagcctctcaaaataaaaacaaaaatagtaaataaataaataatttgttaatgtgaattttgtgtcccagaatgtggtctatcctggtgaatatttcatgtgagcttgagaagaatgggtattctactgttgttggaggaagtggtttatagatgtctgttacatccagttgattgatggtgctgttgagttcaactctgtcgttactgattttctgcttgatgggtctgttcgtttctgatagacgggtattgcggtcaccaactttaatcatgcattcatccatttttttctttgaagttctgtcaatttttacctcatgtattttgacgtctgtcattaggtgtgtacgcgttaaggattattatgtctttttggagaattgactcctttatcgttatgtaatgccctttgttgtccctggtagcttctcttgctctgaagtctgctctgcctttcttctttacttttatttttttactcttaattgtaagatacctgttgaaaagtgcacataccataaacgttcatcttgatgaattttcaccaagtgaacacacctctgtaggcagaacgcagttcaagaagcagaatataacctggatcccaaagccgcctcgtgtcctctcttaacaaaacccctcctccatgggtagctattctctgcagtctaacatcatcaagtagtgttgtctggtttttatttttctttgttttcttttttcggacagagctcactctgttgcccaggctggagtgcagtggcatgatcttggatcactgcaacctccacctcctagattcaagcgattctcctggctcagtctcccaagtaaattactacaggcacacagcatcatgcctggctaatttttgtgtgtgtatatttttagtagagacaggctttcaccatgttgaccaggctggtcttgaacttcggacctcaagagatctgtccaccttggcctcccagagtgctgggtttataggcatgagccaccatgcctggccctggtactgaaccttctgtaaatggaataagatagaacacagtcttctttaacagaatattgtgatacctacccaggtttttgtctggttaatttcactgttgtatggtatttcattttgtgaatgtagctcaatttaatgcctgctcaaattcttaggttaaaaatttcaaaaacattttattgtctgataactatctttgatttggatgagttattctgcgtgtaacacctctggacattggcatgcatagcttgtgtgtctgctcagcaaattcctctgtgtccttccaagctctgctcagcagggcggtggtgtatttttgcatctgttttgtgtactgctggattgccagtgcctggtgcatagcaggtactcaacaaatataggtcacgtgcaggcaccagtgaaaggccatttcctggagcttccctgagcttcccagcctggccagtggcttcatacactactacctctccatgctgtgatggtgttggacacggcttaccccctcaccatgcagactgggccaagccatcccgtgcctgacagcacacaggacagggcctggcatggagtcagtgtttggtgcatgtttgttgagcaaatgtctgctttgtaagccggggttgctggtagagattttggtgggttggggaggccagagggatgagctggagctggtattatggaaagaatgtaggagcccttttctgtcctgttggtaacccttgttagataccctgtctgagcctcaacttcattgtttgtaagaaagaggatgattattccaacctcacaagattataaatcaatgcatgtgaggtccttggtaagctctaggctctataaaagtgctgtcagcattaatcttgttacctcctcctcttcctttcatacttcctcctcctttatcatcatcatcaagtcagtgacttttcgggggacccaacaaaagcatgaggttcctgcctgtgtgagttggggtatatatgatgcaataacagcctgagctctggagctgaggacatgggatccagtcctggctttgcaggtttgtgacctggggcaagtacttaagaactttgcctctcattttcctcattggctaaatgggaaaatcacagttctacctgatttgggtagtttcagccttagccatggcaatcattgtaaagtttttagaacaatggctggcacatggtaagagctaagtgttaagtaaatgaaaaccctactatcagaggcctatgccagcaggatgtttggtccctttataagagatcaggagggagacaggtgcaaggtctttctctgctgttagcgtttcatcctcctgtgtgttgctgcagggtcacaggctggctgctgctgttccaggccccacaggcactccagagcaggaagcaggaatgcagtcaggactgcaaactgcacctgcaatggtgacaaatgctttttctgtaagtggctctctctgtctatcagcaatctttcccagaggccccagaagcctgttcctctcctttcattagctagagtcggagcatgcagtatctgtcactgtgtggggggacccaggatggaggaaaagtcacctggaggtctatagctttgtgctgacaacatacaagatgggtcagtggcccatgacacaagagtgcaggggccagtggggctgctttctgccttccctgtcgaaagcctccctgccccgggttgtgtttctctgctctgggttctgtcttctatctctgctgcctcatagataggcccctctcccagtcacctggatgtgctgggggcacggaaggagaatatcaaagggcaggtggtctctctcaaggaactttttgttctgctaatggtgaaagcgtattgagggcttctgtgtgctgtgtcaaatgcccacaccctgtaaggtaggttatcttcttctcacttacacacggaggctcagcggggccacacagtcagaaaatgttgggacctgatcttgtgcctgggtctgtggctcctgccctagacagcttgagtggacttgaccccaaggagggctaggcatatctccaggaagccatgggatgcccacaccacattttttcagggcgactctagctaccagtgcctttcagggcagaggccatgaatggtgaaatcagggatttggttctggaagagctgggtgtgttgtttttaaaaagccttggttggcattgcattgagcaccactctgggtagtctctggtcacagctctaggtagagagtccctcagggatgtggtcaaaggtgcaggaagtgaagttcaaggctacgtcgtcaagccaggtccaaggaccattcccacccgccactacttcaggtgttgtttttccaggtgaccagcagagggcgcggctgcccacctgacgaacctggcctgtgtcagagtggtggttttgccttcatctttccttgggtcctggaactcccacactggtgttttgccttcttgtttctctttagatggttccctatgagtttagcctgagatcgtggcttgagcagttcttcttaagcatttgaagtttgctgaatgagttatttttacattaagcatgaagaagagttccctggagccccagagaagaaactagattgtcctgggggactgaggcagcagagggagcatgagcccctcagtcccacaaagcccggagccagcttggccgtggggaggctgagccttcactcctggagcagggcagttgcctggctaggctccgccgtgcacattcattcatttattcatcaatggatatgtatgtactgggagactacgacctcccaggcacattcttgggtgaacaaacacaacaaaaatccccgtgcctgtgaagccgacattgccaccatccaggtccttggcccatcagctccccagggaacttcaaggctcccagggccttaggagagcagttggtagcataagaagacggcggaattgagctaaccgtctaagtgcccgcaagaagtagcctcaggccagtggttggtttcagtttacaaccccattgtgatgggcagcagactcttccacatcaccccaaaggctgcttgtcaaacggggctcctcctctttgctgcctcctccctccctgatctgatcctccccacccaggagatagcatcacacccaccctgttgtcagtatcagatttgctggtaacctcaattctacccccctcataaatagttaactagaaaacaaaacaaaacaaaacaaaacaaaccctggaggtatccttgacttctctctctagtcccccgtagctcatccatcacaaacctgtgggagccaccttcagagaacaccgagtccagcctgctgggtgcctctgcctattcctgctgggccaggctgctgctaccactcaccaggatgatttccagcctcctggtccatcctgctgcttcctcccttgccccacatgtcccttctctgacagcagccagaaggatgctctggagacccaccactgcctcagtggctttccaccatccttggaacaaaatcaggctcttcctgaggtccatgagatgttgcatggtctgggtcatcccctctttgtggctgcagatccttgctctggcctctttgcagggacttcagggctccatgctgctcccacctcatggtcttcgctcaggctgttccctctgcccggggcgcccttcctcccttgcatgtccagttggcttccatttgcccttgcacttccagagcatcacttcttcaaaccaggctccctctctgctccagatgaggcatgctgcactctgtactcattgaaattaattgatcctttgattcatattagtcaatcttgtcttctgtgctagacctcaagctccacaaagccaatgtgcaatcatgtctcattcatggtggtattcctggcaaagtgactgtttgggcacagaatagattcttaggaaatattggatggttggatgcatccattggtctgtacctgctttaagaatgagaccaacttgggaggtgtgtgggggtggaattggtcttggggtaccattcctcaccactccctaatgagcaggggtgcctcatacatgcgctgtgtgttggaggggttctgccatccctgagccacctttgcagtgatgtgctccctggctgcccctgggcagaggaaactgcctttgcctttgcggttttgtgagttttgaaagggacttgggcaatttggactgactctgtcccatctttgtggttcttcagggagcagtgttgggttatcggggctgccctgagtcaggaaatggctttgggttttcggatcaaggagatcaaggggcagaaggggggtccttcgatgagcttctatctgatctagaatctgggtggagacagggagggtttcagtgttgattatgcccaccagggcaagaggcagaacccaatcctccaaattcaaagctcagcctagtgcctctacatgctttttttttttttttaaagctttattgaaagaatttacatatcattaagttcacgcatttaaagtataaaattcagtggtttttagtatatttacagagttatgaaaccatcaccataatctaattttagaacattaagaacatttctagaactcaaaaaagaaacggtacccattagcagtcagcccctctcttctcccactccccatcctcggcgtccacagatctgctttctgattggatggacattgcatataactgggttcatgtggcacgtggccttctgccactggcttcttttacttgcataatgttttccaggttcatctgcatgtgattgtggcacatgtcagtacgtccctccttttcatggctgcatattatcctacagttaggatggaccacattttatttacccatttatcagtccatggacatttaggttgttcgtaattttttggccattatgaagctttgttcattccaatagggtttctgcaatggccttccaaatccaccccttgccagggatcttgttcaggagggacaattggtgactttcacaaaaacctgttgtgggccctcaaggctggaaaccctcctccaaacaggtgcctttcacacaccttggggaccagatcctcacagggctcaagccagtcatggtctggagatgaccgactttgaagtccaaagtctctccggcaggcaatttacccggagaccttattatcttctattggtcagtagaggtgggattgctaactttttttaaatttaaaactatttttagtatggaacatctcaaagccaaagaataatataaggaaaagctccagctctacctacctttaacaaaccacagtgctttgctaaaatatatacttctaagaaataaaacttggttgcatctcatcttctgcttccccactccatgtgggctcctgagctcaaatgccaagtcttatccttttatatgtttttaaccctcatccatacacagtttggtggagtaggtgaatgggtgctgctgtgtagaccatctgaagggactagggataatttttggtggtgcacggacaaggcaggaacattggcttagatagaaagttccttccattctttgtccttatggtaacattaaggaggatgtctctattcggtgcctgcctggctgaactcctctctcacccttgggccctttttaaccacacaggagacagctcaggccaagagtggactcaggtattgagttagtgccgtggtcccccccaccaatgccagccagcgaggctgtgctccatcagtcctattgaaggcttcctttaacatgcatgtcggcccggtgtggaggtgcacactgtactcccaagtactaggaaggctgaggtgggatgattgtttgagcccaggagtttgaggctgtagtgcactatgattgcccccgtgaatagccactgcactccagcctggaaaacagagcaaaactctttcaaaaaaaaaaaaaaaagagagagagagagaaaagaaaaaatatgtttaagtgcaaagagttgatttaaagacaaatcttaagggatggaaggataggttttaaatagggaaggctaaaaatcatagggatggttggcaaatgacagacagctggagacctctggtgtgatctttctcctcccccccacctatagccagtctctgggctctatcccttcctgcccatccccaccatttctgcacctgccgtggctgggtcagctgcaggcttccttccaatggaactgaactgtctcaggtgttcactcacccagactcggaaggggcccaaggcatggttgggggcaaggattcagaaaccttcccatggggccagtactcagtgtgtcaggacagcccctggggacttggagtgggaggtgttgaagacccacttggagagaccctgggccaagagcattggctgtggcccagctcttccacgtgctggcttgtaacctgggcaagagtgctcacctcttgaagttgccttcatctcaaaagtggagaccacagtagctctcacctaccagggcagttgtaggaaggaatgaggtccccatgcaaaatgctcagtccaaggctggcaggccacttcaccatccagccagcacatttttatgtggataaaacgtatctattcctagcagtttcccaccagtttcctctttgtttcctgatcttaattgccaactgtaattaaatgattatttgggcatcttattagtgtgttggtgaccattctcggcttcaccctccccctttcccggaagactcaaggagttggggcgtctctgtgtttgtgcactgctaggtccctaatgcctggtgtggtgcctggcacacactcgactctgcacacagtctgaatgaatgaatgagtcctttctttagaggtgactgatgctgctgaaataactgctgctaagagcccaaagctctgtgtggagtgaacatccactttattccccctccccaccaccaccccgctcagttctgtccttggcgcttaaccgggatttcgtccacactgccagcgctcacactgcactcccaggccctgctgtaggtgctaatctgatgggggcagccttagggagggctctgtccccagcaggaggacccttggtgagcgactctccccgcttgcccccaccccttccagcacctgcaaagggggcttagagcggggctgccccatggggttgagaaattgaaatgggggtgtcctcccccaggtgtctctgtggtccttgaatcctggtgtctgttgaaatgcctcctcctctgggcaccttccaggaccaggccaggtgacaccaccattccacccccgtctctacccctttcctggactttcttccttccctgccctggctggggaagcagcggctgcctgcctgtgttcaccccacaccaccgctggggttgtgagaatcgctccttagcaccctggaggacacctctgtgagtggcagccctggggggtgtcgcctcccttgcctggcccctcaggttcctaagggcgtctgaggaaaagcctcattggaaagcgcccgtgccctcctccctctcccccgcccccccgccccccggcagggaggagggttcggagcgagggttcggagggtccggggtgccctagcaggcccaggccaggtggttgcggggaggaagcctcaggtcgctcccctccggtgccggggtgggcgcgtcgggacccactggcctcccagtcccaggagaggaaggaccagggaaaccagctgtctgcagctgctggggaaattaggggctctcagggttccctttcctccgggaggggaggaaacgggactaggaagctttcctgtttctagagcacggcttggtggggtgggcggctcctaacccggggtccagcccctcctcccccaccccggcgcgcggtccaggtatgtgcgacccctcccagtggccacgcgccttctcacgcccctctcccgtgacgtcatgctcctctcgcgcggcatgatgggagaatcctaatgttttccaacagatgctccaagaacagctttcagattaaagcaattgcaagagcaaagattcttccttttcccttttttcctgggggggtggggggtggggtggggggagggagcgcccccagacattccaggacatcaccccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccaggtaacgggctgggcgggggcggcgggcgggtcggggaggcccgaggcaggtggcgctgagagcaggaccccgcgaggctccgcgccccgcctgcattcggggagccgcggcaggaacccgcgctcggccccgcggttcctatccccagtctcgcagggctggggcgcctcggagccctttgtccataaaagagctgatttcctgggtagagccgggcgctgcagcttcccctcctctccggctggtgagctctgccgtcccctcgaaggaggcttcctttcctcgggtgctgaccggctgggggaagagaggcagacccgtggccgcctccgcccagcgccggttctgggccattccctccctccccactgccgggccccagctccggacgtccccgcttgggcatctgctcctggaaggcagcgctccgcagctgaggccaccgcgctgagggcttccaccaggcgcctgactccagcggggcctggcgcacctgggcgcgctagcccccggacaggtgtgctgggcagagccgccggcagggagacgaagggcgtgcgccaggacagagcccggtttcgtgacagcgtgtggactccgtccactcttccacccccatggcagcgttgattgtttaggtgataaaccggtcacaaaggcgtctatagggcttgattgattactttccagagaggaagaaaggcctaataaagcggggggggaggtgggggggggggtgggctgtgtgcgcctgtcaccatggagacgcaggaagcaaagtgatcattaaaacctctctccaccagaaggcaattttcacttcacagggagaagtctgggcttctgaaatgtagggttcaaaaaaagaatcaaagctggtgttttggtatcaagccacaggactcagttttgtatcttagagaagcacaattccttcgtagattctgttttgataacaagttgcttcgcctgcctttgaagacttattctctctaaatgcaacgaccccagatggggacttgatgatgttaaatggtgggcatcagaatccctggggcccgggtgaaggctggctttgtggggagggattcctgcactggaacacaccagagcttcccgataaactgcctagaggactcattacaggcagctgtgtgggcactggatccctcccccccccatttgaaaatttaaacaataaacccgggcaagtattggaagatttctttgttaagactattgacactgtgtcacttggtcaaactaaggtaccggcctgaataaatctctgacttttctttatctgggagggcaggttaatttccttagagtttcaagcagaggctgccatggccgacccttaaggttttaattaatccttttactaggaatgggggattcagccttcagcactccatgatggattgcctttctctgggttggagaggcgcatccacaactgttccaatcatggaagttgagtggcttctcatgagaatccttctaagctccctttgtctccctggcagtaagaggaagcaaacttgaaatggaaattatggaggacttggctttttggctgtatgtgagtttatgcctctgtgggtgggagcggagggttgggcaggtggtgccggtccatgagagaaggaggaggaagggctgggatgcctgtgattaagttatgcgtgggagggcacaggcttgagctctcctctggtgcaactggtctaaatgggacccagagaacaggtgtcagaggtgaaaagtctaaaatatgtgcaattctgtgagcagtagaaccttactaaaaagcaccaagcaattaagtatttatggattgtgtgaagcagattgtgtttctgttctggcagaaagagaatcagaatcatcaagttggagggaacttgggaacttgatggaggaagggcgggctcagggagtattttctgtaagcaccttgcctggctggcctggtgtgtgcctgcatacttcttttgatggtggactcagttcttcctgatgtagtgcatacttgtctttgggcagatctgtttaagaattctttttccaatggttccaaagggtctggtacccatcagtcctgatgggatcttctcctgctgggtgttactcagggctttcagagagcctggggttttaggtattgaaacaacctcagtcacttcttggaaagtctaggcccttcacctgctcttcctagatagcctcccttatttgtccacctgctgctctaatgtgagactcctgaaaattgaacctgaagctccagctgtggaataacctcacacagagttaagaagcagagctgtctcctcccatctaaattctataatttaatgaaagagtccaaggttgcgttcaccctttcccctgcaaaggcatttttaatgcatcagtatttgcaaagactcaaagcattcttcaaaaggtgagctatgttttgacacctctttctcccattttccagaggttacccctgctgggaattgaggggcatcctttggacttttcctaatgttttatatacttgtgttgcttggaaaatggcatatgggaatgtgctggactcatggctcttccatgagtggttctgctccacactgggtctcggagatcttgcctcattgcaatatccatctccctttcccttttaacacccacacaggatgccaagaaacaatttttcagtttagccattggatatttgtattgtttccagtttttacccactacagacaacacagctgtaattacctgggcacaaactgccttgtactcacctgagaatttcctctagggtgggtgtgtgccagctcttgggatgttgaggccacaggggacccacatattttattttaatgatattgcactctcctagaaaatgtacgaattcacactttccgtaatctatgagagtgccctttctccaaacccttgccaacacctgagatcatcaatctatttttctctagcatgaagggtgacaaatggtttcttgttgtgttaatttgcagttccctgattgctagtgagcatgagtgtctttttgtggccttattagttcattaaatctcccatggccgggtctgtggccatggactgtgtggcggggatgaaatatttcccctaggcctgaccttcccgccactttcaccactgcttcgttaatgggcccgtctgtatctacacaatgtgcctctctataaatccgcactctacacccgtgagcatggttaggtgttcttccaaaatagaaatttaatcaaaggtaaggaagcatcccctgatctttcctccttcagaggagctcatggtcacaaggggttttgcttccttttcttccatctgctctcaggctctgggactaggcttctgcccgctccacatcctggggccagcccctggcatcggccccagcacgatggtggcctccttcttgtcgggtcccaggctgcctcctgggccttcctcaacatgatcccatcactgctcctcaccagccatcccctgtcccttggctgtcgctgccttgctctgtcctggctccatgcctctccagctcctttctccaactctctggctctgagctccagacctctgtgttctgcccggtccttccagtccttcagacctgttccccaccccagggaactctgatctcatttctgatttgctcctggcactcttcaacacctggggttcttgtcagtttcattctctgtggactgtcccttctagactgggagcctcttgaggacagggggcttgaccatcacctgaagtgctgcacccctgagctcagcacagagctcagatgcaggagactttcagtaagcatttgtaggacgaatgggcacaagccccaggcgctggtgtctcaacctatgtggcggtgcctggccaggcaactggccactcctgccagctggatggggccagagagtgcttggagggagagcaaagaggagccagcagctgcatccttctgcagggccgggtccaggtctgctttactgcctggagagggagaccctctcagagcatcctctcctgtcatgagctacagacggatgcacagacacattccccaggccctgggctcagggcatcccatgctggccccttcctcttttatgccactctgccagcagacaggtgtgggcttgtgctgatggccacttccttcatcacctgtgcaccctcatcacccacacaccgtcaacaccaggctctgttcttgacacctccctctcccaaggtcacaggtctgccagacacgggcctcctggagcccaccccacttgtttcaggtctcccacccccacccccaccctcacccccaccagggtttagctcctaccttccctttcctggacaacctcaacactgagtcttggttctcttcctcttaccggttttcctgcagaacaggaagtttccaaaatgcaaatgtggtctagtctctcctttgcctcaaaccctctaatgctgcccccttcctgggcgtgggagagggcggaggcaagagcctcttttgtctgtaccatggctctttctagcttccttcctcgaatgttctcttattctggagtcctgggttctgaggatctccctctggctccttgtagagtgtctacatggcttaattagtagtagaactatgcagtaattaccttgtcagcttcttcagggttattaaaaacataaaagctagatgcttaaaaaatactgagtttaagaactcagagcttttttttgattatgaaagcattgcctgttcattatagaaaatggatgctttaaaattccttttcctagctgggcatggtggtcacacctgtaatcccagcagtttgagaggcctaggtgggcagattgcttgagcccaggagtttgagaccagcctaggcaacacagtgaaaccctgtctctataaaaaatacaaaaagttagctggttgtgatggtgtgctcctgtcgtcccagctacttggggggctgagccgggaggatcgcttgagctggggaagcagaggttgcatggagctgacatcatgcctctgcactccaacctgcgtgacagaggtagaccctgtctccaaagaaacaaaattcctgttctctgcccccttctcaccctaacaccacacagaagccaatgacaatggacccctttgtctttaggatctgccaggtacctggcgaagctgtcagcattggaacaacagacatgaggaagtcaggcccaggggcaccgtccagcctcacctgccttcctcatggtcacaggaacctgttttcagtacctcacttggtactcctggagatgatctcatttgtttattagacaaacttgtttatggtctgtccaatacagtagccactaactacatgtggcaatttgaatctgaataaaataaaataaattaagattctgtttcctcagttgtagccacatttcaagtgtgcgggagccccatgcagctgtggctgccatactggatagtgcagatctagaacattccttccttgcagacagctttgttggacggtgctgcttggattgtaagctccctgagggcagggccttgcctgtggtccttttggctgtgtcaccagtgctagcactgtgctaacacttggtagttccccaatgaatgctgacagaatggatgtgccagagtgactggtgtggtcttgagctctcctgcgggaagggaccctcagcctccctagtctcatcatctcatcctctgaaagggagggtacccagcagagataatttcctatccacacagaactcatttatttcaatttagtgagctttcccagagcacctgcaatgcagcacacttggcccttgccagaagggcctctttggacaagagaacaatgagatgcaaagagattctttccctggggctaaataaatgtgtccaagtcctggctcagccatggataagctgtgtgactttgggcaagtcactttacctctctgaatctcagtttcctttaatgtaaaatggtaggcattattgtccttaagttcagaatgagtgaggataactgagctgttgtctttaacaatgagtaaattttgagacacagctttaggaggcagacacctccccaaacattctccaatccccttgaggtaattccatcttctgttaacaaagtcatggtggcagtgaccacagtgatgtatacagcagggagcgggaggaggcgcagcctgcaggtggaccccagcccttctgtgtgcctggctgagctggtcagcctctctgagttctgtgaaatgtgagttagagcaggactgatctggctaggggccaggcaggagtcatgggaccgtgtccctcagtgacgcagaacagcttcaggcaccagggccattctcagcaaatggtggaggaaggaggaggaggaggaggatgtggttcctgctctgattctggattttgggcccctggctctaaaaggctcctcccctacactttcccactctcaccttttgtggaggctgtgtctcccctacccctgcctccctctccggccccaggtccacccagcctcggatgttgttccccggctcccttcctggctccccagcttgtgaatggaaatctcctagggtcccccaccttcacaagttattccctctggtctggtaattttgggatagcacactggttgtcttgaaatgcgatttgaatgtgtattttgcggggattgttttactctgatgagtttgtttcctttgcaagtatatcttcagggaaggtgctttttaggggagggtggctgtctggaatgacacaggtgagccttgttaatgctagtcctgtcgcatggccaaagcgtgccggaggggacggtgcaggtagtgggtgtgtcctgggccctccccagagctttagccagggcagcatatatgggaggatatgaaatgtcacaggaacagaggcaaaaagaaaaagtttgaaaaaaactagtatattagtttgagaccttttcttattgaatttgagagctgggttctattccatgcactagaaaactctttaacacagggcaccaaactgcagcgtctgcagggccgggacttccgctgtgggagggtcagggtgtgtgcctgctggggcggagctgcttcttgccctgtggaaatgtgggcccaggttggtgagaccatcttcatcttttttttttttttttccaggacagtgtctcactctgtcgcccaggctggagtgcagtgacgccatctcggctcactgtgacctctgcctgcctggttcaagcaattcttgcctgctgggttcaagcaattctcctgcctcagcctcccgagtggctgggactacaggtgcgcgccaccatgcccaactaattttttctgcatttagtagagatggggattcactatgctgaccaggctggtcttgaactcttgaccttgtgatccgcccactttggcctcccaaagtgctgggattacaggcgtaagccaccgcgcctggctgaccatcctgttttaagagtgacactgggaatccagatttttatatgacatgttgtgttaggattttgtgttgctataaagaaatacctgagactgggtaatttataaagaaaagaggtttaattggctcatgcttctgagggctgtgcgggaagcgtggtgccagcatctgctcctggtcaggcctcaggaggcttccaattatggcagaaggcaaagggggagccagcacatcacacagtgagagtggaagcaagagagggatgaggaagggaggtgccaggcttttttaaacaaccagatcttttatgaactatcagaacgagaactccctcagcaccaagccattcatgaggaatccgcccccatgattcaaacacctcccacccagccccacctccaacattagggattccatttcaacatgagatttggaggggacaaatattcaaaccctatcggatatgatttttaaatattgacaagtttatctattagggattgggttgactttatgtaatagaaaacctaaataacactggcttaaagaagataaaggttttccttccaccagaagtccagacagcatgatggcgtccctgtcgtagggtgggacgttcagtgaatttcatactgaattctggttgcaacatggttgcttcacctccagcaacaagtacattttctaggcaggacaaagagggtagggagaggcacaggggtgtccacctgccgagtttgacattgccttcttgggagcactgcccagtgacacccacttatacctccttggtcttaggacatcaaaaggctactcccagctgccagggagcctgggaagtgtagctttttctttttgtttgtttgtttgtttgcttaagataggtgtattgctactctaacaagagcaggttccgcggaaggggagggtgagaatgactatcaggtagtgaactacagtctctgccatatcaactttataaaagcacaatgtgatcaaaacaaaacatgtctgggagctgcatgtggcctgtagttgccctttcaaacctcagatagaaagaatctcatgggaagactgaagcagtttttatgttttgtgccattactaagaaattaaaggttggactaagatatgtgatccaagcctaaacattatgtccattcaaattttatttaacaatatccagggaacaagataggcagggtcactgttcctcacagagccaatcatctggtcagcgatcaacggctggagtgaaaatgtgcttattgtcaactcttgttataaaaggagccatcatacttccttttattgaatagtcctctaaacccttgaggtagggccagaaagctagcgaggctgagtaaccggcccatggtcacatttatataaaggggaagcttaaagaggatcttgaatccaagtgagtctgaggcctggcccatccctatctgcaccacccagcttctgcctccctcatcctgcaacttactggaaagcggtcctctgtcctttacatggaatagatatgtgtgtttcacccccattcctggctccagccatctagctgacagacgtatacatacctgtagtcacaaaagcacacagaggcagatgtactctttcatttcccagttcatttaaccagaatggccactgggacaagatttatgtattgaaagtcaggcaaggcgatggcagagaatcagctgtctgtagagttgttgaaggtcccgtctttaatgggctgggactcgtgttcctgtttgttaaagcaagtcggttggatgggtagcttggcaacgcaccttatctaatggtcacgacatctgtagactttgacgttgattagttggcagccacgaaatggatcagccctgcactgagaagacgggagctgtggctatacgacctaagaagtgtgtttattatacatactatgctcctgtttgtaatacaacccttttaaaaagtcaccattggtcttgcaatactcttcctaatgagttgtattgttatggcattactttttggttcaattatctcttgaaagtttgtatccatatatagaaaaaattgttgccttattgtaatcactagctctggagtttcaatgaagtcaggaagatatgccaaaaatgatctttctgcttccctttggcaggaaggcattgtcttaggcagcgttactcctggggtgactctgcgtttcttgagtcacgtgagtcaaatggttgctgactttggcacgtttattggccgggttttttgtgcaaagcttctgagatctgatgacctccacggtgtcaggactgtcttgtcacctgtttttcggggatctgcctggcccctaccccacattctttattttcctgttattctctatatacaaccagagatacaggttttccatcaagagggggcctatagaagtgttctttccaatcaagcttatttacataaaaaagaacatgacttgaaaatagtaataatgtagtggtggtaatacacagaaatatgcgaagaaaccatgaaggtagtgcttggaagacacaggcatgccaaaaaccacaaagctggtgtacaggtttcagtgaaatggggaaatgctgttataaattttcatcttggtcttgtggcccggccatgattacttacctatttgctgacgcattaagcactacagtgtgcatggagcatggtgtgagggtatgcaaaggggcatcgtgcatccgggaagctcatggtctggctaggggcataacattttgacaagtaaaatgacagggcacatatgtaataagtgccaggcctctcaaacttgtccccttctgtgctgtatcccattcattctctgccaggtatcacaggcttctgcaaaagcattctccagacctccgtggccctacagcattgagctttcagtccttgggtttctgaaggttggcagggtcgaaggtccaggctggctcttctccgtgcatctcttatccttcttggacctgcagtctaaaccagccatgttagtcttgtgtagtggtgaagatacatgggacctcttagggcctaggctggaaaccttcacttatgctgattctgttagcctattggccaacttcaggtcaaagagagggaaatacacttgacccctttggttgggggagcaggaaagtcatatgtagatacaggagaggtggagaattggggccagtcttgtaatccacacattaggcttatttccctatgtagtctgtgggctcctggagtcagaatcaccttggaatctcctgccacctctgataaggtgatgccttgacattggatgccaacagacaaggtctgtggggtgcttgcagatgtgtggtctctggtgtcagactgcctgggttcactgtgtggctttggaagatctacctaacatctctgatccacagttttcccatctgcagaatgaggattactttacttatattaatacccccttagacgagcagttatgatgctgagatgagatgaattctgtaaagcgtttagcacagttcctgggacacaggaagatcctggtcaccatgagctagcattcgcctcctcctatcactgtggagaagttttcaccaaaggccatgtcttggtggataagagcaggaggttctgatctggtgcagttttgaggctcccagatgcccttgtcttcctttgggcctcaagatgcaggagggagggctttcctggtctgagctgctgggtgaaatcaggcatccctctagaacttcctcccttcaccctgtactgccctggagctggttcaggagactgctggcatgcaccgggaagctccgctcaaggcgttgccccctgatttcctagtgggggagctggcttgaggcagtcagaatactgagttgggtaaaagacccagggtcagaggctgagtctcattccagctgggacgtgaggctgtggctgcgctgagctgaccaccagcccctgggttccttagggttgcctctgggctcaggaaggaaactgcatgtagacactgagctaagggagcactagctgtttgctttggttagttctttcccctaatccttgcaagtagctggttctgctttgatgtgaaataacaaaagatttagggagaatttataatttagctcatttttttttaatgggaagggtgagttttggagcacatttaataccatgccatgtggggtaagctcagagcgttgcctgcactctcattcacctgggctggctttccccgctcgcttccccgttgggagtctaatacagcctgccttttccttaagatcattacttcaaacagtgttgacattttaatgtgattattttcctgtaatatttttccagcccttttctacttggggagtatatttgcatcctttttctttagggatttgtgttgttccagctccatcctggtctgtagaatagagctatgctcatagtaggtgcatggtaaatattgattgactcttgggtacgtgatagtgacgtctagcacccctcctcatacctattcccatgttcccataaaaaaattaaaatcgagggagaaaaacccaaaaaaaacaacaataaacaaagagttccatgatggcttcaggttaaatagtctcaccctgttggaaattcctggagcaaatgagcaagccagtgggcaggagcccgagtgtgagttctcaggaatatacatcactgaaagtgagcccacacatttgttaatgattggtctctgtgtggtgttaaaaaattaactaataacaatttattccagaggatattagtgtagagcagctattttcttataggaaaagagggattccagtcatttttttttttctgttttgttgaactgatgtttgcatcttgcctggtgaaatctttagcaaggaggaggtggaagttgttcactttagcacccaggggctcagctaacatttcgtggggctgacattctgggtgcctgtgctaggtgtggaaggagaattaagcggcttctgtccacaattgagagtctgagtagaaaaaagaggcatagctcacggcacgtgtcatttctcccttcgtccctccttccatccctccctctgtccttcttctttctccttcccttccagcaaatttagtgcctatgataatgtcaggggtgaggctgggcttggggaatagcgcagcaaaccgacctgttgcctcatcctcgtggtagatcgtctggtgagtgatgggcttggatcacatcagctcataggcgaatgccccatccagctgtggggaggctgccctggagccctgcgggcttgtggaggggttggcatatctggggatctgagggaagggtccaggggagggcacttgagttagagccaaaaggtggcttcgaattaactagcccagcaggaaagggaaaggtatgctaggccgagagattggcagtgcaaaggccaggtggtgggggcagcttcggctggagccagaggcaagagagaagcaggagtatggcgggatggggctgcaggggagctgggagccagacggttggggcctcctggactggggaggagcttgtctgccatgagggaaccatgggatgtctgaagagagggatgtgagtgtgtgtgtgcgtgagtgtgtgtgacagagaccaagagacagtgtgatcgggcacatttccaagccgtcactctggctggccaccccgggtggaaatgggtcccaggaaggcagcagagtgagaccagggaagagggtgtggcagccacagatggtggggcctgggctggggtttgcagagctcattcagaaaaggggctgggactacattgcccggaggaagatctgtgcaggagaggaggctcaatctcagcttggaagggaagggcaggagagggaagggaagggtatgtgccatgaggcacctacgtggtgtctgggcaccccatggtgcagccaaaggctcctcccaggatcctcatgcaggagccctgaaggctgtgcaagaggtgctgtctcaccctgagcagggccgagagcctgagaggtgctgtctcaccctgagcagggccgagagcctgagaggtgctgtctcaccctgagcagggccgagagcctgagaggtgctgtctcaccctgagcagggctgagagcctggaactgtttagagagagtctggggcagtgcaggatactcggagagattgcctggggtgccctaggatggactgtgttttcttctttatacatgagaagctggaaaatgggagttggacgtggattccgtgggcaaaggttcttttcctggcacagtggagcagggatgctggcaggggtggatgctcactacctcctgtgtgcttttcctactgtgagcaaatgtggaagggagaattgctatatgaagaccctccatgacccatatcctgtatagccccctcccctgagtgtggcaggaaccagtgactgtgacaggtttcgcctgcatgcctaggctatcttatatgcacaggagactttaagaaagtataagccttggtggccctgccctaatcagggaagccctaaaggggacaaaattcttcctggagattgagactggaagcacaggatggaagcgggggatgctggtttgaagatggaggggactatgtggaagggaatgtgagtgacctctaggagctgagagtggcccctgctgatggtcaacagagagatagggatcttagtgccatagctgcagggatctgactcttgctaacaccctgagtgagcacggaagtagagtttccccttgagggaagatgagaaggcaccccactgctacactgatttcagcctttcggaccccgagcagatgagaaggcacctgggctgacacaccgatttcagcctttgagaccccaagcagaggacccagtcctgccatgtcctgacttctgacttacggaactaggagctaataagtgggtgttatttgaagccagtaagcttatggttttgtgttatgcagcaatagaaaactaatacggggagggaagtttattgcttccatattacaggggaaagcctcaggttcagagaggtgaagggatcgtcctggtcacctggctaccctggcggagctgagaagcaaagctgtgtggccagactctgatgctcctgctgtgtgctgcctcggtttcctgatctgcgaaatgggctggtcatggcattgtcctgaggccgcaggaggagtggcctggaggctgtgccagctgtgaaagtgtcagggcccttgtgactgttttcaccctccctgttggcacacaggacctggaggggtgcccctccgaggccctccctggcttctcacactcaccctaaacccggtgtgtttccatggttactggtggctttactagtgtgactctcaagctggccccatagccactcctttttatgtgtatttctaatttcctttagagcatttttaaacttttcgctttgaaatattttagacatctaaaaatgtcacaaaatagtaaaaaaataactcctgcgtacctttcacctatattccccaaataacatcccacttaactacagtaagtcatcaaaaagaagaaattagctttggtacaatacaattaactcatctaccaaccttatctgaattgagtccatttttctgctaacatgcttttctatcctgtgatccacccaggatcccacgtggcacgcggccagcatgtctccttagcgtccgccaatgtggaacagttccttagtgtcttcatagcctgatgcctttgaagagtgctttcagttattttgtagactgtccctaaatgaggggttgtctgatgtttccttctttttaaatcgagtatatgcgtttttggcacaaatcccccataagcgatgtcgctggagatccctaggtcagttggaccaatcctggtgatgttgactgtggttgctcagccaggtgcctctgctctaaagttaacactttcttcctctttgtaattcgtcagcgttttgtgggaaaccttgagactgtcagacatcgtttctcatcacaccctttcccaccctgggaatcctcgcctgccagttgtcaccatggtgcgtgttcaggggtggctgtctttccgtcatttctcttaaatgtattagtgagttccattactcactaataagggaaagcttcccccacgctcccatgtatttattcacctgtttacttacactagtgtggacgcctgcatgtatgtttatcctgtggagtagagtccactgctgtcatcttcttgttgctggaactgtcccagacgtggccactgggagctccttcgagtcggtgtctgtgccagtggagtgctcccatcattgtctgagctctttcttgctttctggcagcataagacgctccaggcccccagggcctcgcctctgctgaggtgcttgctgtgcaggatttgggaaggtgctctcaggggctgtgggctcccatgcctgcttccgcctcatccttgcagacccctgtgcaggtaggttatttgtaggtgagcaccccagtgcacatagactgatgtagccgggttccccagggagcaggtggcagagttggggcttgcccagactcctgctcttgccctgtggaaggacctatgagtcggaccccacacagggattaggtggggccatgctgggcagcccatgtcagcctggcacatcttggggactgtccacagtgtcagggctgggagcatggtcttggcacatgtaacatgccccgtttctctctttcttctggggttcaggcatatttctggtccatgataagatctttgcctccttcctgtctttcttgccctcgtggatggcccagaatcctttgtagatttcccacagtggcctttcccaggcaggcactggctggcagtggcagtctagacttcctgcctgcctcagtggccttccctgaaggagctgtacaaaagtgacagggagcacaggccactggcccctggggaggtgtggggcatggtgagccacgtccaccacatactgtgtgccaagctggaaaagagtttgggggtgcagaggacaaaggaagggaggtcacctctacagaatcacatggcacttaatttgtctttcctcttccctacccactcccctcctttcttcccagagacaagaggcagctcctgggagaaggcacagcctctgagactcacaagcagatcttttaaggtcaactttgccatctgtcttttaggcaataaccttcactacagctttttctgcttatttttgtcgaaagtcattgggagaatgagtcattgcgtgtgtatgcctgtgtgtttgtgcatatatatatgtgtgtgtatgtgcatgtacaagtatgtgtttgtgtgtgcaggtgtgcacgtgtgggtacttcccctgatttttttttttttgtgacataacttcccctcatttttttgaaaggctgaaagggactcagggtcaaggccatggtgcatccctcctgcagggagctggagctgggtgcctggaagctggcctttgggtcaggcttcagcctcagccgtactgactgtgcctggccaacctctgtcagtcccttcatcaggccatgctttaaggtcctcctctataaactgggggcaatgctagttcctactcctggggtgggtatgagttccagatgaggcacgtgacctttgcaggattttaacattacagtgacataactgtaatttacctactggtaaatgctctgttcatgtcagttagtagaatagaaagtgctggccctgctgacacagcagccatctcctggtttgcgatggacactatctcaggaggaggctgccgtgtgcctgctgcgaggggtgctccctgtttgctagggaggcccagagactgccccggcacctcgctgcacacagagaggccgtgtgtgtctcttgacccttcagctccacactgggaatgagggagaccaggggttagagatgcctcgggacctgagccgggcaccagctcccatctgtccatctgtcctgggctgctgggggagccggctctggccaggactgatgattcctggcacccaccaggagatgcacatcctgcttgaaagctgtgaactgctatccagagtgtctgggcttatcctgttggagcaaaacccctgggctaatatgtaatcccattgtgaaatgtatttcaaggagggcttctacaaggattctaattttacagcagctttaaccaaaaaaaaaaaaaaaaaaaacccaaatcttcagcaaacactcagaaccatggttcctgtatgatgtatagctttcaaaaacactcccccaccccttggaaatataggcagggaagggaaaataaatgtttttttgtgggaggcaggagcattattgaaaaaaactcaacaggctttttaaaactggaaaagtagaacgcgcgcatgttgaaaaattccagggcggctggagacaggatggggtggggcaggtatgtcggctccgcatggatcaggcttggtccagcccgtgttatgaccttccagctgtctgcttctcctctttggcctcagtttcctcatctataaaatgggaactatagtattgtacgcaccatgcagctgttgtgggggttaaatgatatgatctgtcacattcctgttacatgtatgtattcaacaaacatcgactgtctttttcattagtgaaaaccaggtctctctggctgtgcacccgtctctcgtcccacgacagctgctgatggctttcttgtgtacgctctcaggaaatttctatgcattcttttcttcttcgtttgtttgtaatatgaagggaaacacgctagcccctgttctgtgcctggcttttccctcttaaaactgcatctgtgggatgtagatatgaagtttgaaggatacgtgggaatggaccagatgaaggtggggtggggatggtgaccactgtccctggcagaggaacagcggatgtggtggccatgtggtgggaggggcaccgtgtgagcatgggctgaacggctggtgcgtggggatggggaggtggcttgggcctgccacgcgggacagggaagaccaggttgagggtttttgtctgtatcctatggagtgatggagacctgctgacacttatggagcagagggtgacccactgatctgggactcggaaaggtcaccccacttctgctttggtgcccatgggcgttgtgtagagaaggtgtcctgttttggtttcccaagagaggaaatggacctgctggcaggagaagtgggggagagtggttgggagctgctggtgtgtcgcctctcgatttggagggtggggacataagagtgggaaatggctggggcagtgtctctagagggtggctttcttcgatgtgagcctggaagttggtgaaaattgcccctcttttggtgctctcatgggtgtttggatattttgatccccaggtcatctttcaagccaagtacagcatgcaccaacccctccgtggctgcatcctacagcccctgatccactggtggactgctccacacctgctccctgttggggtctctgtcctcctgggtgatcttctagagcaggagtctcaagctttagggtatatgagactcgccgggggtcttgtctatgcagcatgctgggtcccttcccagagctcctgacttgacgcatctgccatgaagccagtatgaacatgcatttttagcaagatctcaggtgccgctgatgctgctgatctgaggacaccctgctctggagactagaaacatctctggcctggtctccctcccatgctgctcctgtgtagcctgcaggagacacctcctggcagccgggtgtgcaggctggtccagcgcagccacctcagtccctaccggagtggtctctggcaactcgggtaccattctctgggcctacccaaggaacatattacaggggctggagctgacctgctggagccccctaactcagtctgatggaaagaagacttaaaaaaaaacttgtgatgttaatttaaattttacagaaaaattgtgaagctagtacaaagactttatgtaaacctgcaccctggttccctttcactcttatagtagatttgtatcactaatgaaccactcttgaaacattattattaactcaagttcatactttattccaacatccttagtatttttctaatgccctttttccatcccaggatgccatccagatcccgcatgacatctggacatcatgtaccttcaggctgtcttgctgtgacgccttttctgactttgcttgttcttagtgaccttagcagttttgaggagcacctgtagggtgttctgtagaatgtccttcaatccagaacttctttttaaattcctcttctgcttgcggggcatcttgagtcatggaaatagattctcatttgttttctttgtaaattctgcctagagccagggtctgcagagatctctctggaatctgatagctagaggcctcagttgaccctgaggcaggccccattcctgttagagaaggtgcgtggaactggtgtggttgggaggagtggttgagaatggtctctgtgggcacggggtttgcccggcaggcagctgcccagtacggctgcctgtgtggctgatgtcatgttctcatcccatctgatgcactctccgcaagtcactttcagaaactggaagatcccacttaattctgctctggaatatatttagaaatctattcatggccctctcccaaagctgatgttaaaattaagagatatcatttgtaggatgtcatggctgtgcaggaggaacatgctgatgtctccctggccgcctttggtttcttctcttgcttagggatttgcccaactcccattgcccatctgagcccagctttccccctctgagcccagttttcctcctctcaccccaatgtcagagtgggcacatcctccctgcggaggcatgcaggcttttcctctgcatgcaccgtctctgtcttgcgtgacagcccggggctgtttctcacccttgttacgctggggttcttggctgagagctcctgggcaggggctgactttgagatgaggcttctctgttcgtttctggctggttctagatctgggtggcatttggagggtgcaccgcttgtatctgtgaccgaatacctcagggtttgtggtgagggacgtggagatttctgtgctgcaagagatcttagtgcttctattgtgctggggagaggccagcccatcttggggtaccagggctggaccaaactttagagggggtctgacccaggtgttcagagccagaaatattatttgcaatcctctgcagggaatttaaaaatgaaaccattctgaactctccctccagaattcatggtcgtcagccattcaacaaatatttactggacacctgttttaagcctgtcaccgttttttgagtatgcatatagctatatatggcaggttgcagtgacgactcatgtctctgccttcatggaatgagtagtctcgtgggatgaggggaaacagacagcatagaaatagatgtatgatgggactctaggtggttatagatgcctggagtgatgataaagtgaggctggaggaatgagactggcagggaggagagcccaactgtctgtgatagatggtcagagaggacctcagagcagggcatctgtgcagagaccaggcaaagtgagggagctggtcatgtgactaccctcgagaagagcactagggcagcaggaacagcaggtgcaatggccctgcagcaggcatgtgcttgggtgtggtaggaacaaggagaccagtgaggctgagtgagtgatggaaaggggcaagtttttgatgcccacaatgccaagaggtggccaggggaggatcccagggaggtgccgaggcctgggggaagacttgggctttattttcagagctgcccgttgaagatttgaatggctgcagagtgagatgagattgtgctggaggattcgaaggtcatttagtcagagatgctggtggtttggagcaggttgttcacagcagatgttctttgtgcctgcatcacaattccttggaccagctctgccttggtcttcagctgtggcttcaatcaaccagcatgttgggtgatgagcgctgtattggagcaggtggctacactttcaggaatgctgcaagctggctgcagtgggaagtatttacaccatggcaattggcaaatgtacatatcagctcccttataccacccaaacactttccagcacagcacagccatgagcccagtgctgtggatattctcccaagcatcaaagtgcagccaggacatgaggggagctaatgtctgaaggacaatcctcagctgacgaaatgggagtaaacatcccaggcatgcatcctttaggtgggtgcttcttggagctttcagagaatgcaaccttgctgcctacagctgtgaccctggaaatgcacgtgtgtgggtttgcccttcctccctccctcactctcattgctcccttgcttctgcttcctgagatacctcccaaataagctaccttcacctaagcccgcctgcagctctgcttttaggagaatccaattaagatggtggtagagctagatgtggtgtgagagggatcagatggctgggatgagacagaagagtcctggatgactccaagcgttccagcctgagcagctggaaggatggagaggttctggcggcaatggggaggaaccattgagatgagcaggatgggggttgggcaaatcaatgctctgttcagctgtggacaggttctgtttgagagacctatcagatccccaggtggaaattgtacctggagttagggagaggtgtgtggttggatagagatatctgggactggacaacactgattaggtcaggtgcccacctgcatctgtgattcagttgtgccctcctgcttaggaagcgtctgtgtatctatgtatgtatctatcatccatctatttatcatttatctctcttttttatttatctctcaatatatctatcatctataaatatatgtatattctagcatctagtcatcaatcatttatctatttttatttatgtatcaatatatctataatctatttttcaatatatctataatctgtcatccatctgctaatcgatcatctaccattatctatcaatctgtgtatctatcgtctctctctctgtccatccatccatccatctatccaggcagtgcttgcttccttctgccccctccttagcccatccctgcccaggaaaattctcgtccctgctcaaatgccttcagtgacaggaaactcaccaacctcttaaggcttcggcatggaagtttccaactcatgtggccactccagaatgctgtcctccagggactgtgtttctctctcatgtcctcctcccaagatttatttacactcctcacttgccaggagagagtacttgggagctccgagccatgcgtgttccctggcagggtcgcctgtgtgctggggaagaatgggcccagtcatggggtggagacgccccccagctgcagccctggctcccgagcagaggcggctttgtgcttctcggggacaagggttgccattgaggcaggccagggatgctgtgcaagctagcgatggctgcaggctgaaatcgggcatttcacagagagcaagcactgcactgtccccgcagcctgcacgtgaatggaggctttggccctcggagtgcagccgtgcatggggccacgtgcaggcatttctggctcctggctcccagggagagaggcgagccctgttctctccccgagttctgtttgacaaaattcacaaaaacacaaagaaacaaaaagtacgggagaggatcagttcattctcctgactcctggttggtctcaagacctcccctgttgcctgtgctctggaagattccccatagtacctactaggtgggccagagaaggatggatttgtgggaccctggaaggctgggaagaggactgagaagccacagccctgcgctgggaagagccacggaggttagatcttgttttttgtttgtttttaatacaattgttcacactttctaaacttttttgaaataattttagactcacgtgggggttgcagagcttccctcaatgacagcatccacctttccatggttcactggttggcaccaggaggtggacattggtacagtgaggttaactaaaccaactaaaccagaggccttagcgaattccaccaggttttgcaagcacttttgctgttttttcagtgaataattgaatgaaattttatcacacctatagcttcacgacaaccaggtgagacttgacttttaaataatgaggcgccaggccccttggctcctgaagtggcatgggcgacgtgtgtggatgctgactggatgcccacctgcttccttttctctacgttgtgcccccaccatgctccagtggcaggggcagcctcctcctggcccccaggcctctgcttctctggtgcctgtggaggctcaagcctttaccccacctcccttcttcccaggaaggccctggctgcctgagaaggcccagccttccccttctccctccgctgttctggctgagctcatctcctgtggctgccctagcatgtgctgcagactgggggattccacagcagaaacctactctctcgcagtgctggaggctggaggtctgagatcaaggtgccagcagggcgggttccttctgagggctgtgagggcaggacccgtcccaggactctctctgtggctgtgagtggccgccttctccctggttctcttcacatgatcatcctgcccttccagggtatgagctccatgcctgtccccagaagatctggaggcttccatcttctgctccttatcagacaatggagcggaataaacacggttgcctctctggaattggagcttagtgctcatgaaataaaattctcttaatctcacaattgtcctcaatacagttgcagtgggtggcaccgaatgagtgtcgtgcttgtcaagacagccactgtggccttccgtcttcccactgactgatggcaagtcactagaaggaagcacccaactccccgtgatggcattaaatgacacccgtgggtgtggctgtagaccaggggttctaggcagccaagggggttccatgcagccaaaggaaagaagaaactttcctgcagaatgcatgaatatagggccaggtcctaaagcccagcccacgggcaagtgtgtcctggtggttgccactttccagtcaactgattagtgtcaatcatgacactgatttcctggcaatgtgtgagatgattttaggtggtaaatgaactattaattttataaagaacgttcatatcaggtatatgtctgtttaatttttcttttttcttttttttgagatggagtctcactctgtcccccaggctggagtgcagtggtatggtcttggctcactgcaacctctgcctcccaggttcaagtgattctcctgcctcagcctcccgagtagctgggattacaggtgcccaccaccacacctggctaatttttatatttttagtagagacagggtttcaccctgttggctaggctggtcttaaactcctaacctcaggtgatccgcccgcctaggcctcccaaagtgctgggattacaggcttgagccaccgttcccagcctgtttaatttttcattagaaaaatattgcatttccattaaagtagacgtcaagttttcattttaaactttcttaagaaaacattatattcattttagaccaagtggttctattagagcaacatccataagagtggtgacgtgtgagtgaagttggggagacaccgggtggtgcagttacccagcaccatctagaggaagtaccactggggtgggcggttacctggcaccatctagaggaagtgccactgggtgggggtcccttcacagaggcagggtccagtcccggccaccctcaaggagcttgtactgtcgaagtggggagggggacatgagaaatgttgactcaggggcagagggttcttaggcttatcaaggaagctctaggattctcggtgttctaggggattcgaggaggaaagttacacctgatgggtagacaggggtggttggagggatttggtaaaacgttcatgaagaaggggtgggtctgtggggtttctggagttgaagtgaccaccaccagggatgctggcatgtggagctagcttcatggctgttagctgtcattgtggaatggaagttaaagtgtgcgttgagcagggctgaaagaggcatagacctcccatactgggagagaagccatgctcagggaagaatgcccagaggctaaaagtcagggtcagatgcccatcttaggggcccttggttgccataattatcaaggcaaggtccttggataaagtctggtccggtgcctctgaaacttctatgtgcatacatgtcactgggagtctggttaaaatgtggattctgacgcttgggtagggcctgaaactctgcatttttaatgagctcctgggggatgctgctcctcagatgccccgctcttctgtcccctagcccccagcaacagcaaacacttagtgcctgcctttctgcagggacaggggagggaggtttgtttgcagtgacagtttttgggtagctatggagggaggagagaggtaggactttgtcttggtccagtttacaggggccttgacagaggcaggaggggtgggcaggagttgccaacttttatattttggtcaactagggatgtttaaaaacaacaatgaagaaaaacccgaacatccttggtttcacaacagtataataataacactattaacaccagtatttcccaaaagaaatggaatttcaaatccaaagagtcaggaaggccatatactccaacagaagacagtcttttcaaggacacagagccagcccccaaaacacctcactgcattgtcctcatttttcaaaggacttgggaaacatcaccccaggctggcatggatgactgggctgaggcttgggggctgcggctgtatgaacgggaatgcctgtggtcctcagagctgaggtctgtgttcccagaagcccctgtagagtggcatctggccccggcctgtggtagcctctgtcctttcccaggagagaggttgccagggcctgagcaaacactgacctggagtgtccctgcttctgaacctgcctccctatcgtcctcaccttgtggtgtacgggacgtgtggggactgtatcatctgggctgtggctggcggcctctcgtctaatgctaccacatgcccttcataggccatgatgagccatggcagtgctgactgtgttctaccactgctccaggttcctgagatgctcacatcctgggatgtgctggggttgagcaccaaagctaggggaggtcctagtagcccactcctgttcctcagtccccttgcgtctggctgggaaaaggtgcacctcctccgtctctgtccacgtggaattgaccatcatcctgcacagtctctgcccctggtaattggttctcagatgggctcatgactcaggcttcacgaatgagaatctgttctaggacttcagttgaagcgcttggaaagagttgttttccctccacaagaagtcacagagctggtcggctgtgggcttggagtgctggtggccattttccccaacccagctggagcctgagaatggaactagcccaaaggaaagctgagcaaagacaattttgaaggttgatttcccgatggcattatttgcatccctggatccagcgtgtgtgaagctggcgcacccccgggcttctcagttaaacacttcctccctttcaggcttcagcagctttgattgggcttctgccatttctgattattacagggacttagaggaaggaaatggctttgcccagatcacagggctcatgaaagtgcccaggctggaatgcaaatgcccacctacttcccctcacatcactctccctcacctgctttaagtgcatgcccagtcccagggagatcttcccatcactctttggggattctgcctcactgaaagctcttgaagctgcttcaaagtggagtatcatggtgtttcccgggagggtggttgccgggtgctgagaaagactggcctgcagtgctcttgcttttgcacttccgtcccccaccttgatcctggggtgcacgggggcaggaaggagaggagtgtgggagttgatggggagatgagaggagacatctacccatggcctctgcttctgggaggacctgtcacactcccagtgacacagcgtgtgctagagattaggcttttctcgtgaaagtagggttttgaaatataaatcattctataaagacatatgcatacgtgtgtttattgcagcactattaacaatagcaaagacatggaaacaacccaaatgcccatcaatgatagattggataaagaaaacgtggtacatatacaccatggaatactatgcagccataaaaaggaatgagatcatgtcctttgtggggacacggatgaaggtggaagccatcatcctcagcaaactaacacaggaacagaaaaccaaataccacatgctctcacttataagtgggagttgaacattgagaacacatggtcacagagaggggaacaacccacaccagggcctgttgagtggtgggggtgaggggagggatcttagaggacaggtcaataggtgcagcaagccaccatggcacatgtatacctatgtaacaaacctgcacgttctgcatatgtatcccgcttttcttttgtttttgtttttagaagaaataaaagaaaatagaagctcacttgcctggatactttaatattgcctgggtttttgtgttgtggagggctctgtaagtcatggaaaaggtattctcaggagctgctaatgacatatttaattttaataatgagtcacccatgcccacaatttattacctcctgtggctctggactctggttctttgagtggtataatagggcggaggttaatggataacacaattaattatttaggaggttcttacaaagccaaagactttgtaacagattaactaataggttcctaacttcattatcattttgatttttccaaagaatattttctcccaaaccactcaactgtataacattactgggaaatgtctaatttttacacgattcctctgctcagtttaaatactaatgttctgcttactccgtcactgttcagcgcccagctttcggtcttcaccttattgcctgggagatagatataatggattcagatgttatgagccctggaagggtttgtaacataaggcagtattttaatgctttaggggctggaaatatttaaggcaatattttaattctcatgagggacgaagtgttgtggttgcaagtgcagcctctgaaatcaggcggagctgggtgtgaatcccagcctctgcacttaggttggttacatcacctctccaactccgttccctccttcataaaatgggcacactagtagtattaacctggttgcattgcagtgaagattcaatgagaaaatgcaggtaaaacacttaatgtggtgtccagcacagagtaacaggttaggagtgttggccgtgaacggtggtgatggtcatctaatcacagcatggaatgaggaggagcaagccctcaccctggcctgctgctcctttgttgatgaaatgcctgtggttgttttcacaccgcagcaacagaattgagcattttcccagaaaaatttcccggtctaaactgtttactctctggcccttcatagaaaaagaatcgctgctccctgccctcaaggcagcctcctgtgcttttatcttctcgggtctcctttcagaggcctcattataggtgagcgccatccagcagaacgtcctgtgatgatggaaatggtctaggtctgcgccatgccgcccgggattgcgccgctggccgcagatggttgctgaacactcgaaatgtggctcatgcaacctcagaatggaatttttaaattttacttagctgtaattgatttaaatttaaatagccacctgtggctaatggcaaccacatcgggcagtgcagtgacaccacaccggctcagagtagagaaccagtcacctccattctagcatcctttctgagagtgccgggtggagggtgctggctttggctgaaataaaggaaagggagaaggctgctccttgcattttctttttctgttcttttttctttctttctttctctctctttctttctttctttctttctttctttctttctttctttctttctttttctttctttctttctttcctttctttctttctttctttctttctctttctttctttccttccttccttccttctttctttctttctttttttttttttttgagatagagttttgctcttgttgcccaggctggagtgcaatggcgcaatctcggctcactgcaacctccacctcccaggtacaagcaattcttttgtctcagcatcccaatagttgggattacgggcgtgcaccaccacactcggctaatttttttgtatttattagagacggggtttcaccatgttagtcaggctggtcgtgaactcctgacctcaggtgatccatctgcctcagcctcccaaagtgctgggattacaggcatgtgccatcgtgcccggcctgctccttgctttttattatgtttttgctgattcaaagcatctgtaaatataaaaattgaacttactcttttgtgtgaactatttggtaaacattcacaagcatgaagaaggaagttaagatgtcttaatcccatgctgtagagataaaggattttgggcagtacatttgctgtcactttcaaatatttgtatggcgcgtaagaggggagtcataatgtctgcatggggtgtgcccccacttttctgctgggacagggactacacaaagcttcatattatcctgattaatggctgcagggtgctcggtgtgcagtggcctctctgggcaggtctccgggctgcacacagttggggactgttttaagctgctcagtgatgagtgtccttgctgtgaagtatttctgtgtttttcatgtttgtccagagtggccacgaggtcctcctaagagactttgatcaatgtatgtttctacagaaaatgttagaagctgctgctccttcacattagctaatgctggatcttgcccatctttcttccttgtgccaatctgctggcgaaaaattgcttgtctatattttcatcacttttatgtatttatttttttaaaaaagacatgttcccagaagtcactgcttggaaatatctctggtcatttctcttgcttcttttagtttctgggtgaggccagtggttataagccagttcctgagtctttggacagtttaatgggggcatggatcaggtcgcagatagcagactttgatagcactttgattcaatgagggcctactatgagctttgcaggttttatctcattcaatattcataaccacctgaggagctgggtgctatttatccccattttacaggtgaagaaactgagaactctctcaagtcctggtggatgagggacatagtctggatttgaacagagcatgtggccacctgagctcacactcctggtcagcacaccatgggaggcatggggaggggaaggggtgtgggagatggccaggaagacctggtctggatcggggctctgcttactggctgtgaggctctggacaaagttatgtgacctctcagagcctaaatttccccagctctcaaatggatatcaggatatttaccttgaggttgttgtaaatagaaatggagatgtgtatgaaggccctggcataattcctatacttcactgatgcttgataaatgatggctgttttctgtactattagcaatgattattaatacagtgatgaaaaatacagagcaaagatgataaacagaaagtgtctagaagatagttgctacctgagagttagctattgtttattctgttaatgtgttacagtgtaggtatttctacattcagtaacatcataagcaaagaagactttgcttgccaagggccctattgaaagccctcgatgggtacaggctgttatctcaccaacacagactctgatccaaggtgaccaggagaattttagaatgatctaggcaaggaaattgccgtgcttccaaagcaacctgctcctcaggctccctgtggggctgtctgccccagcttgccacacctctgcaggtttgtggctttgtttcctgtatggggtctgaaggtgagcagtacctttgtttcctgtatggggtctgttctgtgttcagaagcaggactcagggctgctggagctggagctggagcctctgagtcctcagggttctccacagctctcctgaccagctctgctagagcgatgtctctggcagatgccttttccctgttgccctgtggtctggcctttctgctgtaggttaaagaaatcacagtgtgggcaggtggcctagtctgtaagtgtgtcctctagtgacctttgttttacctctagccatgcttgctgtttgtcctttcttgggattacatagttggccaggccaaaacatcttagctcacatgaaatccaagttcacagctggtaaaaatgccacagattaaatgctccatagaaattcatgtctataatggatgcatttctcctgggaattcactccttaaataggatgaccttgtcattgactcctgtccctaccctcaaccctaacgtgaacaaatatgaaatgatccttaaccaaccaacatgctagaataaagacacaaagcattaaaaaaaaaaaaaaaaccaacaaacaatgaggagggaggagtaattcttttggcaaaacttgattccctattgtggttgatgtggctgcattctttttgctcgttgagaagttgctagaagacagggtcagtggtggttctatgagggtggctaccatttttcttgagggactgcttttatctgccaagcacatagttctttacatactttatcttcctgaagcctcatgagagctctaagagattcccattattattatccccattttgagcatgaggaaactaaagctcagggaagtatgggaatagaaaactacatggccagggtctgaatccaggctgttttgctgctggccccaaggtcttagccccagtgcatactattaaatgctgcctgagttccttgacacctgcaccactacccctccttccaccaaccaggtggggttcactggtataagctgtcttagcatgttgaaagtgctcttgtagtacttagaaacactgtcatttaactgctatttaggttcttagtagttgtagctatgttagatggatgggccaagccatagccttgtgaggacagggacagtatccagtttgttatccatcccttatctatgccttatacacagtagagtctccataagtgctgggtggatggatgggtgggttggtggtggatggatggatggatggatgggcaggtgggtgggtggatgaatggatgatggatgatggctaagtagatatatgagtggataggtagatgggtggatggatggatggatggatggatagattgattggtagatgggtggatggattgatggatgattgctaggtagatatatgagtggataggtgggtgggtgggtgcgtgagtggatggatggatggagattgatagatggataggtggatggattggagaatgggtggatgggtgggtgaatggattgacggatgatggctaggtagatataccagtggataggtgggtggagggatgggtgggtggatggatggatggataaatggggatggatagatggatggatggatgggtagatgcacggatggataaatggagatggatagatggatggatggacgaatggatgggtagatggatggatgggttgatgatggctaggtagatatatgagtggataggtgggtgggtgggtgagtggatgggtggatggatggagattgatagatggataggaggatggattggagaatgggtggatgggtgggtgaatggattgatggatgacggctaggtagacataccagtggataggtgggtgggtggatgggtggggtggatggacagatggataaatggagatggatagatggatggatggatggatggatggatggatggatggatgggtagacggatgtatgggttgatgatggctaggtagatatatgagtgggtaggtgggtgggtgggtctgtggatggatggatgagtgggtagaaatccaggcagctggaaggacagtggtggaaggacaggtatttggaaggacagtcatttgaagaggaaacaaagacatagtatttgaggggggaattatctgcacagcccccaatttgctgacattagctcctggagaaaggagcacctgcaggatgagcatttcccacctgtctgttcttttctcttggccaagaggacctcacagcaatgctctggttacagtcaggggaaggctgtactgaccacacaaagttccaagaggggacaagcatggtgtgacctccagccaacttgactctctcatcttctccccacgttcctaccttggacctcttctgggctggccgattgaaagagaatattcataaagctgactttgaggagtgttttgggaggcaggcacaaagattattggtattgagtcccagttctataacttactagctgtgtggctttgggcaagttaatccctctctctgagcttcagttcccatcctgatgccaaccttgggtactgctgagggaggaggggagaagggggatggatgcacatgaatggaaggcagtagcagttgttaattccccttatctgactttccattttactaccttcatttcttttctcttagactcttggaagagatgtactgtgctgggatataaatttttgaaacctgttctctttcctcttccatgttctccgtgataatgcaggaaaaaaactcgcaaacctggccatgatgcccctaggccgacagaggctttcctagttccaattctggcattgtaagagagagctctatggaatagcaaaaaacaggcacacttcatcctgtgcatgctggggttgaggctgtgaggtgtgcaacaggacagtagagcatagcagatgggttgatgagctgtgatctggattcagacctacttgtctcagaccctgggtcagcccgtcagcagctgagcaatattgggaaagattcttaaccttggatggttggtaggatcaagtacagtcagtgtagaaatgcttagctcaccacatggactcaggacatgtcaactctccctgctttggctataattactatcctactgtcaaggaactttctctctagttgggctaggtcatgtgcgcagaagggttggaggacaaggtgttgaagaaagatttctccaaagatcctggttggatgtgagctggatagagcaaggctggagagtgcagatgcccctggggccaggcggtcttcaaccagtcttggtgagaaatagtagctcgactcagctttggggtgcagagacactggggaggggcggggactgtagcaacctaaagtgctcctgccctgcctgcagaggatgatctgcacagccctgctcattatgatgacatgggcatgtgcgtgactgtcagctctttggttttcaagagaatttggaagtctaggtttccatgcatcaaaccagtagtagagaaggcaaccatggggagaacctaagtcttgtttctagagagatcatagggttgtaaattttaccttgcatctcagagaagggcagtgctattttagattagggaggttgcaaaggtgatgaactccaagaacactgacaaataccattatcattgcaaaagaatcttaaatgtgtctttgaaaagcaagcatttggcttctaagttgtaaaaatggaccaaaaatgaagcagtagagtagggactcataaccaagtttatgccattattgttacaggtttcttttactgtgtttctctctatatatatgcacatctatataaatatagatacatagatatatggggagaagatatagatagagataatgtatgcatatatatacatattatatttgtctgggttctccagaggaacaccatcaataggatatagagatttatctattgcctatctattcatctatttatctatctaccaatccatccatccatccacctctgttcatctatccatccattatcgtatctatcatctatccattcatccatccatgtatgtatgcatgtatgtatgtctctctctctctatcattttcatccattcatccattgtctgtctatctgtctatctagatgtattagaaggaattggcctatgtgttgtggagtctaaaaagtcccagcagtcagcaagctgaagacctgagagagccaatggtgtagttctagtgcgagtttgaaggcctgagaaacaggagagctaatggtgtaaatttcagtctgagtctgcagaagactgatgattcagctcgaagacagatagagagaattctttcttattccgtcttcctgctctattcagtccctcaatggattggatgaggcccactcatgctagggaaggccatctgctttacccagcctattgattcaaatgtcagtctcatccagaaactccctcatgggcacccaaaataatgtttcaccaaatgtgtgggcaccctcaggcccagtcaagttgacacattaaaggaaccatcccatgcatatctatagattgtgtgtgtatgtacatttgtgtatatataatatataattatcctgttaaggatgtctcacagccttgaggcagagattaattgtgacctggtggtttccaatgtttctgtatatacaaataaattatgcagcaatgataccctagtctcattttattaattgctcttctattagtctgtttaaagtcaattaaacctcccaaggcccctcacggaggaacctctcacaaaatcagtctctgtcacttaggaatcctgagtggatgtcacatggctgtcctagctcctggggagggtgcagacaacatctctgttggaactcctgggtctgtgggtgatcattggcttgcattttgtagtggcatggcccgtggaggtccggatgtagagaaggcagcctttctgcagagcgttagaatttgggaagaagtggtcaggattagagaggaaaaaaaagacttagacatggacaaggatgccaccccagcttacccttcctctagtttcctggacttttgcagggttcggtggataattagttatttgcttgcttggttggtatctgttcacttttatttcttttagactttttttttttctgattagaacaaaaattatatttattattgaaaattcagaatacataggagattatcaagaacatcaaaagcattcacaaatccccccacccccaccccagagataacccctgtggctacttttgtgtgtgttcctccagtacttttcctatagaaacatttttcccgtgtcgggattgttcagcctatatcctttattaaattaatacatcagaagcttttctccacactgcttaggacacttgggaccaaatgctccagaataggaatttgccaccatttattttcccattctgctttcattggaaactgagtctggcttgaggcttttgtttgcttctttcttgctatagtaattgggatggacttaaggctgcctgcctttttgtgtacatctctgattatttctttaggctaaattcctagaagctggaacccggggcagaaggaatgaagattggaaacccttggtgcatgacagcaacttgctgtcctgccaacattggggcgtttgcctacagaaagagctctctggttgaatcaaagaattttaagaatttaattcttcttcttgttttttgtttgtttgtttgtttgtttttgagacagagtctcactctgtcgcccaggctggagtgcagtggcacgatcttggctcactgcaagcaccacctcccaggttcacaccattctcctgcctcagcttcctgagtagctgggactacaggtgcccgccaccatgcccagctaattttttgtatttttagtagagacggggtttcaccatgttagccaggatggtctcgatctcatgaccttgtgatccgcccgcctcggcctcccaaagtgctgggattacaggcgtgagccactgcgccggcctaattcttcttttaaaagttggggatcagagtaaggtgagaaggtatcctgcacagcatcaatgcacacagcgcacattaaatgagtgctattccacttcatttgtagtattttttttcccatttgtaggaactacttttgtgcctgacttccttgttcctttaaatgagccttaaggaagtagtgttgggggaattcaacacacacagagcagttggtctttattatgattttaagcatcttgttttcatgtgagcaccccaactttgccttttgctaaattttgcaacaagttttgagtaattctgcacaaaacagtgcccttgctccaggaggagaacagacatttgctcgttcttcacaggataattagactctaaaattagaagtcaaacactgcatgttaaaatgcatctggataaaatcccagtgggagaattaatccttcttggcagtgcaggggaacttgggtgcacgcctgatggagcggcgagaagctgagagggagtgaggcagcccctctgtgtggagtgttcagggcaaatgcacgggtgctggtgacgcagtccctttacttgtctaaaagtattggattctaagtgaaaaggggggtggggatagaaggccttctgcctcgcctcctgtagtcacagtttggatatcctgtgaaagtagcacttaggcaggcattcggtcctgcttggcgttgtttggtggacttgttagagaacactactgactgtgtttgaggaaggaggtggagcagagggctcagggcttaagcggcatctcctcaagggcagcaagagacctggaacgttccagagtaacccctgcctgcatccgtcggacttgccaatacacactgagaaactgctaaaggttatggatgcaatggaggcttctggtatagtggggaggaaaagcctccattatgaagtcaaaggccattgcgtgcctgcagtgtgcgacaagagctagtggttgcagcaccctgatgggcagaagcttccctcacagagctatggtgatggagaaggcagctgcaaatcaagtcattaccagcaaggttataaaattatttgattgcatttcgaagtgaaaaacagttttgaattaacttctatttgttgtgatataaacaacagatataaaaagatataaaaggaaataaacagtgaccatgacattggttgttcagtttcaacactatcttcgggttccctggtccttgtcctccctcattcgcctcccccaccactgaattgtagactccaacagggggcgggagctgagtttgtttttgctcccagctgggactccagggtctagcactggcctggtgcttagcagcctgtagcaagtatgtgttgaatgggcaaatgtatcctttggcggtacgagacagaagctggtggtcctgtgctgcctgtggccagagcacttccagcatacggggccaggacacatttgccctggtgtcccaggttgctccaggcacaggctgcacctcctgggggctctccctgcaccagcctggtggttctctgtcgcttctcctgcaccctgcgccttccctttgtgtcacatccctacctcatcgctactcatttgttggccagtgttttttttagaggatctctttttataaaatttcagtttttattttaggttctggaggtacatgtgcaggtttgttaccagggcacatcgcctgatgctgaggctggggcttctgttcattctgtcacccagatagtaaacatagggcctgacagcacgtttttcagcccttgtccccctccttcgctccctccctttctctttcggagtcccctgtgtctgttgttctgtatgtttgtgtgtactcaagatttagctcccactcatgagtgagaataggcagtatttggttttctatttctgcgttaattcactcaggatagtggcctccagctgcatccatgttgctgcaaaggatatgattttgttcttttttatgttagcagatctttttttttttttttttttttacccactctctgattctccatgcatcatgagtcccccaaaggcagggctgggttaacctccctgggcccagagaacaggtgctcagtatttttagaatgaacaaaagttctcttgtggaatcatgagggaggtggagggaggaaggaaggagggaagacctctgccctggctctttctcctgcctgaaacagcctccctcagatcccagcctgtggcgcctttctcgtcacgtgtgtgtccgccccacactgccctccctggcctcggaggctaaagcgctggcccctgccagcctggacctctcctcgtcctgcttgatttgattctgagcgtgctcatcaccatctggacatatgttattcacgcacaattaaatgttgcttatattgcatataaaacataaatttatataatgatatacatgtacatatgtgtgtgtggcgtgtgtgtgtgtgcatatccctgtcgacaccaccagaatatgttttaatgaaaccgtcatgttttaatgaaaacagaaagccttctgtttcatgtcgtgacgctggaatgaaaacagtctctcccagcatctagctcagtgcctggcacatcatgaaagcttaataaatacggctagaattaatgaatgagtttctttcccctcccctgtcctgtatttttaataaggctgttgagcctggggcctctgccctctgctggtcactatcatcacacagcctcactcaggaggcccctggccccgttctgcctggagtgttggcaggtggcaagggttgtaagctcctgcccagtcccgtgggcagttctaggatcttacccccagcccctgcgattctgaggggacgtgtcagtcattcagcctccagccagtccctggggatgtctgagggaggaagtaaggctcaagtcccctgaagtgggcagctcctgtcatccacagctgctgcttgttagtgggagccctggggccctgggtaaatgtcctgccagagctgggctcactctggcctcctttgtatacctgggggcaaggtttagctattcagcaagggctgttttaaaaaattgggttggttctggatattataatacctttttataaaagaccacgaagaaaactacattttcttggtgacttttacaataggagcaagttaaattttctttcttcactgagttgtcattgttgccttttttttaaaatcagtttttccctgtcaaaagaaagtaccttaccatgtgatctactgaaatataggagttacactgaacgaagtgaaaatgaagcttgtttgtcagtccttcctgctgactttctcaatctgggcccagtgtaccctgggaggcacagccagagcccagggagtgaatccgattgttcagtagatgcagttccccagttcaggccctgcaactaccagtccaggcctggaggggagcatgcatcccccaggaacatgactcggagctggaatctgactaggcataggagttaattgggcctgaggcagggagggtgctgggaagaacattctagggagagcagacagcatgtatgcatgcacacatgttctgtggcagaagactgtgtgagtgtttggggaggtatgagtgactctgaaagggtttttcccagtggagcacaaagatgcccgtgttgtgggaggaagcccaaggtgggaccaggcagggctcattaaagggatttttgtctttaaatgaagagcaccaggaaagcctctgaggattttaaacatggtggttgcagtcgggcagatcagcttggcaaagatttgatgactagggtattagtctgttctcatgctgctaatacagacatatctaggactgggtaatttataaaggaaagaagtttaatggactccacagttccacatggctggggaggcctcacaatcatggcggaaggcaaaggagaagcaaaggcatgtcttacatggcagcaggcaagagagagcttgtgcagggaaactcccatttataaaaccatccaatatcgtgagacttactaccatgaaaacagtaggggggaaccacccacatgattcaattatctccatctggccccacccttgacatgtggagattattacaattcaaggtgagatttgggtggggacacagccaaaccatatcaactagcatggagaggccagtgtggagtttagggtaccaggtggaaggccccctgaggttggggagggtggtgcagggcagcaggtggcagccaggcccttggaggtccattggcaggactgagcagcagggtgttggagtgacatgcaggtgggggtacagtcctcttcattcttattcacatcttttctgttgatccctttccatctctttccccactagtttcctgtgttcttttgatccacaagctccacatttcctgaaagaaatgaatgccattattatcacatacagccacacacacaccctgtacaaactcatctcccacaacgcccaactccctaacatggttgcctaaatcagaattaagctccctggattcaggtcccagtcccacccttaatgtgcttgtgaatctcaatgaggtgcttggcctttcttggctgggtttcctcatctgtgaaatgggggattttgcactgttttatttttctactttttgccagccttgcaactttccataggactttgcttcatctagactgttggtgtaggaaaacatccttttggttaatggatagatgttataggctaggtgccttccctccaggaggttcctcatcttattagtgaagattctgtagttgcatatggctttagttgctgttgagaaacctacccagactggcttcaccatcaaaggtatttattgactgacaccgttttgtgattagtccagggggagtttggcttcaggcccattgaccacagggtctaattatactgttcaccattgcttctcgtccctctcactgcctggttctctgctggcctgctgtgaggccacatttccttctcctctgttcccccaggctccagccattttgaggaaggaggtgagtttctctttcctattagtgaagaataccaaagctgtaggaatcatatcttactggcctggaggtggtcagcttctttaaaatcacatggcctgattgggcaaggggtaggtcccttgagggaaatcaaggtgctgaaccagaaaaggtggtgatggcaattgggtaggaaaaaataagtccatctcagagtctttaaaaaacatctttaaaatctcctcgtgatttcttaatcagcaagagggtggcttaatctgtttatcccagaggccagggatggagggtcagggaggggttgaccttctggggctgatgatagcatttgtttttcttcccagtccaggcttacgctgaccttggtacttaaggcagggcctgtcctttcctctgctcagcaacatccatcactgccatgtccttttggcactaattaaagaggacacacttggattaggaaaatgatggattgggttgatgtgatttgatgtgaggtggagtgaataagtgacaagctcgcccttagagaaaccacctcggagtagccacaggcagcctgtgtcccccataggagggactgggacagcttggcaaccacctaccccagaacacctgctaggaggagagagtcctgttgttccggcttgggaatgtctgtgtttacatgatgaggctgggaatataggcatcgaagcatcagtttcctttgctccatctagatcagcgttgttgatggatgagtatggtaaagagttggatgattttcccccagagtttccatgctggacaattgtttatttacttgagctaattactgaaatttttttccatgacttggcctaatataaaaaaagacactaatgagagtgaggttttatggtaagcaaattgaaaagcaaatagcaaataactcatctatgaaatagttataagaaaagttattatggtaatggttagggcaaaacaactctatttaattcttgatgcttatggagattccagccaagatatgtgtattttccttaaaaagatttctttaaagcatgtgtcttaatttaatcctgttatacacaggcacatctattaatgaagtaaattcaacaaagagttaattataaatagcagcaacatgttttctttctttaaatattgtatatatttcatgttgtaactcgggggataaattatactaggtggattttgtggtaatataaaggacggttggaattttattgagtatttacttttatttggttttgaagaagagcttctccatacctcagactatcaaaaatcattctgttagagtcacagaaattccaattaagagcttagatgccaatacagactgattattttgaagacttttttcagttcatgactcagttaatattcagtggtgtattttctgtagtttaaaagtatcactgataagttgggagtatgccttccatatgagatacaaattgtccctaaccactcaatcaatgtttactttacatgttaaaaataagaaactaagacctcataatgtggttttaaaggttcctgttttttgccctgaaggtccaaaggtaaatttggcacatttgtcaaaatatagatgaataatttatagatgtgcatccattttatttttataagtatggaaatagatataaagggatttgctggaagaatttcttttggcaaatgagcaaaaaatttaactataaagaatgaaatactaggctctagatataaaataatattcacaatgcaatacaaaatgtgcaggcatttttggtcatattttctatgacaggtttcttagaaatctgtgtttctactatgaaacacatgaaacaaagaaatatttatacatcagcagaactataaattcaaaaattcagagaaaattccaaatgggtgtgatgttgatacttgcatttttctctaaaattaataaggtatgtgtgtatatatctgcatatacctatgattcatgtaaagggttgcagatacaaagattctaagttcataggtataagaataaatatatgaagctgtatcctgtcttttgcattatattgattgttctcgttggggggagggcgttaattttaaaaagtcaagtgaaagtaaattttcccatcaaaggaaggcactattgctttcaaacatcatcatattcaatacaaattaaaacaatgaactactgtatctacccatcagactagcaaaaatcaaagcatataacaatggcaagtgttgccaaaggatggagacctgctgatgttagtgtaaatgggtgtgaccgctttggagagcaatatgacctatcccgttgagctggggacactatgactcagcaatgcttctccaggccttttccctggagaaaatcacatttgtaagtggcaagagaattatccaggaatgttttccaatgcgttgatagcaaaaaaaaaaaaaaaaaaaaagtctcaggggttgggggtggtgggacagaccgttgatagtggaatgagaaatcgtaaacaagaaggatctacccagaagttgccctagttgttacctctgcagtgtggcagggttgggggctatgatagggcttctgaggtgactgtggaggcttacatttgatctataatgttttgtttttttcttgtgtcttttaacaaaaagaaaacctgatttaagcaagatgtcaagatgttaatctttgttaattctggctgttgaatgcatgaatgttgtgtgtgtgtgtgttgaaactgttaaaaaaaaatcatctttgggttgaccatggtggtgtacacctgtaatcccagcactttaggaggccaaggtgggagaatcatttgaatcaggagttcgaggctgcagtgagctatgattgcaccactgcccttcagcctgggtgagagtgagactttgtctaaagtaaaaaatgtaaatgaataaatacatcctcccattacattacattttctaaagtagcgtaacttttcatgtcagaaactagaataaattaagtcactgaatcatgtagtaaattatgaactattgcctctatagttggttgccaaaatggcctgccagtgtctattaatcaatataaaatataaaaatagaacatttaaaaattaaagcatcatgttatattgccattaccagctagccatatgaaccttatggaaggaaatctggctatatttagcaaaattacataaatagtccccctttggaccagtaatcccacttctaggaatctatcccaaaatatcttggcaaatggtaaaatagcacacaggcaatggtatttgttttgccattattcattatagcaaagtgttggaaacaatgcacatatcacgaagagtggactggctggataaataatggcatagccagacaaaggggtatcggaagacaataaaagaaatgagcgtgttctctctactcacatggaagtcatctccaggatatatcatagtattcattagtcagagttttccagagaaacccaaccaacaggatctttttggtaggtaggtaggtaggtaggtaggtaggtaggtaggtaggtaggtaggtagatagacggatagatatggagatacatacagatataaaaggagatttattatgaggaattgactcaagtgattatgaaggctgagaagttctacaatctgctgtctgcaagatggagctccaggaaagctgatggtgtaattctagtctgagtctgaaggcctgagaaccaggggaactggtaatgtaacttccagtctaagggcaggagaaggtccctatgctagctcaagcaggcagacaggaaggaaaaaaggctgacttcctcctttatctacctttttgttctattcaggcctctatcaggtcggatgttgctcactcacatgagggaaggcatgtgctttactgagttcaccaattcaaatgctagtctctgatagatgtggtggctcacacctgtaatcccagcactttggggtgggggcacctagcagggaggatcacttgaggccaggagttccagactagcctgggaaacataacaagaccccatctctgaaaaacaaaagtaaaaaattagctgggcatggtggcacacacttgtctgtagtgccagctactcaggaggctgaggcaggaggatccattgagccctaaagttcaaggctgtagtgaggtatgattgcactttgtgccactgcactccagcctgggcaacagagtgagaccttatctcttaaaataaaaaatgctaatctcatcaaaattagcattaatctactctataatttccattagattcttttaaataattagataatttctgtctctttattgacattatctgtcatcataccttctctttcctctttaagagtgtacattttttcatcgagattagcattttttaagatctggaaatacccttgtagacacgtccacaatccataatatcatttaatctggaaacctgtggccagattgacacataaaattaacatcacaatcattgagtgaaaaaaaaatcgggatatttttatagaatactgcctttcatgtaaaaaagagatgtgttcacgtgtgcattttcatgtgtgtgtgtacttagattgtttaaaataaatgctgggagtaaaaagcgagcactaacggttgcctatagtggaggaagtaacagaggggagggcagaaatagaagtgagacttctatgagtgtactttgttatatgattctgaattttaaagtgtgtaaatatttttacatattcaaaaaattaaaagggaaaatattcttataattgaagacagatggaaataattgaacctaactatatatcaagttggtagcttaacccgagaaagtaattttttttttttttttgagatggagtcttgctctggcacccaggctggagtgcagtggcaccatctctgctcactgcaaccttcgcctcccgggttcaagcgattttcctgtctcagccttctaagtagctgggattagaggtgcttgccaccatgcctggttaatttttgtaattttaatagagacggggtttcactatgttggtcaggctggtctcgaactcctgatcctgtgatccacctgccttggcctcccaaaagtgctaggattacaggcgtgagccactgcactcggctgtgagaaagtaatttctttaagtaacactaaaacccagtattttaactgtatatccatagtggggtggaatttaaggatgctagcatatgtaaataaaaagaatcatatatttcatgattagtgttattattagctgtaatatggatgttattattttgaaattataggactaacttggagaaagcaattaagcaatatgttaatgttgttatgaatcaagattcttattatgaaagaaaagagataaggtataatattttttaaagttatctgaaatcctaaaatcttacatttaaattagaaatattaatattcatgatattctttgctcttaaaatatctatttcataactctgtctactgaaaaagcctaaaagcagtgaaaaccctatagcaacgaacgctttctacacccagattttgtgtactaaataccattccccactaaaacgaagcagagttccttggagaagtgactgcttcctggtctaggatactttattatgccagaaagcaaataagctatcaaaggttaatgagatgattgcaaaagaattgaatgattttctgctggctaagaggaattgcttaatacatttccaacaggataatgactagaattgattgaaacacatcagaattataaaaatctgtgccttcagatggtacttcaaaaaataattggtcaccgttgtatattgctagaacaccagctctctattctgaaagttgctaaaaaaggaataagaaacaagcttttattctgccttcctgttttatttatatttcagggtaaccaaatagctgatgattgaacgtcttctttatagaaaaattttaattaataaatgcaaaaggaaagaatgagaaaattaccatttgacaacccaaatgaaataacaggtgtaggcaattattatcaataggtgttaacagcattaggtaactatcaatggggaattttataatggataaatcaggctgatataacctgaatgtactgatctcattttacctctctaaaggtaggacaaccagaagttatatgcctcctaatatgtaattggaaatataaaccactgcctctaaaggattctttcctaaaaaattaagcctgaatgtgaccaagcttttaaattttactaccagttttcaggaaatatggaggctaaaggaacgtgttaacaaattgaccagcttctcaaataaaatatggaaaagtcacatcactccagaaattttcccagtttactcttcgagccaattcctccttagctcacagagacaattactttccatagatctgtcaccatagattatcacataagtgcagtcatacagttggcatttgtgtgtgtgtgtctggattccttcactgaacataatattttagaaattcattcagtgtgtgtatgtgtgtgtgtgtatgtgttggtttctttgttttattgagtacttcattgcatgaatatcccataatttgtccagtctctcgttgcatatttgtgttttttccattttctggctgatgtaaataaagcttctgtgaggattcttgtacaagtccttttgcggatctatgtttttattttaattgtgtaaattataaaagtgaaattgctggaacatagggtaggtttatgtttaaaaagaacttccaaatagttctaagtggcatgagttctagttgcttcacacctttttcaaaagtgagtgttatctttcatttaattttcccagtcaggctgatatgaaatggtatctcattatggtttttaaatttttttatatatagctttattgagatacaattcacatactatacacttcacacttttgaaatgtaaactttaattgttttaaatatctttccagagttgtgcaactatcatcacaattggtagtctttggctttctaggagtttgtccatttcatctgagttactaatttattggcatgcagttatttatagtattcccttataatttatttctgtgatattggtagtgttggccccttttacactcttgattttagtaatttgagtcttctctctctcttctttatcagtctagctaaagatttataagtttattgatccttcaaagaaccaactctttattttattgattttctctgttgtttttctattctctatttcattaatttctgccctagcctttaattccttccttctgaatgttccaggcttagtttgttcttctttttctactcttttcgagtggaggatttggcttttattttgagatttttcttttaaatataggaatttagagctataggcttctatttaagcatttctgtgactctgtttcataaattttgcttcattgtttcttcattttcattcatctcaaagtactttctaatctcactcatgatttattctttgactcattggttatttagggccatattgtttaatttccatatgtttgtgaatcccctaagtttctttctgttattgctttctaatttcattccattgtggtcagaaattatactttttatgatttcaattattttgaatttattgtggtttgttttatggcccagcctatgatctgtcctggagaatgtcccatgtgcatttgagaatgtgtattctgctgtttctgggtaaagtgttctatagatgtctgtcatatggtatatagttcatttatactgttgttcatcttttcttttttctccttaatcttctgcccacttattctattcatgagtgaaagtgggatattgaagtctccgatttttattattgagttattttccctttaactctatcaatatttgcttcatatattttgggggtcttatattaggtacatatatatttatcatttttatgcctccctgatggattgactctttcatcactgtttcaccatcatctctctatatctatatctctagttttagagtagctttatctgatattggaatagccactctagcttttgtatgattgctgtttgcatgctatatctttttccattctttacttcaaactgtttgtatctttgaatctaaagtgttttctcttgtagctagcatatagtagtatcagatttttattcagtctgacagtctttacttttgttggattgtctaatccattcacatttattgttataatggatatagttagatttgcatctaccattttatttttcattttctatatctctcatgccttttttgttcctctatttttcctttactgctttatttggccttaaatgagtatttttagtgtaacattttaatttctttaatcattttttaaaaatttattttcttagtggttgctgtggggattaccatatacatcttaacttatcagaattcttcagattcatactaacttaatttcagttagatatagaaacattactcctgaatagcatgattttttcttctacctcatttttgcgctataattttatacatattacatctatatgctacaaactttacaatacattgttacaattaattattactttatatgaatttatgtctttcaaggaagctgagaaaataaagagcaagtgctcatttacagagtctgttatcttaaccttttaatttaccatttccggttctcttcatttgttcttgtggattcaagttactgtcttgtgtcattttcttactccaattcatctttgctcccatatacttcctttgcgttattgtcaaacattttacatttctgtatgttataggcacaatgatagaagtgtgttgtgtgtgtgtgtgtgtgtgtgtgtgtttgtgtgttattttatgcaattgtttattaaatcagtgaacagaataaagcagaggaaatatgcattcaggctgtctttcataattacatcattacctttactggagctccttgttttgtgtgtgtgtaaatttgaattactgtttggtgtcacttgatttcagcctcaaaactttcctagcttttcttatatggcagatcttttagcaatacattatcctattttatttatctatgaatgtcttgaattcactttcatttttgaaagatacttttgctgggcataacattcttggttaacagttgttttattttctccttcagcactttgaatatatttcatcccactgccttttggactccattacttctgatagaagtctgctgttaatcctattgaggcatccttgcagtgactagtcagttttctcttgctattttcatgatttttctctttgttgtttctcaacattttgatttttatgtgcttgggtgcaggtctctttgcatttatactatttagaatttgttgagtacctgggatgtatagattagggttttttcgcactaaatttggtaggctttagccattatttctttgaaaaaaatttctgcttctttttcactcttctcttattctggtactcccattatacatatgttggtccacttaatggtgtctacaatttactaagcctatgttcattttacttcattctttccctctgctcttcagattgaataatctctgactgtcttcaagttcaatgattcttttttctaccaattcaacaaagccactgttgatcccctctagtgaattttgaactttaattattataattttctactgtataatttacattagattattttaaataatttctatctctttattgacattatctatttgccaacataccttctctttcctctttaacagtgtacatatttataatattttggacatatttataatagttactttgaaatctttctaagtctgacacctgggccctttcataggcagcttcttttgaatgcttttttttaaatgtatttgttgcactttcctgtgtttttatacatactagatttttttcaaagctggacgttttagtagataatatattttagcaactctggatacttgttttcttttcctctgagcttgccattgttgtttgtttatgtgttttgtgacaggaataggctattttagtgtttatttctacccacagtgtggagcctttggtgttacttttctgacgctgcagccttgggagtgtgcacagtcaccttgagatgatagtagttttagcatgtgtctctttgacttctctcttctgcctccttccttaatctccctgttaatctgtctgcctctgttggtatcataccaagctattaggctccactaactgccaaattattgctccattatttttgacaatgtccagggcgcatgcattcctctacaacctgatccagttaaatttgaacccctttgcaaaggtattttttgaggtcagtctttgaggtttgaccaagagggctcttcttagctgtcttgctctgatcctctctgataaactatctggcctacaatttagcttgttgccatcatggagctgtcagccttctatacctgttttcatgcttacttgtcttttttttttttttttctctgcctattctgtcattaagaccatctaatgaatgttttaaatgataatatatttttcattatagcatttccatttggatatctattgcagtttccatgtggttcattttaaaaatctcttcatacatgtttacctttcacacactatttttaaaaactgctatcacgattatttcaaagttgtgtgataatttcaatagctgggctatttatgaatcttcttctattgtctgtttcctctttttgatcacaaatcaaatgttcttgcttcttcaggcatcatagtttatactacatgtcaggcattctgtgtcaaataacagcacattctttttctttccacttatcagagttggaacactgagtcagtcgtacctgtagatcagctgggtctgggactttttttttttttttttttttttgagacagtctcgctctgtcaccaggctggagtccagttgtgcaatctcagctgactgcaacctctgcctcctggattcaagtgattctcctgcctcagcctcccaagtagctgggactacaggcacgcaccaccatgcccagctactttttgtatttttagtagagacagggtttcaccatattggctaggatgatctggatctcttgacctcatgatttgcctgcctcagcctcccaaagtgctgggattacaggtgtgagccaccgcaactggccgggtctggagctttttgtagctttagtttcattccatgtattaccagcttcgagtgcttagagggaagggtcaggatttttcccttaccatagcttaggctctgagcactgagtggtttctttgtactttatatctgcagtactagctttctgaaccttggagtgctttgaccatgccacagcccggccagcagatgcaggggtcacagagagctacgtttgttttctagtcccactggagtgctccctctgccctgctactcagactttgtagggcatctgtcctgccctcagtaaagacttgcaatgccctggagaggtttctcccagctgtcttccctgcccccagccttcaataattgaatgtccggagttcccaggatagatttctcttgagtttcctccttagccccccactttcagaggacactgccttttacttaggtgaggccccacatatctctggggttcttgcaggtttcttgctttacctccaggaagacctgtacaaaacagtatccagtggttaaaaactcactctgggctgggcgcagtggctcacgcctgtaatcccagcactttgggaggctgaggtgggcagatcacgaggtcagaagatcgagatcatcctggctaacatggtgaaaccccgtctctactaaaaatacaaaaaattagccgggcatggtggcggatgcctgtagtcccagctactctggaggctgaggcaggagaatggcgtgaatccgggaggcggagcttgcagtgagccgagattgcgccactgcactccagcctgggggacagcgagactccgtctcaaaaaacaaacaaacaaacaaaaaactcactctgtggcttgggcttcttcacattctaatctgtcatctggccaccagaatttcattaaagtatcagcaagtttctccttcctccaatctatggcaattccctgttattgcactactgtcaggggtgaaagcagtcagctggcaaatgccttaaatagtgttttctatcacttcatctccataatctggatttcatacaaaagttagtcatatataaacactgagtatctacagcaagaacatcattctcttggagagccagaaagtgagttgttttatgaaacatttctaatttagtcaattttccaaaaatagggaaattatacaatagtcattgcctttgcctatgaaaagtagaaagaagggaaatcaggagaccattgcttcatctgtgggaaacactttctatttgtccttacatatattctttgtttttccataattctgagggataaggaagagaatgtggcagcctgaatgtctgtttgactgtatctcttcacactgtgattctcattttcctaatgtctgtttcagaattttaaagtgggcagtggattatgccagtttctagatcctcctattaccttccagggaaaggaaaattggattcgattctaggggcatgattagcagaagggcacgcccgggtaccgtgactttgttctgaattaaggaagtttgagtaagagaaagcactttttcctgctggactgggctgcttgttgatggctgtgccgttaggagtgtggagcaggatggtgtttcagacagaggtcctgagcaggagagagcaggatgtatggaccaacgacaggcccatgagtctggaaggtggggaaggggggagcatgcacgttgctaatggagagagcacgtctcagaggctgcatcctggcggctttgtggtcatttgttataacagccctaggagactcacatactctccttcaccctctcacagccattccctgtgagaaccagacagagtggctgagttcatcctgatactcaatggacaatggacaggaccccctttttaggacttggttcttcagccccatggcacaatgtgtaccagcaaatgggtttggccaggtcctcttaaacaagcttcaaaattgtccaacttggacttccacagggcttctttctgtggccagagatgccaatacatgtgattttctgcatgcatgtggtcttggctccttggactccaggttggccacgcagcgacagacctgcctctcggtgggagttctcaggaagtcaaatcagatggaaacctgatctgtgtgcacgactggcttcggcagttaggtggtgtgaaaaatgaaatttctactggcttctcttgtccacagggtgaccgctagtggcagggctgcttgctgcggctcctaatctccttgtgggatgccttgggttggatcagtttctcttggcccctgtgaaaggaactcgcggtggaatattgtattcggtgctgcacaggagaccccatttagagacaggaaacttgtgcttgaagggcactctttgtgcagctacagacgattcattcattccttcatttattctgtcaccccaaatctgtctgcatctactgtgttccaggcaccgcacagggcactaggattctggtggtgaacaagaggccggtctcaccctcaaaggcatgtagtcttgagagacacagacactagacaaggaatgacacatgggtgtatgtgaagatgcttaggatatggtgggggcatttagcagggagatttgacccagcttggggtggggtgggggacacagaggcggattctatgaggaagcagcctttaccctgagacctgcagtgggggagcattccctagatgaggaatgagaggtggagaggaatgtggagcaggatggtgtttcagacaggggtcctgagcaggagagagcaggatgtatggaccaacgaaaggcccatgagtctggaaggtggggaagggggaagcatgcacgttgctaatggagacagcacgtctcagaggctgcatcctggtggctttgtagctttgtgaagaaagtgggattttatccttaaaacgaaagggaagaagttggagctgttaagtagggagtgacatgatttgattgcttttttaagagagccctctggaggaaaaggggctggagggggcagggggtacagggcacggtggccgtttctgcaatcgctgaggcaggaggtgctgggggccagtcctgggctggaaatggggagtgggtgagggaactggactaacccagagtgttgcatgaggtgacattcatgccacatggtgacggacttcacagggagggtgaaggagagtatgtgagtctcctagggctgctataacaaatgaccacaaactggggggctttaaaccatggagatgtgttccctcgcagttcacggctctgcaggccagaggtctgaagtcaaggcatcagtagggctgaaacctgcccttgaaagtttctggggcaggatgcccctgggcctctctagcgtctgggggctgcaagccctgcttggctgcagccgtgtcaccgcagcctctgggcgccttcacgtggcctttactgtgcatgtctctgcacatcctctcctcctcttagaatgacacagtcattgggtttaggacccaccataggctagcatggtctcattttaacgaatgacatctgcaaaaatcctacttctaggcaaggttctgggtagacatgaatcttggcaggggaactattcaacctgctacagagagggaggcggatttgctaaggatggctccggctggctgtagcaactgggtggagacgtggaggacagaccgacgccagcagaaggacatcagggccactgaaccagaaacacacatggacgtgtgagtaagtgaggtgaccagacctagtgaggcccccagttcttttcaggttttttgtttgtttttaacaaatgagactgaaaatgtttcggttcactcttacttagtgaaagccgttcttgtgaagctgacatgtagtccagcgacagtgactcaggttagtaagggtgtgtgcttttcatggcgtgtcgacaccaagccctcacgcagagcaggctgactgacgatgccgcgtgcaggaggttccctggctctggggccggctgacctgggctgtcacctcagtgctgctgctttcgagctgtgtggccttgaggagggttctgggcttctctgagctgaagttatttccttgtgcaacggagatgaaaacacttgggaacaaggctgtggaaagacttatagcatggttgcacgtgcttggcaaagaaccagtctgtttagcttgcttgtttattttactgaaggcattatgtataacgattatattgtatattctaccaaacataccaacaagagtgtccaagatgttgatgcatattgaaacgtccatgttactctttagcataatttattgacaactgcttgttttcttgtgattctccctttttcctaaacacttatgagagaaaagccacacttaactgtaagttcttacttattaaggatagtctttatttagtagactgggaaagtggtggtagatggataagtaattaacaaatggataagaaaaatagtaggcttccccacaggaaggagataaggctgtgaacaatccacaaaaggagtgagtgtaaggactttttaattttgagagatattggatacatagttgttatctttctgttttcaaattcccccagcaacccacctccatggccatatccttgttccttgcatcaagcagaatggctcttcctccaaagtgaaccttgggcagcctactctggttacagtcctgcctgccaccgcctccttgtgaccttgtcctcccgccctcctggaggctcctccagggctgcttctcgtagccgtttcctggtgtggcttcagccacttgctgaccctgtctgggtccccaggatcatgcttggcttcactccccattggaccacagccttgaccttctcctacacctcccttcccaactccagacatccccctcctgatcccgggagccagtgcctcactgctggcagaaatcacataaccaagcttcaatacattttccacagccttggcaaaggccaaagggctgcttgccaatccttttgtgtatctcagtgtggcaaagttgttaagaccgtggttcaagtctcacctccacccctcactggaggcaccatacgtcttctgccaacctgccagatgccgcctttcacaagtcagcccctgaaatctgacattgtctgtgaagccttctgtctgattcatcagacgaaagtgaatacccgtgcggtatccattgcgggctgggtgcaggattctcctggacctttctgtgatctcaaccctctcgctggaattaggcacttgctcttgtctccttccctaatagtatactatgcttactttgcacctgatttatttggttttattttataatcaaatcaaataatttattccaagtagtctaaattgaagttttattttcaaaactacaggcataagcagtctttcagtagaatacccactgtagaaaaacttccttaacggttccccttgtgttgcagattttcaaggcttcaccattttcagtgtgattactaatatagcaggaaatccttcaagtatgtggctctctctctacctaggattctttctccaggacagattctcagacacgaatgtctgcagttaaatgccctgtgcttcttgagaaatgatgcagaattgccatttggaagggtcgtgctgacttgtgatgccaccaaagatactcaaaggtgtttgatttcactgcacctctgtgagaattgggaaatgggacagaacatcatctggggatacttaaagaacccgaaggtccttagcaccttgctcaagccaagtaaaatgaatttttcatattacgattttttttttccagcagattttaagctatctacttgggggcagaaataagaaaaagcagatggtaggggcaatgaggttgtggtggagttcgagggagtgattgaatcttgggtgctggttggaaatactgcccatgggggtctgggttgaattggatggaaacaacacttggagaagcctgcagaggggctgagaggggagggagagcctgtgtggactggaggctcaggagatgaagggcgagaggattgggtgcacgctgggactcagaggcttacattcttatgtgtggggagtacagaacccgccacaagctaactctatgttggccatgtttatggttatcagaagtggggttggcgttgaggacatcaaagcttcatgatgccaggggactgcaagagtcccctccgtgggcattgggcaacccaggagatggctaaggagactgaagccagctgctgggcactagtggtttgagtgaggaggaagagaccagagaggactggggcccaggggctgggacttagtggtggagggggctgtgaaggtctgtccagcttccatctgcctgttgtgcatgccttgcagggaggcatggcggcctgagctctctcctcacttggactttctgtggctgaggcagaaataaacagagatggacatcaatatgctggtgtgtgaaggcaccccatggggttagctccaggcagacctaggcattgtgtcctgccatctcctccctgcgccacatctcctgttcagctctatgcaagccacggccccacatgccctgtgagtctgccctctcccaccctgcctaaaccaggccactggtctattttacagaaagatagggttggacatagcatcaggggtcacttgaaagtcacagggctggaatgtcaggtggattcagggcctggggccaccattctgtgacagctgagctgtgggcacattgagctgtgggcaggtggagcagaaggagctcaatttcagaggaagagagagacagagacagaggtagagagagagagacaaagagagacagagacagagagacagggagagagagaaaggaagagaaagatggagagagacagagacagaggaagaaagagagagagagacaaagacagagagatagagaaacagggagagagagagagatagaaagagagtgacatttagagagacagagagagggagagagacctgatttccacatgcagactgaagcaggggcgggagcccactcccggagaggaaggggacatgcagggcaggctcgcggtccaggtcctgagatccagagaagtcccatcacgccccttctgatcaaactggtctgagtgggcttctggtccttacacggtgtaatctttaaaacagtaactgttattattatcacatgaaactgcagcacttccctttcattacctttgagggtcgtttattgaccaacagagagacccatgcttggggagcaacgtccaaggtgcccagcagaggcacagcagtgctgacagtcctgacaagtaacgtgggacacagaccacctggagatctcagcctggaggtgcctcagttgctcagggtgatgagattctattttaagttcccaggttgtcatttaaacctctctcttctgtcttgggatgggctaatggtgagatgaggtgatcgcagggcatgaggcaggggaggttgaggtaataacatcagaagtaaaagtaaaaaatcaaccaaccctctagcccagtgggcgtggctggcccaatgagctgtggggctcccacaataggagtataagcagcaggccctgccacctgggctgctttgccacagggcatttgctccagtgtactctgcctcccaactagcccgtctcattgtctcatttattgacttctcccacttgccttttcatgcatgtgacttgaagacccttggtctaagctgtgaatcctgaacacatgaggccttgtgatagatgcccctaaacatcacaggaaacaaagcagggacaccctcgccatgtaaattcagcttttctgattacaagacagaagggatttttctgactttcccctgtctccagaaattcatgcagaatcctgatttcatcacaactcaccagattttccttccaggccagcctgcctctggggcttaggttttagaccagagcgggtggaaatacagaggtggctccattgccaaggaagtcctgaaaggcttcctgtcctgcttcctttctcttgtgctgtggatggcctttctgtctaagcagatgtgtgtcacgagaaggggcaggtgtgtgtgatggccattcaggcactgctcatgcttccgagttaaaacctcctacttaatcactggctggaaataagcagtgaattctgcagggcgagccacaagggcagtgctaggaaagtcgctgtccttcctagaaccacagttgcttttgttagttttgtaaaggtgagtgtatacacctgtaccgaggcagaggtgggcatgtacacctgtacacagatagaggtgggcacatacacctgtacggacttagaggtgggcacatacacctgtatggggttagagatggacacgtatgcctgtacgggcttagaggtgggcacatacacctgtacggggttagaggtgggcacgtacgcctgtacagggttagaggtggacatgtatgcctgtacatggttagaggtgggcacatactcctgtatggggttagaggtgggcacgtacacctgtacggggttagaggtggacatatacgcctgtacatggttagaggtgggcacgtacgcctgtatgggcttagaggtgggcacgtacacccgtacggggttagaggtggacatgtacacctgtacataggctccaggctcttcctcctgcaacagtgagctgcctcgtttgggtcattggcctttctcacagtttgcaggggttgtgcagatacagctccttgctcagatgtcatttcaatttgtttcctgggaacaaagctctccaccatttaagatacatctcttttctctatgggaccctttgtccatattaggccaggtcctctcaaagctccttccagttaggcagttcaggaaatgacatgtgccttagatgacaattcaacagaacaattcaatgcctaagtttttaaaaaattattacttacttatgagccagagtttctttcttgttgcctaggctggagtgcaatggcatgatctcggctcactgcaactccgcctcctgggttcaagaggttctcctgcctcagcctcccaagtagctggaactacaggtgcccgtcaccacacacagctaatttttttattttattttattttattttattttattttattttattttattttgtatttttagtagagacagggtttcaccatgtcggccaggctggtcttgaactcctgaccttaaatgatcctcccaccttggcctcccaaagtgttgggattacaggtgtgaaccactgcgcccggcccaaagcctaagttttagtataagactgatgtgtcttcagatgctgcctctgccatttgcatgctgtgtgacttcagcctggcagctcaacctatctgagcctcagtttctgcagctgtaaaatggggaccagaactgtctctactccctagggttggagggagagccctcagtgtgacccccggtgtggagtagggagggtttcagcactgaggagttttctcagcattccctgtctcaagactgtgttaactactgaagatggggtcaattactgacccctggggacttaaaataatcagtgccgcttttcctcattgcctaatttattatactcaagaagtggcctccaaatgaggaaaacctgatccatggccaagctgccttgaaagttttctttcaattcttttggtaacagctgtattgagagataattcacatatcgtgcagctcacccattggcagtgtactgttcaatggttttgagtatgtgagcagtgttttgcaaccatcattgtggtgaaatttagaatattttcttctcctctaaagagaaccctgtgtccattaggaatcacttccattttcctttcccccggcccctggccacctgtaacccgctttctgtttctttagatttgcctattctggacacttcatagaaatggaatcacatgacatgtggcggttatgactggcttccttcatttggcatcatgttttcgaagctcatccgtgttgtagcatgtgtcagccctccattcctttttatgacagaatgatattccactgtctggatacatcacactttgtttccccattcatcaattgagggacgtttgtgttgtttctattaattgttttaacctaaattgcctttcacaacgttcttgttttgatgtaactgtctgcttatcaattgtagagttcattaattcatctctctatgtgcccagtgaatatttattgagtgcccagtaagtcttgggtgctgtgcaaggcattttgatgaatctgtgaactaggcaggtaagactcttgccatcacggaaggtcccattctagtgggggccatttaggtgctgctctttcttctgatctttagtggatgaccaacaacaaatagctattaatacacaccatgatgtcggtgatgacgaatgtggtgggaaatggagctgcctacagggaagaaggagtgatgggtgctgtttcagatgtgggcactgggaagatgtctctctgggcagggcaatgggtgcagagccatggatttcactggtctgggtcaagttcagaaatgggtggactatgatgaacctctgaagacctggagatggggccaccttttgaggcagaaacctctcttttgtcctgtgagaagtctgacttggcctcacagggtgcagtcgtcccctgccctggacaagctcatgtgaatggccagagtgtggacacacatccaccaacctgcattctcaattacgtggaagcctccatgttctctctgcatttgaccttctctggagggtaaatgaggacaggcatctgccgggggtggggggggggggcaggcacttttactgtttccatcctgcaaggtccggggagaccccaggcttttctgtcgttaaggtgtcctagagggagcattcaagcttatgtttgttggacctgtgacagcacgtggtgcttgtgtttacagcctgctccatgttccatcttctactgcacttggctatttacaggtccatagacccagatggtgctgtggtttctgtctccagaacgcctccccagtccggcacttattcccactctcactgccatctcctgggcgttgctcaccagcaccttaaatgttcttgccacttctcctctgcaatctcgtactttctgctcccagaccaagggctagaggcatgctttctgtgctcatgtgcgcatgctttctcagcaaccttgtgaggctgccccaccccctccacagctcctccctggtccaatgggagagagcatttggtttcagagagaaccatgtggttctccttctgtttattctgagcttttttttcttcatttagcatcaattcctgtcatggaaaatcacaggagccaactgaagggggatttccagaatatttggccttccttgggccttggtgaagtggcttccttggcctgggcaagtggggctgtgagcatctgtacattcacaagaaggctgggggtgcggctccatgctgggtgagcctcctctctccttgccggggaagggctagagtaagagtcggtttctccaaagtgatgatgcattctttctcttatgggtctggcttggaagccacagaattcaaaggcagtgctgggaggtggcttagccctcctctgctttagttggtggaaaggaaaggtagaaacctgaggtcaaaaacaggtggcccgtgggcctaggtcagcctgcagacttggttggtttgaacacagtgtttgtgtgtttcattgaaccaacatttaaatgtagggagatttcacaccaatatctggattttctttctggcttggcttgaaatactcagagctcgggtactgctggctattgccaggctagagggttcatgaggatggaattgtccagctgtgatattggctgtctccggggcctgcaccatgcctggtagatgaggtccatccacttaatgaaggaacggactggccatggctcttgccaggctgcgtggctgctgcctgctccaggcaggacctgccttctccagttaggccaagtccttgactacccacgtggagaatccacacctggttcacctcacctacttacctgtgtatccagcctggcctctctaggacatctgcatctggtccttgggagcaaccgtaggcatgaggaatgtgctgaaagggatcctcctttattctgaaatgtggcccatcaggcctcagctagagattcttccctaaggaagtctggagtcccgtggctgtaaccacagctttcagaagcggttctcaaatgtgggcagtttgggcaccgtctggaggcattttcagttgtcgcagctgggaggcatggtgccactggcatctcatgggcagaggccagggatactgctaagtacccccacagtgcccaggacggcccccgccacagagcatcatttagcttcaaatgtcagtattgctgaggctgcgcatccctgcgttggagtcacagtgccctgagtccctgtcccaatgctgcacttgcccttgaccttcctgcctcctcgaacctcagtttcccatctctaaagtggagtgatcctcacatgcacctctctcagctagatggagaggaaacgccatggcctgcatgtagaatcacactcagtggtcggggttgcagctctgatatttggggaggccctagccatgggggctaggatctgggctgtggaatccacctgtgtgactatgggtgggtcgtatgtcctcctgagcctcagtttcctcatctgggcatcaagagaggaatagggcagcctctaaggatgtgaggattaaatggtttaatgtctgcactcggcacatggaacctgataaacgtgcgtgagcagcgccatcctgactcagcggtgtggttctggggtctcctgagacaccactgtgtgcccgacacccagcttgcggcctccttccctccaccatctctctcctcatccacgagtcaggttaatcctcccccttgaccccacacaccgcagcaaagttttaggaagttgcctgtggttgccctttggtgtatggactccagggtggctcctgtggaggtgggaagagccttgggggcttccaggcaagagaggtgagtggggcttagcctaggctgtggtggtggggttggtgaagagggaaggaattggagagaggccctggacacagagcccagaggagttgcctgcaggttggatgtgtctgttacggtgagctgcaagcaatctgagggcaggagggtacctcatctccctcagcgtctctctagtgtgtgaggctgtgtagtttgtggatttgaatagacttggagcttttggggcatcttcctgggacaacctcaatttatttggcatcttctcagagtttatctgtgggcatggcaggagtgaccccagactgggttcagccctctcttcctggctgagcctctttgggtcttagtctgctcatctgtagaatgggaatagaatccttcactctgtggcctgttgttttaagttttcaataagacctggtattggaagcccccatcaaagtgaggagctcatgaagcacaggcgttgggcaccagatgcaggatctcttcctgatggccgagcaatgtggcgctaagcggggtgtctgcggttcgccccgcccaggtcagcagcacgacaaggggcaggccttggattctcttagacctgctcacagcctgggcttctggggccctgaatgtggccagtgctcaggtggttgggagctggcctggcagcacctggggctcccaaacacaagggaagacaggcagctgggatggtgaccctggggaccctgctatcctgtggaggccccaggattccgacttgtacccgggcttgcttggtgctgtcttgggactgtctctgggctgggacagtgagctcttggatgggccctcggctgtcagtgcctcagagctgcagaaggtcagagccaggcctggggtggaccaagtggtatctacacccctcccaaatgtgtccgaactgggtagttttgtgcagctcactctgcctctctgagccttggtttcctcacctgacctgcacagtggaagaggagaagagcctgacaggaaggccggatcaagctggtagggtttcagtgcaggccctggcagagcagccccgaagcttgggaaggccaggaaatcccgcgctggtctccagacctgcctgcccgaggagtcgagcttctgatgaaattcagctgagatttcggttttttgtgctctgtaccctgacaaggggcaggaatcgggagccagcctcggctgtcagtgtcctgggctggttccctcccacctcccgcttaaaggtgtcattagcaagggcaagacgtcttctaacaggtggaaacaacttgtcaagacagcctgtggctgctgcgtttagagacccagagaccctgaatgtggactaacgcccccagaatgttcagaattaatgtgctgccccaggcagtgctggggcggggggcatggctctgactcctgcccttgggtttgccccactctgccctcttccccttctcctgttccttccccttctcctgttcctccttctcctgttccttccccttctcctgtccccccttctcctgttccttccccttctcctgtcctctcttctcctgttcccccttgttctcgttccccttctcctgttcccccttctcctgtccccgcttcttctgtctccccttctgttccctccttctcctattccccgcttctcctgttccccccttctcctgtccccgcttctcctgttccccccttctcctgtccccgcttctcctgttcctctcccttctcctgttccccacttctcctcttcccaccttctcctgttcctgccttctcctgtccccccttctcctgttccccctcctcctgttccccccttctctggttccctccttctcctgttccccctccttctgtttccccccttctcctcttcccaccttctcctgtcccccacttctcctgtttctgccttctcctgccttctcctgttgccccttctcctgtcccccgcttctcctgtctctgccttctcctgccttctcctatccccccttctactgtccccccacttctcctgttcctcccccttctcctgttcctccccttctgttcccccctctcctgttcccccttctcctgttcctccccattctcctccctgttcctcccccttctcctccctgttcctccttttccccctctcttttcctccccttcctattcttttccctcttcccttccccctcctcccctccacttacccctctccctccctattcttttccctcttcccttccccctcctcccctccacttacccctctccctccctgtccttctccctcttcccagctaattgtattgaggctgtaccttgtgataggaactttgggtagctctcttagctcatatcacaccatccctggggaagggtaccccattgtacaggtgggtacacagaagaggggagagatgcccccactacaatgtgctgggagcagaatttggacctggatctgagtccagctcctccatcccctgcaggaaggatctgggctcttggggtgtcagggggcaactacctcttcatagcaaagcttcattcgttaagttcctggttctgggctattgtccctgtctccgaggatcagagaggtgaagtcccctgcctgggttcagatggttatggagtaggggtcctggttcagacccatggctgtctttcttgccagcagcacttctttctttggggtgatttttcccccaggggacactgcagtgcctggagacattctggttgttataactggggtggagggtgcttctggcctctggcatgtagctgtcagggatgcggctaaacctcctgcaatgcacagcacagcccccaccacagagaattgtgtggtcccaaatgtcaccagtgctgaggctgagaaaccctgcaccaggcccctccccagctgaccctatgttcctgcaactaagccagcagtagacatacctgcagcagcaggtgttggtgctacaggtgaccctaggtcctcgacctccccatctgtctgccacctgggcctgggcctgggcccggaataaaaggtgcaccaagggtccctggcttcagcattttttgttttcaggttgcatatcagactccttcttgcctcctgaggtcccttgggacttggctccaggcagcctccctgatctaagacttcagcagccgcctcaggactctgcatggccaaggtcccctctgccccaggtcaccaaggtcattgtggtagggaaggagaagagagggccctaagaaaaactccagtcccactagttcctggaacttgcctaaggccaggagaagttgctgccatcgtgggttctgtatatgggattcaggactttggttcaggtggtttctgccaggctctggccagatgccagcctaggcagtgtcctggcagtgctgagtgacacgtctcgggcacagagaggagtgggcgcctggccctgagcagaggggaggcttgttgggggccagcacttgatccactgagccggaccctcagaccctgggttgccctcctcacccccacccccacctcatctctgcttcctgcaacatctatatttaaaaatgttgacagataataatggtgttcagccccaaaatgcagacaggagcttcctgacaattgcagtgctgcgccgggttggaggttttctcagggagcggagcgagtccccaggagcaagtgagagtgccagggctgtgagggctctttgccaatcttgacctttcagggagatttgagagaaagactccagaagcccgcggggagagcaggggttctggggaagataaagcccttcatccaggatccctctgtgaccataaggtgagttgctttgccccacatctctggtgaggcagagggcagggactctgcttagggagcaggcttcttaaaggcaaagggtttgcaaattctagcagcagcagggccctaagagaatggctttttttttttgttcttgaatcggatgactgcatttggagtctggggtgaggggtgggggctgcccctcttggagccacagatgggtcatttttatgtatcaagggagtcagaccaggatcagccctgggtttctggcacagagtccagaaagagtcacgaaggtcttttgtttgcatgtgaatggtattttaacctattacttctgggctaaaaataaaaattcccctcagatgcctttttgtctgtagattgtaagatcgtttccaggaaataatagattgtcattgatgtgcgttttgactgcatggtgtcctattcttaagccaggttttataaaaattcaaagtagaggaggtttcccacagtggagattgaagccttcatttagtgtcaggaacatatgctccactatcaggagtcattgtccttccgggatctccaccactgaaccctgggtgggagtgtgggagtgggtgagggagaaggcacacttggcttttgtgtggttttacatttggtatcatttgtggacttttggttctgaaaaatggtttgcaagtgaagttggatgtctggagttggggcccaagaaggcgatggagaagtgaattctaattcacagttaatatgggtcatggttaagttcttggaagcaacattggtttccaaaggtgcctgctgcgtttttaagctgcaaggttttatgtttttttgacccagtggaaaatggcgattcaggatcccaaggacttcaggagaggttgtctgaatgctaaaaccccttccctgaaatgcttgctttctttttagaggacaggaaatatgggaaattaacagtccttttgtggagtgtggtttgcgtgttgttctttgaggaggaattacggaattatgtgcgtgtataatgatggtaaccacatacacaatcgaagaataacaagtcagaaaaatccatggtgaggttcattcagaaataatcaagagtgtattgtttaattaaggagaggatcagaggaatgcagtcccagagccaccatttcggttgtcacctaggtgcaactctcagcagaaggaagcattcccaataagatgttctgaaaacgtactgccgttgaatctcacaactttcaccccacaagctgcaataagaggccagtatgaaaatgcgctctttcttccccatacattttcttctgttcctgagccgagcccataggtagcttggcagtttgcaattctctgtctacacggaatagatatagatttttttttcctgtatgttttgggtattaactctttggttgccaagctgttgagccctgagtctatattatacaccttcagcccgtggcttacagggcttcaacacatcgttgttatataatgcagtagttttgcttgtggggtgactgttcatatcgtggatgctcagaaaattctatttttaaagtataaaataccactcttcagagcagcctgctcactcctgcctccctgggagccacacgctttgcaccgtggagttgttggcatgaaggcacatgacatatggatgggagtgcgttcctcctgtctagggcctcttaggacccgaggaatggctggaggcagtttctctccagtcctgaggttgatgatccgaagctcttggtgctgagcctgtgctgctatttttagcttcctttcttccctgcatcttgacataattcgacatgtcgcagctgaatctcatctacttgcagagcttaccgtgttttgtaatctgtgttttgtggggcagaaatagtccttgccagagcatattatatcattattattcagggggaaagttatgatactatcaattaactttagaagatgcaaaacacaattgatcctttgattttctttctactgctaatttcctggctgggagcacctggagggtaggcactcctcctccttctgccggaccagaaggcagcaagcagtggttctcacatcttgggaacctgtatcagaagcacctggaggggctgttacaaaggcaattgcagccccactggcagagtttctgagttagcaggtctgggtggggtgggggggcaagtaatttgcatctctcacaagttcccaggtgatgctgacgccggtccagcactgcactttgaatcacagatggagatcacggcagagggttggtaaatatttagggggtggacgatgcctacatgcagagagccaatttaagaaatatacagatggtggagcaggagattttcagttgttgtgtatcctgtccacgcggttgaagatggacttgattgaaaaagaaattaaagttgaaataaaattagctgactgagaggatggctcctgacagtgtccaatgctgtgatgttatttagggaggatgaagcatcacgactcagacaacttactttgagatggccaacagcacacacagacataaatgaagtgcgtgtacatgcacacacacgaaactcagcaaaatattaactgctgaaacaataggtgttcatattattctaatttcatactatttctatttctaatacttttcttcataacaaacattgtattaacatggcaaacacaataatagggcttaggacagcttttcttgtgtgtgtgcttaatagtaaatcaaggtcacccacatgttcacagctgtgttgctctgggtggcatgggcatcggtactgtattagtccatttttacactgctgataaagacgtacccaagactgggtaatttataaagaaaaagaggcttaatggactcacattaagcctctggggagccctcacaataatggcagaaggtgaaaggcatgtcttacgtggcagcagacaagagataatgaggaccaagtgaaaggggtttccccttataaaaccgtcagatctcatgagacttattcactaccacaagaacagtatgggggagactgcccccatgattcagttacctcctgctgggtccctcccgcaacacgtggaaactataggagctacaattcaagaagagatttgggtggggacacagccaaactgtatcaggcacacgcatcgctttagggagttctcatttccttccattcaacctgatcctttatctgcttgttctttcctcctttcccttccattctctttcactccctcctccctggcttccctctcttctgctctccctccctccttccttcttcctgtccccatctcctgtcttctggtgactctgggtcaaaggaccctggtccagaagggttccgtgtggggatgtgttgtgctgaacccctgttaacctcagtagggaaggtaccaggttcaagaggccaaagaagagacctggagccagcaaacaagacatacagttttattatggacttacatgcagggaagagagtccagtggtggcaggttgaagagaactgtcttaacatacagaaacggtccagtggtggcaggctggacaggagaactgccttaatgttcagaaacggtccagtggtggcaggctggacaacatatccaccttcctacagtctggtggtggcagactgggcaagaaaaccacaactgcaaccgcctgcgaacatcatgcagtttacgcagcattttcatttagcaccctcctcctaacagccctcacctggcaaccttcatgtaacccaagcttgtccaacccaaggcctgtgggacgcatgcagcccaggatggctttgaatgcggcgcaacacaaatttgtaaactttcttaaagtgttatgagatttttttttttagctcatcaactatcattagtgttagcgtattttatgtatggcccaagacaattcttctttttctaatgtggcccaaggaagccaaaagattggacacccctgatagtaacccaaaactcagggcctcaatcccctgtacagcccgtgttccacaggacaggccggaggctcagatgttgtggtagataggaacagatctctgggtgggccactcccggattccctagtttggaacacacattcaggtgcacctgtcatacagggtcattctaagggtatgcttaaaatattgatgtcaggtgtgtttaccctgcaggatgctgtggcatctgcccaggaaaaagttgaattatgccagttattgttttcccagggttttcaggctgcctccttgttttttaaataaagttttattagaacacactcacacccatttacttacacacttctctggctgctttccagcagcatagctgaggcagagaccatagatccacacaactgaaaatatttacttctggcctgttgcagaaaaaatttgcccatgctgatttgtttctgtgggctggctgtcttggagattccacacgtacacacatgtgcacatgtgcatacatactcatactaaggacatgcagcaagacgttaagggttgtggagtctagagtacatgtgattgttcattgtaccattttttttttctactttttcacgtgtccaaaaaatttgtaaaacattttgatgactgtggcagtgaccaccccagggtctctagaggaatgccacaggggtccatcccaggttctgagtcttcaacatttgcctcacccacttggcaggttaatcaaatgggtagatgacacaaatcaataaaagcattaacaaagtgtcccatatattcaagagccaaacagatatctcaacagactgttagggaggctgagtcaacaaggagaagtttaatgttcataagcttcaggtatccagctcagatttacaaagatctttgcccaggtcctgcaaggagcagactttgataggaatcaggcctctgggccaggcatggcggctcacccctgtaatctcagctctttgggaggccgaggtgggtggatcacctgaggtcgggagtttgagaccagcctgaccaacatggtgaaaccctgtctctactaaaaacacaaaattagctgggagtggtggcacatgcctttaatcccagctactcaggaggctgaggcaggagaatcatttgaacccagggggtggaggttgcggtgagcagagatcgtgccattgcaccccagactgggcaacaagagcgaaactctatctcaaaaaaaaaaaaagaaagaaagaaagaaaaaaataatcaggcctcttggctggacgcggtggctcatgcctgtaatcccagcattttgggaggccgaggcaggtggatcacttgaggccaggagttcgaggccagcctggccaacatggcaaaaccccgtctctactaaaaatacaaaaattagctgggtgtggtggcgtgcacctgtagtcccagctactcggcaggctgaggcaggagaatcgctccaacccaggaggcagaggttgcagtgagccaagatcatggtgctgcactccagcctgggcaacagagtgagactctgtctcaaaaacaaaaacaaacaaaacaaaaaaaagggaaagaaatctggcctcttaatggaaccaaagtctgcggggtccctagagtgtgtgcaaactgttccagtcactgggacatcagtgtgcaaagcctcctggagcttgtgtgctagtgggagaggacaatgaacggcacctataaccagtaggggatcgtcctgcatgttagtaataagtgttgtgggaaatgaacaggagaagtagggggaggtaagagaaggtataaatgtggtaggctgtagacatttgagtattacatggagtgtcaggattggcatcattacggaggtgacatttgagcaaagccgtgaaggcggtgaggaagtgagccatgtggatatctgaggcaagagcctttggggcaaagggaaccttcagtgaagacgccccgaataagagccggcctggtgggttccaggaacagggaggaggagcccgtggtggctggagtcacatgagattgctggggagggagacgggagagaagcagggacattgtagggaggggcctctgccagcacttgggcttttgctctgagtgtgacgggtcgggggggacattggagggtttgagatttaattatgattcatcaaataacttgagaacaggctagtgtccaggtggactgaccagcctagcagtcattgctgcaatccaggcgggagatgatgctaactggccacagtgaggttgtggacgtggacacttctagaaggtagaatgatgcagttggctgagggagcagatggggaaacagggacagtggagtttcaagggaggactctcaggttctgtcgtgagtaacagaaggatagagcgttggtcctggcctatgaggggaaggccgtggtggagcaggtttcagggagagagcagttcaattttggctacagtgaatttggagcatctatttgacatccgtgcaaagatgacaaattggcaattggctgcacaactctgtgcttgggagagaggtttgggctgaagctgtgcattcgggaggccgcagctgagcagaagctgaatgtgagctaacgcgctctctccctgacttagtcatttgtctgccacctgtagtctaatttgccaaatactttcttttaaaccaggtcttttttttttttttcaaatttaaactcattttaaaaggatatctatgttgcacttttaagtagaaatccaatattgcttgcctttgataaaaggtaaccataaaataaaacaatgacaacaaaacaacatttagttcaagttaggcatagtctctcactaaggattttgagccagagggtcttatgtattatccaaacacagagatcaacaagtgtcagatgccagggtcgtcataataccaaactaagactctcctcttgaagttcttggaagattggagggaaattggcaagaaattagcttctgttgctttgtcctgggtccacgaatcccttaaagtccccttttaccctgttatgtgcctggcccttggggagatgctgagctgagcagccgttatagtgggtagaagaaggaagcttggggtccagcttgaccctctgctagaggttgggtttgccttaggactatgtattttctgaaaggcaaactgcaatttgcaagaacgcagagaggggcaatggctgtttattctagaacagacttgggggatgagaaccttggaaagaaagggtgggatttttcctgcatggttctaggatgtggccctgcagccagctgggaaggataaaaggatacaagtgggttggtttcacttccctctgggcacaggctttctctctgagaattctcactggggctcatatcttttaaattaagtagtctgctcctgaataatatctttctttggggctgtttctttttcagtttatatattggggtccctttttgacattataggctttcctcaaatgcctggtgagccaggatcgaccttgttcattgcagaatgaagcagcaaagagctggtgtgtgctcacggtgtgtttcagctggtgggttttgtttcaggttgcccaggcctggaggtggccttggtgctgaggggcctttgcagaaccttctctttgtggctggtctggagacaggcaaggatgctcctgtactttttgcctggagatgggagttgtccatgttatctgcaatccaccctaggctgatggtgagggagggagtctgctgtcataggaagcatgtaaacagactcaggcttctctcagcatgagaagggattttggatctctgaggtccttcctactgtggatttgcagtttccctccacaacctcacccgcaggaatccggaagcgcctgatgccttccctgggctgggagcccctagagaggaggatctgctgagctgttatgacatcgtgcccacaactgtgcaggcatttgggagatgctctgaaaatgcccgatgaagggttgtgaggatgaaagaatctgctgctgaacacaaactgctgggctccaggctactgagcccaacttattccatggcccagcatgtcccacggctcagcatgtcctgtggctcagcacgtcccttggcttcccatggctcagcacgtcccgtggctcagctctcactcctttgcttctgcaggtcccttggtctggcgtgtcctccccactcttcctgagttctctgaattctacttgtggctccagggccccctctttcatgaaaccttgactcaccacctccacctctttccccacctcacccaccactgtcctgctcttggggccctgcacccacctcctgctgggcccctgcttctgccctgcagtgctgtggcccccttcctgcccagcagctgggaaggcatcctgaagtgcatatcagatcttgccctgtccctgcctcccattgcctctggaccacagcctctgagatcctgcctgccttcctcatcttgtcttccattcctggggaacagtggccacatagccaggtggctggcagcacggacttgggagaccctaccagcctgggtttgaaccctgtctctaccgcctgcttgctttgtgacctggttcctcattttcctcatctgtaagatggtggtgttgaaaggacccgtctggtagggttgttctgaaggttgagatattcaaatgctgagaacaccacccagcacaaggctggtgaatgctccaggagggttcactgcgccgttgccattttcctgttgatcctggagttccggccactctggcctctgctcacatagctggaactcgtcagaccatctcccacctcaaggtctttgcctctaccgtgctgtctcaggacactcgtcccctgccttaccattcggtcagcccattatccttcgggcctcaggttgaatgtcacttgctgagagcagccctctctgaccatccttttagagtggcttccccgcctcacattccccgttacagtctggcctgattgtatctgccagtgggttctgcttcccccaaccacaacttgcccatcatgagggggcagccttgcctgttgtcccctgcactgcatcaacactgcctggaccagaggccctcggtaactgccagttggctgaatgaatgcaggaatgaggcatgaacaatgcaaagatgctgaaccatgacatgagggactgtttcattcatgtggcatgggggtgggctaccccccccatacctaacttttccaatgtgacggttttccttctgaatttataaggtgcccaccttaaagacaggaattcagctcatatcttttaatagaccctgcaaggtatccagttcctaggacacagcattttgttggttattgaatgagactgaagggatgagaagagtggccaatagcatggagctggggcctaactgcccacgtgtggtcttggtccctagtatttattagccaagtgtccttggccaacttcattttatgccacaaaacctcagtctcctcatctatacaatgggaataataataataccttttctagagttggagggaggattaaatgagtcagttatgtttaaagtcctggaacagtgccaatgcccaccacatagtaatttccatgtaaatgtgagctgccatgatgatggtgatgatcatggttgtgatgatggtggtgatgattgtgatgttgatggtgatgatgatggtcgtgatgatgatggtgatgatgatggtcgtgatgattgtgatgatgatggtgatgatgatggtggtgatgatgatggttgtgatgattgtgatgatggtggtgatgatgatggtggtgatgatgatggtgatgatgatggtgatgatgatgattgtgatgatggtggtgatggtggtggttatgatgatggtggtgatgatggtgatgatgatggtgatgatgatggtgatgatgatggtgatgatgatggtggtgatgattgtgatgatgatggtgatggtggtggtgatgatgatggtgatgatggtgatgatgatggtggtgattgtgatgatggtggtgattgtgatgatggtggtggttgtgatggtgatgattgtgatgatggtggtgatgatggtggtgattgtgatgatgatggtgattgtgatgatggtgatgattgtgatgatggtggtgattgtgatgatggtggtgatgatgatggtggtgatgatgatggtggtgattgtgatgatggtggtgatgatgatcatggtgattgtgatgatggtggtgatagtggtggtgacggtgataatgatcatggtggtgacagtgatgatgacgatggtgattgtgatggtggtggtgatagtggtgatgacgatgatgatcatggcagtgatggtgatgatgacgatggtgattgtgatggtggtggtgatagtggtgatgatggtgatgatgatcatagtggtgttggtgatgataatggtggtggtgaatgtgacggtgtgatggtggtaatgagggtgatgttgttaccttgtagtagatttgaaaaagtggaatagagtggaattaaagaaaacactactgagttaataagaagaaaggtagggcgcaggaagtgtttgctaggaaatggaagagtccagcttattccagtatcagttgaatgcagcagactcatgaactttactgaaaccaaaatttaccgaagctgatgagaggatcatgatttcccagagtgtggactgaagcctccgggaggtgtcagagatgattttggagtagtgcttttcacaccctctgtaaaataggacccatttaaaaattttcaatctgttgcaaactgataatttcattaatgtgtagagaaacattttcacacttcacccctaagagaaggtttgtggactggtacctggaacagatacttatcttgtagctgccaccaagaaacactttccagatgggcaccgtagcaggacactgtgctaggacacgctttgagtagtgctgtttcagatgaaaatcacatcacatggggctttgaatttcacagaatcctgtggtcagctggttgctcccctgtgaattatctttcagttgtgtggttgtatatggaggagaaagttgtagtttgtggctcatgtgtcactgactggtgatgttggatgatttctcttttctaacaagcagagagcagcctcaggcacagaacccttgacgggcatggggtcttgccagaatggaattacactgacttgtttccattgcatttattttgtggccacttaatatttttggatgttgattctgattttcctattagagccaagatgtaaagtttctttaatagataatttaggtgcaaaaagtgagttgccttaaaacatagtgtacattatcatgcagctacgagtgaatatatgacaaaaatcatgaaagtggtacaagacaaatttgcagagaactctagtggaaggcaggatagaggagtgagaatagaccaaatggatgtttggggtcatttgggggccatgtaagcctctcccccttatccctggtggaacagcattaaggacatcctctccttcatcccaaacatctgctttatgggaaaccacaggactatattgttagtagtactgggaaagcctagtcggctttatcttttggattctgagaatgttgtcagtgatcatgtttctctcttcactggagttgctaggagttccagcatccaatttcagctccaacctccaatccttgcacagaaccctacagtacgtgttttgtgtattgaagccacagaagcatgtatttttcctcctcattctctccctgacctttttttgattttgttttttgtttttttttcttaactgcagttacatttttgtaagctgtgttacatcgttgtttggaacacagtgggggtaatgcataaatgctgaataaataaataatgatgaaactttttcctcaaactgtgagattggggccactccattgttagagttattttaatgtgatcaggacaaagaggccaagagtgttgtaggaagtaagctttgttctcgtgggcttgggctgggcaacgctgtggttgttgggaacgctaatttctgttatttggtggtgctcatatctcaggcctctgtttaagaaacaacatagattcctccaaggcacatatttgcatcctgtgtgggccgaggtgcctggcttcattctttctctagatacccacactatctcatgggtatttttaaatgcgtgtcttaagagccaacttctctgctgtgtgcaggcttttcatgatgccgggagagttgccacgtggatttgcaggcgctgagggcagaaacaaggaacaggcagcatcagctcaatgggtgggacccactgtcctttcagcccttggtggggcggccttggaggaagggtcattctccaagcagggcagaactcagttccaggttggccagaaggccaaatggactgtggggcaggtctgaggccaggtagtggggcgacccagaagcaggaagatggtgtgtcaaatgtagagtgagacagaaatggcaggggctgaggagttgttgagtcctgttttttcacacttgtgtggggatcttgaggagtttcgtagaggtgccgcagggtctgcctgttgaggagcaaaccaagctgaccgggttacaggtgccatccactgtcccctcccatctgattggtttggatactaggatgttgtgtggattctcctggagtccagacatagccagtgaaacaatattgaaccccctgcaatagtccagccccatcattccatttcataaaggaaactgaggccttgccagggatcccaaagtggtaatccctcttgtagagttccaggggagggcaccaacctctacctagctactgaagccagaaacctgggcattcacctgccctttccattttcctcctcatccccatccctgccacatccctgtatcctggcatctccagccttcagcacctctccaattcatctgcttctcattacccccagccacaccaggaaggtccaggcccccttgtctgtgcgctgggaggatacagatgcatcctgagccttccagcttcctctgttgggcccatctaattgggtttctgctgggcgatgggagtgatcatttgaaacttcaaatctcattatgacagtctatatcccttcctcaatgttcccatcttgtttcacatctttcagtggttgctcatggcttgtaaaatcaaaacaaaacaaaacaaaacacccaaattcctcaccaagccccctcctgcacctctggcctcatgatggcatgattctttgagtctggggacctgagcagatggtctgagctgtgctagaactctaacccacaccaccgcctaccatgcacaaacacagatgtttgctggctgactccagctcatcctctcatcttagcctcagcatcacttctgcaggaaggccccttccaatctcaccagggcccatcacgtcatcctgtctgatgccctttggcactctgggctaatcctttggggccctcagacgccgtccccactgtcttagttgtctggtttgctctctctcttcccctactggattgtcaacttcctgagagccaaggtcacatatagctttagcctgtgtcccaggccttcagcatggtgcttctttgggcacaggaggtgtgtgcagagtggaaggagaccttcatttggtggggagactgtattatagagaagtagtttcatgttccaaagaacaagcaggaaatatcttccttctcctcctctttctgctagtaaatcctccttcctcctcactggctggatgaagcatctcatggtggaatagtttcagatccagggttcccaggaaagggaaccacctccagttccccatcccctttcctttcctgggaggtctctggtgcttatgctactaataatgaacatttaactaatgagttgctacctgttcatattaccaaagcctccctgccaaaggccaccagagacattcctggggtcaaatcagattagatttatggagcttcctgcatcacagggtaacacagtattgagggccatgacaacatcccaatatacaggactgggagaggcttttttacagggcttgagtatgatctggatgattctagaagaaatgaaagaagcaagggccagctctatctgatactatcaagaaagaggcctcccactataggatatctcagtggtctttgttcaggaggttggaggaactagttgaggctgggtaagtgcaggatccctgcccgtggaggggacatcagtcacgtttgtagcttccatgtggcctcgggtgtcctggcggagaccttggctctcctgtcagaagcttcctctgattgtcaacagggatgattttattttactctttatgctttcatctttcatatttaaaactttgatcagtctagaatttcttttgatataaaatgtgagggacagagccaacctacttttctattttagattgccatcaattgtcccaactccatttattgaatgataatcgcttttctctgattttcttgcctcctttataaatatattagattctatacaattttgtgtctatttttggacttttcattttgtcccattgaattgtgtctatccttgcaacaaagccacattgttttaattattatcactatattatatgttttaataacagaagtccctttccctcataccttattcctcttgcagctttttctagttcttcttgtttattttttatataaattttatcttatttgctatatgtcttttaaatatctgataactttagcaggattttagttgtgtaagaattacagaattttaatcctggaaggatgctgaggaggtttctaactctctcattttctggagaggatatgattttatcaaagtgatgctgtgagtttatggcagtgagaaaccagggaatccccaaccctgaacccacctccagatccactcgccccaccaagcctccagcttttgaccctgcatatttttaggtacccagaaattacttaatatttagcttagtggactgccacgatttaaatttgaccttttaaatccaagcacctccttctgctatgttgcttttagaagaaaggacaaagctgaggaattcaacctttgtttccatttatctcttagccttccgagacaggacgcaatgtagccaacaccactcctttgtctccatggtcaaagtcggaaggaagttctttcagaggggttggcttcattgatcttgtggggaaaatcttacaagtacccagggcatggtgtttgataaggaagtgagtggtgtgaaatccaggctcaagaacaaaagccctacaagcctgtacccaacggggccactggcctagaatggtaataaatagaattgggtgacaaccttgaaggtcacccgtggttcagctctggaggtgtccttgtttgtactcactttgagtaaccatcaacttataaatagcctcaggccaattgcccagtgatgattttgactgtcgcttgccaggggcctgggcttgtggtttggttgtgagtctgtcatggtctctgtgacctcagaggaggaggaaggaagatgatgatggatgcttctagtgatgcaagcaacaaacatttttggacaatgtgcccaataccattctctgtactctgcatgagttaacccttcaggcttcaaacaacgctttgaggtaggtgaggagactgagcactaaaaaggtgaatgcggagccagtgtgagcacaaaaggcctggttccctgctagaccgtgcctcctcttggctggagctctatggaaagagttggaaccagggagccttggttaaaatatcagctccatcccttatgaccttgggcaacttacaaatctccaaatctgtattttcaccttttaactagaataatgtatgtcaattatagggtgttaggattaaatgagaaaatgtacataaaacttttggggcattgtctggcactgggtaagtactcaatgaaaaaaggtaatggttttttaacttgtttaatgtttctaagccttaggttttccacttataaaatgaaagcgtcattatatatggtgcgtggctgtcttctcttttggtttggttcggtttgaggatttgtcggggtcacattaccgtcatgaccacctgtgtgaccttgagcagattccttaacccctttatgttgcagttgcctccactctgaagtgggggtcctgatagtggctggctcagggttgtgtgataatcaaatgagagatgcttagagaataagcatcggcgtctggcacagacgtcctcatcctccaagatcctgtgacttgttgcatctatgtgcttgacttagcccacaatccgtccccatctcccttctcttctctttgttctgggaatctttaaaaacacttgttgagcttggggtcggtttgcagaatcatcacctacttttagggtagtctgtttcatttggggtaaacatttaggtttctaagacattgggacagtgatgtttgacttcacatctattcatgtgctctcactgagctctgaatatgatgtttccattcccccatctatcagagatgacacagaatcatttatatagactcaatagactcttaggggaggcaccagccctgtctgtagcttcactacttctgagactgaggtggtacctggtgtatcagttacctgtttctggcaacaaattattccagaatttagcttgtgattttgttgacaattaggctggacttagctgggtggttcttccaatcttggctgggcccctgcatgcatccgtattcaactgcaggctgggtataacactgtcagattttggtgtcagctgggataactgggatgactcaaccctcttctgtactcttcatcttggtcctgttcacatggtggaggcagagccccaggcaagagggaaatgtacaaagccccgttagtcctaggctcaaatcgggcccaccatctcttctgcaggcaattggcaacgtaagccccagtccagcccagattcaaaggaagggggcacacatcttctcttgatgggaagaacagagttcactgcagaggggcctagtctggggagatgaagaaatgtggccgtttttgcaatttgcctcactgaccacatagagggtgactggccctgtattttatgtcatatgtgactctatagaaatgtgtctcctagctgggctttgcagagatgcagactctatctgtctttctgttgtgggctttctaccttgtcatgaaaaggccagaaaattcctgaaatgagtgtccttttcagtccttcaggtgagaggctcctcagggatccacagaccattgttttggcttctgtctccctctgcttgtcacacagggatcacatacacaggtggaagtgaacttgtttgcttcccttcccaaactgtaagctctgtgaagacaggaatctccttgactcactattatatcattggcacctagtaggtcactgtaagtataaaatgaaagagggcaggaaggcaggaagggagtgaatgagttaggaagttaggcatctagataggaaggaaatgagagaaagcctcgatggaagaaggaaagaaagacactggaggtaaacagttgggaaagaaggaggtgaagagatataaggaatttaaattattcttcaacaagctaggtatggggcaaggcactggcctttctgaacctcattgactgcatctgtgtgatggagtaatagtagcacctacctggcttataatgaaataatacatagaagcttttagaatagggaccatcactgatggctgctctagttgttctagtttcagctgatgaaggcactaggatcctcagcatggaagacacagcagcagggacagggggaaatgctgtgggtccaaggagatagtgcaggtgctcagagggtcatggagagagagaagcagcccaatgattgccgggtgctatgccattcagtgcttcttctaggcatggctttgagcagcaattggccaggcttccagaaacttcagaacaagtggactgtgaactctctgcaaactagatgctgtgatatgcattttcataattcccccaaggatgtggacaggtggaaataaactcccagtcacacaaaaccccaccacccagagagcaatctggttgacatcctggctgagtttattaccataatttttcctacgggtacctgtgtaaatatagaaactgtagacaaaattggaattgtaccactgatatggtttggatttctgtccccatccaaatctcatgtcgaattgtaatccgtagtgttggaagaggggcctggtgggaggtgattggattctaggggtggatttccccttgctgttctcatgatagtgagtgtgttcttatgagatctgggtagcacctcctgcttcattctcttcctccttctccggctatgtcttgtgagatgtacctgcttcccctttgccttccgccgtgattataagtttcctgaggtctctacagtcgtgcttcctgtacagcctgtggaactgtgagtcaactaaaccttttttctttataaattacccagtctcaggtagttctttatagcaatccaagaatggactaatacaaccacttctgctgtatcttgggtttttaaaattcacattattttgtgagtattttctcactgcctgagaattttggggtcaggcatttttctcttcaccgcttagacactcaatttctgtttagaaaatggggagagtaagagtatctctctcctagaagttgtctattttttttttttatttgagatggagtctcactctgttgcccaggctggagtgcagaggcataatatcagctaactgcaatgtccacctctcgggttcaagcaattctcctgcctcagtctcctgagtagctgggactacaggctcacctcaccacatccagctaatttctgtatgtttactagatccagggtttctccatgttggccaggctggtctcaaactcctgacctcaagtgatccacccacctctgcctcccaaagtgctgggattacaaatgtgagccaccgcacccagactattttgttttgacctggggagagttaaatgagttaatatccttagcccagttccataacatccactgtaagcttttctatatgttcctttatttaggaagagtgaacatagtgccaagttttacttagagagcagtgctctgcatgctttggtgctagcacacaataaaattaaacggaggtcaaagcagagagcacttagggattcccaaagcgtccagaacaacagtagatggttataaaggacagcaatagtacaatgacgctgcctccaagacgaagtacagcattaattagtactgggcagtggatggccaggctctttcagggctttactgagagcctctgaagggtggcagtgatgaagagtggggccatgagtgaccatctcaggcccgtcgggaagatacttttcatgtggttgacccatggcagaaggaaggacctgtgtcatccctgagtgtctgagcatgttggggctgtgcttcgggacatggggtttttctccctggtctcgttgggatgctcttcacacctaagcagggtttgcacattcaaacatgggccgtttgtattccagccagcattgctgagaaggccggggagcagcttggtgcatactaaggagcagctcctgccctggctctgtccacaccaggctctctgggcagctgcccatggagaacacaagccagcaacctttgaggagagccaggccagcatttgaccatttgaggctgatggaccctgggtggcagggcctcggctctgcttttgggagaccttgaaggctgatgcatttcctccccagccccactcttactttacctggattgctgctgggactttgagacagtccacgctttcctattgtggaggctgtgccttgcctgggggatggagactgaatctattggtgatgatccagtaaagggtctcagagttcagcagagggtgctgggattcaccccaaatatttgggcagagggagagagacaggctgtgaaacagaatgaaataatgatgtgataggaagccctgcaagcattggcccctttaattctccctaggactctatgaggtaaggactgccccacttaccaggatatgaaacaaaggctcagaaggctcagaaggtggaaataaatctcccgggtttgaccaggagcccagcagcccttccccagagcctgttgacaaacagtgcaggcatgtgcctgtctcagggttatcttccgcctgctttcttctcagcatgcgattgcatcatattgtattgattgctactggaagactgaattcagaggcctcacagatctatatcatgactttacggaaatagaaaaagaaaaggtatttttcatggtggctcagacttacttcttatccccatccttgcaggcagaggcccctaacaaatgtcaaaggatgactgagggggctttggaagccaggagacttggctgtagatctcctctaccacttcttagccatgagaccattggtaactcatcgaaccttcctgaacctcaaatagctgctattgctatttgttacccatgagaccaaggaaatagtcttcatcatgaccaaggaatagtcatgttctagacagtgcacaagctaagaaaggagcagagattagaaggagaaaagaggaaaaaagaacaagcaggacatttttcacctaagagattgacaaaaaaatttaatttaatcaataaattacccagtcttgggtagttctttatggcaatccaagaatgaactaatgcaacaacttatgctgcatcctgtgttttattaactcacattattttgtgagcattttctcattgacaatatcaagtgttggcaaacacatgtggaaacagctcttacaagtctcagatataaattggtatggccatcttgcagacacagtttggcaatatcaagtaaaattggaaaaacaaatgctttgactgtccgtgactatttctaggtaaggaggcttggaccaggatgttcatcacaatatcaacattgtgtgtaattatgaaaaactgggaaaaaatcctaaatgaccattaacaggggactgaatacatcaaatgtggcatattcttacaatgggacacttggcaatagttaaaagtaatgaactaaatttctatgggaggaaaatgaagtggacagtataataccatgtttgtaaacctacccaccccaacaaaataatatcatatatagcatgtcaatgtgaaatgaaaaaaagactggatggagagagaggggcagggagatggagagacaaagacagagacagcaagcaagagaatgtgagagctgtaggtatcagactaaaaagacacataccaaatctctgataattgttccttctgggagtgttgaatgataaaaaaaaaaggatttcacctttatcaggaatgcttcattatatattataatagttatacatataaacacacaccagatgatagcttcaataccctccagttttgtgcatttgatatatgattccttgtgcttttaggttttcttaatgttactcaaagaaattggagaaataatttttaaaacaagagatttatttgaggagcttagagaaggggaaaagtttggatatctaatgatttttattttaaggtcaaggtatgatttgactttgctctgtaaagcaattttcttttctccgggagaatgtttgcagcaaacatttattaattagctaccatgttcatggcccacagaactctccatggtactagttctctaccaggcacacaaataaatcctcagctaagtaagtttatcttggatgactttttctctcagtttgataagaattcagcttgccatcctctggcctagctgagccacaggatgttgaaagaagatcaatgctgcctggtaagtacattcagaaacacaacttcccccagatattccagtgtttctgctgatgcccaaatccctaggtcatgtcagctatgaaaacatcagcaaatgtatggagtattaactggaaaggagtgttgttgcttcttactttttataagcccagaagattccaagaacagggaaaatatctaaaaccaagtcagaaaaggacgtaagtgcagagcccattggtgactgccgttatctgctttgaaaccccaggagttggcgatgttgtttgcaaggagacagctatgcttcctttcttgttttagtcttgggctgagacaaatatgacatttcctagatttggggcccagagctacagaaaacatggccccaaaccaaaaacttcaaattttaagtcattcatccttgaggaatatgctgatacctcatttaccccttgtgactcctaaaccctggacatacctttttatgctattaaaagaaggcttctagttttgtttactccagtctcctagatgttgtcattccccttgaatctcctgagaggctggagattatatttggtctggcaaatggttttctttctaccccctttctccttacatttattgtaaaaatattttaatagacaatacatgtatatggttacaaaattaagcagcatgaaaaggtgcacactgccatcatgaatactcttatcatcatcatcacctttattggatagtgaaaagtctgtggccgggcgcggtggctcacacctgtaatccaagcactttgggaggccgaggtgggtggatcatgaggtcaagagatcgagaccagcctggccaacatggtgaaaccccatctctactaaaaacacaaaaattagctggccatggtggcaggcacctgtaatcccagctactcaggaggctgaggcagaataatcatttgaacctgggaggtggaagttgcagtgagccaagatcgcgccactgcactccagcctggcaacagagcaaaactccgtcaaggaaaagaagatgagagaagagaagggaaaagttaagtttgcatactaaacttgctttctggttgaccagttctccttccctgaggcaaccactgttacaagtttctttttcatgatttcttgtggatttattcgtgttattcacgatatgtgtgtttgtcacatgaatgatggcaatctacacatactgttttgtaccttttcttactttgtaatatttcttggagatcatttcatggagatggatgttggtctttctcagttttttatgtgttgcctgataatctgtggaaaaggttcttctccactgccctgttggttgacactggggttgtttccaaacattcatcgatgaatcagtgctacctcgaataatcttttaaccatgtatgcatctttattttcaggtttgagtttatttgtaacatatgttctgatgactgcaactgcaagaccaaattatatgtgcattttaagtttgtctagatgtaaaacattggcctgcaaagatattatatcaacttataaaaagaaaaattaatggcagcactgtttgtcaatgccctcaccaaactaggtcattgacaattctaaaagatgggtctacaagggtagtgcttaaaaacatcatttttggtttaggttcaagccatgtttacacttgaaatggtatgatatcttacatggtatgagagtgagcaggtgggggcatatctggaaagagatcagtgtgctttggtagttgttgaagtgaagctgagtgatgagtgcatggtagttcacgtttccatgctctgtacttttgtaggtgcttactttttttgttttgtttttttgtttttgttttgagacaggggcttgctccatcatctaggcaggagtgcactggcacaattatggctctttgcagcctcgacctcctgggctcaagggatcctcccgcctcagcctcccaagtagctatgattacaggtgcaccacactatgtctggctaatttttaaaaaaattttttggcgacggggtctcactacattgcccaggctggtctcaaactcctgggctcatgtgatcctcctgcctcagcctcccaaaatgctgtaattacatgtgtgtaccattgcgtccagctctttttcctttttataacaggaatgtccaagccatatatgaaacagatccgacccacataataaaaatatggaccataaatcatcacgagttgttttctccttgtatttagcaaaagctcctcctgtgctcatggcaggctgagtgcctggcccgtgtcttcgtactctgcacagtatccttgtgaggctgagatcagtgtttttatttctgtctcacagatgagaaaacagtggtccagagagattaagtaggtagcagaaccagggaatgcagacttctcacaaagcaatacactgcttctgcctgaccatcactttgcctggctgctgcctctttggctaccatctgtctgccagtctctggggacactagttactctgacagtctagctaccagataggctccagtaagatgggaaagacctggatagaaataaaggcattctatgaacattacaccagcaactctttttaaaaaatagattttattttttagagctgttttaaatttacacaaaaatcttacaaaaagtgagttcccatatacctcctctccccttcccagtttctcctattattaacgtgttgcattgtgtgcacatttgttacaactgatcaacaaatgttgatgaattattaactcaagtccacagtttacatcagggcttacacttgctgtttacattctacgggttttgacaaatgcataatggaatgtattcaccattacagtatcatagaggatagtttcaccgaccccccaatcccctgtcctctgcttctgcagaacccctggcaaccacagatcttttggttgtcactatggttttgtcttttccaagatgtcatatagattgaatcatgcagtatgtggacttctcagactgtattctttgactaagcaagatgcctttaagtttcctccatgtctttcctgtctcgatagctcatttctttttattgttgcttaatagtccattgtcgggatgtaccccaatttgtttatccatttacctgtggaaggacatcttggcttcatcccattttttggcatatggtcatttttcagtattttccaaatggttagatttcatacgtgaatctcattgctcttagaaggtcattcagatgtgctcctgacctggacccaaatggcctggacccactgtcatcacctccctgtctggcctcttctcccactccatcttctttccccactctgcagaccctccagcctccttcctgttcttttgtgcaccatgttggatcctgcaccttcatccttttttcttctttttattcagaagactctcaccccaagtcttctcacatccagatctcagctgaaatgacacatcctctaagatgccctcctgacccccttactgaaagggttgcatgctgccaagcaaatgtccctcacagactgctctgggatttcctttactgcacttttcactctctgaagtggccttgcctgtttagctggccatcatctgtcccccacctctggaatgtcagcttcgcagagggagggaccacatctggcttatccctggctgtatcctagccctagaacagtgcctggggcctcacagaatatttgctggataagtaagtgatggattgattagtctgactactccagtgcttctcaagttgatggctttccatctacacatattgtattcatccgtgaaaagagagaagaaaccaggaaaagcacatctccaatgatgagggttatgtctctggcagcctgtattttggacctgggtgggatcatagtgtgtgttcttgtagcttttgcctgagtttcgtctacatggccctacttatggagtctaagatggagctgacagtgatgtatcattctaaacaagcgtgttgttgcaagaatccatttcaaagagatcctcttttaaatgctacttctctcccttcctcttcatctattctagcctttgaaaggtgtttatgttgattctgccattctccattcctgaggcacagataagcatcataaatatgttagttttgaacaggtcctgaaatttgccgacataattcccattttcttgtcagtacttccaagcatgaatagccttttttttcggtatggtgaattatctacagttagggatggtttaaaggtatttttatgaggacgtttagtcattgggatcacttgttcctgagtcatgcatttattttaagtctaagtcttttgaaaggtcatttagatttttcaaaaatagtagtcgtatcgttgtctcatattctttctccttgcccattttttgcttttaacaaaggaaattattttcaaggaaagcatcttcagataatgcacaaccagcccaggggaaacctagctttatagacacactagtgagatcgttgtgtaatttgatgggggaaggtttgtaaggtttgtgttctgtgtagaaaatggtgagattttaaaccaaagtttcattccagttatgaaaataagacatgtgcatgataaatattttcagatcagtgaaagaaataaaataatttttacccatagttcttctagatatcattaatattttggtgtatttccttggggtgtgtgtgtgtgagtgtgtgtgtgtgtaatttcatcagactggaaactctgagcagtcagagttcttgtctgtcgtcctcattgctctatagagagtactcctgagaagacactcagtgccaatttactgactgaatgaaagttaagtgtgtgtgtgtcacatatttcaaaacaaagtctagatagttctctatatttgattttgtgtccctccagcaatttctcatttttaaatttttctttgaaaacatgatttctaaatagtgggctgttatttcatgggatgaaaagttgtgttggaaagccccttcacactggaatctttgaaaccatcttcattcatttctttacaaaaaatctttagcagtgaaattcttgggttaaagggcctgaacactttaaagactttcatacatttttgctaagtaaccctccagagagaagggaacaagtggccttcccatcggcaaggaataaaatgacccatctttttatgttcccattaagagtggctttaagggttctcttgtaatgatgcatttttgttgtctacattagacttgttgtccctagtttcttagtagcattctgattttgctatggtatgttttcatgttcagaagtttgaaaaattgttaggtcaaatttagtatttttttctttaagacttcattaattgctcctatacttaagaaggtctccatcaccaagagaaagcaacctgctttctctcctggattattttcttctggctttcttgtaggttccttttctttccacttcagctcatgggaaatgcatttgaatgtgaggtgtagcttcctgatcattctgggtagcccagtcactcagcactctcctgagaatagtcttttttttttttttttttttttgccactgattggaaatgcacgtcttatagtattcccattttttacattatactaaattctctttctggactttttattttatttgtctggatctgccatgtcttcatgttaactgttttgataactacagctttattatatattctaatatccagccaaacacctcctttattatatttttttcaattttgagagccattctattatgtgtatgctacaagaagaatattatgagttatatcagatcagattataaaatacaatgagaattacataaaagttatacaatcattttggagaactgatatttttaccaaattgagtaatcccattcaaaagcctagtatgtctgtcctagtatttaagactttctcttttttttttttttttgagacagggtctcactctgtcgcccagactggagtgcagtggtgccatctgggctcactgcaacctccacctcctgggttcaagcaattctcctgcctcagccatccaagtagctgggattacaggtgtgcaccaccatacccagctaatttttgtatttttggtagacacgaggttttgccatgttgcccaggctggtctccaactcctgaacaaaaagtgatccgcccgcctcagcctcccaaagtgctggaattacaggcatgagccaccactcctggccagtatttgagaattttaaagtcaatataattctaagtttaaacgttatggtttcttcccagggagcacaacaatttattacgagttttatttctatgtgtttaatgttttgcattggttattgcagatgagatttttgttttcctgttaaactatctggtgattttgctaacactagaaaaaaatactaatttggattcattcattttgtaaccttaaaagagtgattcatcttactctcttagtatttatcttattacttattatttaatatttatgttaaataccctcttagtatttaaataaaatagttttcaagttggttctcttcagttctctgagtgtagattggttcatcagctgctcaaagggtgaacaatgaaaggggtgcttcctgtgaaatgttcccatggggctcatagtgcacctgagccgagacactcctggttcaagggcagttctgctgccctctgtctgtggagaaggcttgtctgttgaacctctcactgccatttcccttcctgcaggctgtgagcccaagaatgaagggctgctggatcactggtctttctgttttgctgtgagaggaattggtggtggccccctcatgcttggcctttgagcctgaggagggacgaggatctaccctgggtgtccagttactctttgagccaagtggtggatgaagactttgggggtgtggttgactcagaggccagagctgaagtgagcagaaagagcccacaccaccttccaaagcaccaattccaagtcagcaggtgaccttccagaagaattgtgcaataggctttaacttttattgtgcaaacaagtttctcacataattaactcaatggcctccagatgaaaacagtgacattaagaccccactggcttcctctgaattccctgacgaactcaaacttttcccatactggcctgtagtatctggatttctgcaaaagacaatagggttgattttggagtttcagactgtggaactctgtcctagttaatgagaagagtctgataaggccacccagagggcaagtgaggtctaggacgctgcataaacaaattaggaaatgacagagaggcaccaaaactgcagcacgtttcagctgtgtgttcctttctgtgtctctctgattcaatgtggccagtgttttctggagacttttgcaaaggtgggaatggggacacatggcactgtgaccccatctaggtggttgggcctggaggctactcatcaacccaccacccagagaacagaccatgcattcccagctcccaggagccagtgctgctcccggttcctgcctggatcacattagtgttcatggttgttaagcttgttcctataaagagagccctctccccaagagctggtaattggggaaagaagggctttttttctgctttgcttgttccaatcttgtgtttttgcttagaatatgaacacacatggtcacacacatacatgaaaagccagaacaaccagaggaccttctgtttgagcacccagactagacgcacagcagggaaaccatgcccagcctggttccctggggtctgggctcttggttctttcctttgcgattgaggaggaggcaacctgctttctctcctggatttaaaacaccctctacctctcaagtcctcacatcatctgtggaccttatcctcagtgcttctctagaaatgtcttattgttttctaactaaagagaatatgaaatttatttgcataaagaatcttttagtaatgagtacaggaaaaaaaatagtccgacttgagctggtgtaaatgaagagaggcattgattggttcaccgagctgaaaagctaagggcatcaggcaggtggctgcattcagtgatgtggaccacgccagcagggctctgctgtcttgtgcctggctctgtgtccatctgatttggcttcatcccccatcaggttctccccataagggaggaaatgactgtgtagagcccctgactcatattctcatagcttagcaatccttacttagtgatacggtttggaagtttgtccgctctaaatctcctgttgatttgtgatccccagtgttaaaggtggggcctagtggcttggggccctccccatggtgatgagttcctgacagctggtagctaaagagtctggggcctcccttcttctttctctctcttgctcccactctttttttttttttttttttttgaggcggagtctctctctgtctcccaggttggagtgcagtggcagtggcataatctcagctcactgcaacctctgcctcctgggttcaagtgattctcctgcttcagcctcccgagtggctgggactagggggcatgccaccaagcctggctaattttgtatttttagtagagacagggtttcactatgttgcccaggctggtcttgaactcctgagcaaaaaacgatcctcccacctcagcctcccaaagtgctgggattacaggcgtgagcccccttgcccagctcttgctccgactcttgccatcgaacgtgcctgctaccccttcaccttccaccatgagtggaacttcctgaggccctcaccagaagcagacatcagtgccgtatttcttgtacagtctgcagaaccatgagccaaataaacctcttttctttataaattacccattctcaagtgttcctttttaacaatgtgaaatggactaacctgggaaaacacatattttaaattttcctaacagttccagaaaaagtcctggaatggattctcattggcccagcctggtcacatgtccatcccctgaaccagtcatggtggccagtgaaatgtgatgctctgatttgattggccaggcctacctctgtctgtacagctgggtcactggggtgacagatgggagcatcagctccatccaagccaatggactgctgatggggacagggggagttcatcaggataagctgggcacgtgctactgtagtgatctgaacttttgaggggctcacaaccatggtgcctgtgtctctctaattcggcatgttgatcatgggatagcaaagggacgctgcttatggaagttctctgggcaccagctggaccgaggcaccacatccacatatcctccacaatcacagaggcaggaagggggaacatggagaaccgtgccctggctgggaaagcatccgcccagaaggggcagatgccacttgcactcctattcagttggccagaataagtcccatgtgcaggcctgggttctacaggtggggatgtgtaattccctcccgctgagaggcacagagcatttgtgagtcataatagagtctgctttcggttgccctgctggtccccagatatttaggtcctgcttcatgggagacagccccaaagtcccactcagtcactactcacagctcattgtctaggatctttgggtgatgaatcattatctttacatcgtgtttggacatggctcttctttattcagagacttatgacaagtgatctgcccccaccatcaaacacctaagatttaatcttgaaacagggataggataactgcagtaaacgttcagaaaagggacgatgaactgtcaaatgatcgctaccctgaagttctcccatgcaaatacagtgacattcccttctctgggggaaagagagttccttcattgagctggtttggctccatgggactaccttccagtcttcattggccttcttcattggctttagcgccacctttctgaagtcttccctttttggttatccttgctggcggaatcaaaagaagatattggaagacatgctcttcatagagtatgagcaggtgtctcagcctagaaaaatggagacccagggattattttctacaacgttcagtctcttttattcaatctggtgatggcttggacaataaaaatctctcaaaacttttttggtcccagttggcttcatctgccaaaacacacctacagtttttctgagatgtaccttttccatagatctaagaccctgatcttgtcaggctcccataaaagagctataaccatggtccctttgccaatgaattttgtcctagtttgctaacaccacataaatccatttgggatttttaaccacaggtgtgacagcagaccaattctaaaccaccctttgccagttaaaacctttttggctttcttttgttgcttttctcattggttctaagaagccagggttttttttccaatcttacaaaactttgaagttctagattctcttttatttttgccagaccctgttatctgcatagacactttcccagaagtactggttatattattgaataaagagagtagtttgttaccttcatcttaggaagggcaatttggtgacttcaaatgtgagagttagcacctacttgggagtaggaattgtccttagtatgttttaggaagaaattagatttttcatgccttgagcctcccctttgtccaggatgcatgaaggacctgatgggaattctgggtggtgttgggggagatggtgcaggtggaacactagtttcctgaggttgactcagcactttccattctgctgagtcagagtctcggtgccttccttgattaggtaaagccatcccttggcatctctgaagtgcagcttataggctacttgtagtgatatgggacatggtcttttatggggtcatgtgtattttgtcatctggtccttttgcagaacctgttgtgttctgacattcctgagttggcagaggaaaaaatcaggtctcagggaacatgttggtaagtggcaaagtcagggttgttgctcaggtcttcctggcttgaggtcttttcttctttctatttttgcagattggtttctggaaagatttatttaaatcctctctagttcacccctattcttgaatcaaaaggcttatcttaacaagcacaaaaagccccatttattcaggtattataaacaagaatggaaaagatagatgtggcctcatttactcatcccattctcctgctttttatcccacaccaggagtctaccaggctctaagcagacctcaggaaggatggggctgtcagatgtgagatgttagtggtcctcattggactgtgactgggtcctggtttttgaagcttgttttgtttcttgggaggcagcaataaggtcaagctggggctcaaagcatcatcgtaaccagcaaaatggggaccacagcagcgagttcactggctaggccctttaaaaggcaggcacacactttcaaatttcccactatttttaaccagcttgcttgcttgcttttaaattcatgtgtggttcctggaggcacttgacctctttctacagagccttcccctctgctattttaatgaacagctgcatcaatgactccctaaattccaactgcatcttcttcatcctcattaacctttaccttggcattcaagcctcttccaggcctcctcctcctttttcttcctcacctctcttaccatggctttccctcacccacttcttgatgttcctgcatcataccttcctttatgggaatgttctttgccacctgtcaggatcctacccacccctcaaggtctggttcaaatgctacaccttcagaaagattttgggggaaaaataaagtcttttttctttttgagtctaaaagtattgcacactcattatagaatatttataaataaaattaaagtcattcccagtcatatcaaccagttaatccctacaaatatttgcatattttcattcatctttcatgtatacatatatacagaaaatatttataatactgatgccatattgtatatataattacatatcccaattttaaatatagcatgtgtcttgaaaattttttggtatcattaaatgtttttcaaatacataattttcactggatacttgaaattctgttctacctctcttctacaattatgtaaacattcctcttactgtttggttgtttacattgttgtgcgtaaggctttgtctctatctctgattatgtatgtagaaatataagtatttttgaacagcgtaaacttttttaagctcttgacacacattgccaaacgttttctcagaaaggtggtatttgttttcactcccatatgtactgtaagctcatctttccaaatcttttccaatctgatgagttgatttttaagaaatcaactaccagtttggcaaaaatggaaactcattacagattcccctcaacttacagtagggttttgtcctgataaactcatcttaagttgacaatatcatgtcaaaaatgcatttaatatacctaatctactgaacatcatagcctcgcctgtcataaatgtgctcaaaacacttatgttagcctacatttaggcaaaaatcatctaccacagcctattttataataaaatatcaaatatctcatataatttatcaaatactgtttaccccgtcaaaattgcaatggtttcacgccattgtaaagttgaaaagtgttatgtagaaccatcgtaagtcagggatagtctgtatttaatttgtttcttttggggtaacttgtagagtttaattttcttttttaagttgtttactgctatattttttcttctgaaaacgattgaaaacatttgtactcttttcaatggggttaagagaagaggaagattttgtgcttcttgttcattttaaagaggtctttatatattaaggacttttttttcattgattgtgaatatattccagagttcattattttacttttttatatgaattttgaatgaaaagttttaaaaattcttatgtaatttggactagccattcttttgttcttgattggttctatttcttttaagcttaaaaattttatcttaaccctgaatcagtttttttccctagattttctacaactgtacttttcaaattaaactgaaatctatcttagtgggggtatgaaagatttccagtgtgacttttccccaaatatctgattatgattctgctatgcgttgcattgttgagaaatgcttttcccattggcttatggtgcttttgttcatcttgacctaacctatcccatatttcatgtagatgcaccccatgatctgagtaatgacacttccactgtggccatgcagttttgattattatagctttgagatgcatttccaggtctgttagatactcttccttgtcatttttttatactgtggtcccctcccagccataactttgcacactctcgagagttccagtgactgttgcaaatgcctttaactcttcagctcactgtgaacttcttgaggacgggactcaatttgtcctaatcaactacacatcctctgtatcatagcccatcatagcattggccagatagaattcactgaaaacacatttgttatgttgattgtgcaatttctttctggtcattttctgggtgacttgtatttttagaaaacctacaatcaggtgtattatttgattaaatttaggaaagaaatatatgctgtatttaattggcttgtgtttctcagcttcaacccaagttaattcaactttcagtgttgtttgtaattaccagacatttagtacattaatgaagacttctttccagtagcccatttatatttactcttgaaaaatgatttacttttgatttcaaaccaaaaacattatcattctaatttctggattctctcatttctattttcaacccaaaacattccgttgagatatgaaataatattggatcagcctggaaggagaccttgggtgaacaaagcgagtttgcctcatttctcacaacacggtctagggtctgagttctcattttgaatcagggtggaggtgggaaaacagctctcctgggtgcctgttgaatgtgtgcctttttgggcatctgtttacattcatgagggtccacagaggcccagagaaattccaactacttgagtttttttttctatctacattttaacacttaagtcgattcctggacatatctggtacttcttgtgttttctactaggcataggacattactttgcacagagcaggtgttcaatagacacgtttcttttaatgtaaaaaaatttattgaatatgaccctcacataacaaagcagcccagtagtccccttgtgtacccccacccaggtattcccagagagaaccactgtcttaatttacatcgtcttgattagttttacttgtttttgagtcttacataattggaactgaacaatatgtaatgttttgtatctgtcttcttttgttcaacattacatttctaagattggtccatgttaccgggtttgataatatttcatcattttctttgctgtatagtattccaatgtgtgaatatattctcaatttatccaatctactgttaataacatttgtgttatttctagtatttggctgttatgagtgatacctctggtaaccttcttgagctcgtttttgtcttttgctttttttttttctccttttttggtaaagaattgctgggtcatatggcttgcatatgtttggcattagtagatactgtgaaacagtattccaaaatgtttgaaccacggtcaactcccacagcagcatggaagttctagttgctctttaatctcccccacccacccttgatactgtcagctttttctaaacaattttagacatcatgatacttgtatggaaatattgcattgtggtttaattggtatttccttgaaaacgaatgaggttgagctcctttttattttttcatggctatttgtatgtcttctttatgaagtacctgttgagttttttgaaagttttaaaaattgaattctaggaatttaaaaaatatatattctggatatgagtctttggttgaagttcctcaatgtgctttgcctttacattcacttaattatatattttcaggaaaagaaatatttaattttaatgtaggtccatttagcaatcttttttcctttttgtatcttatgtaaggagtatttgcctacccacaaaccataaagcttttctcctgttttcttctagaagtgttatttgttttgctctgaaatttggaatcagaattaattttatgtatggtatgagggagggatcaggaatcaattttcccatatggatatcccattgatcctccaccatttggtgaaaggaccattcttttcctactgcacagctgtgttcttttctcataaatcagtcagtacactgcgtgggtctatttctgggctccatgttctgttccattggcctgtctgaacttgttccaatagcacatcatcataattgttggagatttaaaatcagtcatgatatctgatagtggaaatcctaccactttgttttttttcttcaagatcatcttagtcattcttggttctagacatttctatataaaaatttgaattaatttacacacatacacataaaccttttgtaagttggattggaattacattgaacttgtgggtcaatttaggaacaaataaaatctttaaaacattcagtaatttggtctgtgaacatggtatatcccaccttgtatttaggctatttttcttttttctcaataatgtattctatgtataggtcttatgcacatctttggctagatttattctggagtattttatgctgctttaatgacatttaagttatctcgtttaaatataattttctaattctttggttctggcatatagaaatacaatttatttttgtatatggacttcctatgtaagaaacttgctaaattattctaattaagattattttggattttctaaaaacatttctctggagaaaaaaaggaaagcttcattttttcctttccgatccttaaacattttattccttgttgttctggttaaaacctctaatacaattttaaataaagaccttcttgtctcattcccaatctcggagggaaagatttgaatatttcatccttaagtatgggtttgcaatagattttttgtatatattcctcatgaaattaaagaaatttccttttattcctaatctgctggcagtttctaatcataagtgtgttaggagttttatcaaatgctatctctgtatttgtggaagtgatcctataacttttctaatttattctgttaatgtggtgatttccactgattatttttaaatgtcaagctaatcttgcatttctagattaaacctaacttgttttccatgttttgtctttctgcatttctctgcctctggtttactaatgttttctttaggatttctgtatctatggtcacgaaagataggcctgtcattttcatttctagtgatgcccttttctggctttggtatgaaggttatgctggcctcttaaaattgattccctcatgttttttattctctctgacacttgtgtaagactggtattatttcttccttgagagcttggaggaatttactgtggggcccatacatccttcatcagatactcaaatgtttagaagaggtgacatcctttacgtgaggttccaagttaagaaaaaaaatgttaaaggtagaagcagaggtgcctgtccatattttctcctagtgggaatgattcatttgtatatttatttattcagcaaaaaatatcctaaatgtttgtagcacaccagacactgcagcagttaaggatacagcagaagtgaaacacacatgcctgccttctaggagttcacattctggaccaaggagtgttttctattccagtttgagagtgtgtgtccatgcacctggctgtgagctctgggtccctgtgtgctggccctgcccctcctctggctcatggtgctcactccactccagggctccaccccatgttttcagtctccacccagacattgcttcgggaccttcagcaatgaggttccctgcccctgctttgctcttcccttcaccctttgtgtgtgtgtgtgtgtgtgtgtgtgtgtgtgtgtgtgtgtgtgtgtgtgtgtgtgttgtgacagagtctcgttctgttgcccaggctggagtgcagtggtgcgatctcgatctcagctcactgcaacctctgcctcccaggttcaagcgattcttgtgcctcagcctcccaagaagctggaattataggtgtgtgccaccatacctgtctaattttcatatttttactagagacggggtttcaccatgttgcccaggctggtcttgaactcccaacctcagatgattcacacacctcagccacccagattacaggcatgatccactgcacccggccctcttcactcttcaactgagagtcctgctcattattaatgtcactttttttagagaggactttcttggtccctgggctaaaggagattctccagtcccctaagctcagagcccccatgctcttctctcctagcatttacatgttcataattcacacatttatctgtatgattatttttgttttaatgtcatttgttgtcaccaaattgcgggcttcatgatgaaaacagttgcacctcttctactcaccaatgatactcttgtgcccaatgcaaaaccaggcacacagtaggtgctcaataaatgcgccttgctctccttcctttctaaagggttccagaaggccattaataggcaaaaaacgcaagcgtgggtgaaggctgaatctatcatgctccctgatgggtccccatgcccagcactgggtgctctcttagtgttagtaaaatacatgaatgaatgaatgagtgaattaatggatggatgaagtgcaattgaaatttattatgctcataaacacaaaaattaaatagatttactgcattaagattattttaagaagttgttttattcctacattcattttgtttccaacacaaacagtacataaaaataattatttcttggattcatgaaaaattgaaagggcccttgagtgtttatttagtgtattctttttggcagaattaatgatcttaataatgaaaacagcactgggtgacttttttaaattgaagtttttattgagataattgtaaatgtgcatgcagctatgacaaatggcagggagatatcttgtgtaccctttcctcaattttcccccagtgctaaactagaatatacacacctaattgggatactgacacggatgaaatccactgaacttatcccactgtctaacttaattcacatttgcagcactgtgctgagtgctttatctcatttaactgtgacaacagccctgtaagggggatagcattatcactcaggttctagagcctgggacacccgtgctcagagaggtggagcaactcgctcacagcctggtgcatgctcaggggtggagctggaatccccactggaaacccaccccccagcccgtgttcttcctggtgctggcgtaaaccatgatatatagatctgttccttgttagagatctctaaagaagaaaactacttgcttaacaaaaatgactttgctatataaaggtgtggtttttttgactattcctccagaatggcattttttagaagtctgaagtctaagaaaacctctgcaaaaattcaaggcacttaaatctttgatgaagcactcaaatgtattcatttatcatccagtctttcagtttcattgtagacagatttatgtcctttgtgatggtagctccatgtcctggaatggacctcccatccaggttcacagatacagctaagaggctggaaaaggtcgcaagtggaaggaagcttgggtttgtagtttcctcacatattcttagaagctaggggctggggaaacccagaagttaggtggtcaagggcaaaaagattctcccttttctgtctttcttccccaaaccttgtcacatggaagatttgaaatggctcccccaggcctgagtcctgggcagctgtgtcactgttggtgcccacctcccaggctgcttgctctgccctgcttggagaatgacaacttcttaagttgccacacagtacccagagccaccagttcctctcctggttgctgtgtggctgagactgaccctggatcatgaggcatcctgctgcccagcccatcatttccatctggtcctgttggggaggaagaaaatgcagaggcaaatgcagatgcagtatctgtggctgggctccagcaagacccctccaaggtctctgaccccagggccagtggtttcacccacctggaccatctacaagggtcaaatccagtgtgtgcagtgcctggaattagaggaaagagacatgcaggtacagcatcgtgaaaggccccttttgatgctatagaaaaaaaaaaaacctccaaaataattttaatcatgttcctatctttgtttatatttcattatggaatgagatctggttttgacttatattaaggtgacctgtttgaaattgccaattttgtgggtcgatgacagctgaatattggcagttttaaatggttcaatctaatgcgagttaaattaaaaccttgaggaatatgcaacttttcactttacacggctctgttttaaaaagggtgtcaacatatttcagccttgcggagatggcggcgtatgtctatcctgtgttgcaagcagctgtgaatggttgcgtcgttttgcttggcctacgcatgggcgtgttgtcaccagaaagcgtctctgctcctccaagtggtggcaagcccctcctgagagccattcctcatccagacaagaatccatcagatcttatgaaaatttaatgtgtgaaagtgtacagttgcatgagggtttttttcttttaaataaattagtttgcagcccttgctaacaccagatgaatgaattaagaatgcacctcccccggggctgtcgggctgctaaactgcatgctggggcgaaattccctttctcttattcttagctttttctttttttttgaaacagaatctcactctgtccaccagactggagtgcagtggtgcgatctcagctcactataacttccacctcccgggttcaagcaattctctgcctcagcctcccgagtagctgggattacaggcgcctgccaccacacccggctaatttttgtatttttagtagagacagggttttaccatcttggccaggctggtcttgaactcctgaccttgtgatccacccacctcggcctcccaaagtgttgggattataggcatgagccaccgctcccggtctcttagcttattcttaaggggaatttcctaccttttatttttcttcttgagagagtttcaaatttgccagaacctgaagggttgttgtgctttcagccaaaaggatgtctcagtagcctttagcccaccttcccccagggcaatggtagcatggaacatgcaacccctagcttacttgaaagattggacttgaaaaaaatcagcagttccttctggaatctgcaaggattggggaatttgaaagattcaggggaattagttcggcttcccaaactagttggttttagtgaccccttcttcttcccgttgcatcactggtgtgactgatgttaacattattgttgccccgttttacaaatgatgaccctggaaaggcttggagggccctggggctgcctaaggtcataggccaggaagaaatggagcctgtccgagggcttgcgtctcctcattctgaagcccaggctttctccatgttttcaaaatgccagctggttgcattttgtttttccaaatgatattgtagatgccagaaagtggggcctgtgtttccatttcttggttttcctgcccttccagctctctcataggaggcatatgatgagcacagggaacaggcatctgtgctgggcagacctaaaacgaggaaggggcaccgtgaccagttaccttgcggtgtggcacagtgctatcttgaagaccataacatctctcgagcaggctagcatatctggtccgaaaagtcgccatttctttgggtgggcttgtacaaagtggtccacatctcacagggtggtctgctgggctctgcaggcccgtgttgtgtccataatacatgatcaataaacacaaaagctgcccatcaatgaatccaggtgttcacccggatgggcgtgggaaactcagacaggcagaggccacgggctcttctgtctctcaattcctgtcccctttgcatactgggggggcacttgctgggggtagtccagtaattttatctcatggtgctccaccagagaccatggtgctgatggcacctactaagcgcaacgctgtgcttgactctaccctctgagtgtgcccactcagggctggtctccctcatgcagcccgaggcctcctgccaaagtccacttcaaggggaagccgaaggtgcacacaatcccctacgtctcctttgatccaagtacatcagctcttccaaattgtgtttgccgtgcattttttttccagaatcctcttaagaaggatttaagaatcttgccaaagtggccacttctcctaaaaacatctaacccagtcctcgcagattccagaaggaactgctgattttttaatttatcttcagtcatttgctttcggaagggaacatttattgtgttgaaaattaaagacttgataaaaaatgtttgctttttgtggtgtccttgaaaatcgagtgattttcacccaggatttctgtagtgggtgtcaggcaccgtggatttctgtactgggtgtcagggaccgtggtacaccacggtgcttagaaaaatggatgatggaggtggtgctgtggctggctagcatttattaacattgttattgccaggcaccatgtcaaccctttcctatgcattagctcatttaattcttacagccactatttgtggcaggtactagtattatccccattgcacatgacaggaaacggaagctcagagaggttatgtaacttgcccaagtttgaacagttaataagagcttgcattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctgggtgagacatgatgatggggcgatggtgggggatgtggcagcacaaagcaactttgtccactgatgtcgggaacgccttttgaaggaagaaaagtgtaagttgttacccagagtagaagatggccaggccaggagttgggaagggggttctagaaggcaaagtgcgtgtaaagttcttgaaactagagatacctaaggaatctagatgaggccagtctggttggagcaaagggtgatgagtcgggaggctggagagtgacaaggaccagattgcgtggggaggatactgctgcctgggggcttcccatcctgagggcggaggaacttgaacacagtagttatttgctatcaactgaaatgtattgagcccctgctgctctgtgggcatacaatggttggacaaacagacaaagtccccgttctcaaggaacttgtattccaacagaaaagaaaagaaatacacaagacgacgtcaaagagtgacaagtggcccaaagaaagtaaaacaagggcccagtcagggtgactcacgcctgtaatcccagcactttgggaggccgatgcaggcagatcacaaggtcaggagatcgagaccatcctggctaacacagtgaaaccccatatctactaaaaaatacagaaaaattagccgggtgtggtggcgggcacctgtggtcccagctactcgggaggctgaggcaggagaatggtgtgaacctgggaggcggagcttgcagtgagccaagaacatgccactgcactccagcctgggcagcagagtgagactctgtctcaaaaaaaaaagtaaaacaaggtggcacctcagattgaactgaggaaggtacaggaagccactacagtgggtgggcagggtgggcacctctgtgcagtgggcattcaggggtgaggagtcagcactgtggcagtgttgggagaaggtattcctggcagagagggtggctgattggaaggccctgaggcagcaacaaacagggcacgatcagggacttccctgtgcagtcagcgtggctggaatggagggagcatgatggagaaggcaccaagtgaggccagaggctcctcagggggtttggattggatccttaatggaggggtgggaggatgccctggagggtttcagcacaggacggcaaggcctgctgtgcattgctggggatctctttgcttccataaggtcagtggaccgggaagtggccagaatggcagctgggatgggcaggggatgagggggacactcttgccatcatgcatgccacacatgatggggagtgggcttgaggggcagccatggcggaagaggagccctcaggggtttgggagaggttagcaaatactcatgcttgttttgggaggagcctctgctcacggtgggggcatgggggtggtggtgagcaccgcagcttgtaagaggcaagcttgtgtggctgctgggtcccacgtgctatcagatggactcctatatggtgtgctgggaaagacgccctgtggctctcaaccagctcagcctatggccctgagagaggatgtgggcaggccctgaccatcttggttttcttccctttttttcttttttatttatttctctttttctttctttctttctctttctttctttctttctttctttctttctttctttctttctttctttctttctttcttcagctttattgaactataattcacatattatacaattcacccttatacagttcacagttctgtggtttttgctacactcacgggtttgtgcaactgcaccacagtctaattttaaaacactttcatcatcccaagaggaaaccccatgtccattaagtgctccctccccacttcccctttccctacccctggcaaccgtgaatctactttctgtctctctggacacttcatacaaataggatcgtacagtgtggggtgtgctgtggcagggttgtttcacctaacaccgtgttttcaagttcacctgcattgcggcattgccagtttagggctgatagtattccatgatacatagaccatactctctttatccattcatccgttgatgggcatttgggtttctttcccactttgtgtctattatgagtagagctgctgtgcatattcacgtgcacatttttgtgtggacacctgttttcagttctacgggatctactcaggagtcagatggttatatggtgacccagtcttcggggcaagctcaggagcagaatcatcgtacggtgactcggtcattggggtctactgaggagtcgaatggtcatatggcgactcggtctttgggcaatggtaaggagtgagaatggtcatatggtgactcggtctctggggtgtggtcaggagtagaatgttcatggtgactcggtcctcaaggtctgctcaggagtagaatggttacatggcgactaggtctttgtggtctgctcaggagtagaatcactgtatggtgactcgatgttgaattatttgaggagttgccagactccttccatgttggctgcctggtctgcatcctccccactgtgtgtgaaggctctgatttctcacctccttgcccacaccttttattgagcctgaacacctttcacatggtcacacctgacctgagcagctgcccggccatagtgccaacacatccctggccacgagaggtggcgcctgggctggccaacgtgcaccctcagggtcgggatgtgatctagagcagggcttctctcattctgttcctgcccatgttcatttcaacccccaaaaggacttgagctctcaggcttaatttcatttacttaatgcatgaaggaggaaatgatttctgaggccaagaccggagtggtccccagggactccatttcaacagtgtatttaaaccaccacgtggaggttgcttgctaggctgggaactgtgatcaaagaacttccaatattttatgttcataaaggcagtttgagagtaatgttttttaaaaaggcatctgaatggggaggaataggatcattgtgaggtccacagtctctttgcctttgaagtttgcaagaagctactgaatgagttccatgctttgtaatactctggtctgggcaccctcaggcgtgcgtggccggcagggacctgtaggaatcctcttcacctggggagatttgaagcctagtgcatataaccagggccgtcacccaatgctgtgtgatcctgggccagtcagttagccttttgcagttagctgatcgttttcacctcagcttgaggcatctctttcaggaagtttctccagttccagtacacgctctcaagcgactctccccctctcctcaaaatgcttacctgcattttcatgatgcagctatgatgtgcaacattcactaattgatgtctgtgaaccctggtggctgtgtgccaggtaggtatgtgctcaggtgtgctgtgtgctcagtgaggctgtgaacccacgtgggtgtgagcccaggtaagctgtgtgctcaggaagctgtgagcctaggtgtgctctgtgcttagtgaggctgtgagcccaggtgggtttgagctcaggtatgttgagaggagggtggatgtgagcccaggtgtgctgtgtgctcagtgaggctgtgaacccaggtgtgctgtgtgctcagtaaggctgtgagcccaggtggatgtgagttcagtgaggctatgcactcaggtggctgcaagcccaggtgtgctgcgtgctcagtaaggctgtgaacccaggtgtgctgtgtgctcagtgaggttgtgagcccaggtgtcctgtgtgctcagtgaggttgtgagcccaggtgtcctgtgtgctcaggcagctgtgagtccaggtggatgtgagttcagtgaggctatgagctcaggtgggtgtgagcccaggtgtgccgtgagctcagtgagtccaggtgggctgtgtgcccaccgaggctgtgagcccagatcggtatgagcttaggtgggtgtgagctcaggtgggctgtgtgccttattgaggctgtgaacccaggtgggctgtgagctcagtgaggacagacaccacacctggttttgctcatgggtatcaccccagtacctggcccagagcagatgattgtcttgatttgggttttggggaggtgaccctggaatgaggatttgagagcaagtaatttataagaaagctgtcccaggagaagctggcaccagtgctgggaaagtggcacagggaggccaaggaggggtagtatcaggcacagctgtgcaggggcagttgcagcctgaccctgagggtactctgagcatgagtgtgtcagagtttgtctctgctgaggccaggggctaggctacattcttgccaccaccagtcattggctctcggctctgtgcaggaggacagagaggctgagaggctgggagttggcctgtaggggtgcccttaggggcaaaagcacatgggagctgggaggctccacagccttggactggaggggtgggcagagcactgacagtatccgcttggggtcaggccatgtggatccagtgttctactccgatcctctccgacaggccttccagaacagggtgtaccatgtgctccagcacgagggagacgtgcttctgatgtcagctatagcagtgcctccagggtcgatggcacgagcccagttgacaatccccacagccagatgctttgaaatatgtgatccttgataaatttttaatttagggtaattttaagtttgcatattgcatgagactttactgctctttgaaatctgcataaatcacagtcatgctgcatgtttgggttgtcacttggcatactggccagctttttgttggccccccaatcctacttctgctaagggctggcctggtgtgtgtgaccagaatgccaggcccagaagccaccagcactaagtcaatgggaagtgctttgctcagtgcagagctgctgctgctggaatcactgcaccacttattccccatgacactgggcctcctcgccaccaggtcaagccagactcaagacgcaggcaaacggaaaaatgcagaactgtttgctccttctccctccctggaaacccctgctcttataggttggctttgttggtccagccccagcttcttgacttggtagggagttccacaggatgaggacatgctttttgtgtttttctttgcactaaactatgtgtaacatcaaatttaccatttcaacccttttaaagggtacgattcatgtgtgccaatcatgctagatataatttgcattttcctgaatattaattagggggaacatcttttttatatgctgttgacggtttggatacctccttttggaaggtgttcccggactttgcatattttccacagggttatttgactttgttcatttgtgggagttcttttgatattctagaaactggactatgtccagttaaatatgttacaaacatcttttcctgcactgtgttttgtcttttcattttacagtgtttttgattaaattcttaatttaaataaccaaagagtacagttcagtgctctgtgcagtgagtgcagtcacattgttgcaaaaccatcactgctgtctaattccagaacctttcatcacctacaaggaaattgtgtgatactcctcattctcccctcctccaagcccctgataactacgcatctactttctgtctgtatgaattggtctgtgctgaacatttcatgtaaatggaatcatacgctgtacggacgctatatggacttttgtggccggctgtccccatgcagcatcatgttatcagggtccctccacactgtagcaggtgtccaggcctcattcccttttatggctggggaatgttccatggtctggatagactatacttgatgtgtccatttgtccgctgatggacatttgggctgtttttgctttaggtcatactttctgcctgatgtaaaagtgccagtcgtgtataaggactgtagtcagcgccaccatgccacagcttagagaagggatgggggaactactgggttgtcagaggcgccgttcttgaccctcagagactttctgtctcctggaggagaagtggctgtgttgggcaggtttgaatcttgagaattcacggtccctgggtttgaggcctcgctgtgccacttgatgccatgtgaccttgggcaagtcacctctccctctgagcctcacttttctcacctgttaaatgaggtacttataaagccgaatagcctaattcaaacattttaagtctgaaatgctctgaaattcgaaacttttttagtgttgacatgatgctcaaagaaaatattcatcagaacattttggatttcaaagttttggatgctcaactggtaatgcaaatattccaaaatcagaagaaatctgaaatccgaaacacttctggtcccaagtgtttcggatcaagaatactgcacctgtaacacctgcctccttagtggtgtgatgattgcgtggaatgagacatgaaaagggctcagcccaaaatcgtctggcaccaaatacccaatggataggggattttgtttattttgttgttactgttgttgaggtaaaattcatatagcacaaaattaactattttaaagtgtacaattcagtggcatttagtacattcatgatattggcatctgccacatgtgtctagttcccgaacattgtcacatcacatccaaaggagatcccatgcccattctcccctcccacatcccgcggcagccaccactctgccttgttgagtggtcttctgtgactggctcctttcgtttagcaccatgatcttgggggtcatctgtgctgcagtgggtgtcagtgctttcttcctggtaagagcgtaacatggtgcagtcattgtggaaaacaattgggtggttcttggaaatgtgaaatataggattactgtatgagctagcagctccacttccgggtatctaactaaaacaactgaaaacaggtattagggggaaaaaaacctgcacacgaatgtccaatagcagcactgttgttcacaatagccagtatgtggagacaacctaaatgcccatcgacagatcgatggattaacaatttccatacaatggactattaccttttgttattattattattattatagctttcttaactcctattgattttttcaaaagtgacctcagctgtcatctcttttccacaaagagtcttacctgagtctggagaccattcctttttctgaccacagaaccccgtcttaatctctgtcctgcctcttccactcattaattcattccctgattccttccaaagtatttgttgggtgcctgctatagacaaggtcactccagtggggagggaccgacaacaccaagtcagctgaaataacagcaccgtggagggagtgtgtgccatgcggagaattttgggttgggtgggagggtgcttggatgtctcactgttgctctgatggaccaggaggagatgtttgcaatgaaacccaagtgataagaaggaggcagctttgcaaaggtggaggagagcctcccttgaggggctgcttactaggatccggaggtggggatgagcctggggaggctgcagagaactgtgaggttggagctgctcacagggagaggtcacagggctttgagggccaaagggaggcctaactcctgtggaagccactggagggtttgaggcagggtaaggcggggtcaggggtgtatgccatgtgacccgaagggagggcattgcgggaacctgggagcgatgagggagacctgggccgggggagtcagggcagggcggatgtagcaaagtcacattgtcctgagtgaccattcacttggctgtccccgctcccaggcctcaggactgtgagggcaggcactgggtctcaggcccagagaagatgctcagaaaaggaaaaggagaccggggcacgagtgagccagtgcagtgtgcagagtgagggggcagtgggcaaagaaattgcatggcccagatcactcactggagaccagagacaccttagtgtcccaggatgatgaagagcgaggggccagagctaggggagttagtgatgcatctgctagccgggctggccctccctgtgggcacagagaaagtggttcctcaacagccatgggtgacctttaaggatgcccacagatggtgccatctcaggagaagggtcccagagggactggctctgtcacctgctgtcagctgctcccggaaagcccgcactgcatgacttgctggtttgttggaatggttccatcttgctgtgtcacttccatgacaatcaccagaggaaccaggcccaggcaaggggcctgtgatgaagcgagcagccctgatgacatcagaaatgcagacagttccagacattcaagcatgatgtccttggctcttgggtgaaaatcctcctcggtgtgtcagggaaagtcattgaattcacgttggacccggacttggtaaatcttcagaagcacgctctattctgcaggatttaagcttcagatgggcctagactggtatgcacaggtagggactgtgcacttgagcacagatggaccttcagcccatctccttttggttctcatatacttgttgagccctggctaggccctcctgagctctgtttcagggcctgcagaggctgctgtacaggtcacacttggtctctgctctcacggtcaagtagccaggatggacataaaactaatgaacacatacatcaagagctaattaaaaattgtgctgaaggccatggtggaaaaataacaggaaacctaacaggtgggtaggaagggtgagaccatgagggatgaataggagttcatcagagaaaagtgttgcctccagagggaatggcacagaaggcagccctattgtgggaaagcacttaatgagcgaggagggccatggtggtagagaagcttaagaaatggaggccagggctctggggttacagtgggggttttatatttcatcctaagagccactgtgatgtcatgtggggagcaatataaggccctgtttgcttgcttgcttgcggggtaggcaggagtggaagcgggaaaccagggcagaggctgcagaactgtacaggtgaaagtgatgctggactgcccccaggggttagaagtgaaatgaagataagagatcaggatccaaaaccatttattctctccctttttcttcttggggcacccagtagtattttttcccagaagacatttcttaaaggatcacttaagccaggaactgtcaaatgcacaaaccaaatgcactttctactagtttttgcaaataaagttttattgcaacatagccatgcccattaatttatgtcccatctgtggctgcttcacactacagcagcagagctgagtggcggcagcagagactgtgtggcccgcaaagcctcagagttttattatttggccccttacagaagacatttgccaattcctgacctaagcaaagtgagtgagggacgcattttcaaaacacaaatctgttggcttaaagtcttcctagcacttaaatgcatttaatccctctgaaaaatgctagagtagacacagtttttaaattgacttttgtttttctttaaccttttgctgatattatatataagaaactcaccttatgctttaggtttagaaagtcagggttggaactcagactttgaagatgttgtgtgatattatttctctaaatttctactacaatactaaagtctcctgatgtgttatttcactttttgtcctttctctgaaatgctcattttcctccttttctgtaaaatataatctcagggaagaagtttgtaaaagcagcttttagcctttgcaaagatataggtgggcctcttgtacaataatttttataagagtttgttctttgcaaatgcagatgcatcctactaagccacatacaaaaaaatcatcacaatgatgacaacaacaaagccaattttccagattccacctttctccttcctcatcctcttcatgtttgaatttgtgctgccaaattctatagagcattttcagatccacttgatttacagatttgagctgaatttcacttggaaaactgaccatatgtctggcaggcaccagcgaccattggcagtactatagggttgatactaaacagatgggctttctagttagatgtgctgttttttccacaatacatatgagaaagaaaagaagccactttaataatgtcttgatttttccactggtgtcagagtcatcaatgatgcccatttatgtagtcttaatttcagcatcattgcgtgcagggtgccttagacagctagaagaagcttaatgacttgggaaattttgaggcccaacttctgcctagatcttagagaatcttgttatctttggaatacagatagtggataaaagacttttatagtccaaaaataaattattaacactatttgtcaggaatacattcaaagttcttagtcctgggtttattgctcaaactatttgacagcttttgtggggttattgcagtctaggcagcaaggtgtaaatagcggttgtctgataggtctgtttaggaaaatctagctaaacaactgaatacgatttcttcctgcagaacttctcagagcctatactatgctaatatgcactggggctctcatgaagagggttttagtacagacagcattttctaactactttaatcctctcagcatctccctatgctagagttccatggaaaacactttgggaaacaccggtgtcatgcctagatggtaaactgaagagcagagaggctgcggcagacctgccatttaccagctgtgtgaccttgaacgagtgctttcgtgctctgagcctctactttttaaatgtaaaatggagctgaaaatataggccctgcctgttagggttgtttgcctggaatgaacatgcagaaggttttggtggcctccctttgggcattaaaatataagttctcctaaaattaagtatttattcaattcacaattttccaggggccaattattcactctgaagcttagccaggcttttgtcttttcttctctgtgcttcttagcacctccactaaccagtaaaggagagaaaggagatgccctttgagttaagggctgctgagggggcagccagaagaagccatggccaacatgaggtctagaggtggctcgggaattgcagttaccttccactgtcgggagtcagtgggacagctccaggccattgttaaaaaccattgccctgcatttgattctgcttccatttttgtatcatgggatcaatccactcattcatttattcactcgctcactcatttattcaacccacctgccaggcactgtgctaggtgccggaggaggaagcggaccctaagtctaggaattgcattgtgcagttgttgaggtctctgtttcccctatactggaaaagtcagcagttagtccatcaaacaagggctataatcagattacagattttgatgaatgaacttgcagggctgtagaaaaaagcctataagcttttaggaatagagccataggcatttagcagtattttcttcccttttttgaataaattcactcctttttttttttttttttgcatccctccctgccctccacccaacaccagcaagcagtttattcctccattataagcagtgtgactataagacacttgtcaaatggtctcactttgtccttggatggtatgacccttgttttgtttttattgatcagcacacccaaaatatcatgctcttcagtcattacttaggaattttctaggggtggaggaggtcaaaccaagaacttttacatttgggagattgaaatctatttctaaaacttgattttggaggttcagctccattctggtggtcactctctgaaaatgcccagcactttttctgtagatggctgtcaagccacatctcttgcagcctggccacaggcaattggattttcagtgctcagtgcttccgtgtgaggttattgtatgttgctttaaaggttaacttcttcctcctcccagccctatttctccttcctcctcccagatcttagacagcagtgttatcatctgctctgtgtcatctagcacaggactgggagaggggcggagttgtcaaagaggctgtggggttaagatcagggcttttacagcagatgacctgagttctaagctccactctgtcgctaactagcatgtgccctggggtaattatttcacatctgtgtgcctccattgtcctcatctgtaatgtaggtgatgaaaatagttcttcgcttgctagggtcttgatggaatacaatgagcaaattcatgccaggtgctcagcactgagcctgttgcacagcaaatgctcagtagatgcttccgttgctgatgacagtgatgacaaaaacaaaccttcgtattccttggctcttccatatgtgtgagtgcccccatcctctgccttcctgccttcagccttgttccccctacagtctgccatcctcaccgagattccacgtggtcttctcacaaggctgaacttgctccaggtccctcaatgactccacattgtccccaggactcttatcacagccacacagctcttcttggtcaggtccccacacgccttcctaagctcacctatgtcaactctgttccatagaccataagctccagcctaagggtcctcaagttccagtgcacagacccacaccagcaaattaagaacactaagagcaatgcagttgggttttcatttacgaatgtagaatcaattaatttttttaagagacagggtcttgctctgttgcccaggctggagcacagtggtgcaattcactgtaacctggaattcctgagctcaagcaatcctcctgcctcagcctcctgagttgctgggactacaggtgtgcataaccacaccgagctaatttttttttccttcgtttttgtagagacagggtctcactacgttgcccaggctgggcttgaactcatgccctcaagcagccctcctgcattggcttcccaagccactgagcccaggcctaaaaattctgtttgtttgtttttttctgagactatattttttctattatgtgtactaagttgtgatgaacatagatgattgctttgtgtagtgtgtgtgtgtgttggccattactgccataatgaacattagcatatctgtgtggatcccaattttatatgtggaaattttactgggtttctgagccttagagactggggacctcagacctagcttccccaaatgactccccattccccaaacaccatgtactgccatgcatttatgaatttgcacgttttactaaaatcctactcaacctctaatacccaactcaattatcactacctactacctcccctagcttctagtagccttcttagagttatcccaccctcaagcaggaaaagttgcttcctctgctattataatcctctttcttgattcttcctggtggttccaggtaccttagttttctcagtggtcactgagtcccccgggagagagggtacctagcaccactttgtccctcaggcctaacactgtgctttgttcaaagacaatggtctccacgtattggtgttacaggtaaggactcaaagaagaaatagaggtcatatctcagcttcttatttgcttctattgtggctcatgtcacattatgaggttgccttacactttctgtgttccttcttttctcctccataaatacatgagcttcatgcagcgggaaactgcaggcatgttgatggaatttactgctctgtcaaaactcagagcagtcctgacacacagcaggccctcagccgatatgatgaatgggtttgtgagtgaatgaataaaacaaacaaggaaaaaattattttgcaatattatctgatagagatggcacctttcttctctaagaaatcagccatgtagcacatggcactgagtacctgacctcactcccccagagatatggggctttccttccaatatgtttttggggaatttcgtgaagtggaaggataagataagatatcttagtggatgaaagatgaggatgaaaaaatacctgatgtcactaaagggtggacatcaaagtcagatggacgaggaacagaccctggctccagcgtttggcagccctgcactccggattcacagggtcgagcaggtgtttatttgggcagcccctgggtgccaggaaccagcaaagatgcgagacccagcaacaagcacgagagtgacggttctcattgtcatggagcttatgtttgttctcatgggaaatgcagatgacagtcaataaatagtgaatcccagggcacaatctgagagtaatcagagctaggatggaaggaaatgtgaataaagggattggccctgcaccaggcatggaaattagcctgtaagctccatgaggtcagtgttccgtcagtcctagaacagttcttgcctcatagctctgtgtggctgttgatgggggaaagggatggagttagttacccagggacaagtataccagctactgtgagcctgagagaggcctgggagagggctggctggagttgccaaagaggctggagcttgtcccttgagttgcaagcatgtgacatcagcaggggagggccagctgccccatccatcatctgaggactgaggctgtgtgtagcacttcctcacacagatgccaggtgtgacagacatttcccattaattaacctctaatgcctcagaggtggcagaggtgcagtggaacctggcactactgttattcagaggctggggggtggctgctaatgtgtttgcaccttccagagtctctccagtgtgagaaggcagttcctcaggaactgcagggagagacggggagagaattcctggagtggggggaggtgctcccatctgtcccttccctctgtggacaggtgtgcatgggccacatgcacccgcccacagatggcatcccacccatgcaggtgcacacccacccacgcccatgcacactggctccgcaggtgctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacacctgccccgctgtacacctgcagtgatgggctcatgtcctctgcccttggaggggtttgtaagtagttttctctgagcagcactattttgaagtttctcttcttgggcggagagtcatagctctcacaagccctcccctggcacagtcctgggcttgagccaccccagggaaggcagaggggagagggaatttcctcccaagggggatgcagagcagcacagcctggggcccctgggcatggggtcttcactcctctgatgacagttgagccccttgaggagctgcttagactaaggcatctgtcctggtcaatgcattggatttttggtttaggagcaaagggtcttttgagctgaagaccctctagtggctccctgctgaattctgaatcaggttcaagtccctgactacgaccctgcctgcctccccagcacatccacgcctctcaaccactgtttcctcctgtcttggacagcctgcccctttcccatcatagcccctgtcctgttccccactggggcggccctctggagcacccagtgctgaccctgtcacagtcggtcagtcgacacctgccctcgaggctccctgaggaggccctgggtcctgtccttcctcgcgtctgtggggatcctggttcagggctctctatgtccccctggcacgtgcctgagctgttgctggcactggagatacagctgcaaacatccatcaagggcctgcagtcaggagcttcagctcggggcatgggcaggaggagtggagacaactacaaacaggtaaacaaatgagtgtgtgcgtgcatgtgcgtgtgtgtgtgtctgtgtgcgtgcatgtgtgcgtgtatgtgtgtgcgtgcatgtgcatgtgtgtgtctctgtgtgcatgtgtgtgtgcgtgtgtgtgcatgcacaccagctgatacctgtgatgagaaaaataaagaggaaggcaagaaatagtgaggagtgccatcccacatggggtgagccaggactgtctaaattcatacctttattcattgttcatctcctgcaggtgagtacagccccacaaaggcaggcatcgtctcttttgttcacctctgcacaccctgtgcctattaggatacatggcacatggttggtgtcagtacgtatttgttgaaaggtggagtgagtgagtgagtgagtgagtgaattcttaaagggagagaggagtgcagtctcctcagtggccaaagtgctccctcgccagccctcagctctgctgtgaggaccactgtgtgtcagagacggggtgggaaccccagaacctgctccagccactagggcagaagtggggggaggcagctgattaaaatagtgcaggtagtgacggtggtcctggcagtgatggtggtagggagggggaggcgccactgcccctcctgcccaccttccaccagtggaagcagtcacatagccacagcaagaaggagacaccataccccccagcaaggccctggcaaaggggatgcagggagtcaatgcttcaacctcctgttagtaagtggcagggccaggaggggagcctggggtgcctggtcccagcccccatgttcttcacagctacgtcacactggcttccatggcacatggcaagcactaatgcacaataaggatgataataagggggagggagcagcagagcacagagagctgcacaagtttagtgattaacttggattttgtcctaaatgagaagggaagcgagcaggaagtgatagggttagagctctatttctaagacatcggatcacaggaagaccagttgctggggcagggatgctggtactggaccagggttgttatgatgcaggtggcaaagaaagttgggttcagggtctgatctgtagtttattctgtgtgctactccgttttgccttggctgctaggaagctcagggcacacaaataccctcctctggagcccgtgtggtgtctgtcgtggggacccacctaactccttgatgctgtggccctcagcagaccctgattcctccagatccttcctgacactcccttcatccttcagctgtgtatgtgtgtttctggtgattgctgccgatcctttgtgaaggaggtgagatataaataaagcaatgattatgctccatcctcgtctcctctgctcatccctggagatcttcgtcttcatcttcagctgagcttggaggcttggggagacctagcccatccttcccctcgtgcaaagcatgctcaggacagcaggctttcccagggccatgtggagtcacagtcttgctcccatctggtgtctgtaggtggaggaaggaaaggagaggatgagaacatggaatgcattgtctctgagaagagaaggatccctgtacatccctctgcctcccgtggccttggggagagggtggccgggaggatctgtggttaattggtgttctgcagctgccctggttccacacatttcctgggctcccactgggtaccaggcactaggtgctggggtcgcctcaaaaacacagtggaggatgccattgctgtagctcccttaatggtttgcagagcccagaatgtcaaacaagacattcctgggcttgtctttccccatggggctgctttgtggagcatctgtggacacagcacctagcacagttaacacttgtattagtccgttttcatactgctacaaagtgcccccgataaaacaaaaaagaactgcccaagactgcatgatttataaaagaaagaagtttaattggctcaaagtttagcatggttggggaagcctcagaaaacttacaatcatggcagaaggtgaaggggaagcaaggcaccttcttcacaaggcagcaggaaggagaagtgcagggcgaagggggaggagcctcccttataaaaccaacagatctcaagagaactcactcaatatcatgcggacagcatgggggaaaccacctccctgatccaatcacctccacctggtctttctcttgacacatggagattatggggattataattcaagatgagatttgggtggggacacaaagcctaaccatatcagcactctattagtaatgcctggagagaatgacctcatgccccaacccacctagggtgggcctggtttatcctcttgtcttggtgtcccatccttctgtgttctgctttgggtcccctcgatgcagctttggaaggtgagaggggcctctggagtcagggtgctcaaggtcctgccctgccacagcatttcccagctctgagaccaacaaaaaaatggctcagggctctgatcttcagtttgttcatctgtaaaatggatataaaatggaatgatctctagctcatagatttattgtgaaggtaaaataggacaatgccttaggatagtcctggccctgcacaggcagtgaccagcgtttactccatcatcattattctattgctcatatcatagaaattattataatataaattttgaccaaaagttacctgcactggcatggtatgttaatcagagtgatgataaagtctagacatatagataatattattttacatggatgataacatgaactattaataaactgtgtattgtggatgtttatctttgttttcagattgtttttcattttaatttttttttagagacagggtctctctctctgtagcccaggctggagtacaggtgcaaatcatagctcactgcagtcttgacctcctaggctcaagtgatcctcctgtctccgactcttaagtagcatgcaccaccatgcctggggaatttccaaaaatttttttgtagaggtggagtctctgtgttacccaggctggtctcaaactcttgggatcaagggatcctctagccttggcatcccaaagcattacgattacaggcatgagccactgtactggccttcccagaatttatgaccacactgagtcctcccctcaaccttacctatcagggatgattatcatggcatcttttttttttatcaacagatgtggaaaccgaggctccaaggggccgggtggcttactcaaaggccctgggttagagacaggtgcagccctttggaagccagaccccgtggaagctctagaggctgccaggcaggccgcctgtcactgggggcacagaggtcactgccatgtggggccttgggccctcgggtgctgcctcatatggctcttctcaggctgagctctgcagagcccagattcagagcaggccgtcctgggcctccttggggcagccagtggcatgcatgggtgccttaggtgggaaatgcgggagtgtgaccccttccctgggtctgaggggcctggcccatcataatccccggccccttggacactggtaatgccccttcccctcgaacactggtggtctccttccctgtcctctctgacaaaggtgacctccttcctcaggtgagcccttgtgttagccacaccgtccagcccttctccctgcatgtccatgcttcctggggctctgaggtctgcatcagcttagggctcccagccccttccacaggtaacaaggcaaattcacctgctggctgtggaactgaccacgcgctgaccatgggaggctgagccagctgtcggggagtgtgtatgttcgcagggcgaggggtcctggcagaggtctgggctcctgtggtagcagccgtgctggggagcaccccacgggtctgcgatcttcctcccccagcgacactgggaggttaaatcggagcctggttgggactcaggtccttgttgctgccagaagaaacgtcccttccctgtcccaggaggcatctggggcaatgtgctcatctattctcagtcctgcctgggtgacggcctgaactctgctctacactgtgaccctaggatggaggtgacgctggcttactttgtgagcttctctaactttaccattttgttagttgcattttgtttcattctaactaatctttcctactaagggacacacggcttgtgctacaaaaacagcctgtgaagcacatctccctctctcccccgcctgccaacagccagggctccccatttctttctttctttttttttttttttcttctttttttgagacagagtctcaccctgtcacccaggctggagtacaatggtgtgatcttggctcactgcaacctttgcctcccgggttgaaacaattatcctgtctcagcctcctgagtagctgggattacaggtacccgccaccacactcagctaatttttgtatttttagtagagacgggatttcaccatgtcggtcaggctggtctcgaactcctgaccttgtgatctgcctgcctgggcctcccaaagtgctgggattataggcgtaagccactgtgcccagccccggggttccccatttctttggagggcccacagacattttctctccacacaccagtgtgtgcctgtataccacccctgttcgcacactggtggcgtgtgcgtgtgaatttgtgcgctggggttttctttggcctgattatctcagatcagtttcctgtccgtgcttggagatccactttctttctttctgcatctgcacacaggtggttgacaggacagacgatgacttacccagtccccctgtggacgggtatgtaggtcggtatgagtctcttttacaacaaacagcactgccatgagcttcctaggacgttcatcttcacgtgtcccagagtctacaaacatggccgtttcatggacaaggaaggggtccaggagcactgcttcctctgcctgctcacagacgtgctcacagacgtgctcactctgcagccgtttgctcagaattctcaccggcctggctctgcgttgggttccaaggctgccccaggcctgggctctaccctagaagaggtggcagcctggtgggagggcaggcaggcagaggtctttgcggctcattggtgcctgcataggtagcttcatgggcgtaagacaagggagtgaccctgtctgggacaagaggaaggtaaagactctggacaaagtcctattcaatggaggagctgaagtttatgaggcagagaagcggctgggagggagagcagcgtgggtggagggcagagcacgagcaagggtcctgggcaggcagcgtttcatgctggaattaggaacatcttcacacgtggcgcgtcatatggcggaaggcgaaggcttctggtggccgtgagtgggtcgcaggagggagggtctcacagagggaaattcagcgcacgctgctgagctgctgcggccactgtgggtgcactgctggacaaccatcctggggtccaggctttggggggatcactggtgaccccttagggtgagaggtcatcaccttgggcccccaggagtcacataggtttggtggccacttgaggacccccttggttttcgtcttccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcaggtaaaggcctggtgacaggcgcgggcaggctgtggctgggaccagcgtccttggcatggtgctgcggcccctgctgatctgtgacttcctggcccctacacaggaggggcagatgtgcttcatggcctgtgatggccaggagccatgcaagttaccccgctggcccctccagggcccacctggcctccctgaagccctggggtggagttggcaccaggcaccccatgtgggacgctctgcccagaccctaaggtgcccacaagtccactgggaccttgttaaaaacgaagcctctgatttacttagggctgggttgggccgagacactggctttggagcaaggtctcacttgctggcttcacctgggtggtgagcccccagcccacgcgactcccgcaccacctcacctcccacacctgcaatctcacttggaggatgctggggcctgggtcgtacccccacagatgcaggtttagttggccaagagcctcctgggtgactcagggttgaggccgtcggtttggctttgacacctctgggcctctcttcttcctgaaagacagaggctgctcccctgctcctaagctgtctcagtgtgccttccctacaccctcccaccaaagcatccagaaggttcctccactcacctcctgctgccccctcacaccctgccagccctggctctgtgggaagcgggattgcgatggctggtcccgttgcccccgcctcctcggaatccagcttgggaactgcagccatgaggctgaaccacagacagggtggacacaggcagtgatgacgggacaagcagccgtaaggcacataacggcagaacacggccccccagcatttggcatggaggagccaactcaaccctcagaacctcctgctaggccagcactcccgcaggatcctgccccatcggaagggatggggaacaggcccagaaagggaaatcactcacccagggtcacacagccagcaggtggcggggctgaggcttggaccctggcagccgggtgtggtggctcgtcagcctgggctctgcagatggcagtgttctgagaagagagcccggaggaggccgcatctccaccccagggccccgcctccagccacatgcctgtgagccacacctaaaaacaattagtgagggagctgctgctgtggaatcagtcccaggcctcaggaaccagccctggcgagtgcccgtctcaggctgttgcctcggggggtccctggggtcccatttcctttccagctctgaagaggcgcaggctccagggctttgaggatggtggagacgaaggccaggtgttacagcgcccaggcccacagcaggggaggcggccaacaccgacagcaggccctccactcatgcttttctgtgtgctttacaaaattattattattatttttaccaaccaagaagttgatagatgaattcttgttgaagtggaaacagaacaagcatcatcattcggcagatcttgagcacctcctgtgtgcccagtaccaacaggaggggcccaggccctgcccacccagagctttccgcagagtagggagtcgagtgacaaagtgtggaagccaccaagtgaaccagcacgtgagtcgattgcagactccggcgaggctgcaaggcagcctccctcactggatgctaggctcagctaggtgggcgggttccatttgttcccctgcatctggcagggccccttgcacacacacggcactaatgggctcttagtgatccaggcttaatggcaggatcacggagcaggccctggggggtggaaatgagcagggcgggcactgctttgggcccagtggtccgagaagacccaggtgaggaggctgcattgagctgagatgtaattggttcattgagaaaggcagggaagagcatggcagcagtgggaacagccctcgaaaaggcagcgagctggggaaggcacgtctgtgcagcagtgaaaggccgggggactagagcagagtgacctccgtgacctcaggggggtctctgacattctccaggcctgctgaccccagcagtggaactggaaggctgaggtttgtcttctgaggactctgggctctttggcctactccaagctgtgccgtgtgagttcaccagcaagatgctctggggaccctgcaagggcattggaggtctcgaggtttttacctgcagcatccccaccttcaggaccgccattcgggcatctggaaattcgaggaacagtgctgcattttgtttacttattccaaaccactattttcctttaaagcagggggtgttatttgtttcagcatatcaaattcctgatttcacgggcatcacgggttaggatgagttgaagtgaatgcaaagatgattgaaagagaaatatgtagcaaacagtggttttggtaggcgaggctgggggaaccggctgaagatggctctcaggggctgcagggtggaccagcatctcagtccatgcctgccctggcaggtggctcagatccactcagccatttacacactgtaccaccttcacaagctgcaccaccactgacgtccccatccccgagagggggagggtagagcctcgcagctgcatctttgggtcatcgggaagtccttgagtcagtgcaggcaaagacctgtgatgtctgaggctagccaccatgagcaccgcctggtgccggcctggggacggggtccacacagagctcgaggcctccacccctgttcttcttatctgctttgtgagcctggctgcagcctctttgctgacacctcccaaggtcagcattcactttgtcaattttatccacaattctggcacctggaaattggcttggaaattgggaccacagaaaggaaattctgttttctctgcccaaaaatgtccccaccctgctgtgtttgggtttcccttttcatcctttggctttagggtaaatatcctcagggaagccacccgggaggtcaaggatgggatgggtttccccagacaactgccccccagtcagtcccccgccccaggcctgacttattcctcctcgcccacttctagacacttgccatctgtcctcccacctgtgctggcatcaggcagaggctgtgcctgtcttgctcatggcagaatctcctgtgcctgacatggtgcctggcacacagtaggtgctcagtaaatgtgtaaggggtttccatagattgaacacctgatcaccatggcctgttcccccagtggagccccacctgtgaaggctgcagggcttctgccctccgtgactccccagcacccagctcagcacttggcacatagcaggtgctcaggaaatgcttttgagtaagtgaaataattccattgccagtgcctgtttgtcatctgcctccccaactagacattaagctaagccaggtgggctgactctgtctgttccccggcagctggcagggccccctgcacacacagaacactgatggactctctgtgatccagggttaatggcaggatcacggagcaggccctggggtggaaatgagcagggcgggcactgctttgggcccagtggtcggagaagacccaggtgaggaggctgcattgagctgagatgtaattggttcattgggaaaggcggggaaatcatcacagcagtggaaacagcccttgcaaagctgcatctttcaaagaaagggttgaggtggttatgtagtcttgtatttggaaattggggctcacctgtaggcaaacagttttcctgacggaaggaagaagatgattgtggagcagcccgaggcctgcctgtgaaagaagggagaatgggacaaggtggtggccgtcgctcaagagtgttttgctccgggaaggggaggcagaaagggctattctgaaggcggaattgacaaagatttggcaaattaggcttggtggaaggggactgggggctggcctcctcccttcctgtccatctggtagactggaagcttttaacctgggtttattggaagaagctctagtgggagagccgcacaggagaatctcatctgtgagtggatgttaagagcggccaggaggcacttcgcaaaggcgaacaggaaccacggaaaggagcccggggtgttggcggcagagggagggcactttccttggttggtaatttagggaacatttggtgaagggcaggaatggctggtgagagctagcttagagaggggcgttatatgtgcaggggctttccagataaatcacagaaatgatcgctgtagaatatctactgcgtgcactgctctttagctgtggtttatgcacattgcttagcagcactcttggtaagaaagttgggcctcgccagtggactaggccccctaaccccgaggcgcctgctagctcagtgtttttggtctgtaaacttgagcctggcattggctgtggcttggacagggcccagtgacacctttgcctgagactcacctgtgtgtttgtgtgttgggcagcgctggagaagaagatggccggcaggcaaggccgagaggagctcatcaagaaggggctgctggagatgatggagcagggtaagtgggacccgtccctggcttggaagggcacggtgctgggaatgcagaatggaaagtctcacatgagcccaggaagcccatcagaaacagtgtagaatccaaggagggccgtgttcagatgaagcctgcaaggttggagagacaccccatgtcaggagccattccattggtccagcccccaggggcacgggagaccccattactgagctgaagagctccccctcatggcaccactcctctctggggaatgtctaacagagctgggtgtgcatgaatctggtggtttatcccaattcctttaaagtggtagcagtggttttttcagcattaatttttttttcatattcacatttcagtcctccatttgggcaaattatttttaattccactattacctactccccctaccaccatgtaggaagcattcaggacatgctggggcggggtgggatattgtgcacgccctgtctcattggtcttcccagcatccctggggagagaggcagcggctatcccacttgcagacgaggcgtgggagggtctgggtggtgactgccccaagtcattgcagcctgagagcagagacacagaacaaatcctgatctcttggtctctggtctagagagcttaatctcagtggggtctacataatcatctttgtttccatctttcagaaaggccagttattatcactcatgcaattaactgaacagagttctttaattcccaagtctttctctttgtgatggattcctggaggtgtgaggcccaggacttagatgctgacactagcccttggtgccttccggttccctgagaggctaaatcttggttaggaggtttcacaacacctcactgcctctggaagactctctggagctggaccaagctctggcctgctgatttgaggaatctggccatgcatagccagtttcctgaggcttgcatggatatattgaattcctctctccccacttcagccttaaaatattactagtgtctttgtaatttggcccaaatatcaggaattaggaaggaagctcatgaaataaacgaatccagattttatgcagccgggcctgtcagcacacaaacccgattgtgggcccaggcttttgtcattgtttcctctctttagactcgaagagtgaagtattttgatgatgctatttttaggggaaatctacatgggaaattgcttcatagtgataataaaaccttacatgtgcgaggaaagcttggtgtcaagtcccgtggcactcagatggttaacgccgtcgtgacgctcggatttggcggaatgcggttgctgagctagaaatctggaggattttcactgggatgggacaaaaaagtgtcaaactccggcattttgaatatgttgccaacaagcatacctttggatcttagggaaggagaaaggaagatgaaaacaatgctaaggccttttctcatctattctaaaaaaaacactacttttgttgagtaaagagtaagtatatagatttggttcctctcaaaaatgaagctatagtttgactaattaaaggggaaaacttctaggagcgttggcttttttccactctgaatttttgcaagatgactttgtctgatgaagtcatagcagaggctggagacgaatgcttggccgcggccaggctgacagtgtggctctcaccctgctgccgtgggagcctggtctctggcttccgtgcctctgacggcgacatcacacacccgcaggcttacagaatcactttagatcagggtcggcaaaccttttctggagagggtcagatagtgcatatttcagggggacgtgcagtctctgttgcaactacttgtctctgcttttgtagcgcaaaggcagccggagacaaaacatgcatgagagggcatggctgtgtcccaagaaaactttatttatggccactggcctttgaattttatataattttcatgtgccacaaactattatttttcttttgatttttttttcttttgtcaaccatttaaagatgtcaaatccaggtgggggagctggattggtccccacattgtggtttgctcatctctaccttccatactctctctcttgctaaatgattgtggaccagggactagagtggcctgaaacacagtctctttccttgagagggaaaatgcactcctaaattgatgccatgacattttattgagggcccactctgtgtcagggtctgtgctagctgctgaggacacaggtgagcaaaatactgttctgaacgcacatccagtggggccattaggtaatcccacaaaaagccggcaactcacgaccacagtgagtgcagtgaaggatgcagcaccctaagatcatgagacaggacctgacctggttctcggggggccgggagatgtttgagtcaggtccaaaggtgggcaggaggacctaggctggttctcagagtctgttgcatattaggatcacctggagagatttaataaccctccaccgctcaggcagcagttaaattagatgcgctgggcgtgggacccaggcagcagtgcttcctcatcctccacagctgattccgactttgatgcaggaaggttgaaaagccaagagacagaaggaagcggggagtgacttccagcccacaggagcagcaagcacaagtccccgcggtggaagggaccttgagatggtgggttgggttggaggaaaggaggaaggaggaagcaggaaagggagaggggcttgggtcaagacgcctcccgtcttccctgcccacacaccggctggggtggcagaggcatgaccacgctgctgcgggagcctggggcggccacagtgcgagtgggtgggatctgcgaggagcccgagtgtctctgcagggaaatatcagggaccgggcagcaggggttgctctgggaggggacttggacttgcttttcgcagtcgactcttctgtgctgcttgaatcctttactgtgtgccacctgtaatcaacctgtaatcaacgtgctgtaataacgggatccacgcagatgcttggccacaggctcccggctaaatccttccctgcaccgcagtttccgtcctgcactagcttcaaaaatgtcttttctcactgggtcgacctgaggtcagaccctgtctgtccctaatcctcctggtgctgggtcaccgggtcctcttgcaggatgactggaattgttggcggtggctgtgcacctgccctctccggctcaggggaggatcaggcttgagggctgttgctctggggtaggcacgcagtgccgccgcctctgctgtggatgtgaggactctccagggtgaggagcagaggcgctttcctggctttggggttaaggaaccggcttcagggttaaggaaccggcttcagccaccgccttccactgctggcagggacgaatctgcagccgggggcgccctcctgtggccggccaggctcatgagcctccctgcaaggtggacgggacttcatgcaggacaggccctgtgaggctgtgggagtggattgtcagggactccagagcctcatttgagccccctcgaaactcacatttgaacttccttggccaggacaaaccccaggattgccctctgccctgcacacgcgcatgtatgcacacacacatgtacatacacattggacaccctggagcttgccctgaagcaggtgggcagcctggtggagtgagccggactctgggcagggccagcagaagagagcccgccagctcccgggggtgaggcagcatccagggcatgagtttgctccctctggggtgttactttatgatcgatggtctgttttatgaaccactgtgaccccctcccctctcgttcctgtgactctagtcgccagcttggacctaggaaggaccctgctggtggcgttattacatgactagatgtgtgcagtggagcccgttgtgccctggggagggcagaggggacccctctgatctcttcagtgctccttccaccctcgtctcggatatccgtgactaagtgaggccagaccaaatctctggtacaaggggtccccttccccagcccccttgccctggtccccagcccacgtttctctgtgctagacactgtttatgttctgaatgactttcctccatctccctgtatgcgttgacttggcattttcttaaataatttaaggaatttcctaccccgtcattgggtataaaagaagagagtttattactctgtgctgtgttcagtgacttgagattgactaggcattctttcctcagggaattggacagtgacaaatcaagtctatctggtttccatgtggtaggaacgccgggggacacatgtctgcacgtgtgcacacacatgcacgtgcacctgtgtgcacccacctgtgcttgcactgtgcacatgtgccacgacacacgtgtgtgcctgcgtgtgcatctgtgagtgtgtgtgcatgtctgcaacacgttccctctcactgtggctgctcaggtgcactgccccgcgctcccctctgcagccctcagaaggagagtggccgggcggaggctggccttccagcgagaggagcagggcctgggctcccaccgctcccccaacccctccccaaccagcgtttcttagcaacggccctgccaccagggctattttgggaactgaaacttttcactgaacatgattatgagctggagctctgaccgcagcccagagaagtcctgcaagaagtccttgcagaaaacctgcaagaaagcaggggaaggttcaaagactgtggaggggcatggtgcttttctgagtctggagacctctgggccttccaggttctatgttctgacctttttatagtggcagttgtgatgattttgatgatgacgatggaggcatccttattattaacagcagtgacagtcatggcagcaaaagacctgtgcattctaaggtttggtgtccataactgcaagtggtgggtggcagccttgcctgtcacatagggtaggtgtgaagctcaagctggcagagccctgtgctcccctacgccagctctcacattccctgtgtgttgccaggggctgggtaagctgtgctgtcacggttgcacgtcaaatgcgagtaagtcggtcacgagaaggggctggtttcagttttcagctttgtgacctctaattttgtctactcggtgagctctcttggcttgtatctgggttggtgggctgttatagccaagggtcaaatgtggctcaggacctgtttttatgtggtctttgagctaagaatgctttttaaatagaaaagactttcataaaaattaaaaaaaaaaaatcaagggttgcagcacgggggatacagcacgtggcccacagagcccgtcacaatggccatctgcgccttatgggaagagcctgccagcctcgcctggacctctgggcaactgacgcggctgcatggatgagatcgtccagccctaaatctccagacttctggcatggctgaccttttcattctccccggaggagacgtgtgcggcagagggaatatgatcagcagcgatgacaagctcaaatctcttccagggtcccaggcaggaaatgggtctggcatgagtcctgggtgtggtgaggactctggagggagaaacggttctgtcctaagcctgctgttagcagatgggcccaaaggtgcagaccaaggggccagatcactcttgtcaccctcctcttctcgttgtcagaaaccatcaccaacaacaatgacagaaagcacatgtaaagtgcctaccttatgccagacacattccataccctagctccgttaattctcactatgttgccatgaagcaagcagaaatattatccccattttatagataaggaaattgagatccagaggaatttgctatttgggcacaaaacaccgtttgcaggtggtgggacgcatgatggggtgactgtatactgtttgtccaaacaggacacttttaggagtgaaagggacactgttgaaggacacagggatggcaggtaggaatcgggactgaccaggtcctatggaccctgaccctgaagtaaatgttgcctcctccttccactgccaggatgggacgtgtgtggaaggaggtcagcgtaggctagcatccccaaacggccacctcgtggctgtgtcgacatgtgcaggtcacactgccctctgcaccgggcctccaggaactgctgtagagattgagaggagtcctgcagggctatgtggaggctttgtgcatggggctgtaacgtgcatctcagtgacgtgactgtgacttgctggccgagggccctgccatcctgcagttgggtaactgagccatttattttgctctccaagtgctgagcccctcagcattaaggtgcaaacccagggatggcaagtgaagggccagaccctcagaggctgcagcagccgagcttcaagagacggaaagcaccaggtccttccttatgccctgctagtgcctcctcttctgggaaggctgcctgtcagacctagggacccccggctctgtggcccctccatccatgggtgtgccccgttcctgggctcacggtgccatgtgtggtcatctgcgtggcttcctcagagtgtgagacccctgggggcaaggactgtatcttactaacctccaccttgccagggtttattacagtgccagacacgtagccggtgatcagtaaacacctgtttaatgcctggctgagggtcaaacggtgggtgcagaggtgagttggttctctgcagccatgacaacccctgcatctcagagacctacagcaatcaccgtttgttgtcccctgtctgggttggcctgtgatctgccccgtgggtctgctgactccagccagctgctgggcatgtcttcaggacaaaggtccagggaaacaggagggacgagcagggatgtgcaagcacttctcatgccagtgctgcatcatacccactgtgtcccatcgaccaaagcaagctccagggcagaggccggggtcagagtggggctactgcaaaggtgcacggcagtgggtgtggacgtggctcaggggcactgcagtctcccacaggtgtcggaggaagagtgcacacagggagtggagtgtaagagcagaaaccaggctagggtgtgctgaggtgcccagggctcccctggaaagtccagacttggagagggactcctagggtgtgtggtgagggggagaggggtgggggaccacccagagcctagaatggatacttctcagaaagactcttgggacgacggaagggatgaaggaagggaggtgcaggcccagctgacagctacatttccttgtagatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcaggtactggctggagaccacgcgaagttgagctgctcctagaatggccatacgtccccactgttgtccttggctatagcttaggcaacagccctcgtagaacattgttctccagagagctgggcccgtgctctaagcgctgccatgctgtgctgcctggctgggttgaagtgtttgctggggcacttttctctactgtctctttccaagtctggcacggctgataagtgaaggtacttaacgatgttcatctccctggcacacctaccccccctcccagggcgtctttgtgtttccctgggaacttctaggcaggaaagtgctctctggaggggcaagtgcccagtggggggattttagtgaccctaaaagggtaggaggtagggttgagggacttttctgtggccgaaatcctgccacagggggcctcttggcctaagagatgctgaagtccctgcatgtgtgcatgcctgggagctggtcggtgctgatgcagtctcagcatgctgcagcctatgtggggctcttccgctgcttcttgaggggaggtgggcttggtgccttgctccaagcctcagtttccctctgttaaatgggaaaagtaatggacctacatcagggttgtttggagggtgggaggaacttagcagtgtctgacgtgtagagtgactattatcaaaggcagtaggggctttgcgtagtggtggtggtttttattttaattgaatagaccagggcgcttcccaaggataggggagaagggaggaaggatagaggggaggaaagcaggaactggccacagacacctgcagatgcttcaccagctcctcctcctcctgcccacctggcagagtgattcttacggagcttcactgttgacttggaatcctgatgtctcgtaaaatttcaagctataagcgagtctcacacggtttgggggtgggaaggtgaacgcgtctctccgtgagtgtgggaggttggaaatccaggccccaggacagcctgctgggcttctgcttcagagcgggtggacacctggtcctccgtgcccgggacttccttctgccacacaagggtggcaccacacactcgcaggccgcccgtccacaacgcccctgcagcgctagcggcacctgcccagaggcatgctcagccctcttcgggggtggccgtgtctctccagtttcacttggcttggaatttggggtctgagagttgtgacttctggagggtcccagctctcacgcagaggccccctccacacacacaggtctctgtgtgccccaggcatctgactttggggctggcgtggttctttttttttttaatactttaagttctagggtacatgtgcacaacgtgcaggtttgttacatatgtatacatgtgccacgttggtgtgctgcacccattaactcgtcatttacattaggtatatctcctaatgctttccctccccctccccccaccaagcaatggcaacaaaagccaaaattgacaaatgggatctaaactaaagagcttctttgcagcaaaagaaactcccattggagtgaacagacaacctacagaatgggggaacatttttgcaatctactcatctgacaaagggctaatatccagaatctacgaagaattcaaacaaattgataagaaaaaaaccccaccacaaagtgggtgaaggatatgaacagacacttctcaaaagaagatatttatgcaacccgctggcatggttcttaaggctgagcagagcctggccttcctgccgtggtgtggtccccacagcccagcccttgtgtgtggcctgtgagcctccccaagggaggcagggctgctgctcccagcccttgatgggggtcacgcttctccttggcagtgatttctgtagctcagctcagggcctgtgcctgctcccctcagtgccctcttctgacctcagacacgctcccgctctctctccagatgctgggtgtgcggatgggttcctgagagcagagtgggtctgttgagattacacatttgtatcagggaccctctcctgagtgaggcctgagggaggagtgggaatcagctgggcagagagcgaggtgcagagcatcccagaaaggggaatgacatgcaaagacaggggacaggaacacacacgttttctgtaaagggccagagaggaaagagcatgagctctgcaggctggaggtgtctgacacagccactcgcctctgccccctggtagcacaaaagcagcgtcggtggtgaaagggtggggctcttgtcggtggaactttagtgattaaaaacaatccagggcccggtgaggtgggtcacacctatcattccagcactttgggaagccaagacaggagaatcacttgaacctaggagttcaaagtcatcctggacagcatagcatgacgccatctctacaaaaaagttttgttttttgtttttggttttaattagctgagtgtgtgggcacacacctgtagtcctagctactcacgaagctgaggcgggaggatagcctgagcccgggaggtcaaggctgcagtgagctgtgatcacaccactgcactccagtctgggcgacagagccagaccctgcttcaaaaaaaattcaaaataaacagcccacagaatggagagagagaagagacctggcaggttatccctgagggcagctggaaccccccagggatggagagtcgatgggatttgccttgtaggaagcgctctgctggtgacccagcaagacctgggggagactggagccgtgcatggttccctggggacttgtctcattcccagcttccccagtgtgggtcttgtgctcctgggatttgtgagatgacttcttgtgaatggcatgtggacagacaatgagaaaacattattaatgttcaattaataatgaaaaagtttaaacattaataatgaaaatacttttcagtaattagggcaagtagtattggcttctcattttgggcaatgatagagatttgctttttcttataaacagagataaaaatataaattcacttaaagtaaaatatagcaaacaaaagtatagaaagtacagaggaatgtccaaaatgtctaaagcaggagccacaagtctgatttaagaaagaccattccattccctagggatgcagctggcttattagcagttagtgacatttgtcatcatgctggggataacaagaggtgacacaagtggctgcctgcatgcagggttggggagcgtgctctactaatgactgcacattcatttagcttacttagccctggaagcagcccccggagatctcacgcccatgatgaaatgctggcacaaaagtcgaataactggtccaaatgactggaaacagagggcaatgtctttgacatcaggccgacctgggtttgagacacacggctgaactccttactgagctgtgggaccatgggcaagtgacttaacctttctgattatgtttgatcaactgtaaaatgaggatagtagtcacactgacctcccagggtcgctaaaattaaattaagtgatccccaggaaagacttatctccctcctaacccacaccgagcacttggaaagtgtctgctgctgctactgtagcatcactgttactctcaccatcatcgttgtcatcgtcattgtcatctgttgtcttcattgtcaaaaacaacccttggaaagggacgcactaacacgcattatttagctgcctacagatgctcccagagaggccatctctctggtagcatgtgtgttttgggatgtggggccacctgcagtttgctatggctgggacaaccccgaggcctcatccagccctgcaggcctgggatcctgcgccagggaccctgcgccagggacatcggtcacctccacaacaccaggtcaatgttcagaagcttggccatgagcaacatccctataaacggggtataacttaacacagggacattaaatgcactggttaaaaatttgcaagccaatgtttaaaaatcaggagtgttcacagaaatccagatgtgcagtttcttttcagtcatcaaagttcaggcctccggatccctgttcccacacagccagggtcgctggagctgaacagagtctgtccctgtagatgggtgttggagtttgcaaccctttccatgaaggttaagagcctagtctttggagccaatccctgtgttactgacttaatcttctgctttgggccccagtattttgtgatagaaggagttaaagcttgaggccactgtgaggcaacgtggtcctaggtctccggtttctactgcagagctcagggggaccagctgttagatgctgtgtgtctgatgctgtctgttctcttcccacattctgcacctcagcacccaagggaactgcccacatctgggcccagtcgctctgtgttgtgggtaattccatgacagacagatgtcatctaatggcagacaaagccagatcctcaagtggcaaatgtgtcacgtgagtgctggaacctgggacctgcttctctccttgaccttggacaagttcagggaaacctcatgggggcccagaacatggtgccccgtgggtgatggtctacacctgcaggagcccctggggtgtctgcagtggtgctcattgctgtcctgaaaggtcagctgctttctcttaaaaagcaaacctcccatgagctttgctgggggtcggggagaggggtcatcaaaaagcacaaggggctgtcctgggtcactcctggcatccaggtggcaacatccaggactggagttgcagcttccccgtgccccaaccatgatgagtgtgggtgtcaggggatacatctgaatattgcaaatctctcaggaggaggacactgtcaatgattttgaccattattttccttgagcctttggtttggtgatttgggttgactttgggcttttgtgtttggggcgactttgcttttcctggttttgtttggatggtgcccgatatggtttggctgtgtccgcacccaaatctcatcttgaattgtagctcccataattcccacgtgtggtgggagggacctggtgggagatcattgaatcatgggggtggtttccccagtactgttctcatggtagtgaataagcctcatgagatctgatggttttataagggaaaaccccttttgcttcgttctcattctcttttgtctgccaccatgtaagatgtgcgtttcgccttccgccatgattgtgaggcctccccagctatatggaactatgagtccattaaacttctttttctttataaattactcagtctcaggtatgtctttatcagcagcatgaaaacggactaataagtgccacaccagcaacagagcattccctacaaagcccagaaggatccggtgttttgacacaaatgggaacagggtcctcttcagtgtttctactatgggacaggggctgagttctggccttcccacaagtgcactaattaaaaaggagagtgacactcagggagcgtgttctgtgtgcactctattatcttataacagcctcatatttttggatgagaaaacagagcccagagaggttaagtcactttcccaggccatagagcataaaaacagatcaaacccagtggcaggactgggtttgatcttcaccataacagtctacagcctaaactctagagccaaacaggagacaaacatttcttctgcttctggaatgttctggaatgtgagtctagaacaaggactgtcaaattgcaggcttcaggtcagatactgcccatgtctgtgtctgcatggctgtggagcactgctctagtgggccggtcctgggagccagggagggaggggtgcctccctccctgtgccctgctcctgtcttcctagctggtggctgcccttaaccactgcctggggcctatgctggtcccagctacccctggggcctgggctctgggcaactgctgggcaccgagtggaggaacctcatctgggagttggtgagccacctggcccacagccagctgcccaagctgagaccaaggttgtgctgggtgtacgggggtggagtacaagtgaccatggctcaccacatccatccttgggctggccacccttgaactccagaatgtcttcagtgggtggtaactggctgcaaagtgtgtcccctgccctggtagccctcttgaggcaagtggcagggcagagtttttcctcttgtttaagttcctacataatattcttgattttgcctcttagcctggaaagacaaaaatgtttactatctgcatctgaacagaaaaggtttatcagcccctgctctggaaaataagtggggattacacagaagggtgtcagtggaacatgctcagcaaagaggtaccagtaagtcatgaacttgtggcgctgtggttgagcttcaggtatttccattcctagccctgacccctgcattggggtttgtacagtgtagaagcttctggttgagactgcatttggtaagagggagcctctgctggtccagccccaagggagcggtcccccaaatgcagggaaccagtgtcttcttccactttttaaaaaattgattcagcacttgagatgttaacagatgttgcaatttcagttttgacaagattccaaaatacaacggtggctgcacactcacgtgagatgcagagggcggtgtcagagaggagagggaagatggggaggagggagggagagaggagatgctgaaaaccgtctcctgtccttagagccatcaggcaggctaaggatgtgagggttcagtgtgtggtgaggatggatgttttgggggagactttggaggagggttttggtcagcgtagctggtgtggtgagtctcatggccatcagggtgaagggtggggaacccatagtcccaccttgggcaggtggaatgaggggacctcagagacttaccctttaccctgtgccttaaggcagtggcactatgaccattgactcagtcctgggaaatccagagctcccctgtccagtgcagtagccactagccatgtgactgtttgaaataattaaaatttaagcttgtttttcactccagccgcttgtccagtgttcagtggtcatgagggtctagtggccaccatatggacaaggaagaaatgtgtccatcatctcagaaagtgctactgggtagtaccgagggtcagggtggctgcacatctactttgctgtgaaacaagggcagatgtagtttggattggctagccttccagagttctccatactaacagagactgtaatagcaacagaggccacatggcccaagctggaaatattttctacctggccctctgcagaaaaggcctgccaaaccctggtttggagaatgggtttccactggggtgggaagcattgccaggagctgggaggctggtgaggaggcccaggcagaagttctgacagctcacactgggaaacacgtgggtatttctgagaaatattttcgaagtagagttcgtgagacttgcctgtgaattagatacaaggggtgggtacagggtggagaggacaagagaaggatggcgtggggcatctggtctggctggacagctggtgggtcatggaacactgaacctggtgaaagtaggtgatatggtttcgctgtgtccccacccaaaatctcatcttgaattataatccccacaatccccataatctccacgtgtcaagggagaggccaggtggaggcaattgaatcacaggggggcagtttcctccatgctattctcacaatagtgagttctcacaagatctgatggttttataagagactcttcccccttcacttggtacatgtccttcctgccgccttgtgaagaaggtgcttacttctcctttgccttctgccatgattgtaagtttcctgaggcctccccagccatgctgaactgtgagccaattaaacctcttttctttataagttactcagtcttgggcagttatttttagcagtgtaagaagagactaatacagtagggatctgtctggattagtgccatgtccacagcttctagaatagtgcctggaacccatggttgttcaataacatttgcaagatgggttgatggttgaatgagcaagagggaagggaaggctcaggagaattttttgtggggaccaagattcaagtttggatgtgattggcctccagatggagatgccagtgtggccaactggtaacatatgagtctggagctcagagaaatggtccagggttaacagagaaatggaatcagttctgaagccaaaggagtggatgagaatgacctgtgagaaggttagacagggaagaggacctaggccttcatcctggggcagcccaggtggacattcagatgcaggaggtgggacctgccagagaggctgagcagaggtggccagagctccaggggagaaccaggagagtatgtgtcgggaagccagaggggaaagtgttaaagatggtggatggctgagtggggtggccctggctcagtgagggggccaggccttgctgggtggagatgcagtgttaaaggtcatctttcataagtttatttttcaaaggagcagataattgtaactaagctgggagtatacatgaggtcaagactgtttggtttggttttgggtagaatattttagatcttgttgggatcctgaaaagaaggataagtcagtgatgcaggccaagcgggacaacctgtcaatagctcagagggatgtggaactggcccaagtcagtgcttatctagtgaagtcttatgtggagatcagacatagaagatagatccagatgattggctggggctgacccagaagtgaggacactgaccccaggctgcccttcctccctggtatgaggacactgaccccaggctgcccttcctccctggtatgaggacactgaccccaggctgcccttcctccctggtaatgcttcctttggtggcacctctgagcagacccttggagcctggttcagacgctggccacattgtcctggaggagatgagtcagaggagtgctgagtagctctagacaaaccttccccaccatggtttcatgttggcctttccatacttgtagtgggcaggttcgggtattttatacagattattgtacagatgaggagactgagactcactaagcaaggtggaggccaaagtcactcgtctgtaaataggtcaaacgtatggaggaagggggcggatgctggatactggtgtaattgaggccgggtgagccagttccgtgacatctctgtctcccaaaagcaggactttggaaatgtgctgggtgaccagtaccctgagagcgtaacccattcacaaagaagcgttcaggaacaagaagtcctgtaaacccaaacaatcaaagcagggtgtggatgcaaggaccatattaaaggacttcagaataatagatgtgtgaatatctgaaaaggggtgggacccccccaggaagaaacttcctagaagaaaactaggcctgggctggctactgagagctcaccccatgcctggtggtcttggccaggaacttggctgccgaggaaatgggctgtgaagtgtggtgtcccaagaatgagggtgtccacttgcctgtgctgatttacacaagacagaaaactccacaaagttataactggaacctacatagagaaaatgggcatttctgtgcttacctgtggcttaacaaggacacctcacaactatttttacctagaaagcataaaatatttactttgatgttgttatcagggcaaaacttactaagtgaaacaactaatcagagttgtagactcttagacattataggttacaagtcagatgacataatgacagtctcaaagcataggagtcttaaaccctttttaacaagtaacacttttgaggacagtttaatgtaacaagaaaaataaaatgaaaacagcattttcatgtgggtatccatgcagaacaagagtatagagccagttgtaatggttgttctcagttcaggccaacttcataacacagagctgagtctgccgtctgcagctggagtatgtgttgttgagggagaacaacacatactccatctctgctttcagagattttgttctccaggcattaggagggctggcctttctgagataaggactccattgtcatgaacttaacataagaaagggctgggaatgagagtttaaaacttccaacatagccaataaaggaacggaaactaatgatagctaatgggatacaaggagcgtgcaatatttgcatctggtgtttagctggaggctctctgcaggcaggaattaggcctgttgtaacaccccctccctgaccactgtgttttcagcaccatggacagcacccaacagctcttgggtacctccagaaacagcagctgatagatgaatgaaccccataggagctaacacagtgacccaaggacaagccccagctccactaggcttttcccttagacatacagtggggagagtgttcgtgtgttcttcattgggtagttgtaaaaactgaataagatgatgtatgccaggtgccttccacaggccttagcactcaagagtgtgctgagagggcaggaagtgagggagtgctggtcccagggagaccatctctcttggatcagagggaaggaagaatagagatgctggggacagcagtttgcatttgagtcagaaatccaagaggagccccggtctgatgacctcagtttcccctgtaaagctggaggtgaagctgtgtggtgggagcaggcaaaggtgggaagctggaggtggggaagggacagaaagggcttgagcagtcatgcagagcacctgcaggaggaagctcctggccacgggtcctgcagagtgacagttcttcctgaagtggactccgtaggctcttcctcctgcaatagtaggcaagggcaggagcagacaagtggcagcttaatccccagatgaaacttttccagagagttaaatggaaaggaatccaggcaaaggacttagggactgttggtccgattgttgttgaaataatggatgatggaacccaagccaggcaaaaagagaaataagaaagggaaggattgataggttgagggaaagctggggatgggcaggctgaggggtggttgtgaaggaggtggatggagcctgaatcagcagctagaaagggagggatgagggttctgggtggcctgacccttcctccaagtcgatccttcctatcctcactcccactctaggctggcatgccagatgttagggctgctgcaaacagacaaataagaatgagagctgctggactggagggttacactgtgtcatggccacttcttgcttaaactgagaaacaatcctgtgagggactattgttaacacaatgccatgcatgagtaaatggagttttggagagatttagtaacttaaggtccaagagtaaattcagagaccacttgagcctgggtgtgtctgactccaaaacctggcatggtgaacactgctcctaggtgaggtgggagctgtggcatggacctctcatgtggaaaaaagaatggaatccctcatactattgaaatgacttccctctctccatattcctctctctgcttccgatggttctattgagagttgaacttgcaggaagtcaagtgcctgtgtgaggtcactgctctgtatgctcttcacgatcccatcccaccaaaccctcttgctttgctctcttacttccactgctgtcagaggaaacatgtttttaactctctgctttgcctttgaaccagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggtgggtccacatgcatcctgcccattctatttcctttctctgccccatccatccatctatcctacattcatccacccatccatcatctatctatttattcacccattcactcatccatccatccataccttcaaccagtcttgattgggcaccaactgtgggctggttctcatcattagcttctgtgactggggctcagggcaggcccagaggagtagatcttaccaaggaaactgtggttggcaggagtagactgcctaggctccctcaagcaaacaggggagtctctttgcaggagtcaaaggggggatcttccaggacctgaatgcaagaggtgcagccagttcccaggatggggcttggctttagcttggcttggcttttctttttcttttttcttttcctttccattctgttcctttccattccattccattcctttcctttccattcctttctgttccattccattctgttctgttccattccattctttctggatgctcatgtgtctgtctttctctttgtgcttctctctgagtctcagtctctttcagtcagtctctctcccttcctccctccctctctctgctggtctctgttttgctgtttcactttccagtgagttctgtccagcaaggcagagccaggagtaaacagcagacattggtggtcagataggggtgcacagctggacagaggcccccacagtcatacacttatgtagcttttgtcacactggcagaataatcctagcaagtagagataattactttgcaagcttaggtattttttatctggaattgactgctacaaacaggacacattgatggtctcagggaaaaagtaggctgttgatcaagagataatgacttttcagagtaaagccttgcgtgctgtctttgaaggctgtgggcgtgaaacatgatgcatagcagggtttgacagttttgttacaatcacctaaccagtgattaaccaccatcaataattgccatttgctgggtaggcacgaggtgccccatttatggttgagaaaacaggctcaggaaactccagtaacttgtcccaggtcctggaaatgattgagacttttgaacccagtttttgggcccaaagcttgttgctaccacacgtgtggccaggggctggtgccctcccctctgcgatctcacctaatcctcattgtgcttcttcccagttttcatgaaagagggaactgccaccttttggaagaggtgtcagctgctgagacaaggagagcccgggcatgagctcgggagggctgggtcccagcccttggctcttttctggggaccttactgccccttatggggtgaatgttcaatctggaggggactcttgggtggaaaatgctttcagtggggcattttccttgtacacctaacacgaattaagtattccagtctaactgatgattctcagccagataccacagaaacggaggaggtgagatgcaccccacagggggcctctttagctgggactgcagatgtcctggatgggttagatgtggggctgtggtgccctgtggttccccaagtagtattggtttgtgggagaatgtgctgctgggtgggtggagggatgagtgagggggcgcccccgccaccccaccaccctgagacttggccccagctgttctccctgacagaacattctcccttcctgctttgcctggtcagtacctttgcatgcttgggaccacagctcaagctgtttctcctccaggggagccagccctgacccttgacctcatagcaccatgcgccccatcttccagcatttaccacattgccccaccttgtttagtgggttgaatggtgtcaccccaaaattcccatccacctggaacctcagaacatgaccttgtttggaataagggtctctcaactgccattaagttaaagatcaagctgagctcatgctggattcggttaggccctgaatccaatgacagtgtccatgtgacaggcaggacaggacacacagggatgggactgatgcatccacagaacgccaagaattttccgggggagaggcctgggacggcatctccctcacagcctcagaaggaaccaacgctgccagcatcttgatttcagacttctggtctccaaaactgtgagagttgttctgttgctttgggctgcccaaggagccatacacgccttgtctgttggatggtttgcctctctctaaccacctgccccccagacagtagtccctgagagacggccacacgtctgtgttcactgtcaaatccaagtgcaggcatagtacagggcatacagcaggcactcagcaagtgcagatgatggttggatggatgaatgaatgagtgaatgaatgcatgcgtgctctgaaccctgtctgtctgctttctgcatctttctacatctctgtagatgaatccaaatattcagtctttatgcaacatggccacataaattacagtacaaagtttgaggcaaaactgtgctactttgcattttgttattgtctttgtgatagctccctttttcctccattgaaacctaaaaccatttaaagtccattcaattagccaccatccacctcattttattctggcgaatgtataatttgttcctggccctcaataacttggtaacccagagagtttcctgcctctcccaagcttgggaaggtcgagcctcagatggcacaggtcttcattctgactccacacgccctaaattctggcgttctgtccccagtctgcggacacttctggcttccgccctgccctcagttgcaaggacatcaggggatactctgacacttatgcgtttccatagggactgaattgagactgggaggtggaggagggtagttccgagctatgggtcctggcctggcttcttcctgcacagactacattttggtgactttgatttaattttctcagttcctctttttccttttcctttgggaaaaggttcatgtgcttcagcatgtgaacactagatggtagcaaagaagaaagtctccttacctgggcttcccttgctgcaggagggaccctggcccaactgagtctccacccaaggcaggactgcaggtgtcttagttcatctgagtgacttataaaccacagaaatttattcgtcactcttctagaggctggaagtccaagatcagggtgccggcagatttggtgtctctgatgagggcttgcttcctggttcataggccaaattcctggactttcttgaaaagtcttcatctctgatcaccctctgagtcactacaggcccattaaggtgggcaggttctcctctgtgtgctgtggtccccaccctgcccccatggagaaattgcaggaggtcctttgcattcctgggtttcacctgcctggtccctggagatgcgtttacccctctcccttttacctctcctttacccctgctgtcacctggtccagttggtaacgctcaactctgcgggatgggagtcccacagcctctgccaagtgtaagtggagctgggtgcgatgtgctgttctcagcccccaccttttcctggcagcctgcccctgaggtggcttctgaacctcagcttcctcatctgtgaaatgggggtgacaagtggtcccctgcacaagctgggtggggcgagccaggcaaagctctatgggggccgtgggggcagtgctggttgtcacatctgtgattgacagtggggcagagacctgggtgggatcccagctccaccaagctgagcgagagcaggcaaaccacgctgcctcagtttccctatttgtacaagagggctagtgattccttcctcatggggctggggtgagaagtagaggcaatgatggttagagacagaggggctgggggatgctgcgtgtcacctgcgtgtgctcaggagtggggcactgtcctgagcaggagcagcctggggaggctgaggccagtggggagaggacagcgcagtgtgcagaagctggggatgggtctccctgcagcccctgccctgcctggccacttcttgcatggctggctccttgtcatttctcaggtctcagctcaaagtttccctctgcagagcagcctttcctgacctccctctcccaaaccagctaccacctccccccgaccagcccagtactctcagcccacctgcgtggtgccctctcgcccccctccctccaccactctctctcccagcccttttctctccctctccttctgtctccttctctattctacaatcatctgctctctttctgtctgcctggcctctgtctgtctccaccagctgacggcagggcctggcccgtttccctgtggcctggccttgtgtggccaagcaggtgcttgtagagaaagcgaaataactaaagtcctccacgaggtttacagtttccttttgggttttgaggaatactttttattgatgctgtccacatcccaggattgtattggaagtttgtttctggtttttagggaatggggtagtttagatctggttgttttgctggtgggattaaagggatctggtgtttgcaccagtcctgccaggacgcttttggaatgagagtttgtgctgaacacctaagagcttctgggcctgtgccagctgctaggctcctgaaaaggagctgatggtctcattttacaggcaagtaggctaagcctttgagagcttcagtgacttgcccagagtcttgcatactgggaaatggcagatcaagaccagaggccaaatctgcagaagacaaagcccatgctctctgctcttccgggcacctgacaccctgctggcccggagcacatgcaggagactgtcattgatggaaggagggggtgtcccactcatttagacttgaatgagcaaagcctgtttagaatcatcttcaaagtcatttcatgtacacaagtgtttattgcccgtgttttaagtgccaggcctggggaaactgtaggaaggaaggtggacacaggcctgcccaggagcaagaaacagactgggcagcgtgattcactccaagtaagaggaaaagtgtcagggcaggctcaggtcccaggggacaggagacgagggatctgatcatggcctctctaaggaaatggtattctagcagaggagcggggaagcatttcaggcagaaagaacagcccatgcaaagactcaggttggacggagtgtggtgccttcaaagacgggagagatcttcacatgctggagtgaagagagtgaggtggagatgcagctagggagccgagtggggccacccccaggggccttgagactgggccatgagttcgaatcatgtcctaaggaagatgggagagtgatccaattcaccttctggggtgatcctcctggcagagatacagggagagggttggagcccagaaatttattccttactgttctgggggctggaagtgcaagcccaaggtgctggaatagatgctgtggggagggcagagcggaccatggtgctcatccaggctgaagggtggctgcacagattcttccgggtttcccaagaacaagaagcagcttcaggaagctgaattcatagcagagaagcaggaaggaggcttttctaagcccagcgccctgcagggaggatgctggtgctggtgtctgcaaggcttggcccctaacagggtttgccctacagatggagcagaactggacagagatgcaccctggcctctagctttgggagcagggatcccggtccagcatcttggcattagttggggcccctcctggaggtgcaggggagcgtcctttccgctcatggtccccagtctcagcaaaacccttggtcccagctcctgaagacctatgttcttgctgcttcctcccacaccccaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacaggtgaggccctgccccatgagggagacctgtgctgccagaatccctgcctggccagcctcaggctgtgcagctcatgccacgcccagggccttggctgggtgtcccgttctacagtcactttctgaacaaggaagtcacattttcattttgcacctcgctctgcagattgcatagctgatcttggttcccacattctgggacggggtgcacagtgaatgtgcactatgggaacctggccacaaagtcctgtgcgtgagcccctcaggacccagggtggggtgggagctttgcaggagagactgacttagagaaaagtggccgttccactttgtcccaggacactgagggcttcatagttgtcactgggcaagagtgtaaggcagcctgtgcctgcagcttactcttattttggatcacatgtgtctcatggactgtgaaagattagaggtaaaataggtaataggagacagtatgggttggaggaatattagacaaacaaaatgtccttctcagtttttgtgaagtcctcgccctgaacattgattgcatgtattttggcaggttttattacttgcatgttctgtgcttttcaaaacagcatgttgtaaacagccatttgccttgaactcaaatcctcatgctccttctggtgtgtccaggataaaaaccaagaggtcacatgcattttggggctgcctctgtgatattcattataagctccaaagtcaatcgtgctgggtttctgggtgaagggggtgacctataacctgaaccatctttctggtttagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggtgaggaaaggatggcccattaagtgtggggatctcggccagaggtctagtgtcaccagggggtcgaggacagagctcgtgcctgggggaggaacaggtcgaggggctgcacctggggagaaacaagaggggggctgtgtcctctggaaatgagcttctcctgaaacaagctggggtgggggtgcacagccaggcttagagcaaggaactagaaaataccccggtgaaattgttttgagagttgcatattagttttcatgtgtatgtgaaaaaaaaaaacaacataaaagtggtgaagcaagtgacttagagaatgccacccctgaggatgctgtggcgaacagtatatagttggtgtacagatgctcagtgtacagaagttatagcaaaaacaaaaacaaaaaaaaactgtaacaagtaaagcaggacgagatggaagcagggggagagggaggaagagagattgctctattgatctcaaatggccgtctcagaagtgctgtggatgggacaggcagcatacgcttgtttgggagcagatgctcacagggtccttggaagccagctccgtatttgtcctcatggtgcgttctcccatgaggtaattgctccatcctacccttgaggactccggggctcgggacgatagaggcctgcagaccaccctgtgatgaagggagaaggaggctcaggccaggaggaggaagtgctgagggggtttccctcccagctggtactggctgtgcggggccctctgattagtcccaggaaggtccagggcggccgtggtgtttggcctgcaagggaaggatcaggaagcgtccgttgctgttcttcctggaagcatctcatggtgactgttgcgggcatgggcaaagctcaggccacgtctccctgggtgtctgtggggagcaggaaagggcatcagatgtcggtgctgaccctggctggtactgaaggcatgcggtgggtactgtgatgggtggatagaccggcagcccagggctccatagcctcccgcttcctgctgctttggagcctttccaccgggtccgaggaagcaattctgagtatgtggctgcacaacatgaaaggggtgggggtgctgtcacctgtgcgtttggaggaggctgactgccaccgcggaaccagtgtctttgtggcagaaactaggagctggtcactggcctgagggcaccaacctctctgaagaggctggagcctgtggtgttcccaaactcgttaggccctggaatccttgcccttaaacacctgtgagcctccagcaggagggtgctatgagggtgcacttctgagtagagctggtgttgggatggtcaagggctagagcacggtccctcagcctcagcgctggtggcaagaggccaggcgattctctgctggggagggggctgtcctggacacattaggatatcctgcagcatccctggcctctccacactggattcccccagtgaagacaatctaaaatgtctccagacttggccagatgcccctgaggggcagaatcacccccagctgagaatcactggcatagtctgtgcccttggtttgggggtgcccttccataagtcccttatccactccaggacacaatgctttcattggtgaagagggagatgggaactgcttcctcttgacattgacaatgtcagcagccagggccccttaccgggtgtttcttgtgtccgggatgctggtctaaggttgtgacaagaaaggttttatcctcacaggagccccatgaggctatgacatcatagtccttattttacagatgtgtaaactgaggcatagggaggccatgtaactggccatggtcatgcagctcgttggtgccaggctgggacttgaacccaggctgccagcgccagctttccgctctgtgctagaccctctctgaggatgagtggattaatccatgtcagcccttggcacagggcctggctcagggtgcacctcggagagcacttcttcctgtcctcaccagccacacggggaggatagcccctggggaggacagcccctggggaggagagcctctggcccagaagggtctcccggcttgactttcctttagggcattgttaggccatccagatgcagtgtcctcacgcctggcgttaaaggtataatgcagtcattttatttaaacacagaagaggatgggaatctgcatttcacctctcgggagcctcaggcctggcccggatatgacctcaaaaccctctgtggcagcgtggttgagccagcagcgtggttgagacacagagtttctgcactggagacggcatcaaagcacatctagcagcacccttggctcccacctctgtccctcccgcccagtgccttccttctctgattgagtgctctgcacagggacgcctcctgctcagccaggtggcctggtcacagccagctgtgttagcctcttgtggctgttgtaacaccttatcatctgctgggtgacttatgaccacagaatttactcttctgcagttctagaagctagaaatccaaaatcaaagtgtgggtagggtcgtgctccctgcgagtgctccaaggaggagccattctcttccagtttctggtggttcctgcattcttggcctgagaatcccagccctgcctccgtgggcacatagctgcctcctctccctccttcctctccccttcatatgaggatagtagtattgcaggcagggcccatctggataatcctggatgatctcctcatctagagattaacttaattacttctgcaaagatccgatttccaaataaggtcactttcacaggttctggggatttggacttggcacatcttttagagaaccccctttcaaccccctgattccactcctcttggttaactcgttcctcttctcattgagctaaagctaggctctgggatttgacccacaaagtcccctccatccctgagatctctgtggctgggccggtccatggcctccaacagaatgtgctgtgaagcttggacttggccctgggcaggtccctcccctgtccctgccccatttccttgttgtcagacgaaggccctcattgttggcttctatgacaacactgaaccttccttcctagctgggacacagttgcagattcacactaattcttgtcattctctattctctgtctctttgctacctatcaattacttattgttgactgtctaattttgtctgtatgagggatcatgctggtatctgtctgtgtcccgtggtgtgtccatcatcccagggtacctggttctaagagtcagtaagcacctgttggttgtgtggctttaaacacatctgtgaccctgatgaatctgatttgtccctccagccgatggcccctgagctccagggtgtctctgtggactctacgcatgcgtccacgtggggactggtgtgcattgcatagcttacatctccagatctcggttcccatctgcgccctgtgctgggactcttctccatttcaatcaatacatctaagcctcctgtgaagcttttggctttgtgctgatgtccggatgaccctgaagtcctctctgttccccttggagcagttcgcgggtccagccaactccctcttctctggcaatggtttgctgtgctctcctgcctggacttggcctccaggcggtctctctgtgccaccattgccccatttctagttcattctccacacaggtggccacaggaccagggtctcatagaagttggataatgtcacctcttgctcaaatccctccagtggctccctgaggcactgaatgccacatcctccctagtgcctgtggccccaccccatgtggcctgcctccctctcccggctcgcctctcccttggacccagcccatgggcctctttgatggtcctcacaccccaaccacagcccctgagactcttgctgtccctggaggtgtgcaaggctccaccgcgtttaaaacatcgctcagtgcaggaagccacctggccgctgtgtggcaacacttggccccttcttctcacccaaccttatttcccctacggcagcgtccctgacgccaataccattggctttgcccatgcagcctctctaccagcacatgggctccgcgagaccaagtcttcgcctctgtagttcttactgtgcgcacagctcacgagtgctaagtgcaaaataaatatcagttacatgaatgagccagaatgggccaatgggggattagagaagccagtgcctgtaaagtactaacaggtgccaggtccagggagccctcatccctggactgtttctcccatggcgtggctcagacctgagcctcttgttatttgttctcgaaacccagtgtctgtaagtgaacacggattttgagctggggtctgagagtgggggaaggtagcactcattgtagaaactcattctggaaactgctgtcgtgaacgtggcccaggcccaccgctgtctgcaccgtgcaatgtgttacatggggtgtcatctgcaagccctgggtgaggccccctttcctccatgggccttttgtgggccaaggtcaggattcctgtctgaccctgagaaactccttgttgagggctgggctcattgcacaaactggcaggtatgtctgaggtgcaacctccagccatttgcaaattgaggcttctgtgtgctggtcccagggtatagagtctagggtccctgaagccctgaaatcaagtgcagaaagcagtgctttgcttttgtcacattctcaactgtgtccccaatgctccagaagtgatagatctctgagataaaatgctgtgggaaaattcaatattggtcatacagaaagtatataaatgttgctttttggggggaaaattactcacagtaggaaaggcctgtaagagtattttgctttgcctggtgcagacaatggtgaataatggttgttatttgcttctctctgcagtgtgttgagttcaaaccccattcccactgtctcgcctgatacattgttttcacatctccatggggtgaaagcagaaagcaccaggcagcaaattaatcaattattaatcgcaacaactactattttattcatttattcatttattctccctctctccctctctttcccctgttgagggaggtttggcagacgttgtcttatcccatgtgaaaaagaaaatttttgttatcaaacgtttttgtgaacttcagttctctattagaatggagaatgcatctgcatgagaatttaatttttggaaatggtggaggccctatgcccacatgcacatgcgtgcccacacacacaggcttgcacatggggtgccttcgtgggtatgcctggtcagcggtgggtgagcagggccttgcgctcattctccagtcatcaaaagcgaattttatgagaaacagtctttgtgttgtcactgccccaagatttaagttttaaaacctgtcaagaaaaagatgtttgtgttttgtcttttctctgtgctgaacccaagagtcatgaccacacctgtctggtttttcacagtgtcccagctctgggcgcagtagaaacacgtgatgagggggagcgagggactgaggggctgctatgggaatccgggctgcaagggaagaacctactgatggaaggaagctgacttctccagagccccccagctgcctgtgctgctgctcctcctgcagacagcttctcccaggtgctcatgacagcaaggctgcaggctaggactcaccactgtgtctcacctgggcccatgtaaggacagcacaggccctccacttcatccatgctgtagtcttagtccctttgagctgtcataacaaaatccctagactgggtgtcttataaacaacagaaattcattcctcacagttccagagacagggaagtccaagatcaaggttctgacacgtggggtttggcaaggccccactttctcataggtggtgccttctatgtgtcctcacatggcagaaggggccacagagctctctaaggcccctttcctaagggtaccaatcccattggtgagggttccacctaatgatctaatcaccttccaagaccctaccccccgaataccatcacattggggttaggcttcaacataggaattttgggggacacaaacatctggcccctggcattgggaatgtcacagggagggctgtctgtgcagctgggtgggcctccgtctctggggcttactctgcgtagagagacttgctgcaggatttgaccaccccacgtgcctcgacatgtttctttctagctctgtgaccttggaaaagtttcttaacctctctgtgcttcagttctatcccttgtaaatgggggtgacaagaaagttcttatgaaggtcaacaggggtgctcaccgaagtatagctttgtctcattgtgctcagtgagcgttctggttgccgtggtaatcagcactgtcaccctcatcatcactgtggttaaggagcatataggaacaaggaagcactgggcatccaccgctcatcaaaatactgcctcacaggcatgaagcaaagtttagctcccagtttgtcaatgttccgtagctgatttgtgctattcctcattcctcggccaattcatcagtgagagtgttgatgtccctgccgctgcataggtacatctgttctccatccagacatgcagttacatgtgtttgtgtaactggctgtggttttgcttgcctgcttagcaagggacaagggcaaggggaattaatcaccggggtctatgtgccaggacaggctggcggggacctttgggttggtcaggagaaacaagcctcaagaaggcctctcgatggcacctgccatgagccacccgtcccagaccaggttgggtaacccacggcgcccagcctcagattactctgcccattgggatgaccctgggcaggtggtggcacatctgggccctggctgcctttcggtagctcacaggtgatgtcagtgacccccttgtcaggttgtcctgggggcggatgagacaacgctcatggagggcctggcctgtgtgggcacatggcgctcacgtggtagccctgctgccaaggttttctgagggtgtgtcccagcggcaaaagaaaaaaatctgatatttgtacattatttatttataaactatacattaggggtaccatgctaatatactgtgtactttataaaatatacatgcaagatagtaataaaaggtgacccgagagagtgactatgtacatattaatatgttctagcacagcctgccccactgtgtcctaggagtaaggccctaggaagtatatttcagcaagcacaggggggttctagtgctggtgcaggagtgaaagagtaaatcctagcccccacaatcccatgagtcaattccagtcagctaggcggtacaagagtaaagggacatacgggatttcccggctttatagattttttttaaagcttcttaagacacacccttgctatgtattcagcaagtactatatgtcccaatctaggcctcaaggattctaaggagaaactagacacagtctccaaccctctaggagctcatgactgaccttaaaagctgatgttcaccataaactcaacaacgcaaaagagggctgggtcgggagttgaaaggtgtattagtccgttttcacactgctgataaaaacatacctgagactgggtaatttataaggaaaaagaggtggttgtttttttcattttgttttgctttgttttttgttttgttttttctaagacagagtcttgctctgttgcccaggctggagtatcgtggcacgatcttggctcactgcaacctccacctccggagttcaaacaattctcctgccccagcctcccaagtagctgggattacaggtgcataccaccatgcctggctaatttttgtatttttagtagaggcagagtttcaccatgttggccaggctggtctggaactcctgacctcaggtgatccacccacctcggcctctcaaagtgctgggattacaggtgtgagccaccacacccagccagaaaaagaggtttaatggacttacagttgcacctgcctggggaggcctcacaatcatggtggcaggcaagagagaatgagaaccacgcaaaaggagttttccctcataaaaccaccagatctcatgagacttattcactaccacgagaaaagtatgggggaaaccacccccatgattcaattatctcccattgggtccctcccacaacacttgggaattatgggagctacaattcaagatgagatttgggtggggacacagccaaaccatatcaaaatcctaagacaaatgtgtgacgccaagaatgtggtgacacgggcatttgatgacatggagaacgttacacggagagaggcaacactcaggcagttcctggtactgtctaaatgtaaagaaagccttctttgcaggctccgggatcctttccccagtagacatacttgtaaaaagtgaatgctaacgtgttatttgaatgccattttaagtgtggggagggtgtactgaaaggcttcgtgcagtgtatgcttctgtaaagtgaagagccacctgcagcgagtgaggactcccccacagtcgtctccatggtgacttcacagaacagcaggcagcccctgccttttcttgaaagttggggctagagatttgaaaggctgtggaaacccagccactccctgcactgacaccagatggcgctggagatgctcgctgggatgcaggatgcttgtgagaacctggtctcaggacgacctggtgggcgtcttgcagcggaggcaggtctggcccagggtggttctggctgagcaccaagcagcagagctctcagagtgggaacgcacagccccagtgacaatcagctgaaacagggctgccccccgccccgccccaccccggcccttttttttgtttgagctattatttcccatcaagtaccttgataagcacttttcatgcattttattgcctaagtcccttgacaaggtgataagacagctgctattaccgctttttttgtttgtttgtttgttaacagtagaggaaaatgaggcaaagagaggggatgaaacttgcccattttgaatccagggctttccagctccacagcacatgactgtagcctactgttcgtccaatgcgtaagcacatcataggtgccaggcactgccctgggtgctgtggacacagtgatacaagccagggtcccagcccgcaggtgcctgcagcaagggggaggcaggagcccccaggaggtgatttcaagattggggcatgagcaccagatggacacaggcaaagagtactctgtgatttgtgcatctgaaagcagctgttctgggccagccgtgtgctcttaaaagcattggtaggaactgtatccgtctccctggggcctgggcctctgcactttgcaggctccgcaagggtgaaggtcaatcttgtgtgtcctcttggctgagctgttccacccagctattgaaatgctagtctgcatgttgctgtgaaggtattttgtagatgtggttgtcacctgcagtcggtgactttaaggggctttgagtggccctctccagtcagttaaaggtttgagaataaattggagtttcccagagaagaggaaatcttgcctcaagactgcggaatccactccagccgctggcctgccctccaaatccaggactgtacagcccccgcaatcgcatgagtcaattccttaaaataaatgtcttaaaacacacacatatgcacatatatgtgtgtgtgtggatgtatatatatatatatgtgtatatatagaatgtgtatgtacaaacatgtatgtgtatgcatatgtatatgtgtgtgtggtgtgtgtctatcccattgcttctgtgtctctggagagccctgacccaaacaccaggtgactctcaagagctgccagggtggagaaccaaagctttaaaatgaggagtcctggtcatcaaggtaaaggctttccacatagggacagcttgagcctgggcgtggagatgagacgcgtgaggtgcacagggtagcgtggttgttgcatagcccagtgtgagacctagggactggccagggagagagacctttattcaccctgtaaagaaagctggaattcaaaagacaccaaagtgtgaagcctctgagggttgtcccaagtcactcacctcctggctatgtggccttgggctacactgtgggacgttgtcatctgcaaaataggaaaactaaatcctagcacctgccttatagggctgcggggagatgacatgggaaacgcattcaaaggctgcctctgggcctggcataccgcaagggctcattcaatcttggctgctcttgctgccactggtgggaagcagtgtgggatctcctgcagctgaactgatctttctggagtgcagacctgatgccgtctgtcatgattcaagccttggaaagggccccaggactttccgagggtgggagggtgggctccagagaaaagacagggaggggccatgaggaggctcaggcaggaggggatggggtctgcagggagtgtcagagtcagctccagctgccgtaacaggataccacagagtggatgcctgaaacgacagacgtttgttttcttaccattctggaggctgaaagtccaagaacaaggtgatttccagtgaggcctctctctgtgtctttatagggccgttcccctgtgtgctggttggtgagagtgggtgatgagtactctggcctctgtttcctctacagggacaccagttccatcagatcagggccccgctcttgcaacctcctttaaccttagttacctccttacaggccctacccacaaatacagtcacattgtgggtcaaagcttcaacttgtgaattctggggcagagcggtggtacacaggtgaatcataatgtgggagactgaggcagagaggagaaactggcaggagctggggagtggggatggtgctgctggactccattcttgcagctgtgggcccctggctgcaagagaaagcgcagaggggaggaagcgggagatgattcgccagcgacctgagttgactagagaggggccctgcccagctccacgctgacagggaccatatagtcagtcaagagcgtttattgagcacctcctgcatgcactgtgaggaaagccaagtcacatccacagaggaaggccgtggtcagcagcaccagcatctgtccagtgggtgtgtccctggcatgttgcaccagcacagcgtgtgaggtccgatccttaaagctgcttcattttgttttccagcagccctctgcatcccctgcttctgcatcccctacttcattttgttttccaacggccctctgcatcccctgcttctggttttccaacggccctctgcctcccctgcatccccaggtagcactagacttttctgtttatttgcaggtagtgaactgccactgagtctgagtcgtaaacactgtttggattcagaggtcagaatatccttcccctgtgatgctcaaacttctgagtcagttcggtgttttgccagctccctcctcaactgagcccctctgtggcaggaggcctggggctgggatcctcccctttgccctgctcattccccagcttctgcgtgtgtgcccccagggagtgcaggctagcctggtgtctgggggccttggctgggctctgagctctgtgtggccattcagtttgcccacttgggtcccagtctgtggggctggcacctgctggaggttcaatttcccttcaaaaaaggtcatggtgatccctctgagaattactttgagaacctgacaactcaatgatgtgagattgcctactccaaggcccttctgtgggggacagcgagggctgctgtggcctcctgctcctctctctttaagatgagcaggtccatccacagcagcccagggagcagccctgggggcagagccatcaaggacctggtggagccatcctgaaacttcaacaggtcagggtggccattgtgcgcggcatggcacttagcacagctgagcagttaaaggggtatatggagggccctctgtgcagttgacaggtgtctgtggagcactctctgtgccattgacgggtgtccatggagcgctgtctgtgcagctgacaggtctccacagagcactctctgtgcagttgacgggtgtccatggagctctttctgtgcagttgacagatgtccgtggagctctctctgtgcagttgacaggtgtttacagaagtctttttctgtgcagttgacgggtgtccatggagcgctctctgtgtagttaacaggtatttacagaagtctctttctgtgctgcttgtagaagtcctcaacaatggtgatcttcactaatcactatttttttttcaggaagtatgcaggacttttgcaatccaacgtgcgtgtgttattttaaatttcatggctatggtggcagtggtgtcagagtaagggaaatcatgcagagtggaagcaagaggaaaccctgtcacttgtgccctattctgttgcaaaaccatgtcccagtgctggcctagacacacggggtaggaaaatagacaccacgtttttgtaggaagattggagaatagtggtctccttgcacttgacctgctgtgaagagttgatgttaacttcttggtgagtatgtaaattacatccatgggcacaggcgttctcgcagaggatgccccatccaggcctgtgatgcaactgcagtgccctggcaagtgcactggcttccggggctgggctggggagggcactgagctgagatccagaggaggagcagaggtgggagggtctcacaggctcagaagctccagggtggaaggaagcccagcctttgagggacgaaagggaagaagacaggcagagatcattctggagaagccagtaggggagtggccatgtgcagccttgtctactatgccagtgatctcactctttatataaagaaaatgcacaagagatatagggacatctttgtggctgttgttctgccaacaaccgtggcacacacaaaaaccctcacagcaggagcccaggaggagaagagagtccccattccactccttagacagcccctctggccaggagctggagaggagagtttccagtgccattccttagtcaggcgccctgggctagagctcaggctttcagacagagcctgacttttccacacccacttcctactggtttacagctactgtataaagcaaagcaccctcactttcctctttgtgacaggtagtgatgctttttacagaaactagactttatagaagcctggaggtgtggaatggtagagatccacaggactctgtagtgaacatgcaacaccagctcccatctgaaatacacacccacagatgcatttttccgttttattttatttcttccataagttattggggtacaggtggtatttgcttatgtgagtaagttatttgtgagatccttgtgcactcatcacccaagcagtaaacactgcaccatatttgtttgtcttttatcctttgcccccctcccactcttctccccaagaccccaatgtccattgtatcattcttatgcctttgcattctcatagcttagctcccacacataagtgagaacatacgatgtttggttttccattcctgagttacttcacttagaataatagcctccaatctcatccacgtcatcgtacagatgcgtttttctctagagaaagttcatcagcccagaaggcctgcctgggcgcttccctttcagactgagggatagtgacacttcccttaccctcaggcacccattgcagggtctggatgccccccacgcctggcagcccctcctcccccattgttggctccctcctctcattaacctccaaccctgctctctccctggctcccaggacaccatccctgcctttcttcctgccatcctggcccctcttccctgacccgcccctaaaggtgagcaggcccaagcttcctggctccttcctttgctggctctgtgctctctcttgaggctcaacctcacatctgtccccatatgtggatcgtcacaaatctccatccctggctccagctctttctgatgctaaaacctcacatgtccatttgtccactgtccctgcagaggccctgatgcaccctgagttcagcagagccaaagctaaccttgtcctctttcccgggaaacccgctcaacttcccagatcctcatactcagctaatgtcatctccatgtttccacatcaaagcccaggcagtcccctcctccaacatcacagccccactcattcagaaaagatgtgccatgatgtatgtgtcaggcatggcagggagagtttgccctcaagacccccagagtctggtgtcggcatctataacagtgtcactgttgtttcagaaaacgtcaggcacttctgcctctggccatgatgaagcgatggtagctgccctcccactaaaatcaaacgagagactggacaaaatgaatgagaggactgtttcgaggcattgaacagaaacagtacatgcctgttatccttgagagagtggagacccctgggttagcccataattgatctccctggtttctgggggaggcatcttcctgcagggtgcagggaggtggcctctgagcagagtggtgatctcaccgagatgaggaggcagagactggagtctgggctactgaaacagctggagtttgtaggacaggaaggagctatgtaacgggttctgtgcagatccagttggccatagcctgggctatgcctatatgcagaattctacagacttagcagagattgcctgtgagcatgacagctgaaggtcagggggtgctaggagatgttgggagttcagctcaaacagaatgaagagatcttgatgaatgcaacagacttgaaatcccacaaagaccaagacttaggagtaaggggcataccttaaggctttgttcaaaaccaaaatggacctgcagttattataaatatgttagaggtcttagagtgtcaacaaaatgatcacaatgaatgaccagatggagaatcttagcagagaaacagaaacaaaaagaaaaccaaatggaagttctagaattaaaaggtacaatatctgaaaatgtcactgcttgtgcaaaacagactccaggactgttctcacacaggggcttataaagccaggacataggccaggctgggaggagttggggaatccctgccaccctcctctttcctgggattcattactccctctacccaaatgccaaagcctcatgcacatcaattcatgcagcctgaacccagcaggatccacgactgccaatcctggcttgcagtttgtgctgggaaatggctgcattagcaacgtggagacatacttccttgtaactaagactttgtgcatctctgtaattatgtccttaggataaattccaacatgcaggctaattgagaaaaagatatctcatcatgagtttattttaactccaaagcctctttgccttatgttcttatttatatacatttcctttttttctcttttttaaaatttaactttaaagttcaggggtacatgtgcaggtttgttatatagataaacttgtgtcatgagggtttgttgtacagattatttcgtcacccaggtattaatcttagtacccattagttagttttcctgatcctctcccttctcccaccacattggcatcctttttcttctctagagagtatctgagactggttctaaaagcagtagccagcccggtgatacagggagaaatagccaaaagagctcctgccaaaacctacagtaatcagaaactttgactcaggaattctcccctttctagggatcaagctgatggaaatattcatatgcatgcagagaaatgcaggaatgaggacattttctgcggctttggttagaagtagaaaaacaaacactaacctaagtgtccattcatggtgagctggaccaataaatgatgggattatgtgatgttcacactgtggggttattaacagctattgaaagagctggattaaaacaccctgctttggaaccaggaccagctgtggtgtggaggaaacagcatattgcaaagtagtgtgtatggtatgatcctacttttgtaagacatcagaattaagtgggagtctgtaaattgttaattgtgtagaagtaggtctggaagtagatactgcaaaatgttagcagtcgctttttttagaggtgagatgtgggcagagaaaggaatactatctttccttaatactattaggcttaagttgtttgcaacgagcatacattatttttgtagctgaggaagagaacatagttctttgagctttgctgggaggcagtcagctctctggtctcagctatgacctgggacaactcatatctccatgaactttggtgttcttttcattaattcaccagggaggtgagggtagaaggagagcctggtgagcacctttcagctccaccatggtatgaatgtttgtctcctccaaaactcatgttgaaatttaattgccattataacagtattaagaggtgggacttctaaaaggtgattgggccatgagagctccgccatcatggatgggattaatgctggtataaaagagtctgtctggccctctctcagcctctctttgcccttctgttatgttatgacataacaagaaggccccttgttatgctggtaccttgctgttggacttcccagcctccaaaactgtgagccaataaatttctgttcaatgtaaattacccagtcttgggtattctgttatagcagcatgaaacaaactaagatgggctctaattctgatggtcagagcaagctccctggtaggttgaagggtggctctgactgggactccccattgggaagcaaatcaccctacagccttgtcctctgggaagtcctgacctcaaggagcactgcccagaggagtggctagagggtcactctggagaagcatgtgagcacttttcttttttctttttttttttttaactgaagttttagggtacatgtgcacagtgctggtttgttacatatgtgtacatgtgccatgttggtgtgctgcacccattaactcgtcatttacattaggcatatcttctaatgctatccctcccccaccccccaccccacaacaggccccggtgtgtgatggtcctgttcctgtgtccatgtgttctcattgtttcatactgattgtatttctatttatttttgcaaacaggtggtatactcagtatacattgctcaaaggagccccagtgctactggtttcttatctgtcccattggggctgttttatgcttatacaagcgaagatacattaatatatgttaagcttttccatcttggagattaggtatcagggagaagactgatgtgagatctgcctcctcttctttgtccctttcctgtctccccactcacctaggaatagaagggaggattctgacgactagtcttagagccaggcacctctcttcactctagagagggcagctcttcctgggatcaaagtgccatgtgtggtcttcttggagtggggctatcaggaacagctgggaacaaatgaggggccttggaagcatcaaccaggtctcatctgttgatggacatatgggttgtttttagttattacaaataaatctgtgatcagcatttgtgtacaagtctttgtgtggacatatgctttcacttatcttggataaatagctagaagtggaatggctgagtcatgtggtaggtttttaactttttaataaccggaaaaatgtgaagtgatcctgccatttagagtggtcctctgatatattctcaccatcaaggtattagagtttcagttcctccacatcctctccaatacttgatgtggtcagtctttttaatttcatgtaaagaactctgtgcagatccagttggccaagggctgggctatgcctatatgcagaattccacagacttagcagagagttagaatttaatttttaattctagtgggtgtgttgtggtgtcttattatggttttaatttgcattttttctaataattaatgatgttgagcattttttcatatacttatcaccatatctttgttgggaaaatatctattaaaatcttcccatttttcaaaattaggtcaattgatttttatgtttgagagtttcattggtctgtgtgtctgtttttatgctgctttagttattataccaaaatattgtttggtaccatgctgttttggttactatagctttgtagtatatctatttattttattttatttttttagagacagggtctcactctgttgtccaggctggagtgcagtggtataaccacagctcactgaagccttgacctcttgggctcaagtgatcctcaaacattggctttctgagtagccgagactatagacatgtaccaccacacccagttaatttttgtattttttttttgtagagacgaggtctcactatgttttccagggtgctcttgaactcttgagctcaagcatttctcccaccttggcctctcaaagtgttgggattacaggtgtgagcccctgcacccagcctatagtagtatatcttgaagtcaggtagtgttgtgcctccagcttcgttcttgctcaagattgctgtaaatattcagtgtcttttgtggctccataccaattttagattcattgttttcctatttttatgaataatgtcattggtattttgataaagattgcattgaatctgtgtatcactttggataatatgggcattttagcaatgtttattcttcccagccatggacaaaggatattttttcatttatttgtgtcatcttcaatttctttcaatgattcataattttcagaatacagatctttcatctccttggttatatttattcccattttacttttttgtagctattgtgaatgggattattttcttgatttctttttcagatagtttgctattgctgtacagaaacagtagggatttttgtatgttgatttttgtatcctgcaactttatggaatttgtttattttaacagttttttggtgaggtctttagggttttctatatagaagttcatgtcatctgcagacaggaacaatttagcttttcctttctaatttggatgccttttttttttctgtagcctaattgctctggctaggacttctagtattttgttgaatgaaagtagtaaaagtgggcatccttagctgggcatggtggctcatgcctgtaatcccagcactttgggagggtgagacaggtggattacttgaggataaagagttcaagaccagcctggccaacacaaagaaacctcatttctactaaaaatacaaaaaattagccaggtgtgctggtgcatacctgtaatcccagctactcgggaggctgaggcaggaggatcacttgaacctgggaggccgaggttgcagtgagccaagattgtgccactgcactccagcctgggcaacagaacaagactccatctcaaaaaaaaaaaaaaaaaaaagagtggtcatccttgtcttgtttcagatcctggaggaaagactttcaattttcctccttcaaaatgatgttaactatggatttgtcatatatggcctttattatattgagttacaattcttctaaactgacttcattaagaggttttattatgaagtgatgttgaattttgtcaaatgctttttctgcatctatgatttaacatattaatttttacatattgaaccatgcttgcatccctgggataaattccacctgatcatgttgaaggatctttttaaatgtgttgttgaatctagtttgctattattttgttgaggatttttatatctatgttcatcagggatgctggcctatagttttctttttttgtgtccttatctggtcttagtaacaggtaatgctggccttgtagaatagtttggaaatactccttccttttcaatattttagaatagtttaggaagaactgatattagttccttaaatgtttggtggaattcagaagtgaagcagtcaagtcctggactttcctttgatgggagattttttagtactgactcaatctccttactcattattggtctgttctgattttctatttcttcataagtaaatcttggtaggctgtacgtgtccaggaaatgatccatttcttctaggttatccaattgttcgtactgtgcattgtgcaggtaattgttcataatagtgtcttatgattccttctgtggtatctaatgttccatttttcatctctgattttccttcatttcttagtctaaagatttgtcagctttgtcttttcaaaaaaacctcatttgttaatcttttgtattttctagtctttattttatttctgctctaacctttatttttttttccttctactaattttgggttgagtttggtcttttcctggtttcttgaggtatagtgttaggttgtttatttcacatcttattttttgatgtaggcaattgttgttgcatgcttccttgttacaactgcttttgctgtatctcatagggtttggtatgtttttacttttgtttgtctaaagatactttctaatttcccttttaattttgttgttgactccttggttattcaggagcatgatgttttatttcctcatatttgaaaagtttctgaagttcctcctgttactaatttctggctttatacctttgtagtcaaagaagatacttgatatgatttttatcttcttaaatttgttaagatttgttttctggcctaatatattatctaggagaatgttccatgtgcaattgagaagaatgtgtattctgcagctgctggatagaatgttctgtaaatgtacattatgtctgttttgtctaaagtacactttaaatccaatatttctctgttcattttttgactggatgatctgtccattgctgaagtaaggtgttgatatcacctgctattattgtgttgcaatttatgtcttcatttagatctaataatatgtgctttatatatttaggtacaaatttgtatgcatatatatttacaatggtaacatcctcttgttgaattgatttcatcattgtataatgaccttttacagtttttgacttaaactctaatttatcagatataagcatagctactcctgcttttctttgggtttcaatttgcatggagtatttttgtccttcccttcactttcagtctgtgtgtgtccttagaggtgaagtgaatctcttataggcagcatacaattaggtcttgtttttaaaaatctatttagccactctctattttagctggagactttattcatttatattcaaagttagtattgatgggtaaatactcctgccattttgttagttgttttctggttattttatagatcttttgatcctcttttcctctgttgttgtttacctttgtggtttgatggttttctgtagtgcaaagctttgattctttccttgttctcatttgtgtatctgctgtaatttttttgttaccatggggcttatataaaaaattataaagttataatacactattttaagtagaaaacaatgtaactctggtcacatacaaatactctagacttttaccttaccccactcccacagtttttaattatgctgccttaatttacatctttttaattttgtatgtttcttaacaacttattgtagctatagttatttttgaccattttgattttttaatcttcatactagagatttgaaagatttacctacaccattatcataatgtagattctgaagttgattatgaatttgcgtctaccagtgagttttatactttcacatgttttcatgatagtaattattgtcctttcacttctggttgaagtactctcttgagcatttcttgtaaaggcaatctagtggtaatgaatttcctcagcttattcttgcctgggaaagattgtatttcctccatttctcaaggatagctttgctggatataatattcttggttagtagagatttttttccccctctcttatcatcccattctctccaggcctgacaggtttctgctgagaagtttgctcatagactaatggggattcccctatatgtgactttgttatttttatttccttctgcttttagaatcttttcttgttttcaccttttggtggtttgattatgatgtatctgagagaggacttctttgagttaaagttatttggggatgtttgagtttcatggatctggatgtccatctctctgccaacacatgggaatttttcacctgtagttttgttaaataagttttctgtgtttttatctgtcttctttgaaaatttcataatgcaaacatttgtttacttaatggtgtctcataagtcccataggttttcttcattttttaatcctttgctctctctcttttcccctctggatgggttattttgagttcagaagttcattttgcttgatctagtctgttgttgaagctctcaatttaaaaaaattatttattgaattcttcagctacaagatttctgtttgttcctttttaaatgatgactctttgttgactttcttattcagatcataaattgttttcctgatttcattgaattttctactgtattctcttgtatcttgctaaggtttcttaaggtcattattttgaatttcttctcatgcgattcataaagttttatttctttagggtcagttactggagaattattgtggttttttttttggcagcatcatgtttccttgctttcttgtttcttgtgtccatgcattggtatctgcacatattgtggtacaatcacctcttctaattttacagattggcatattttgggaaaaacttttacctatagatgggacctagggtgtcagtagggtagagtacattgccctttgttccaggtgggtgcagtaatatagtctctgtgcaggtttttcagctgtaatcaatgtcagcaatgcctgtgagtacctctgttgcctagtctgcagaagtctgtggcaatagtggtagcaagctatagtgttagtttcctcattggctgccaaatactttttctatgtacattgaggtaattgtgtgctttccttttttcagtttgtgaattttggtaaattacactgttgctttttgagcgataaactaatcttgccttcctgaaataaaaactccacttggtcatggtgtatcacaatttttataaattgttgggtttgatttgcttttttttttagagttttacatcagtgtttttcaggaatattggtctttcattttcttttcttggaatattttctagttttactttgtcagagtaaattctggcttcacagaattatttgtagtctctcctgtcttagtttattcatgctgctataacaaaataccacagacaaggtggtaataaataacacaaatttatttttcccagttctggaggctaggagttcaagaagctggcaagttcaatgtctggtgagaacccattcttcataggtggcaccatctaggtgtccttacatgacaagagatggaaggacaaaaagatgtgaactattgtgaagcccttttttaagggccttaaatccattcattatggaggagccctcaagccattcatgatggaggagacctcctgaccctaatcacttgcaaaagtccctgtctgttaacactattacattggagattaagtttcaacatgaattttggaagggacacaaacattcaaaccataaaaacttcctttcacttttttgaaataatttacataaaattagtattattctctaaatgttttgtagaactcatcagtgcatgtgtctgagactgcagtgtgtatgtgcatgaagatttttaattagaaattctatttttaataaatataggtccattctggttacatatttcttcttaagtgaggtttggtagtttgtgttttttcaaggaagttgttcattttatatcaattgtcaaatttattagcatgaagtgattcactatattttttatatcttcttaacatctgtagaattagatgatgtcagtgtcacctctccagtttctgatataggtaatttgtgtgttcccttaccatctctttttccttcttcttcctgatgaattattttctttattattttttaaatttcattggtttctgctttgatccttattatctttttcttctactcttgtggtttattttgttcttctttgtctaggttcctaagatggaacctgatatcatcgatttgagacctttcttcttttttaatattggcatttaatgttataaatttccctgttaccattattttgatatattgtattttcatttgtttcaaaacactttcaaatttcccttttgatttcttattggagccatgaattattcaggaatttaatttagtttccaaatatgtgggtttttttagaggtatttttttttgttattgattgccaatttatttccactctggtcagagaacatacttggtatgactgagtcctttggcatttattgaagcttatttctggtccaaatatgtccaatcttggtaaatgttttgtgtgtacttgaaaagaatgcgtgctcttctgttgtttggtatagtgctttataagtgttagatcaaattggtcgataatgtcattcatgtcttcagtagccttacaagttttctatttattctatgaattatttagagaggggttttgaaatctccaagaaatgatgtgtggatttctttatttctttcctcaattctgtcactttttgctttaggtattttaaagctcacataggtttgtcaatatttagtatcattgtgctctcctgatgaaggtatctctttaccattataagatgacccttttcaaagaacctgatgaggtttcttgctctgaattctaccttgcttgacattaatgtgcccatttcagctctgtttgattagtgtcagaatggtacatcttttttaagattttatttttaatctatttgtaactttatatatagttttgttgttctttataggttctttatatataagacttgttggcagcacatagttttgtctcatgttttaatccattctgaaaatttttgccattaattagggtattctgaccatttgcacttaatgattattttattaggtttaactctaccgtctggcaatttattttctatttgttccatctagttttttccatcttttctatctttctgctttcttttggattgagtgattcttttattccactttatctcctctgttggcttattagctatatacctctttgactatttccatagttataatggttgctttagtggttatagcatacctctcttatcttatcactgcctacctcaagcaatagtatgctaattcacttttagtctcatgacctcaccagagtatacttctgttctcctttcccaacatttgttctattgttgttgtccattccactcatgttataaacctcatactactttatttttagtatcaaagtcagttttcttttaaagataaataataagaaaacaattatatatttacacttgtggttaccatttctattactcttctttccttggtatagattcaggtttctattggctatcatcttccttttgcctaaaggatttcctttgtcatttcttataatgcaggtctgctggtgatgaaatcttccagcttttttatgtccaagaaggtacttattttgtctttattttgaaagatagtttttccaagtatggaattccgagttgtctggggttttttttctttcattactttgtaattgttgctccactgtcttgtcatccacattgtttctcttgagacatctgctgtcattctctttgttactctatacagtgaatacagataatgtctttttatttctgtacacttttaatattttctcatggttatagattttgattaccatggcccagacacagttttctttatgtttcatgcataaagttcactgagccttttcctgcttctttgcaggcatggtaattttttattggatgacacatgtgaattttaccttcttgggtgttggatgttttttgtattcctataaatactcttgagttttgttctgggaagcagttaagttacttgaaaatagtctaattcatgccaggttttgctttaacatttgttagatagaaccagagcagtgctcaattattgagttagctcaacagctaactcccattccagaggcagaaccccgtgtactctattcaatgtctgtacaccatgaagttttctgtctggctgatgggaaccggccctccgtctagtgccatgtgtgcaccgggcactgctatctcatcatttcagaggattctttcctcagagtcacatattaatccactgagggttcaagggaccctctgcagatctttggatcttcttactatgcaactctctcctctccaggtctctttcacgctaactctggctgccctgatccccttggcctctcaggttcatattctcaactctgggagttttccaggctcttcctggattccccctccctggattgtggcctggcaactctctagaggcagtagctggccagtcatgggcctactccatttgattctcatttttcaagaatcactgtcttctgttgctgatttctagcacgttgaaaactacggttttatacattttgactttgtgtttgaggtttgagtgaggaagacaattcagtccatgtttgtccaccttggtcagaagcagaagttaatgtcatagctttttactttgaagactcagacaagttttcacaacacattccttctagagaataaagttaggctctgctattgggtgtccccagatgggaaccccacttatttttaggcttcagctcagacgctacttccttcagaagtccctttctggcacactaccttcctcatgtggcttatttgttcctcttgcaccagatcactccgcagcttttgagtttgtatatggcaacaatgaacaaggtataatcctcgctgtagataaactcatcatatttgtttttctccatggagtgaaaatgttttaagctcatataatgactatggtcagggaaaaagccacacaaataattaggatatgttgtgacagtgcacaaatagaaacacacataatgtgcttgagaacatgataaatgccggttttacctttccttccctcacctgaccaagcttagcgagacgtgtggcatcttcctcatctttgctcttcagtgccaggtatggaataggtccattatggacaggtgccttattgaactgagcagagccacgaatgtcaggctgggagtgtggtcgctggagtcaggccttggtttacatcctggttctgcttcttaaccactctgtgcttcgacaggagagcaggaggtcctacttagttttggacgtgctaagtttgggatgcctgctagagatctgggggaagcatggtgaagaaagctgaatgtgcaagcctggagttcaggagggaggtggtgtctggagatggaaatctcgagccagtagcagttggttcttagtgtcatgggacacaggaggtcatataggaagcaaatgtggacagagagtgaaggggtttgaggattgggtcctgggcacatccacctctggaggtaggggagatgatgaagagccagcaaagtaaactgagacataatcattgaggcaggaggatagcaggctagggcagagacctgcaaggagagagaagagagcctttcacaaagaagggagtgaccgatggtgtccatgcttctgtgtgcttgagtacagagtctgggattctcctgagcatcctttgctccactgggatggaagatgggacctgatgagaccggggctaggggaatgtcctgagccccacacgtttgtgtctgtgtgcagggagcgtggaaggcagttcctgcttggtgaggtggagctgagagcggtgccacttagcagctatctgtgccactctggtatccggagagaaggagccggcatttgcccatccttcctcctaagccctgtcagttgtgattggaacgatgcccccgcccaccacatttgctggagttggactagagctggtaatatcagggttttactttttagtttaatttcttgcacaatgcatggatgtttattgagttttgccaataaagagttccatagggtattactgagcaggactggtctgaagataaatgaaagttgtgtacttggaaagacaatgctgtattattttcaaacccccttgagaaaaaggccttttgcactgggtgagctctggatcaggtccaatacagacagccttgcaaaagtggtgtttcagggaacacaagatgggtcaaatgatgacagtttggggggaatgagtctttgaagagctctagccctgttcttttccctcggtggctgccaggcagctggtcttcactacaaatgcagactgtcacatgtcaagactactgcagagttgaagaatggggcacaggactggaaaaggtgaaacattcttctcaaaattccaccaatttttctggaataaacattccttgttttgctgtaaacatgtggttaatttcaagaattgtgaaaaaattgactgcaatctttttttgccagttttctctttgcttttacaaaggagagattttttttttgtcattttctgtgatgttacctaacaatgttctttctaagcaatgacttctttttttataaggaaactatataaaaaataaaatacagtaaccaaaattaagtaaaatgatcaattcttggcttttatttgccaatttattttaatatatatttacaaaattggacacatacacatatatattttggcatataatatgcatactttctgtcatttgctttccttagcaatatatagtgactatcttttgtcattccgtaacatatacgccaccatttttaataggtacacaatattcagatggaacagatgcatcgtaatttaacaggcatcctctgactggatgtttacgttgtgttcaatttcttacttttatgaaaaagtccgggatgaacatcctttcatgtactttttatgtgtttgtcccaatcattttaggagacagactcctagaagtgggatttccagatcaaaggttaggatgagaaagtaagcgtgtttgggggcatttggggagggtgatgtctgtcacacaatctagactgaaagctctccgtccgtccctgcacctgtttctcagcttctacctcctgctcagtgctaggcagcctgctctgggaaggcatgctcatttagattaattcaatcagtgggtagaagggtcactcaaatccatgaaaagtcctcattttaagctatgtcttttggaaatttcctcttttggcttttaagtagcaaaacctggtaaccttctgataccttggtgaagatcagtcagatctgtaagtttttgttgtggtcctactgtgtatccttgctgtgttcatagaggccggattaataagtaaatgagaatgacttgctcctagcacagatttcacacagagtgagttttcatttatgtctagaaatctgcaaagaagggaactttttctcggttaagagcaaatacgattgaaagtatgtgatgataagcctgagacatttgcaatgggcttaaggacttggttcatcaaaagctgaaaagattaaaccacgttcagtatagttttatgtttaagcataccatagttctctgaaaatggcagttccttttcctgtattagtcccttagcattatgaaggaatctgtcccgagacctttgagacttcctgcattcatgaatgtcaccgtcgcattcagtctctctcataacatgcagtaaaggccaactgaaaaatgcctgcaactcctccaggctcctgaggagactataaatacaagactgcagtcatttataaagctattaaaacaaagtggggcctgagcccttgctgaaatgattttcagagttgttttctctctaaaacacatggcaaacaatcgcatgttagaaattcaagacttggctgagttccactttttgtatcttactttatcccaaacttctgtgaaacgaccatgttgttcaactgactttcttgctttctattcccgcctccacactaggagttgacttccttttaggtaccatgtttcttaagaaataaaacctgccttcatctatggaagtgatcatattggataacaacttgagcccccaggaattaaatcccggcccaaaaaaactgcaaaaccacagactgcaaaactgcaacctacatcgcatgtagatactctggagttacttgcaggcagcagcatctgcagtggcagggcaggtggggactgtgctgttcggaaagctgaattaactagcacccacatttcctagtgcactaaggaatgacactctgcctgcgaaagagctaaaccccatctctgctcctaagtaaatataaacattccattccctaataccttcctctcatgctgttaacttcactcagctgattccagacacacatagaacacaagggctggcctagcagacctggagtcagcccaccgttaagttcacgcaacagtattcaccaatgatctgccatctccacaccctgctaggacatgggcgggtgggggaaaggctgtcacttaaagtctctgcaggagacagatggtaaacaaactgaaaagatatcagttggttggggggaattaagataagtggagtggtggtgattgaaggctcagagggtttctgaggacctgggtccaaccctggatggtcctggcaaggctgtgcggtaggcagaggaaggagatgacatggagaccctagcgtgggatatctagaaactgaaggaagagccatgtggctggggggacagtgggcagggagaaagtgcagggaccatgtggagctgggtgggggcagtggccaccatggggaaagtcactgtgtcatttttggtccaaactcagacgtttttgaaagaaaaatgtaggtgctattagtaatcatctgggacagcaggtgtcagccgggactgtacctggaaacccatgagtagggggcttagcggacagagatggtgacatcaccttacccctgtgttgcccactgttccactggaaagtgccgcaagctggcgagcgtgtgtcctctcagttctagccaccatcaccctggtctggagtccttcctctggcaggtgggcggctccattgacaagccagccctccgctaagacctgtctcctttgttcccttctctcctcttgccctggatggggcttttaggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaagtaagtggcagcttgcgggcacagccgggcctgtgctctggccttgcaggcggagcccctctgagatcccacatcctgggtgtgccaggccgggacgcacaacccaccgtctgcagcaggtctcttgaccccgccaccgttgacgtttggggccgtgtggaggccctttcctgtgggggctgtcccgtgcatgctcagatgtttagcggcattctcggcctctacacactacacctcccgtgacaatcaaaactgtccctggacatcatcaaatgcctcctggagggtgaattgctccactggcctgtagcagccaggcaaggactgggccaaactgatgaggacatggcttgtcagtgttagagacaggggcagtctctgttcacctctatctgatcattttcctgcaagaaggtggatccagtgttgccagatcttctaaatttgtcaagtaaagctacccccccacccacatacacacagttatgcagtcacgtgtcacttaatgacaggatacattctgagaaatgcgtcattaggagattttgttgttgtgggaacatcacagagcgcactacacaaacccagagggcgcggtctgcagcacgcctggctccacgctgtagctgatggctccgaggctacaaacccgtacagcacatgactctaccatatactgtaggcaattctagcacgttatggtatagaaacatttctcaacatagaaaaggtacagtaaaaatatgacatacaaaatacaaaatgtcacctctgtatagagcacttaccatgaatggagcttgcaggcctggaagttgctctgggtgagtcccgagtgagcagtgagtgaacgggaaggctagcacgcgaccgtgcacctccgcagacttcagaatcactgcacacttaggctacgctaaatttacataaactttttttttctttaatagtaactttttactggataaactttaactttcggactcttataataacacttagcacaaaacacaaattatacagctgtataaaagtaatttctctttacccttattctacaagctttttatatttttcaattttttaactttttaaatgttttattaaaaattaaaacacaaatgccgcattagcctaggcctgcacagggtcagaaccatcaatcactgtcatcttcctcctccacagcttgtcccactggaagatcttcaggggcagtaacatgcgtagagctgtcatctcctatgagaacagtgccttctggattccttctgagggacctgctggaggctgctttacagttaacttttttttaataagtaggagtacactctaaaataatcattaaaattatagtgactacatacagcagtaacatagtcctttcatatcatgatcacgtgtgatgtactgcacggttacacgcactagactttgagaggccttggcagcacagtaggttttttcacaccagcatcgccacacacgttaggaacgccttacaccacgatgtcatatgacagcaacaatgtcacgaggcataaggaattttacagctccattttcatcttctgggacaactatcttatatgtgtcgtatatgtcgtgtatcattgaaatgtcatgaggtgcatgtctgtgcatatatacacatacaggtatatccacatacgcatcattttctggacaatatgtgcaccaagtccacccatctgccgtctggctgtgacccagagccacgggtgggcaccttctgtgttgcacccccataagtttccctgggtggtccctgctgtctgctgggctggagttggactgtctcatggggcaggacagagtggagctgctgcgtcttgctggttgaggtctgaagggatccagtcatgcccctgagacagaatgggggccttcttttggaaggcaaggctaccatgagccgggtggagctgacttgtgtggctttccaggatcgggcacctccctagttgctttccacattccagagccactggagttcagaacccctcggagcttgctgcgtaccccagtttgcgcccacggacactgcccaaaggtgccaagagccactgagcaggcatcggtgggctttcagaggaaagtcatgccattctggcagggtgggcctctgtttcccctttcaccaggccagatggcaggctaacgtgtctcgtgtgcggtaggagaggaaattctgataaagctcaggtgcaccgtcccaggagccacagtccacatctcctgcccaccctgtgaggtgtgagtcagtctgtgtagggctgggcttggtagacagtgccctggacagcccctagtccgctccttccctctttaaacctcaaaagccaacccttccctggagggagagacagtgccccaggggtgaggggaaccagctcccggagcgccagtgcctctgttggtttgctctgcacccttgctgtccccaggcccctgagtcactggagaccctgggaaaatgcaggttctgatgctgcaggtgcagggaggcctgagaatctgcatttctagcaagcttctagggctgccgacactgctcgctgctgggctgcaggccacactttgagaagcgagggtctacagcagggtccccagccagggaaccattgatgtttgggcccagatcgttctccgtggaggggccgtcccgtgtgtgtagtgtgttagcagcattcctcccgccttccactagatactagtagtacaccctccgcttctgaccaccaaacgtgtcccagacaccgcccaacgtcccctgaggtcagagacaacagaacgctccccgggtgagaatccatgatctgaatgttggactcccgctctgggcagattttcctctgagcagtggggcttttcatttcgaggaagggttgtttctggtctccgctggggagcttgagccccagtgttcccaactcccaccaaaatccttacttgagtgttttcacggtggagggccgtgaacgtaagcaggtgaggccggcccggggtggggctgtggatagagcacgaggtcctacccttccaggtgttacagagttgtgcttggggcgcaggtgcaggttgcatttctaccagcggttgggacagccctgccgctcggcctctgcatcgtggtgtcgtcatcccaggctttcatttctgcaagtctcagtgatgggacgtgtgttcctaaggcttggtttcctgtttctctgatttctggtgaggttgagcattattttcagcgtttatcagctttttggtttcttctttatgtactttgcctgaagttttctttatcttaatgatttttaggagtttacttttgaagatgtagcttctaatccttccccattttgagttacatgattcttctctctggggcttgtattttcagttttaaaatacttttctttgaggcacaaaagttttgatttttaaggctgtcagattgctgatcataaacttgaggagctcacagcctttttctgtgaggaccaagttgtcagtactttgaggtttgtgagccaggctgtccccgccacccctactcagttcaggcgctgtagtgatgaagtagctgtagacaatctgaggatgaaggggcatggctgtgtgtcaataaaactttatttacaaaaatagccagcggtccattgggtccagctggcactttgctgacccctgatgtgctttatggttcgcactatttgtaccgtgtttaaaaatcctccccagcctagaggtcatcagaattttattcacttctgttatttgcggttgcctttacctgtaccagttaataatggttttctatttgatagtcaaaccaagttctttcaaattaaaatactaagtgaattgatctaaacaacaaaaaaaaaggtaagtaatggaagatagtacatgtggttcaaaaaacaacaaaaattatggtggggcttggaatgagagatgcctggggtccccaccgccgactgtgaaggttgagaggaagttgggagaaggttgggctgccggggataccccaaacgcccccctatgtaagaagtaccaaaaacatgggccctgtggcttgtttttactccattacttactgaatctggaactaattttaaaccttggactggaatgtagtagctccctgctatttgtcaccatgtttaaaaacctggaattagacacagagaaaacagcagcggagtagcagcatcccaggaggtcagacatggcttcctggaggcgccatttgttttccctacagcagtggcttaattggtctccctttgtctctgctctgcctcctttcagagattcctccaccgtctcttgctaagtaattcagcctctggttgccatggcaacgtgccatctactgtatcccaaagaacatttgcgatttcctttttttaatttccagaaccttcatattttatcttctgagtgttcctgggccttttcctggtgaagcagtcactgctccccacggctaccccagaacacatccgtgtgcttggtctgggacccccaggaaagtcagggtcccatttgaaagagtgaagctctatgctgattttcacccctctctgtgtaggagctcagcttacctttaaaacctgtgtggatgcatcagcagagtatgagaggcccgcagctcctgcacggtaggtgtgcactggaaattatgcacagaggcacgggctgttttgcctccatcctgtctacagccaccatctaaggagagcagtgggaagcacctgctgccggctttcagcataggtgccggcgatgtgcttgacgtctgccttactttctttcatttatctagtcttcacagtaacccagtaaagcaggtggtactatcatctccattttacagatgagaaaattaagccttggtgagaaggtaactggcccagggccacgtagcttgcagaagctgccgtgcagtgagataggccatttgttagagccctagccctgggcctgggagaagcattctagacacgaaagcactgtggctccttgtttatcttaggcatggctttgaattttcttatattggtttggctttgatcagggtatcagctggcaactgggcaatgcaccaggtgtctcgggcaaaggacttcacacttgctctaaagcagtgcagaatgttggccgggtccggtggctcatgcctgtaatcccagcactttgggaggctgaggcaggcagatcacttgaggtcaggagttcgagaccagcctggccaatatggtgaaacctcgtctctactgaaaatacaaaaattagccaggcgtggtggcaggtgcctgtagtccaagctactcaggaggctgaggcaggagaatcgcttgaacctgggaggcagagtttgcagtgagccaagatcatgctattgtactccagcctgggcaacagggcaaagacaggggggttgggggtggtggcagtgcagactgtcaacacagcatggagcagtggggggttggacatcctcagggggaacatatagaaagagacactgcccagcaagggctctggaacagtgcagcaagcaggctagagccccagccgtctttgtctcagctgcgtgagataggccagcaccagtgtctcagaatctctctccttgtttgtgaaatggggatggtggcaatacctgcctcagggccctctggaagattccacattggtccctgaagaaagtcataaaagcacattctcagcagggggtgctggggccagagctgctgctgtcacagtcaaggctggatgcactcctgggcgagctgtcacctgcacggggcagaggccagcagcaggccttgtggcaggatgaaatgaatgctgctgcatgaacagcggtcacgatgctagtgggccagggagtgcaggagcattgctgttgatggggcttgagtgtcattcccattcgtgactgttgtgtaattttgcccgaagagagaggaatagggtaggcacctcctaagtcatgcacaaactgtcattccccttggggcgttctttgctcccaggaacgtgtgtgagaagctgattaatgctcagtagcatctttcaggagggggcacttagcatgttcatacagcagttagcggatctctgagtggcttctctgcacgttttgtcctgtggcctccagaacacgctgcaccctcaggtgtcctcccgggctgtggcctcccactcctgctctgtctgcaggagcaggacacagcgtgcagcgagtttagacgctccctcctctagatgtgctttaggcaaggcaggcctatttttggtcctggagacagaacgcacagaaatgtggagacagacagtgtccccgcagaggctgtggtttgggctgcaaggcggaaaccgtgcctggccagccaggggaccagcctgtctcaatggggccttcgttctgctgtgagcttttacctgaaactgcatggacggaaattttcacttccacagaaatggtgtttggtaaatttcagacacgtggaagcgggggaggaatcagcttccaatgccagccttcataatgacaccactaatagcatctgagagggtctgccgtgacgctgggcaggtgcagtgctgattgcctgtgatgccgagcagggaccatcatccctgctctgcagatgaggagactgggcagagaggctaagcagtgtccctgggtctcacagttcatgaatggccaggctgtgggctccagggccctcgctcccagccactgagccttgctgcctgaggccaagcatccggctcacaccttgtggacagggccgggaagctgatgatacactatagctaaaggccagtttccggtgaatgtttgtgttaatgaggtggttatggtccacgttcactgggctgagtcctttgcccgctgatgtctgcaaccctgaagttctgtgctcggtatggtgtgggtgctgcacacaggctccttcatggatcttactaccttccccaagaccctcactgaggagcgaacacacctgacatgggtcactcccggagcagggctgagctgccgcaagcgctgacggtttctcttgtcacagttatcattgccgccctgaaaaggctgcaaagtttgccttctgcctcagggttaatccatggctgctgggatggaaggtagcatttgaaattacctacagggggaggctgcacctgcagaacgggcccagttgatcctgtcacatccaatgtcattgcccatctcttggggtgcttaccccccaattacagagatttcgaattcatgtagcgtgcacgtgctaggcgctggggtgcagagatgaaaagatgcactcacaggtgataaattattgtgtctggtgaaagatgtacagagatagatgtgtggaccagcttcaggagggagggtgagggtgtcccaggcagaccagccagtgagagctcgaaggtgggaagcagcaccgccttcccaggactaccctgggggctgagaaggttcagggctgggtgagggtggcagggcagagggagaagactggaggggccatgggtccaggtggtggaggctcctgtgctgcccgctatgggttcccaatccacacagacctcctcttgtcattctgggctcagctcagatgtcaccttcctgaccatctcccagtggcacagcctcgccattaccctgtgtcacatcgtcccctgctgtgtttttagccacttccacagctgctgaaagtgccgtttactcatctgttctgttcgcctcttcagggtgtgcccactggcgtggcggggccctgctctgctcttctgtgagggccttgcccaccaaggaggcgctggctaagctggtgggaaatggcagatgaggaggcctggctctcccgagaagcagccagggctccctgggggtcaggagcgagggcatgtctgggaaacgcccctctgctgcagtgcagggctggtttgggagagcaaggctagagctgggtggggagacaagggtttctcacatgctacaggcccaggagccagcaccatcctggggacgcggggctgcagagaggacggcagagctggtgaggatgaacggcaggcctgtggctgagggaggagggcctgccagcctaggggtgggtggatctgcaatggtggagagggaatccaggaagaaggcaggcagacacaggggaaaggttatatgtccaaagggtccctatgccgtcaggtgcctggggtttttggcagtgcttccatccacttgtgcaggtgagactgcccaaggagcacagggactggaacgggagactgcccggtccatgctggacttgctgatctcagctgaggtcgagggtattcagagcccgtcgtggtgttttatacggtcctgtacttcctgttatccttggtccattttcttctacactatcttccctccagtttcacacacttggacagaagggagtggttgtttttcactgaccgccaggaaccacaacaggcttctgtgtgttccagtgaaataagccctatctgtctctcgggaatggagcagtgttaagctttttttaaaagcacaatctgaagacactggggtctggaaacccattttttcttgttctgaagcctgtggggcctccgcggttgggccttgctgaataatttggggttttaggttgggtacatcaagggtaaagggcttctgtttggatcaaacaggaggtggggggagggtgagattccctcatattgctgagaagggagttgggggctgagttccccgacttcagaggtgagacatctcacaagccagaccttgggactgtccctgtggacccaggctggactgggaagttcagggaaccctcgactcgaagagggttcttgttaatgaacagtcttcaaggagcaaagcccagactgttctcccagtgtggtgtacacatgaggagggacctcatcggggggaatttggcttcctgatattcaaaagcacatttgtctgctcagtctctgaaattgccagtgggacaatttccaaagggatcaccagaaagaaggtaaatgcagagacgaacaaggaactcatcatacccaggatcgttcttgatcaaaatgccaacagctgggcatcttcagccaaaagaaatgcagttgtggcaggaaagactcagctgtacttggggttctggtttttttttttttgtttttttttttgagatggactctcactctgtctccaggctggagtgcagtggcgtgatctcggctcactgtaacctctgccttctgggttcaagcgattctcctgcctcagcctcccaattagctgggattacaggtgtgcaccaccatgcccagctaacttttgtatttttagtagaaacagtgtttcaccatgttggccaggatggtcttgatctcttgacctcatgatccgcctgccttggcctcccaaagtgctgggattgcaggcgtaagccaccacgcctggcttgggtttcctgttttatagtgaaccccaaggttgcaaaacaggcgatgaggcttgtgatcatttatctttatggatcatgggtctgcgaactggatgagagttttaagcatgtcaggtgtgcaaacatctcctatggttgtgggaatttctccttgcatagccaccattgtctagagcagcagtccccatccatttttgtaccaggaaccagtttcatggaagacagtttttccatggaccagggaggaggatggttttgggatgattcaagcacattacctttattgtacagtttatctctattattattacattgtaatatataatgaagttattatacaactcactgtaatatagaatcagtgggagccctgagcttgttttcctgcaactagatggtcccatctggaggtgatgggaaacagggatggatcatcaggcattagattctcataagaagtgtgcaacccagatccctcatatgcgtagttcacaatctgctgagaatcgaatgctgctgctgatctgacaggaggtggagctaaggcagtaatgcttgctcgccactactcacctcctgctgtgtggccaggttcctaataggctaggttgccccagatgggtactggggttgggacccctgttctagagcagtctgcacgctggggactctgggtccatgacagtatttccttcctgtgtgataggcctcacagcctccactttgcatgtgaggaaatggaggctcagaattgttagtagccagtgagtagctgagtgaggacatgaacctgagtctttccagctcaaagtccttttccttagcctatttcacaactccctggaactcatccatggccatcctctggttcaaattatcctccacctaggcagtagactttcctttaaggaaggaagaaacttcttcaatgttttatcctcagtgcctggtacacagtaggctcccagctaattactgttgaatggatggttggttagatggatagatggatgattgtatgattggataggtgggtggttgggtagttagatggatggccatctggatggtgggatgattgaacaggttaatggctgctggggtaattgcattataagatgcatgagtataggtagatggagagacagctggatgaataggtagatgggtggataagtggtgggatgttgtgtagttagatggatgaggaggtgaatggagacattgttgaactaaatggcatcctattcactgtgcttgatgtaccctaatatctgtccatccatccatgcaactgtctcagcacgcacagtgggttagatggaatttcctaagagtttatttcaataaaataagagtttagttcagtacaataagtgtttattgaatgaatatctctctttgcatagtgggctctttggatacatttaagcaatgattccatttactacattgattataaccaacctattcagaagtgtatttgtgaatagtgtgagccctcaggacctcagtggccattgccaattttggagactggttctgtgctgtctccaggccagggtctgcatacgcttctggcgacaccactgccgtctggctgctgaccagcctgggctatttctgagctgcaggtccttaggccctcaggtgaggatactccagaagcctccacttcaccctcactggaaggaagtctctggtggaaacaagctactcctaaagctttctgagcacttgtcaggaggaataggagagaaagctttatcggaatgagtaagaccaatagtattaacccatgactcgccacaggaggcgggtgggggatggtgtcttcacagctcattcaacagagtagaagtcacagacccaaatgctccataagtgacctgggccaggcagggctgtggcatcctggggagtgtgcactcttgctcaagagggcagctgtcactcagatcctgtgggccatcacccctggccacatgtcaggccattgtggccagaatttccaagagaaaccgaagatttgatttttttggtgaaatagccttcatgtaaatgttgagagcctcttcctatttttaaaagcaatgtgtgcacccagaaaacatatttgtggaccagatttggcccgggaccacccactggccacctctgatgtgaagtcacttatgcacttgtattgggagaagtacatgtttctttacactgaggttaaggggattttcaactcttgagttagcagggaaaataaatgggtcatcctgtaaagtgactgtcagcagcggaagcctccagggctaccactgtcagtatcctagggagcctcagcgaacctgtctccttcctcgcatatgtgagggggcccttgtgtgcggccctctcagctccacccttgctctaaggaagccgcacagtgcaccgctgagaagtcaggatggacagaatgcctcggttcccagccagctctgcagttttccagcatgtgggcatggggaagtcacctcctgacatgcgccttactttcctcctctgtaaaagggatgtgactacaacagagcctgtcttttggggccacgggaaggatgcaatgagccgtcacacgtagaatgcctggaatcatgcctggcagagaggaagctctccaggaagaaaaggaagaaatctgagttccatgaggatagggaatttgtctctttcagttttaacagctttgttgagacataattcacacaccacatgcttcacgcactttaagtgtccaattcagggcttccaacatactcatagagttgtatttccatcagcacaatcgattttaagatattttcctcactccaaaaagaagcctctccctctcagctgtatctccagtccctagaatggtactgagtcctgtgggtactcggtgattttgcagctactgctgcagggacgaaggggaaactgcatgggaaggcatctcctaaacatgaccagttattggtgtcaccattccctttgcttcaccaacttgatcttcttcagatccttttcttctgcttcggcatcttttcattgtcatcattttatcttcatcactatcatcaccttcactgcttgtttatcatcatctttgtcattttcatctttttcttcctcattatctttccatcatctttagcaacaactttgtcaacatttttatcctcatcatcattttcatcatttccataatcacgaatttgccccatctttgctccctaggagacactcggggaacttgggctctcaatccccttgacgtctgggggcttggcctatgaagggaatgaagcccacatctaaagcaggttccggagcctctgctgagtctgatcgtgcctggagtgaagaggactcttgagaatggtgggggctgggcgcagtggctcattcccgcaatcccagaactttgggaagccgaggcaggagaatcgcttgagtccaggatcacttgctgtgttgcccaggctggtcaccagacctgggtgcccacaggcagataagaggaaggtgcctgagtcaccaactgcccacgggactgaggcacctccctcttatcttcctgctattttccagatcagcctgggcaacacagccagactccatctctacaaaaaatagaaatttaaaaacagctaggcatggtggtgcacacctgtgatctcagctacttgggaggctcaggagggagagaggatggcttgagcctaggagttagaggctgcagtgaactatgatggtgccattgcactccagcccgggcaacagattgagaccctgtcgttaaaaaaaaaaaaaaaaagaaaacaaaatggtgggaaggtgagtctgagccgggaccctgcagatcccacaggtccagctcaggttgccacccccgtgtgtggcctggttgggccggtgctgtcccagtactggccacccgtcaactgaggcacctggttgggccagtgctgtcccagtactggccacccgtcaactgaggcacctgattgggccggtgctgtcccggtactggccacccgtcagctgaggcacctggctgggccggtgctgtcccggtactggccacccatcaactgaggcacctggttgggccggtgctgtaccggtactggccacacgtcagctgaggcatgcagggctctgccatctatagccttctttggattccgagatcccaagaacagaagctgttggcatttagcaatttatgattttcttcctttttttgatgctgcagatttatccgactgactttcccagccctccagggggaccgttgctggggcttccggtctctctttgtttagaaatctcagggcaagtggagatcaggtctgttctgcacagatgcaccttcctgagctcttggcgtggcaccacctcctgcttcaccactgtggtgaggggtctgcctgtgaacactgcagagcctccaaggtcaagaagaccaccaagatttatgagggcactttcaaggatttgttgcaaaaatgcgaaggagctcacgaggcagtgctgtgagcaggctctgtgtggtattgtgggcagaaatcaacctcagccctaaagggaggggcctggtagtcctgcaaaggccggggcaggcaaggccagcacggatcaggcaaaatggtggctatcatgtatggatcttgtacgttctgcttttagatggaggtagctaagcaacagaacacacagcttccaaattgggacaagtttaaactggcaaatctcagccccagaggatataaatatgacgcttcatcgtcttgggtggaagtccccgtgtacagggagggaaagcccatctgtgtgtggcatgcagggtacagggagtgggtcccgagtcccatcctgtgcaggggagaggctcaggccccttctgtgcagtgtcaatatgaagtggccctgtccctgctgagggctccagggagggtcagctgctgtttgttttccttggttgcttgggaatctgtagaggatggtacagcatgttttgtaagaaaatgcaaaacaacatcaacccccattcagtgtcaataaaacatgattcccaaaccagggagcaggtggtttggtggacttggaggctgcctggctgagagccatgggctgagtgagcccagggaagtcacatggtgagtccaagccttgaaatgggtgtgtgatgtctgcctgctcagatgcttgcagggactaaataccacacagtcctgcttcacccaggatcggggcttagcgtgtgtgagtagtagtcatggtaataagagcacaaccatagctcactaacatgtatgaaacccatgttatgtatgaggggtggtgtttgcctgcattcatataaacataagacgtaaatgctattattggatgttcttagcagctaaggaaatggaggcccagagagattgggtaagatgctcaaagtcacacagctagtaagctagtggagctgagatgtgacccaggtgggccgactccagaccgcacgttagagccaccccactccctggaatagttgcacaggcggtcaggactggcatggttgttccaaaatcaacaaggacgcagactcctcttaccttcctgctatttacccttatgccggtgttgatcctccatggtccagggtggctgcaaaggcaccagacatcatattcaagtcccaaaggggcatacatctcagctgagtcagcttttccagagggctcctcccagaagctcctccacacacatctacctactgctccttggttggaccctcctcatgtggccgtggtcagctggaaaagagactgctctgaataggaccagcattcaggcataagaaggggagaagggagatggggtaggaaactcgcggcttctgctgctttaggtgttcaagttaattttgttacattaaaggaagaaaagaagcaacaaatgaagagatggatgagtgaatggaaagcattctgtctgttaggtagcaatgatttctaagtgatttctggagcagcctggtttgaggagtgcatgtggatccctatgggcttggagagcaccgccggggaatttaaaaatgccccattcctgaccctcccacactgggccagggaggtgagcagctggcaggaagttgaggaggaggagggaaagaggaaccctgagaggcgctgagagtgatgtggacaaacacagctaccccctccccagcaatcctaccctttctgcagcgatcccaccccttccccagcaatcccaccccttccccagcgatcccaccccttccccagcgatcccaccccttccccagcgatccgccccgcaacgatcccaccccttctccagcgatcccaccccctccgcagcgatcccaccccctccgcagcgatcccaccccctccgcagcgatcccaccccttccgcagcgatcccaccccctccgcagccatcccaccccctccgcagccatcccaccccctcccctgccatcccaccccctccccacagtgatcccaccccctccgcagtgatcccaccccctccccaatattttagttcagcaacagatgtttcctgaacagcctctgtgtgccactctccgcactgggcctaggatggggggaagaacaaagcagatgcgggggctgccttccgaagcttccattccaccagcaggcgtgggggaggggaggtcaggtgaacatgtgtgtggcacatgtggaatatgtggctatggctagacacgggaagggctgcagtgcagagtgaccgtgttccactcaggtggcttccagcatcccctcctgggctggtgggcgctggtgcacctcagtgccattgctgatgaaggtctgggtccggtggaaatggtgtggtctgcagatgaggtgcgcctgtcttttcttaaatcaaggacactttcagatggatttggtttctctctgactcggctcgttcagtcagcctgacgggcacctaccgtgtggctcgggccccgtgctgggcaagaccctgcctccagctcccagcctcactaggagtgggggatgggagtcacaggatgtgcccagtggaacagccgccagggcaggtgaatcctggagagcggcgggctgttcaggtctgggaccctgggaagccacagggaggagtgcatgggagtgaccctggaagcccagagatggagatggggaggggaagggctggcaggggccctgcccgagcaaaagatcagaggcagacaatgctcagcgtccaaggaggaaagcggaaggagctggagggcaaggcaggccctggtacctggcaggtgctccattggtgcctgtggaatggaccccaaaggatcttagccctgggagcaggcagtggggagcattacgtattctttccattttcaaaatttgaagaagggacttatatacatggtaaaaaataaaacggtacttctcactcccacctcatccatctgtccggagtcagccactgtccacggggccatttgtgatcattcagaagtgggtctttataggagtcctaacgcccagaacagtaatctgcagatattacctcccatgtgctgtgcccagctcggggtgagctggaacctgcggtagatccttcgctcggcatcagtctctggagggaggtaaagacctgtcctcagtgctcagccccaggtgactactcaaaaagccatttgaaagaagagatcataagcatgatttgttcatgctttaaacacaattttaaaccatacagatgtcacttgtttggccgtcactttgaggtagaatccaaggacatttctttgaggaaggatctaccaacttaagttatttttgctctaaacaaaggctggatgtgtctcctccaagttccactgacagtttctttggagaggagtgagtatttaaaggcacttggaagcaatctcagtgcagaatccttccagagttttaaggccccacctccccagatctcacttctctctcccacgcaaactgcacagtggtatttttagcaacttgcctctactgactccaaagcttagttttcatggaatttacattttcattttacacccatatgagatcatttaatcaatgtgcattaaaagcttaattacatttattacagagacaagtacacctggtacaaataggtttgggaacagaagcaaccagttcctgatccatgcacagctcagctggtgtggccaggcagttctgaaatcaacagggaggccacgaagtcagcacgggatgcccagcatggctggagccactgaaggatttctgcttcaagaagcctcaaccggtatctaaggccttcccactgatcagatcaggcccacccatttcagccaggacactctccttgacttaaagtcagctgatcacggcccttggtcacatctaccagacgccgtcacagcagcacctagaggagtgtttggttgagtaactggggactgggaccccaccccccataccattcaggttgacacatcaaattgaccctcacagattcaaggttggcagaaagctcatgagcagatgtaagattgcactcagtctctcactcacagcctctctcctcaggtgatttgtagagaagccactattcaagcaaagggcaagttcaaagcttagactcttaatgatgatgtggttttgcagtttctatattcacgtttattcccttttatcttccccagagtctggctgggagagccttccacataagggctaatggagcagcacccggttcctttctgtaatggcattgaattccactgcagggttgaacacaggtcctttaggcccaatgggcattaaggctctgccctgtgcttggctataatgaacatcctcatacgtgtgtctgtaagaggcccatgtggaaggatgttcacacacatcagaaatcttggaactggaactggcaggttagagaatatatgcatctgtcatttttgacctgagcattgaccaccagggaatgcccctgattgacagccccaccagtgggggggcggggggaggggctctgtctacactcctgtcaacattgtggattttccaactttctgccctctgctgatctggaggtggcacagtgacgtgctgtttggcacaaccacacactccatgtggttgttatttccatggaggtctgtgaatgacgatgaactttggacttgccccacaacagcagcccagttctactagtaaggcagagctgtgtcccacaagcccagaaccatgccccctgcagcggggcccctgtattgccagtggcttctctgttcattttgctgtgccagcttgagaggctgtgcaggggctggggattcagcagtgaccaggtagacaaagtctctgcccttggaggggtcctgagtccctaactggccagcttggtgccttgtcctgggttggcacacatactgccttttgtactctggtggcagctgtgcaagcgtgggactgtggtgtctctttcacaggcttggagggtggcttgcccaaggttgccttgttgctgtcaaaaccagcctttgggctcaagtttctcaatgtaaacctggcgttgccttgatgtcccattcatgtatccactcatgcattcagacactcattcattcattcagtcacttgttcattcattcactcgttcattcactcattcactcattcattcattcagtcactcattcattggtcacttatcacggaccaggcttggttccagggccctgagtacacagcattgggtactactgatgcagttcttaccattgaggtactcaaaacataaataatcaattctggccatgaaggccacaaaatacacaaatgcactggggagcaacctgtgcagaaaggagccagttacttcagctggaggagtcggggtgggctttctggaagaagaggtttaagctgaaccatggggagatctgggtaacaactttctcagcagagggaagggcccaggcagaggcgctgggtgggaatcagcttggcatgtgctgtggtctgaatgtttgtgtcctccccaaattcatgtgtcacccccagtatgatggtggttgtacatggggcctttgggaggtgattaggtcatgagggtgcagtgctcttgagcgggattagcgccctcaaaaaagggacccctgagggctgcattgctccctccaccatgtgaggacacagtgagaagatgctgtctctgggaaagtgggtcctccccggatgccgaatctgctggcacctcaaccttggacttcccagactccagaacagggagaaatggatttttgttgtttataagacactgagcttaggggactgtgttgtagcagccgcgctgggcaagggcagctcagcaggtcagcatgaccaaaggaggacaaggtatggggaggagggagatcagtggggtgggggaggggaggggtgctcaggggcttcgaggaggctggagctctgctcctcagcaggttgtctccctccaggaattccctgccacaggctcgggcctctgggtcctggtggctgagcacagatcttcgctgagtgtccctggtctgggccaatgtggggccagcatcttggttcttcccagctgactcaacctgggcttggctcacccttggctgggacccaaggaggccaggcagggtggtggggcccagtggggtgtggggcacattccttccagtgcgctcccctgccccagccttacacctggcattacagggcacatgctgtcctcaccctgcctctcacacctgctgtctctgcacacaccctcctggccctgcctctcacacctgctctctctgtacacactgtcctcactctgcctctcatacccactctcccacacactctgtccctgccctgtctctcatgcctgctctgcacacacagtcctggccctgcctgttacgcctgctgtctctgcttccctctctcacgtccttccctgcagggtgcgtctctccctcctctttgcacacatgttcttggcctttcttcctcactccactttcctcctttcaaaagtagcattggcagggctgggtgtcactgtgaatgacattctctgcgttaccttgactgtgagaacagaaagtgcctctctacaggtagatgcgagtttggtcctgaaagtcaagggcctggttttcctccggaggatttgaatccttccctctccctgctcccctcccttctctccttccctccctccttccctcccatagttctcaggcaccaggtgattcctcagtacctctgagagtccccagatggaaggtgacctggatgtcccttggtgtccatgttgctgtctttagcacctggaagaggaggtagaaggggcatgttcacggtggggttggggaagcctctcagggcagcccgggaaccatccggagagactggtgctggtgaccagctggccttcatgggcgggggtgcacgtgatcttggtgcctcacctgagcccttggaacacccggctccaggaggctgattggaggcgagacccctccccaccaccactggggctgttcctggtgcagagggtgaaggactcatctcatctgtatcccaggggcactaacccaaccctgggcagggcagtctagagtccctttttggcttagggtgggccacagagccaggctgacaaaacagaaatagcaacagtgatggagacagtgcggtgtgcagcttgcggagcccagggcacagcggcctggctagccccctcacatacggctctctcctttcagtctcaccaggtgagaccatggaggtgcagagaggagactggctgcacccaggaggtggaggacaagagacactggagagtctgggaggccaactccacgtacctggagttcttttctgtgctgccctgggagggagcccaggctccaggggacatatttctcctgcagggtggggttgggaggacagagtaggcaggagcctttggcctgaaggcttgtcactgtgggcacaagaggcatgggacaccttcccgacatcagaagccccccactgcaccaagcttggcggggcttcctggtggagttgaagttgccctgcctcctatgccctcaggacacaggaggcaggccagccgttctgttgccttttggaaactcagggcagctctgtggattgtcacagcaactggagctcctgctgtattttcaggatggtcccgggaggcaggtgttctgcagccatggggcactcccttagcaatgaagactggccccccattccacttgacttctgaatgtccctgggacactcatgagagtccgaagcctgtttatgatgacctgagcctcatcccaagtgcattgtggacacacacaggaggtattttggtggagctgtattacaggtggcgtctcctggaatgcaaaatgccagaaacctctcccacagattggggagggaaccttgctttgtccagagcttcaccaagaagcattcctccactagtgtctctcagggcatggagtgaccagtgtggcagctgtgggtctgtctgcattggtggctggcactgtgatggtgatttttctgtagcggcagcattggcattgtgtgctgtgtcacccaatccagccatgcctggcacttacttacctatcggaatatgtgttatttgattaaaacttaatttcctttttcctcctttatattgcagatagggtgttatgttgtttttttggttatgcgtgtcagggatttggaggaaaagggacaagacagaacaattgtaataatgggggtgtgtggggtacagtggggctgcggacccgtgtgaggagaaggacatctttgccggacagggacagtgtgaacagccacttattggtaaatgcagctcgacgtggggccatcacccggcatggagttttgggaggggtgggagtaggaggggctgctggaggggtcaccgtaaactgaaaggctttgctgagggccttggagtttgtcctgaggatggtgggaacccgggcttgagctcatcgtgggagtaggagttagagttatgctgctgtgggcagggaggtggacagtgtggaagtctccatcatccagggctgaggcttgtggcctggatcagggaagtggccttggggatggagagaggcagatggatggatggacggatggatggatgcaagcagaacccagcagacttggagcttcctggggtgttggacgtagggagtaagaggagccagttctcccaggggtctggtgtgtgcctgggtggtggctggagccagcccctgagcccaggatgctgggcacggagcaggtgtgaggaggtggggaacagggtgtgaaaaggtcggctttggactcagagtgcctggagtcacatcctccccggcatcccagaagtcaggactgctggctgctgagatggggcttgccccaggcatgtggaccagcagccagcacctctcagctgagccctcagtcggcagaacatccctgcttgctgtttcctagtgtggacacactccatcccctctgcctggatgcccatcccaggtctttccctgggcggtttctttcatcatccaggcctcatcttatggcctggagagtcctcttctcttcctgaacttctctccagacacacccacattgctctgacgctctgagacatagggtcaatgtgcctgtcatccgtgcacccagatggtgtgcgcctgggggcaagcagacgagacatctgccccattcaccatcagatgtctgaggatgcatcaatgcgtcgtgtgaatggtgtgtggagacgctgcctcgctggggaatcccatctccaggcgggggccgccagcttttctcagtgactcaaggcggctgtggggcaggattggcattcccagaaaggagcctcccaaaatagcccgggcgtcccctgtgggtgtcgagctgtctgttctctctaggaaggcattctgccttgtatggaaggaattgcttctcaatttctgctccacactgaggtgactttagatgttgattcaaaccttttctgtgacatctgtgctggggtgagatcaagatttgggggatgtgcgtttagtggggcagcctggctgggtggggcttcattggggaagcaaagcttggggagctggaactatgcttctcctgaccccgtgtccttccacttcctgaaattacctgcagcccctgctgctgtgctcatcatgcaggaaggcagtcagctgagcagtgtgtgcagaggacgattcagaaactggtacaaacttggcactgagacggcgtctgatgggagaagagggggtgtctgatgaaagaggctatgacagacaggagcatgtgcgtgtctggtggaagagggtgtgcgtgtctgatggaagagggtatgagtgtctgatagaagagggcgtgagtgtctgatggaagagggtatgagtgtctgatagaagagggtatgagtgtctgatggaagcaagtgagtgatggacagtgtgagtagatgatgaaagaaggtgtgagtatttgatggaggagggtgtgtctgatggagacggtgtgaatgtctgatggagagagcatgagtgatgaagagggtgtgagtgtctgatggaggaatgtgtgggcatctgatggaggaagatgtgaacatctgatggaggtgtgaatgagcagatgttgaaagagggtgtgagcatccgtctgatggaggaggctgtgagtgtctgaaggaggagtgattcttggggatccaggcctgcaaggaggcgctgggcaggatggagcctgcagctctgctggctgaaggtggaagagacctgggctcagcacgccaggtgaataatatcagtgctatagtagtaatgatgccacctatttgtgtgtcaacctcctcctgtatttagtgttctcgactctcccagcatccctgtgggttttgttggcaggtgttcacctggggaatcagaggctcaagtaagggagggcgtgacgccatcacccagctggcaggggtcagagctggaactggaatcctagctctgtgccagtgctggggcaccagtgctgactgtggaatagacagttgacagcctccacagacctggaaatgtgggtggcacagtggcatcatgactcctggagcctctccaggcgtcctgactgtccaggctgtcggcggtctcatcagctccacctctaggccccttcctccccattgtttgtcccctgctccctgtctcctctgtgctactcacagcacagggccaggtgtgtcgtaggtgactgctacagatctgtcgtgtgagaggcactcggaaccaggaagtgcctgtggggtcacctgtttggctggtgcccccttggcccccagaaatgactcacatccacacttgaacatacagacatccttttccagggtgtgttgtgctcgatacctttaattcctgtctgcattccagggcctgcccagcctcttcctggctccccagcccagcctggtccttccggcctccctgtcatccccacctctcgtgtgtgcacaagcagggaccaggtagggagaccggcagatgctgctctctgtccctggggtttcttttcttagtgttgctcccacacccacgcgatgctttaattaactgccacactcaggctttctcagtggggagagtcagaaatagactgtggcttccccagctccaggcggcaccaggacgtcaccagcagccccatttctgaatcaggagtctcaagcagctgcagagggtggggaggtttggggaatcccacaggggttctacacccccacctaccccgccccacccctctgcagggccttctgcagcttccaaagcccagctatgctccggccacgtctctagcggctcctcggagagcaacttgatactgaagctcaaagcccaggaagccctggcggcatccctgccccagccaggtccaagcaggctatgtagtgagggagaggaaccggcgcccattcctttgctcctcgacacaggctgctccccttgcctgcgccggctctgggggtctgctctcacagagcttcatgactcgttcaacctgactgcccttttcctggccatggttctgcctagaaaatttcctgggccaccctggcctgagtggcgactgtgtgtcagggcaggggtcagcacactgtggggcaggggtggtggcctgtgatgcatgcctctgcctgggcctgactctctgtgctgggagaatgcttcctgggcctcatcccagctgtgtccctgctggctagttcctgccagctggtgttgccggtgttcctccctgcctcagccctcccagcatctggaactggctgtgggttctgattccagctgtagtagctgctgatcacattcctctctctgagcctcaagggtctcgcctgtaatgttggcaaagtaattgtctgtccttggcatcaggctcgtcaccatttttccttttggaagccccaactctgcatgaagagttagcatagcttcaggtagcaggtggacaaaagggtatcttttatgtatacttagggtaacaagtattaatttggagtgtggggtgtttttgctctgtggccaacttcttccccaagtcttgaacacttcagggggccctcacaggcctgcagcacactttgtccttggtatctggtgggggtctgggcaggtccgtatctcttggtagtgggttcatctccatctctgttggacagaaatctggaagagtccggagagtgtttgcaaatgcaaatctagtcctggcacgcccacaccccatctcacccaggtctgctttaaatccttcagtgccgctctggggttccaggagtgaatccagactctctctccagcgatgccaggctgtgtgggtcctgcccctgctcagcctcggtgcacacacacctccatgcgatctaaacgaccccacctcaggacctttgcacatgtcctctcctcacctagcgatccccaatcatcctctggatcccaactaaagtgtcaccttctgggaagccattcatgtgcagattagagcctagtctgaacggtggcctggccttgttgggttggcagaaccaccctaagaccctgcttagcaccctcacctggcagtcaggggtcttcttgctcacctcaatcccctccactggtgagaaccacagggagggtcttggggcccacagcactgtctagggttctgcatccacccttccaggtgtggggtcctggcactctgtaagtagagaggcaggttggtgacaagccagtggggtcctggcctgagcacccttttgctctgtttacaaccctgtgcctccggggctgtgtctacccagaggactgcatattctagaccattcaggggtaccctgttgacattcagtgagaagcttggcagctagatgaagccctgcagtgagcgattggaccactaccagactgcctctgtgccttgggaccaattgcacagtttttgctggcttgatgtccacgctttcctgaggtgtaccagttggatgaaatgcttttctgggaacatggtccgcgatcagctggcaagtcacaggttgggttttcttgagaaattactatatcccaagcatgcattgtcacaaacatttttgtgcattatctcatttaatgctcattaagagggtctggtactaattctcattttggatgagaaagacaaggttccaacaaagggcggggggaagccttgttcgggggccatgccagtggacactagcctccagggacatttggggtacttctcagatttgaggaaatgcacagcctcactcctcaggtgtccctatgggtgttcctggctgggcagctggctcaagaattgtcttgagccacacacaaaatacaaatggctggggccagcatcgcggacagtgaaagagtttaccaaggcagttataggtaaagaaaggcaaatttattagagaaagtatgaagatccgttgcaagggtgcaatgggcagcacagtagagaaggggctgctggaaagaggcaggcgctggagggaagttttatagggttgtgccagaggggcttatgtgcagataagatagtactgctgggtcttcgagtggaacaaggtgtttggaaataggatgtcatgccagtgggttgtctgtgattagctggctctcagaacaattcttctcccccacctaggaccccttcctcattgttgcttacttattaggactccacgttttacttcccaagatcccattcctatacacagcctctccctcttagccagaggagctgtgcaaaggaagtaccttttcatgggtaaaagactcatggtgcgctcactcttgctgggcttcagggatttttcatttctattgctctaaaagtgcctgtgtgccttccccctccatcccatctccttcctgcttccgagcccttctgtgggcagcatgggggccaggaatctggcttgttcctgcttttcctatggtggtctgccccaccattattcacacacagaggctgttgggttctcttaccattccctgtttacagagactcagatacattcagaagcgagctaatgctgggtgcccagctctaaggggagaccccagacaactccaatttcctgatgatttctcttcctttacctaattccttctccaagacccttgcagacactgctgtaccaagtggattctgtgtaactctctcagaagtttcctcttccatgaagcctgccttgattacccacccccatcctcactccctcagtgtttaagcccagtgtgtgaacagttaagagacgctatggtcttcccacactggtttcttctcttcatttgggtctcagcgaaatgtatctctgccagattctgaatgtatctgcccctgcccaaccactcacccaccatatccgccatttcctccacggcattgaccactctctcagatgattttgttcatttgtctgcctttacctctagaccaggggcatccaatctttcagcttccctgggccacactggaagaattgtcttgagccgcatacataaaatacactaacgataggtgattagctaaaaataattgcaaaaaaaccctcataatttgtgttttcagaaagtttatgaatttgtgttgggcctccttcaaagctgtcctgagctgcatgcagcctgcaggccacgggttagacaagcttgctctagactatgagcttcccaagggcagggaagacttcccatactcagcactctgttctgggggcttggaacagtgcctggcacatagcaaatatgtcatagtcatctcctgagtgcttgaatgagtggcctttggggtgttttgactagactgcaaaagcaacacttaagtgagctaggctttgcatacattgtttgggactggggaggattccagccaggaattgtcagggggggaggttcaagtctcactgaacatcgagatatgatgtggaagcaaccacccacagagccagaagacaaagcccccaggggagcagaaccacaaagggttgtgttctagtggggagggaggagtggctgagccccgcaatgccctaggctttctgctgggacaaggattataaataggagataaataatttttaaatggaggcaacatcctcactggggcaaaatattatggccctaaattctaggcattcaaatactgggccctgttgtctccctgctgtggttagaggatctggaagtgggaaggtttctggctctggcccaaggacaatattattgtagtcataaaaataatcagagcttggcattaattttggatgatgatgcctccttctcctgacaagccctttatgttttttggtggtgactgttggctgcatcctccaacttcctcaatgagagaccacttgaaaaagaaataataatttgtcttcatatcgcacactccgtctgggctgatggtgggaggggaatgcgtgtgggtgggctcagctctgttagctgcgctggctggaagagattcccagtttttattcagcgctcgagctgggctgcatgcttgctgacaagaggcgggaggccccttagacgtctttagacactccccctgtgctgggctgggcacaggcggctctactcagcagttcagcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaggtttgggcgacagatcagaaaaatgaagacctgcacatgtggagctggagcaaggactagtctagtattagctctgtgacgggagagctttgactgtcacctggaagtctgacttgattttgccagcaagaggcaacaaccaaaggttcactttctctccttccaattttgggaggcgatctataggggtttgccagccacctctcatccttgcagaccccaggtggaatttgcaggcagccactatggtgcaaaatgtaattttagtgtttttccgcagacggctgagccaaagacctgccgtggaagagctggagagaagaaatatcttgaaacgtgagtagctggtgattcctctagaggttttccttcacgtgtggtgaggctgttgcacaaatcctgagttcccataacccagcccttctctgcaagcggaatgctccatgctcccagtaaacctgagctgctgctgaattctgaaagcaagccccaaaggaaagctgatatacctagaaacattttttttaatttaaaaaaactcctttcctcttagcataaagatgtttttattttcagggttagtcccatatgtctaagtgcgttaggtttcaagcaggtcttcctggcagtttgggtcggggttcttcatggctatagaaatcacaaagcatgaaccgcatgaacacactagagaaggacacgccccttgcctgttacacttgggaggaataaagcagtcagctcagggaaacggtgaagccatgagaagctttcctgtggctcaggactttgaggttccaggaccctctgttgctcccagccttgcaaccccttgcatttcccgttaggtggacaattatagcatatgctgagcataggtgttcatgagtaacctccatgctctagggcactatattccattaaatattccataaagtcagtgatttaggggtggccaaacctcttgaaaaagtgtttctccaatagttctttatctagtcattttcagtttttaaaacattttccacagaaagtgtcttctaatggcttggatttttaaaggactttttttctctttatgtgatgaatactgcagactttctctgagtttgttttcttatttgtgaacatctttttatgaagttataatggtaccaagctgactttctgtcagaaaataccgcagagccccttgttggtctgggtactgaacttgaattgattcctccctcctttctttgcctcagtgccttcattaactgcctaaaacaatcccctcctttatagattgttgaaaataaccctcagataaagacttcttcattttactttttaaacttaagatatagtgactactgttctatgttaactataccatctctgaggatttaaagaaaagctcttcattgataacatgcttaattaagtaggcagacagaaaagtcaagctgtttcagttgccaaatatttgaatttttaaaaattaagtcacttatttataaagcttgtaagttgcagatgctactaaaagtagcagtccagacttgaaccaggcaagttcaagacacaggaagcaccacattccaagtagcctgctgtcagcaacaggaagagagtactacagcccagacctttaacccaggaaccatgtcttctttcagtagcagcctcttccttcctatcgtgggcaaccaggtcttcccatcagcaagtacttctaattgtgttaatctttggaaataaatatcagagccttagaaatagaactatctttggtgaatagggagctagcaaatgcataactgaaactgactgcccttaccttcagtgcatgaaagggaaaatgggtttcctctgcggtggccatggcaatcccgccataaacactgtgccttcatcagtgaatgtaggtttgtccttagctcggaagccctctctagtgtcctgagtggaaggacctgagaattttactgctaggtttgtggtgggtgtttggttttacttttgttctgtggagatgagaatagggtaactatatatagcctagtatgaaacatcatactcataggctctagatacacaggacttcaagcactcatactgtattgtattttcttcttgtaaccaattcttagaatatcacttttgtatttgcttcaagggggaactcatgactaactgcagtcatatctgaggagcactcaaaactccgcccatataacactataacgtggatagaaaagcagaagagcaggggtccctttatatggtgatggtaattctttattaggcccaatctgtgccagggactatattcagtacttggtatatattccctcatttaatcattgcaacatatttgtgaggtttgcactttttaataaatgaatattgggaaaaggatagcactagagttcaaccccaggtctgcctaactccattgcccatcttcttaactactgcatcagaagcagtaatacatttctggatattcatggaagtctcaggtataactgtccaagctgctggagctatttccagaaaatatgagtatagcagtcctgattatgggtcccttgctttgtataatgcagagggtgttctgggtctggaaataagaaatccataaacatatcactaaggggagctcagaaggggaggtctgtgggcttaggctaacagggaggacttcttggaggaggtctccaacagagcgcctggcacaaagcagcactctgacaggaactttcaaagatcagttctccaaagaccctgctggtgaccttcgtagtaattatggcatttttcaggattaaaaaaaaaaaaaagatctgactttgtttcaatcttttcacatggaagctgcacttgggagctgcccatggcctattttaaagaaatctgaaacattttacgtcacgtaaatccctcatggcttgccttgtctggacactttcacaatgtctctctaattgtatcagctttctgatgataccttaaaagtatggtttcttctggtttctcacttgtataaagaattaagcagaaagaggatttcattaccttttctaaaacaccctaatccaagatgactcacttaaaaaaaattactggaaagcacaatatattaaactctcatataaccaatcccacaaatgtataaatatttgaaacgcatcttttacataaaggcagataatgtgaaattgtgttaattgcaagtggcaggatttcccttaccaaaacctaccagtgtttctaggagtgctgattgttgaaatctctttcctaggaatggagctatgttcaggtcagggacataaggctttatttagcaacagagaacaccagaaataggacagccattatcttgtatcccagggggaagcttacgttttatactatatctcagcactttcgtctatttttggcttccaagggtaggtgcgagcacagcttgaatgttaatagtcacaacttaccaagcaaagctaattttgctgagggacttgggctcctttaaaaggcactgtcatataacagtgttcacgcttcagcaatggagagtcagcgaggttcatagatgtgttaagatttgaaatatagtctgaacatataaattccaggcaagcatatgctgcccaggagctgaagaaggtgttccatgttttatgttggttaaaaagtctgtacgcttattaaggaaaaaaattagtggcagtgctatttatattgaaatgtacatatacatttatttacttagtctactacagctttttttatgtggcatctaagtgctagatgtaaatataaagatatttggggagaaagacagacacagaggtgtctacttccttaaacaaacagcagccatatctgtggttgtttctaatgcacagaagggctgaggagaccaggttgggatgacagcaaagctttgcttagtacaagtatttctgtgtaatgagaccatgatctcctgagcagtgactgacaaagtgggaagaaaacaccatgagtgatgtggaattaacttcagctcccagaaatatggatatcttgggaacacttccctgctgaagagaagaacgtttcaacctgtttctctttgttattttttttttcctattttaatctttcacagaaaggaatgatcagacagagcaggaagaaagaagagaaatcaagcaaagattgacaagaaaggtagtataagcattttattgcctgaataataaaaggtggtctagagaacagctgcttcggtagcaggtgggatgggtaatgctaggtatcactctgtgatcatgaataatgttctcctggacatcatggcatcagttaaatcaggatatttgctcagcaacaatgaattaactccctctgacgttccctatggacgaagtccttccctagcacggtagcacttggagaggtgcacaatgcacatgacattttttacttatgttcaggtggaagccagaagttgattggcattttcttaatttacagtgtctaggaaaagcatacctgggtatcagtgttttagtcacattttacactcatcgcttttgttcacctccaatatgtctagaagttcctcagttgcagaaagctttattagactcaaaggtttgttctctgtgactcaaacagttaacatttactatggccaatacaggtagcaactctataaatcttaatctacttttaaagccttgaccatttctaaattcaagtgttctggattccccttcttcgttgtgctgctccataataattctcttgaaattaacagaatatccttcctaagctggacatataataactttattagtacttttaaaaagcttatctaattgtatctgaagccagtgatgccataaaatctaagttaattcactaaccattccttgagctggtgctatgtactactgggggtgtgactccttctgataaaatatgttggaggaagggggattgtgatttaagagtacagtatataatttcagcccttcacattagagattgcttgtatttgggttatattttccagtttcaggttttttttgttttgttttgttttttaagagaagtgctgtttgttcagagtacttcaaaaaagctagtttggcatgtgatacttaactatgatgatctttaattttagcttaatcagagacccactgttgatgaattaagagacagaaaaattctgatacgattcagtgattacgtggaagtagcaaaagcgcaggactatgacaggagggcagacaaaccctggacgagactgtcagcagcagataaggtacctaactgcctgtgctggtggggggtgttggatgatataataaaggcaaaatatgtcatgccagggagtttattcatagacaatgggagccctcaactatttaagggtatactgcagtaaatattggtttctcaaagataattcagggtcagattgagaagtggttctcagctaggtgacagttttgccccgagggacatttggcaatgtctagagacatttttgattgtcacaactcgggatgctactggcatctcctggtagaggccagggacactgctcagcatctcacaatgcacataacagcccccacaacaaaggattatctagtaccaaatgtcaagactgtggaaattgagaaaccttggtataagggataaatcaaaggtgggcaaggctgccataagagatcaactgacaagtttaaacaaaaagagctacagtggggacaaagaggcattcaagaaagcctctacagtatagaaaaggttctagattctccccctggacttgtgcagtttgaggtatctctgagaacctcctaagaagtctgaactgaacagctagagaggcaggaagaacacaaggaggtagtaggtcatagagtctctgcatgacatttggtgagcacagagagggtcagttcttgtctgtgatcaaacacttgactggcaagatttaagcccaagagtgtccatagagttttgtcaccttcttgcttctattaattttcagaagacttaaagcctttaggaagagaaaaattatacattcaggcaaggaatttgctaattgttcttcattcttcatatgctgagtatgagtatgtacacagatattgcatcaacttggagaaatgtgaacgtgttggactaacttgcctggttctttgtgactgatgtgcccagaggatcacagtgatgcgaggagaagtatctttggtggtctgcagatgtgtttgagtatgagaataatatacccctaaagttcttaaagactttccttgtcccagaggctgtgtttgatgttttcagtctcatcaggtccctcgagtgtttatctgagaaagaagtacatgatgcaagtgggcctggggaagccaaaatattaatgtatgctgaagttagaaaggcttatttctagattatctctgattataaaattccaagttcaccaaaagctgaagtttactcattatcttggtgttcctgtttcattagtgccctaagcatgtgcttggtccgtttaggtatggagtgaacggagtttggggaagggttgtcttcccactacagttcagcaaattaatgaatggaacacttacataatactagtcctagccagagcaatcgagcaacagaaagaaagggcatccaaactggaaaagagaaagtcaagttatccctctttacagacaatatgatcttatacctagagaaacctaaagactccaccaaaaacttagatctgataaattcactaaagccataggatacacaaaatcacacaaaaattagtagcatttctataaactaataatggactagctaagaaagaaatcaagaaggcaatcttatttaaaataggtaccaaaaatacctgaaaatgaattgaaccaaggaggtgaaagacctctacaaggaaaactacaaaacaatgatgaaagaaattgaagaggccacacacaaatggaaagatatctcatgctcatggatagaaaggactaatactgctaaaatgaccataaaatgaccaatgcaatccctatcaaaataccaatgtcatttttcacaaaaatagtaaaagccatcctaaaattcatgtgaaacccaaaaagaacctgaatagccaaagtaatccttagcaaaaagaacaaagctggaggcatcacactaacttcaaaatgtattataaggttatactaccagcataatattggtataaaagacacatagaccaatggaaaagaatagaaaacccagaaaaaattcacttatttacagccaactgatttttgacaaaggtgccaagaacataaactggggaaaggacactcttcaataaatggtgctgggaaaattggatatccatatggcaaaagaatgaaactgtacccctatttcttactatatacaaaaatcaacttgaagaataaagacttaaatgtaagaccccaaactataaaaccactaaaagaaaacacagaagaaacagtccaggacattggtctaggcaaacattttatggctaagacctcaaaagcacagatagcaaccaaaataaacaaatgagactatattaaactacaaagcttctacacaacaaatcaacagagtaaagagacaacagggaatatgagaaaatattaatatctgcaaactattcatccaaaaagggactaatatccagaatatacaaggaactcaacagtcaaaaaacaaaacaaataatcccattagaaagtagacaaaagacatgagtagacatttctcaaaagatgacatacaaatcgccaacaggtatatggaaaaaatgctcaacatcattaatcaacagggaaatgcaaatcaaaaccacgatgagatatcatcttattccagttagaatagttattaaaaaaataaaaacatgctggaaaggattaggagaaaagtgaacttttatatactgttgatgggaatgtaaattaatgcagccattatggaaaacagtatggagactcctcaaaatattgtttaaaaactatatgatccagaaatgccacttctaggtatacacgcaaaggaaatcaaatcagtacattgaagagatatctgtactcccctgttcactgcagcattattaacaatagccaagatacaaaatcatccaagtgtccatcaatagattaatggataaagaaaatgtagtgcgtgtatatatgtatatgtgaatacagtgtgtatacacagccacacaaaatggaatattccaccttaagaaaatccagtcatttttgacaacatgtatggaactggatgttattatgttaaataagccaggcacagaaaaacaaatatcgcatgttctcactcatgtgggatcaaaaaagttgatgtcatggaggtagacagtagaatgatagataccaaaggctgggaagggtggcagggtttggggagagaaagagaggttggttaaccagtagtaacatacaattagaaggaataagttctaatgttctatagcagagtagggtcactacagttaacaactatgttgtgtatatttcaaaacagctagaagagaggacttaaaatgttcccaacacatagaaatgataaatactggaggtagacatcctaaatacttgatcatcacacagtctatgcatataacaaaatatcacatgtaccctgtatatatgtacaaatattatgtatcaataaaatttttacaaagacttccagaatattagctacatactagcttggtaggactataataatgagtatggcagttttaatgatgaaccaaaaaattgtttgtttttttctgtatattacataatagagtcaacaaggattaggaatggttaatttataaacacgatgctaatttcctgatttttttaatatcctgtaaaacaatgtcttgtttttaaatttcaggcagcaattcgtaaagaattaaatgagtacaaaagtaatgaaatggaggtacatgcatcaagcaagcacttgacaaggtcagatttgtttctgtgaatttcatggtacttatttttgaaacacacaccgccttcccccgtcccccgccacaaaccatgtatccagctatacaaattcagcatttttccagagaactctattgaacaaatagaatgtacctcaagtaagaatgctgcctgctcccattatttcctttaggacttggtgaaaggtgatatgtatggtaacaatatcggtttatttaagtagttaatgcatatttaacaaaaataagcctcaaggcaatgaaagtaatttttctgtgtatttaattcccctctaatattcagaattcctccaatttatagaactcacctgtttatacttacagatttttgtgaaattagtcactccccaccttcacatttactttttcctatcgtaaattattagtcacatctttaacacagccagcgttctcctaaagctgagtatttgtttcctcagtaaatatttgagtaagtgctgagaatgcaatagtgaatatgataaaggaggctcccatcttcatggagtttatgtcccattgggaatatattggctgattctcccataatcaagacttttcccattaagatgaatatattctctgtctatgctatgatatgcaagggatgacactgggcttcttagtgatgacgaagttgggaaaagatttaactctctttacttattgaactgcatattttttcagtatttccccccacttcttttccatggccatgaccggtagtaattatgtgaagttctcaaacatctctgattctaaagcagatgactgtgatgcaacaagccttcaactgtatcagttgctttgtcttctcctttatctgaagatgctcaaggcccacatacaaagagaaaggaaatcctgcatatagatactgccttaaactaaaataatagctttagttttctgtttgttccaaagtggccactgcaattgttatctgaaagatttactctgtaagattaatgtggctatagaacagaaactaagtacaatggaattccaccttaaccaatggttttagggtgaatatatcaaggggaagggaaagttggatgaataggaaaaaattatgcaaagagtttgttttttaaggttccctcccatgactaacatacttttggggaggaataggtcatatggaggaataggtcatatgaatgtttaggaaaaacagtttcagtaaatcatgcacaattacatttaatgttcattctgtcttaaatagaatgaatacatattctatatattgcaatctcaattttgtacattttccgattatacattattaaatgtttagtaaagatgtttattgtcctaagttgatagctttctaaaataatgactctaatacttaaaatgtggtataaagaccctaaaattatttcaacaattcaagagtcagaacggtatttttggttatgagattttaagagttttaaaattactatgaacatattactctacaaaaagtcataactctactataattttcaataatttattaacaaattcatcatttctactgatttagcaaagccctggcctttctgtgtacttcaagggcttttaactcacaggtttaaaactaagttctagatagtcctaagaattcagcatataacaggggcctgagagtggggagccctctgagactctaccctattttaaccagagtagctccatcctcatgttttacatatgggacttctgagaatctttttaatagcagcaaatttatttgtataaggtttttggctattttaactgctagaaatgaataaccttaaattctttgtcttttttataatctctagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 778 - DNA, 243164 bp, Homo sapiens
gcaattgcaagagcaaagattcttccttttcccttttttcctgggggggtggggggtggggtggggggagggagcgcccccagacattccaggacatcaccccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccaggtaacgggctgggcgggggcggcgggcgggtcggggaggcccgaggcaggtggcgctgagagcaggaccccgcgaggctccgcgccccgcctgcattcggggagccgcggcaggaacccgcgctcggccccgcggttcctatccccagtctcgcagggctggggcgcctcggagccctttgtccataaaagagctgatttcctgggtagagccgggcgctgcagcttcccctcctctccggctggtgagctctgccgtcccctcgaaggaggcttcctttcctcgggtgctgaccggctgggggaagagaggcagacccgtggccgcctccgcccagcgccggttctgggccattccctccctccccactgccgggccccagctccggacgtccccgcttgggcatctgctcctggaaggcagcgctccgcagctgaggccaccgcgctgagggcttccaccaggcgcctgactccagcggggcctggcgcacctgggcgcgctagcccccggacaggtgtgctgggcagagccgccggcagggagacgaagggcgtgcgccaggacagagcccggtttcgtgacagcgtgtggactccgtccactcttccacccccatggcagcgttgattgtttaggtgataaaccggtcacaaaggcgtctatagggcttgattgattactttccagagaggaagaaaggcctaataaagcggggggggaggtgggggggggggtgggctgtgtgcgcctgtcaccatggagacgcaggaagcaaagtgatcattaaaacctctctccaccagaaggcaattttcacttcacagggagaagtctgggcttctgaaatgtagggttcaaaaaaagaatcaaagctggtgttttggtatcaagccacaggactcagttttgtatcttagagaagcacaattccttcgtagattctgttttgataacaagttgcttcgcctgcctttgaagacttattctctctaaatgcaacgaccccagatggggacttgatgatgttaaatggtgggcatcagaatccctggggcccgggtgaaggctggctttgtggggagggattcctgcactggaacacaccagagcttcccgataaactgcctagaggactcattacaggcagctgtgtgggcactggatccctcccccccccatttgaaaatttaaacaataaacccgggcaagtattggaagatttctttgttaagactattgacactgtgtcacttggtcaaactaaggtaccggcctgaataaatctctgacttttctttatctgggagggcaggttaatttccttagagtttcaagcagaggctgccatggccgacccttaaggttttaattaatccttttactaggaatgggggattcagccttcagcactccatgatggattgcctttctctgggttggagaggcgcatccacaactgttccaatcatggaagttgagtggcttctcatgagaatccttctaagctccctttgtctccctggcagtaagaggaagcaaacttgaaatggaaattatggaggacttggctttttggctgtatgtgagtttatgcctctgtgggtgggagcggagggttgggcaggtggtgccggtccatgagagaaggaggaggaagggctgggatgcctgtgattaagttatgcgtgggagggcacaggcttgagctctcctctggtgcaactggtctaaatgggacccagagaacaggtgtcagaggtgaaaagtctaaaatatgtgcaattctgtgagcagtagaaccttactaaaaagcaccaagcaattaagtatttatggattgtgtgaagcagattgtgtttctgttctggcagaaagagaatcagaatcatcaagttggagggaacttgggaacttgatggaggaagggcgggctcagggagtattttctgtaagcaccttgcctggctggcctggtgtgtgcctgcatacttcttttgatggtggactcagttcttcctgatgtagtgcatacttgtctttgggcagatctgtttaagaattctttttccaatggttccaaagggtctggtacccatcagtcctgatgggatcttctcctgctgggtgttactcagggctttcagagagcctggggttttaggtattgaaacaacctcagtcacttcttggaaagtctaggcccttcacctgctcttcctagatagcctcccttatttgtccacctgctgctctaatgtgagactcctgaaaattgaacctgaagctccagctgtggaataacctcacacagagttaagaagcagagctgtctcctcccatctaaattctataatttaatgaaagagtccaaggttgcgttcaccctttcccctgcaaaggcatttttaatgcatcagtatttgcaaagactcaaagcattcttcaaaaggtgagctatgttttgacacctctttctcccattttccagaggttacccctgctgggaattgaggggcatcctttggacttttcctaatgttttatatacttgtgttgcttggaaaatggcatatgggaatgtgctggactcatggctcttccatgagtggttctgctccacactgggtctcggagatcttgcctcattgcaatatccatctccctttcccttttaacacccacacaggatgccaagaaacaatttttcagtttagccattggatatttgtattgtttccagtttttacccactacagacaacacagctgtaattacctgggcacaaactgccttgtactcacctgagaatttcctctagggtgggtgtgtgccagctcttgggatgttgaggccacaggggacccacatattttattttaatgatattgcactctcctagaaaatgtacgaattcacactttccgtaatctatgagagtgccctttctccaaacccttgccaacacctgagatcatcaatctatttttctctagcatgaagggtgacaaatggtttcttgttgtgttaatttgcagttccctgattgctagtgagcatgagtgtctttttgtggccttattagttcattaaatctcccatggccgggtctgtggccatggactgtgtggcggggatgaaatatttcccctaggcctgaccttcccgccactttcaccactgcttcgttaatgggcccgtctgtatctacacaatgtgcctctctataaatccgcactctacacccgtgagcatggttaggtgttcttccaaaatagaaatttaatcaaaggtaaggaagcatcccctgatctttcctccttcagaggagctcatggtcacaaggggttttgcttccttttcttccatctgctctcaggctctgggactaggcttctgcccgctccacatcctggggccagcccctggcatcggccccagcacgatggtggcctccttcttgtcgggtcccaggctgcctcctgggccttcctcaacatgatcccatcactgctcctcaccagccatcccctgtcccttggctgtcgctgccttgctctgtcctggctccatgcctctccagctcctttctccaactctctggctctgagctccagacctctgtgttctgcccggtccttccagtccttcagacctgttccccaccccagggaactctgatctcatttctgatttgctcctggcactcttcaacacctggggttcttgtcagtttcattctctgtggactgtcccttctagactgggagcctcttgaggacagggggcttgaccatcacctgaagtgctgcacccctgagctcagcacagagctcagatgcaggagactttcagtaagcatttgtaggacgaatgggcacaagccccaggcgctggtgtctcaacctatgtggcggtgcctggccaggcaactggccactcctgccagctggatggggccagagagtgcttggagggagagcaaagaggagccagcagctgcatccttctgcagggccgggtccaggtctgctttactgcctggagagggagaccctctcagagcatcctctcctgtcatgagctacagacggatgcacagacacattccccaggccctgggctcagggcatcccatgctggccccttcctcttttatgccactctgccagcagacaggtgtgggcttgtgctgatggccacttccttcatcacctgtgcaccctcatcacccacacaccgtcaacaccaggctctgttcttgacacctccctctcccaaggtcacaggtctgccagacacgggcctcctggagcccaccccacttgtttcaggtctcccacccccacccccaccctcacccccaccagggtttagctcctaccttccctttcctggacaacctcaacactgagtcttggttctcttcctcttaccggttttcctgcagaacaggaagtttccaaaatgcaaatgtggtctagtctctcctttgcctcaaaccctctaatgctgcccccttcctgggcgtgggagagggcggaggcaagagcctcttttgtctgtaccatggctctttctagcttccttcctcgaatgttctcttattctggagtcctgggttctgaggatctccctctggctccttgtagagtgtctacatggcttaattagtagtagaactatgcagtaattaccttgtcagcttcttcagggttattaaaaacataaaagctagatgcttaaaaaatactgagtttaagaactcagagcttttttttgattatgaaagcattgcctgttcattatagaaaatggatgctttaaaattccttttcctagctgggcatggtggtcacacctgtaatcccagcagtttgagaggcctaggtgggcagattgcttgagcccaggagtttgagaccagcctaggcaacacagtgaaaccctgtctctataaaaaatacaaaaagttagctggttgtgatggtgtgctcctgtcgtcccagctacttggggggctgagccgggaggatcgcttgagctggggaagcagaggttgcatggagctgacatcatgcctctgcactccaacctgcgtgacagaggtagaccctgtctccaaagaaacaaaattcctgttctctgcccccttctcaccctaacaccacacagaagccaatgacaatggacccctttgtctttaggatctgccaggtacctggcgaagctgtcagcattggaacaacagacatgaggaagtcaggcccaggggcaccgtccagcctcacctgccttcctcatggtcacaggaacctgttttcagtacctcacttggtactcctggagatgatctcatttgtttattagacaaacttgtttatggtctgtccaatacagtagccactaactacatgtggcaatttgaatctgaataaaataaaataaattaagattctgtttcctcagttgtagccacatttcaagtgtgcgggagccccatgcagctgtggctgccatactggatagtgcagatctagaacattccttccttgcagacagctttgttggacggtgctgcttggattgtaagctccctgagggcagggccttgcctgtggtccttttggctgtgtcaccagtgctagcactgtgctaacacttggtagttccccaatgaatgctgacagaatggatgtgccagagtgactggtgtggtcttgagctctcctgcgggaagggaccctcagcctccctagtctcatcatctcatcctctgaaagggagggtacccagcagagataatttcctatccacacagaactcatttatttcaatttagtgagctttcccagagcacctgcaatgcagcacacttggcccttgccagaagggcctctttggacaagagaacaatgagatgcaaagagattctttccctggggctaaataaatgtgtccaagtcctggctcagccatggataagctgtgtgactttgggcaagtcactttacctctctgaatctcagtttcctttaatgtaaaatggtaggcattattgtccttaagttcagaatgagtgaggataactgagctgttgtctttaacaatgagtaaattttgagacacagctttaggaggcagacacctccccaaacattctccaatccccttgaggtaattccatcttctgttaacaaagtcatggtggcagtgaccacagtgatgtatacagcagggagcgggaggaggcgcagcctgcaggtggaccccagcccttctgtgtgcctggctgagctggtcagcctctctgagttctgtgaaatgtgagttagagcaggactgatctggctaggggccaggcaggagtcatgggaccgtgtccctcagtgacgcagaacagcttcaggcaccagggccattctcagcaaatggtggaggaaggaggaggaggaggaggatgtggttcctgctctgattctggattttgggcccctggctctaaaaggctcctcccctacactttcccactctcaccttttgtggaggctgtgtctcccctacccctgcctccctctccggccccaggtccacccagcctcggatgttgttccccggctcccttcctggctccccagcttgtgaatggaaatctcctagggtcccccaccttcacaagttattccctctggtctggtaattttgggatagcacactggttgtcttgaaatgcgatttgaatgtgtattttgcggggattgttttactctgatgagtttgtttcctttgcaagtatatcttcagggaaggtgctttttaggggagggtggctgtctggaatgacacaggtgagccttgttaatgctagtcctgtcgcatggccaaagcgtgccggaggggacggtgcaggtagtgggtgtgtcctgggccctccccagagctttagccagggcagcatatatgggaggatatgaaatgtcacaggaacagaggcaaaaagaaaaagtttgaaaaaaactagtatattagtttgagaccttttcttattgaatttgagagctgggttctattccatgcactagaaaactctttaacacagggcaccaaactgcagcgtctgcagggccgggacttccgctgtgggagggtcagggtgtgtgcctgctggggcggagctgcttcttgccctgtggaaatgtgggcccaggttggtgagaccatcttcatcttttttttttttttttccaggacagtgtctcactctgtcgcccaggctggagtgcagtgacgccatctcggctcactgtgacctctgcctgcctggttcaagcaattcttgcctgctgggttcaagcaattctcctgcctcagcctcccgagtggctgggactacaggtgcgcgccaccatgcccaactaattttttctgcatttagtagagatggggattcactatgctgaccaggctggtcttgaactcttgaccttgtgatccgcccactttggcctcccaaagtgctgggattacaggcgtaagccaccgcgcctggctgaccatcctgttttaagagtgacactgggaatccagatttttatatgacatgttgtgttaggattttgtgttgctataaagaaatacctgagactgggtaatttataaagaaaagaggtttaattggctcatgcttctgagggctgtgcgggaagcgtggtgccagcatctgctcctggtcaggcctcaggaggcttccaattatggcagaaggcaaagggggagccagcacatcacacagtgagagtggaagcaagagagggatgaggaagggaggtgccaggcttttttaaacaaccagatcttttatgaactatcagaacgagaactccctcagcaccaagccattcatgaggaatccgcccccatgattcaaacacctcccacccagccccacctccaacattagggattccatttcaacatgagatttggaggggacaaatattcaaaccctatcggatatgatttttaaatattgacaagtttatctattagggattgggttgactttatgtaatagaaaacctaaataacactggcttaaagaagataaaggttttccttccaccagaagtccagacagcatgatggcgtccctgtcgtagggtgggacgttcagtgaatttcatactgaattctggttgcaacatggttgcttcacctccagcaacaagtacattttctaggcaggacaaagagggtagggagaggcacaggggtgtccacctgccgagtttgacattgccttcttgggagcactgcccagtgacacccacttatacctccttggtcttaggacatcaaaaggctactcccagctgccagggagcctgggaagtgtagctttttctttttgtttgtttgtttgtttgcttaagataggtgtattgctactctaacaagagcaggttccgcggaaggggagggtgagaatgactatcaggtagtgaactacagtctctgccatatcaactttataaaagcacaatgtgatcaaaacaaaacatgtctgggagctgcatgtggcctgtagttgccctttcaaacctcagatagaaagaatctcatgggaagactgaagcagtttttatgttttgtgccattactaagaaattaaaggttggactaagatatgtgatccaagcctaaacattatgtccattcaaattttatttaacaatatccagggaacaagataggcagggtcactgttcctcacagagccaatcatctggtcagcgatcaacggctggagtgaaaatgtgcttattgtcaactcttgttataaaaggagccatcatacttccttttattgaatagtcctctaaacccttgaggtagggccagaaagctagcgaggctgagtaaccggcccatggtcacatttatataaaggggaagcttaaagaggatcttgaatccaagtgagtctgaggcctggcccatccctatctgcaccacccagcttctgcctccctcatcctgcaacttactggaaagcggtcctctgtcctttacatggaatagatatgtgtgtttcacccccattcctggctccagccatctagctgacagacgtatacatacctgtagtcacaaaagcacacagaggcagatgtactctttcatttcccagttcatttaaccagaatggccactgggacaagatttatgtattgaaagtcaggcaaggcgatggcagagaatcagctgtctgtagagttgttgaaggtcccgtctttaatgggctgggactcgtgttcctgtttgttaaagcaagtcggttggatgggtagcttggcaacgcaccttatctaatggtcacgacatctgtagactttgacgttgattagttggcagccacgaaatggatcagccctgcactgagaagacgggagctgtggctatacgacctaagaagtgtgtttattatacatactatgctcctgtttgtaatacaacccttttaaaaagtcaccattggtcttgcaatactcttcctaatgagttgtattgttatggcattactttttggttcaattatctcttgaaagtttgtatccatatatagaaaaaattgttgccttattgtaatcactagctctggagtttcaatgaagtcaggaagatatgccaaaaatgatctttctgcttccctttggcaggaaggcattgtcttaggcagcgttactcctggggtgactctgcgtttcttgagtcacgtgagtcaaatggttgctgactttggcacgtttattggccgggttttttgtgcaaagcttctgagatctgatgacctccacggtgtcaggactgtcttgtcacctgtttttcggggatctgcctggcccctaccccacattctttattttcctgttattctctatatacaaccagagatacaggttttccatcaagagggggcctatagaagtgttctttccaatcaagcttatttacataaaaaagaacatgacttgaaaatagtaataatgtagtggtggtaatacacagaaatatgcgaagaaaccatgaaggtagtgcttggaagacacaggcatgccaaaaaccacaaagctggtgtacaggtttcagtgaaatggggaaatgctgttataaattttcatcttggtcttgtggcccggccatgattacttacctatttgctgacgcattaagcactacagtgtgcatggagcatggtgtgagggtatgcaaaggggcatcgtgcatccgggaagctcatggtctggctaggggcataacattttgacaagtaaaatgacagggcacatatgtaataagtgccaggcctctcaaacttgtccccttctgtgctgtatcccattcattctctgccaggtatcacaggcttctgcaaaagcattctccagacctccgtggccctacagcattgagctttcagtccttgggtttctgaaggttggcagggtcgaaggtccaggctggctcttctccgtgcatctcttatccttcttggacctgcagtctaaaccagccatgttagtcttgtgtagtggtgaagatacatgggacctcttagggcctaggctggaaaccttcacttatgctgattctgttagcctattggccaacttcaggtcaaagagagggaaatacacttgacccctttggttgggggagcaggaaagtcatatgtagatacaggagaggtggagaattggggccagtcttgtaatccacacattaggcttatttccctatgtagtctgtgggctcctggagtcagaatcaccttggaatctcctgccacctctgataaggtgatgccttgacattggatgccaacagacaaggtctgtggggtgcttgcagatgtgtggtctctggtgtcagactgcctgggttcactgtgtggctttggaagatctacctaacatctctgatccacagttttcccatctgcagaatgaggattactttacttatattaatacccccttagacgagcagttatgatgctgagatgagatgaattctgtaaagcgtttagcacagttcctgggacacaggaagatcctggtcaccatgagctagcattcgcctcctcctatcactgtggagaagttttcaccaaaggccatgtcttggtggataagagcaggaggttctgatctggtgcagttttgaggctcccagatgcccttgtcttcctttgggcctcaagatgcaggagggagggctttcctggtctgagctgctgggtgaaatcaggcatccctctagaacttcctcccttcaccctgtactgccctggagctggttcaggagactgctggcatgcaccgggaagctccgctcaaggcgttgccccctgatttcctagtgggggagctggcttgaggcagtcagaatactgagttgggtaaaagacccagggtcagaggctgagtctcattccagctgggacgtgaggctgtggctgcgctgagctgaccaccagcccctgggttccttagggttgcctctgggctcaggaaggaaactgcatgtagacactgagctaagggagcactagctgtttgctttggttagttctttcccctaatccttgcaagtagctggttctgctttgatgtgaaataacaaaagatttagggagaatttataatttagctcatttttttttaatgggaagggtgagttttggagcacatttaataccatgccatgtggggtaagctcagagcgttgcctgcactctcattcacctgggctggctttccccgctcgcttccccgttgggagtctaatacagcctgccttttccttaagatcattacttcaaacagtgttgacattttaatgtgattattttcctgtaatatttttccagcccttttctacttggggagtatatttgcatcctttttctttagggatttgtgttgttccagctccatcctggtctgtagaatagagctatgctcatagtaggtgcatggtaaatattgattgactcttgggtacgtgatagtgacgtctagcacccctcctcatacctattcccatgttcccataaaaaaattaaaatcgagggagaaaaacccaaaaaaaacaacaataaacaaagagttccatgatggcttcaggttaaatagtctcaccctgttggaaattcctggagcaaatgagcaagccagtgggcaggagcccgagtgtgagttctcaggaatatacatcactgaaagtgagcccacacatttgttaatgattggtctctgtgtggtgttaaaaaattaactaataacaatttattccagaggatattagtgtagagcagctattttcttataggaaaagagggattccagtcatttttttttttctgttttgttgaactgatgtttgcatcttgcctggtgaaatctttagcaaggaggaggtggaagttgttcactttagcacccaggggctcagctaacatttcgtggggctgacattctgggtgcctgtgctaggtgtggaaggagaattaagcggcttctgtccacaattgagagtctgagtagaaaaaagaggcatagctcacggcacgtgtcatttctcccttcgtccctccttccatccctccctctgtccttcttctttctccttcccttccagcaaatttagtgcctatgataatgtcaggggtgaggctgggcttggggaatagcgcagcaaaccgacctgttgcctcatcctcgtggtagatcgtctggtgagtgatgggcttggatcacatcagctcataggcgaatgccccatccagctgtggggaggctgccctggagccctgcgggcttgtggaggggttggcatatctggggatctgagggaagggtccaggggagggcacttgagttagagccaaaaggtggcttcgaattaactagcccagcaggaaagggaaaggtatgctaggccgagagattggcagtgcaaaggccaggtggtgggggcagcttcggctggagccagaggcaagagagaagcaggagtatggcgggatggggctgcaggggagctgggagccagacggttggggcctcctggactggggaggagcttgtctgccatgagggaaccatgggatgtctgaagagagggatgtgagtgtgtgtgtgcgtgagtgtgtgtgacagagaccaagagacagtgtgatcgggcacatttccaagccgtcactctggctggccaccccgggtggaaatgggtcccaggaaggcagcagagtgagaccagggaagagggtgtggcagccacagatggtggggcctgggctggggtttgcagagctcattcagaaaaggggctgggactacattgcccggaggaagatctgtgcaggagaggaggctcaatctcagcttggaagggaagggcaggagagggaagggaagggtatgtgccatgaggcacctacgtggtgtctgggcaccccatggtgcagccaaaggctcctcccaggatcctcatgcaggagccctgaaggctgtgcaagaggtgctgtctcaccctgagcagggccgagagcctgagaggtgctgtctcaccctgagcagggccgagagcctgagaggtgctgtctcaccctgagcagggccgagagcctgagaggtgctgtctcaccctgagcagggctgagagcctggaactgtttagagagagtctggggcagtgcaggatactcggagagattgcctggggtgccctaggatggactgtgttttcttctttatacatgagaagctggaaaatgggagttggacgtggattccgtgggcaaaggttcttttcctggcacagtggagcagggatgctggcaggggtggatgctcactacctcctgtgtgcttttcctactgtgagcaaatgtggaagggagaattgctatatgaagaccctccatgacccatatcctgtatagccccctcccctgagtgtggcaggaaccagtgactgtgacaggtttcgcctgcatgcctaggctatcttatatgcacaggagactttaagaaagtataagccttggtggccctgccctaatcagggaagccctaaaggggacaaaattcttcctggagattgagactggaagcacaggatggaagcgggggatgctggtttgaagatggaggggactatgtggaagggaatgtgagtgacctctaggagctgagagtggcccctgctgatggtcaacagagagatagggatcttagtgccatagctgcagggatctgactcttgctaacaccctgagtgagcacggaagtagagtttccccttgagggaagatgagaaggcaccccactgctacactgatttcagcctttcggaccccgagcagatgagaaggcacctgggctgacacaccgatttcagcctttgagaccccaagcagaggacccagtcctgccatgtcctgacttctgacttacggaactaggagctaataagtgggtgttatttgaagccagtaagcttatggttttgtgttatgcagcaatagaaaactaatacggggagggaagtttattgcttccatattacaggggaaagcctcaggttcagagaggtgaagggatcgtcctggtcacctggctaccctggcggagctgagaagcaaagctgtgtggccagactctgatgctcctgctgtgtgctgcctcggtttcctgatctgcgaaatgggctggtcatggcattgtcctgaggccgcaggaggagtggcctggaggctgtgccagctgtgaaagtgtcagggcccttgtgactgttttcaccctccctgttggcacacaggacctggaggggtgcccctccgaggccctccctggcttctcacactcaccctaaacccggtgtgtttccatggttactggtggctttactagtgtgactctcaagctggccccatagccactcctttttatgtgtatttctaatttcctttagagcatttttaaacttttcgctttgaaatattttagacatctaaaaatgtcacaaaatagtaaaaaaataactcctgcgtacctttcacctatattccccaaataacatcccacttaactacagtaagtcatcaaaaagaagaaattagctttggtacaatacaattaactcatctaccaaccttatctgaattgagtccatttttctgctaacatgcttttctatcctgtgatccacccaggatcccacgtggcacgcggccagcatgtctccttagcgtccgccaatgtggaacagttccttagtgtcttcatagcctgatgcctttgaagagtgctttcagttattttgtagactgtccctaaatgaggggttgtctgatgtttccttctttttaaatcgagtatatgcgtttttggcacaaatcccccataagcgatgtcgctggagatccctaggtcagttggaccaatcctggtgatgttgactgtggttgctcagccaggtgcctctgctctaaagttaacactttcttcctctttgtaattcgtcagcgttttgtgggaaaccttgagactgtcagacatcgtttctcatcacaccctttcccaccctgggaatcctcgcctgccagttgtcaccatggtgcgtgttcaggggtggctgtctttccgtcatttctcttaaatgtattagtgagttccattactcactaataagggaaagcttcccccacgctcccatgtatttattcacctgtttacttacactagtgtggacgcctgcatgtatgtttatcctgtggagtagagtccactgctgtcatcttcttgttgctggaactgtcccagacgtggccactgggagctccttcgagtcggtgtctgtgccagtggagtgctcccatcattgtctgagctctttcttgctttctggcagcataagacgctccaggcccccagggcctcgcctctgctgaggtgcttgctgtgcaggatttgggaaggtgctctcaggggctgtgggctcccatgcctgcttccgcctcatccttgcagacccctgtgcaggtaggttatttgtaggtgagcaccccagtgcacatagactgatgtagccgggttccccagggagcaggtggcagagttggggcttgcccagactcctgctcttgccctgtggaaggacctatgagtcggaccccacacagggattaggtggggccatgctgggcagcccatgtcagcctggcacatcttggggactgtccacagtgtcagggctgggagcatggtcttggcacatgtaacatgccccgtttctctctttcttctggggttcaggcatatttctggtccatgataagatctttgcctccttcctgtctttcttgccctcgtggatggcccagaatcctttgtagatttcccacagtggcctttcccaggcaggcactggctggcagtggcagtctagacttcctgcctgcctcagtggccttccctgaaggagctgtacaaaagtgacagggagcacaggccactggcccctggggaggtgtggggcatggtgagccacgtccaccacatactgtgtgccaagctggaaaagagtttgggggtgcagaggacaaaggaagggaggtcacctctacagaatcacatggcacttaatttgtctttcctcttccctacccactcccctcctttcttcccagagacaagaggcagctcctgggagaaggcacagcctctgagactcacaagcagatcttttaaggtcaactttgccatctgtcttttaggcaataaccttcactacagctttttctgcttatttttgtcgaaagtcattgggagaatgagtcattgcgtgtgtatgcctgtgtgtttgtgcatatatatatgtgtgtgtatgtgcatgtacaagtatgtgtttgtgtgtgcaggtgtgcacgtgtgggtacttcccctgatttttttttttttgtgacataacttcccctcatttttttgaaaggctgaaagggactcagggtcaaggccatggtgcatccctcctgcagggagctggagctgggtgcctggaagctggcctttgggtcaggcttcagcctcagccgtactgactgtgcctggccaacctctgtcagtcccttcatcaggccatgctttaaggtcctcctctataaactgggggcaatgctagttcctactcctggggtgggtatgagttccagatgaggcacgtgacctttgcaggattttaacattacagtgacataactgtaatttacctactggtaaatgctctgttcatgtcagttagtagaatagaaagtgctggccctgctgacacagcagccatctcctggtttgcgatggacactatctcaggaggaggctgccgtgtgcctgctgcgaggggtgctccctgtttgctagggaggcccagagactgccccggcacctcgctgcacacagagaggccgtgtgtgtctcttgacccttcagctccacactgggaatgagggagaccaggggttagagatgcctcgggacctgagccgggcaccagctcccatctgtccatctgtcctgggctgctgggggagccggctctggccaggactgatgattcctggcacccaccaggagatgcacatcctgcttgaaagctgtgaactgctatccagagtgtctgggcttatcctgttggagcaaaacccctgggctaatatgtaatcccattgtgaaatgtatttcaaggagggcttctacaaggattctaattttacagcagctttaaccaaaaaaaaaaaaaaaaaaaacccaaatcttcagcaaacactcagaaccatggttcctgtatgatgtatagctttcaaaaacactcccccaccccttggaaatataggcagggaagggaaaataaatgtttttttgtgggaggcaggagcattattgaaaaaaactcaacaggctttttaaaactggaaaagtagaacgcgcgcatgttgaaaaattccagggcggctggagacaggatggggtggggcaggtatgtcggctccgcatggatcaggcttggtccagcccgtgttatgaccttccagctgtctgcttctcctctttggcctcagtttcctcatctataaaatgggaactatagtattgtacgcaccatgcagctgttgtgggggttaaatgatatgatctgtcacattcctgttacatgtatgtattcaacaaacatcgactgtctttttcattagtgaaaaccaggtctctctggctgtgcacccgtctctcgtcccacgacagctgctgatggctttcttgtgtacgctctcaggaaatttctatgcattcttttcttcttcgtttgtttgtaatatgaagggaaacacgctagcccctgttctgtgcctggcttttccctcttaaaactgcatctgtgggatgtagatatgaagtttgaaggatacgtgggaatggaccagatgaaggtggggtggggatggtgaccactgtccctggcagaggaacagcggatgtggtggccatgtggtgggaggggcaccgtgtgagcatgggctgaacggctggtgcgtggggatggggaggtggcttgggcctgccacgcgggacagggaagaccaggttgagggtttttgtctgtatcctatggagtgatggagacctgctgacacttatggagcagagggtgacccactgatctgggactcggaaaggtcaccccacttctgctttggtgcccatgggcgttgtgtagagaaggtgtcctgttttggtttcccaagagaggaaatggacctgctggcaggagaagtgggggagagtggttgggagctgctggtgtgtcgcctctcgatttggagggtggggacataagagtgggaaatggctggggcagtgtctctagagggtggctttcttcgatgtgagcctggaagttggtgaaaattgcccctcttttggtgctctcatgggtgtttggatattttgatccccaggtcatctttcaagccaagtacagcatgcaccaacccctccgtggctgcatcctacagcccctgatccactggtggactgctccacacctgctccctgttggggtctctgtcctcctgggtgatcttctagagcaggagtctcaagctttagggtatatgagactcgccgggggtcttgtctatgcagcatgctgggtcccttcccagagctcctgacttgacgcatctgccatgaagccagtatgaacatgcatttttagcaagatctcaggtgccgctgatgctgctgatctgaggacaccctgctctggagactagaaacatctctggcctggtctccctcccatgctgctcctgtgtagcctgcaggagacacctcctggcagccgggtgtgcaggctggtccagcgcagccacctcagtccctaccggagtggtctctggcaactcgggtaccattctctgggcctacccaaggaacatattacaggggctggagctgacctgctggagccccctaactcagtctgatggaaagaagacttaaaaaaaaacttgtgatgttaatttaaattttacagaaaaattgtgaagctagtacaaagactttatgtaaacctgcaccctggttccctttcactcttatagtagatttgtatcactaatgaaccactcttgaaacattattattaactcaagttcatactttattccaacatccttagtatttttctaatgccctttttccatcccaggatgccatccagatcccgcatgacatctggacatcatgtaccttcaggctgtcttgctgtgacgccttttctgactttgcttgttcttagtgaccttagcagttttgaggagcacctgtagggtgttctgtagaatgtccttcaatccagaacttctttttaaattcctcttctgcttgcggggcatcttgagtcatggaaatagattctcatttgttttctttgtaaattctgcctagagccagggtctgcagagatctctctggaatctgatagctagaggcctcagttgaccctgaggcaggccccattcctgttagagaaggtgcgtggaactggtgtggttgggaggagtggttgagaatggtctctgtgggcacggggtttgcccggcaggcagctgcccagtacggctgcctgtgtggctgatgtcatgttctcatcccatctgatgcactctccgcaagtcactttcagaaactggaagatcccacttaattctgctctggaatatatttagaaatctattcatggccctctcccaaagctgatgttaaaattaagagatatcatttgtaggatgtcatggctgtgcaggaggaacatgctgatgtctccctggccgcctttggtttcttctcttgcttagggatttgcccaactcccattgcccatctgagcccagctttccccctctgagcccagttttcctcctctcaccccaatgtcagagtgggcacatcctccctgcggaggcatgcaggcttttcctctgcatgcaccgtctctgtcttgcgtgacagcccggggctgtttctcacccttgttacgctggggttcttggctgagagctcctgggcaggggctgactttgagatgaggcttctctgttcgtttctggctggttctagatctgggtggcatttggagggtgcaccgcttgtatctgtgaccgaatacctcagggtttgtggtgagggacgtggagatttctgtgctgcaagagatcttagtgcttctattgtgctggggagaggccagcccatcttggggtaccagggctggaccaaactttagagggggtctgacccaggtgttcagagccagaaatattatttgcaatcctctgcagggaatttaaaaatgaaaccattctgaactctccctccagaattcatggtcgtcagccattcaacaaatatttactggacacctgttttaagcctgtcaccgttttttgagtatgcatatagctatatatggcaggttgcagtgacgactcatgtctctgccttcatggaatgagtagtctcgtgggatgaggggaaacagacagcatagaaatagatgtatgatgggactctaggtggttatagatgcctggagtgatgataaagtgaggctggaggaatgagactggcagggaggagagcccaactgtctgtgatagatggtcagagaggacctcagagcagggcatctgtgcagagaccaggcaaagtgagggagctggtcatgtgactaccctcgagaagagcactagggcagcaggaacagcaggtgcaatggccctgcagcaggcatgtgcttgggtgtggtaggaacaaggagaccagtgaggctgagtgagtgatggaaaggggcaagtttttgatgcccacaatgccaagaggtggccaggggaggatcccagggaggtgccgaggcctgggggaagacttgggctttattttcagagctgcccgttgaagatttgaatggctgcagagtgagatgagattgtgctggaggattcgaaggtcatttagtcagagatgctggtggtttggagcaggttgttcacagcagatgttctttgtgcctgcatcacaattccttggaccagctctgccttggtcttcagctgtggcttcaatcaaccagcatgttgggtgatgagcgctgtattggagcaggtggctacactttcaggaatgctgcaagctggctgcagtgggaagtatttacaccatggcaattggcaaatgtacatatcagctcccttataccacccaaacactttccagcacagcacagccatgagcccagtgctgtggatattctcccaagcatcaaagtgcagccaggacatgaggggagctaatgtctgaaggacaatcctcagctgacgaaatgggagtaaacatcccaggcatgcatcctttaggtgggtgcttcttggagctttcagagaatgcaaccttgctgcctacagctgtgaccctggaaatgcacgtgtgtgggtttgcccttcctccctccctcactctcattgctcccttgcttctgcttcctgagatacctcccaaataagctaccttcacctaagcccgcctgcagctctgcttttaggagaatccaattaagatggtggtagagctagatgtggtgtgagagggatcagatggctgggatgagacagaagagtcctggatgactccaagcgttccagcctgagcagctggaaggatggagaggttctggcggcaatggggaggaaccattgagatgagcaggatgggggttgggcaaatcaatgctctgttcagctgtggacaggttctgtttgagagacctatcagatccccaggtggaaattgtacctggagttagggagaggtgtgtggttggatagagatatctgggactggacaacactgattaggtcaggtgcccacctgcatctgtgattcagttgtgccctcctgcttaggaagcgtctgtgtatctatgtatgtatctatcatccatctatttatcatttatctctcttttttatttatctctcaatatatctatcatctataaatatatgtatattctagcatctagtcatcaatcatttatctatttttatttatgtatcaatatatctataatctatttttcaatatatctataatctgtcatccatctgctaatcgatcatctaccattatctatcaatctgtgtatctatcgtctctctctctgtccatccatccatccatctatccaggcagtgcttgcttccttctgccccctccttagcccatccctgcccaggaaaattctcgtccctgctcaaatgccttcagtgacaggaaactcaccaacctcttaaggcttcggcatggaagtttccaactcatgtggccactccagaatgctgtcctccagggactgtgtttctctctcatgtcctcctcccaagatttatttacactcctcacttgccaggagagagtacttgggagctccgagccatgcgtgttccctggcagggtcgcctgtgtgctggggaagaatgggcccagtcatggggtggagacgccccccagctgcagccctggctcccgagcagaggcggctttgtgcttctcggggacaagggttgccattgaggcaggccagggatgctgtgcaagctagcgatggctgcaggctgaaatcgggcatttcacagagagcaagcactgcactgtccccgcagcctgcacgtgaatggaggctttggccctcggagtgcagccgtgcatggggccacgtgcaggcatttctggctcctggctcccagggagagaggcgagccctgttctctccccgagttctgtttgacaaaattcacaaaaacacaaagaaacaaaaagtacgggagaggatcagttcattctcctgactcctggttggtctcaagacctcccctgttgcctgtgctctggaagattccccatagtacctactaggtgggccagagaaggatggatttgtgggaccctggaaggctgggaagaggactgagaagccacagccctgcgctgggaagagccacggaggttagatcttgttttttgtttgtttttaatacaattgttcacactttctaaacttttttgaaataattttagactcacgtgggggttgcagagcttccctcaatgacagcatccacctttccatggttcactggttggcaccaggaggtggacattggtacagtgaggttaactaaaccaactaaaccagaggccttagcgaattccaccaggttttgcaagcacttttgctgttttttcagtgaataattgaatgaaattttatcacacctatagcttcacgacaaccaggtgagacttgacttttaaataatgaggcgccaggccccttggctcctgaagtggcatgggcgacgtgtgtggatgctgactggatgcccacctgcttccttttctctacgttgtgcccccaccatgctccagtggcaggggcagcctcctcctggcccccaggcctctgcttctctggtgcctgtggaggctcaagcctttaccccacctcccttcttcccaggaaggccctggctgcctgagaaggcccagccttccccttctccctccgctgttctggctgagctcatctcctgtggctgccctagcatgtgctgcagactgggggattccacagcagaaacctactctctcgcagtgctggaggctggaggtctgagatcaaggtgccagcagggcgggttccttctgagggctgtgagggcaggacccgtcccaggactctctctgtggctgtgagtggccgccttctccctggttctcttcacatgatcatcctgcccttccagggtatgagctccatgcctgtccccagaagatctggaggcttccatcttctgctccttatcagacaatggagcggaataaacacggttgcctctctggaattggagcttagtgctcatgaaataaaattctcttaatctcacaattgtcctcaatacagttgcagtgggtggcaccgaatgagtgtcgtgcttgtcaagacagccactgtggccttccgtcttcccactgactgatggcaagtcactagaaggaagcacccaactccccgtgatggcattaaatgacacccgtgggtgtggctgtagaccaggggttctaggcagccaagggggttccatgcagccaaaggaaagaagaaactttcctgcagaatgcatgaatatagggccaggtcctaaagcccagcccacgggcaagtgtgtcctggtggttgccactttccagtcaactgattagtgtcaatcatgacactgatttcctggcaatgtgtgagatgattttaggtggtaaatgaactattaattttataaagaacgttcatatcaggtatatgtctgtttaatttttcttttttcttttttttgagatggagtctcactctgtcccccaggctggagtgcagtggtatggtcttggctcactgcaacctctgcctcccaggttcaagtgattctcctgcctcagcctcccgagtagctgggattacaggtgcccaccaccacacctggctaatttttatatttttagtagagacagggtttcaccctgttggctaggctggtcttaaactcctaacctcaggtgatccgcccgcctaggcctcccaaagtgctgggattacaggcttgagccaccgttcccagcctgtttaatttttcattagaaaaatattgcatttccattaaagtagacgtcaagttttcattttaaactttcttaagaaaacattatattcattttagaccaagtggttctattagagcaacatccataagagtggtgacgtgtgagtgaagttggggagacaccgggtggtgcagttacccagcaccatctagaggaagtaccactggggtgggcggttacctggcaccatctagaggaagtgccactgggtgggggtcccttcacagaggcagggtccagtcccggccaccctcaaggagcttgtactgtcgaagtggggagggggacatgagaaatgttgactcaggggcagagggttcttaggcttatcaaggaagctctaggattctcggtgttctaggggattcgaggaggaaagttacacctgatgggtagacaggggtggttggagggatttggtaaaacgttcatgaagaaggggtgggtctgtggggtttctggagttgaagtgaccaccaccagggatgctggcatgtggagctagcttcatggctgttagctgtcattgtggaatggaagttaaagtgtgcgttgagcagggctgaaagaggcatagacctcccatactgggagagaagccatgctcagggaagaatgcccagaggctaaaagtcagggtcagatgcccatcttaggggcccttggttgccataattatcaaggcaaggtccttggataaagtctggtccggtgcctctgaaacttctatgtgcatacatgtcactgggagtctggttaaaatgtggattctgacgcttgggtagggcctgaaactctgcatttttaatgagctcctgggggatgctgctcctcagatgccccgctcttctgtcccctagcccccagcaacagcaaacacttagtgcctgcctttctgcagggacaggggagggaggtttgtttgcagtgacagtttttgggtagctatggagggaggagagaggtaggactttgtcttggtccagtttacaggggccttgacagaggcaggaggggtgggcaggagttgccaacttttatattttggtcaactagggatgtttaaaaacaacaatgaagaaaaacccgaacatccttggtttcacaacagtataataataacactattaacaccagtatttcccaaaagaaatggaatttcaaatccaaagagtcaggaaggccatatactccaacagaagacagtcttttcaaggacacagagccagcccccaaaacacctcactgcattgtcctcatttttcaaaggacttgggaaacatcaccccaggctggcatggatgactgggctgaggcttgggggctgcggctgtatgaacgggaatgcctgtggtcctcagagctgaggtctgtgttcccagaagcccctgtagagtggcatctggccccggcctgtggtagcctctgtcctttcccaggagagaggttgccagggcctgagcaaacactgacctggagtgtccctgcttctgaacctgcctccctatcgtcctcaccttgtggtgtacgggacgtgtggggactgtatcatctgggctgtggctggcggcctctcgtctaatgctaccacatgcccttcataggccatgatgagccatggcagtgctgactgtgttctaccactgctccaggttcctgagatgctcacatcctgggatgtgctggggttgagcaccaaagctaggggaggtcctagtagcccactcctgttcctcagtccccttgcgtctggctgggaaaaggtgcacctcctccgtctctgtccacgtggaattgaccatcatcctgcacagtctctgcccctggtaattggttctcagatgggctcatgactcaggcttcacgaatgagaatctgttctaggacttcagttgaagcgcttggaaagagttgttttccctccacaagaagtcacagagctggtcggctgtgggcttggagtgctggtggccattttccccaacccagctggagcctgagaatggaactagcccaaaggaaagctgagcaaagacaattttgaaggttgatttcccgatggcattatttgcatccctggatccagcgtgtgtgaagctggcgcacccccgggcttctcagttaaacacttcctccctttcaggcttcagcagctttgattgggcttctgccatttctgattattacagggacttagaggaaggaaatggctttgcccagatcacagggctcatgaaagtgcccaggctggaatgcaaatgcccacctacttcccctcacatcactctccctcacctgctttaagtgcatgcccagtcccagggagatcttcccatcactctttggggattctgcctcactgaaagctcttgaagctgcttcaaagtggagtatcatggtgtttcccgggagggtggttgccgggtgctgagaaagactggcctgcagtgctcttgcttttgcacttccgtcccccaccttgatcctggggtgcacgggggcaggaaggagaggagtgtgggagttgatggggagatgagaggagacatctacccatggcctctgcttctgggaggacctgtcacactcccagtgacacagcgtgtgctagagattaggcttttctcgtgaaagtagggttttgaaatataaatcattctataaagacatatgcatacgtgtgtttattgcagcactattaacaatagcaaagacatggaaacaacccaaatgcccatcaatgatagattggataaagaaaacgtggtacatatacaccatggaatactatgcagccataaaaaggaatgagatcatgtcctttgtggggacacggatgaaggtggaagccatcatcctcagcaaactaacacaggaacagaaaaccaaataccacatgctctcacttataagtgggagttgaacattgagaacacatggtcacagagaggggaacaacccacaccagggcctgttgagtggtgggggtgaggggagggatcttagaggacaggtcaataggtgcagcaagccaccatggcacatgtatacctatgtaacaaacctgcacgttctgcatatgtatcccgcttttcttttgtttttgtttttagaagaaataaaagaaaatagaagctcacttgcctggatactttaatattgcctgggtttttgtgttgtggagggctctgtaagtcatggaaaaggtattctcaggagctgctaatgacatatttaattttaataatgagtcacccatgcccacaatttattacctcctgtggctctggactctggttctttgagtggtataatagggcggaggttaatggataacacaattaattatttaggaggttcttacaaagccaaagactttgtaacagattaactaataggttcctaacttcattatcattttgatttttccaaagaatattttctcccaaaccactcaactgtataacattactgggaaatgtctaatttttacacgattcctctgctcagtttaaatactaatgttctgcttactccgtcactgttcagcgcccagctttcggtcttcaccttattgcctgggagatagatataatggattcagatgttatgagccctggaagggtttgtaacataaggcagtattttaatgctttaggggctggaaatatttaaggcaatattttaattctcatgagggacgaagtgttgtggttgcaagtgcagcctctgaaatcaggcggagctgggtgtgaatcccagcctctgcacttaggttggttacatcacctctccaactccgttccctccttcataaaatgggcacactagtagtattaacctggttgcattgcagtgaagattcaatgagaaaatgcaggtaaaacacttaatgtggtgtccagcacagagtaacaggttaggagtgttggccgtgaacggtggtgatggtcatctaatcacagcatggaatgaggaggagcaagccctcaccctggcctgctgctcctttgttgatgaaatgcctgtggttgttttcacaccgcagcaacagaattgagcattttcccagaaaaatttcccggtctaaactgtttactctctggcccttcatagaaaaagaatcgctgctccctgccctcaaggcagcctcctgtgcttttatcttctcgggtctcctttcagaggcctcattataggtgagcgccatccagcagaacgtcctgtgatgatggaaatggtctaggtctgcgccatgccgcccgggattgcgccgctggccgcagatggttgctgaacactcgaaatgtggctcatgcaacctcagaatggaatttttaaattttacttagctgtaattgatttaaatttaaatagccacctgtggctaatggcaaccacatcgggcagtgcagtgacaccacaccggctcagagtagagaaccagtcacctccattctagcatcctttctgagagtgccgggtggagggtgctggctttggctgaaataaaggaaagggagaaggctgctccttgcattttctttttctgttcttttttctttctttctttctctctctttctttctttctttctttctttctttctttctttctttctttctttttctttctttctttctttcctttctttctttctttctttctttctctttctttctttccttccttccttccttctttctttctttctttttttttttttttgagatagagttttgctcttgttgcccaggctggagtgcaatggcgcaatctcggctcactgcaacctccacctcccaggtacaagcaattcttttgtctcagcatcccaatagttgggattacgggcgtgcaccaccacactcggctaatttttttgtatttattagagacggggtttcaccatgttagtcaggctggtcgtgaactcctgacctcaggtgatccatctgcctcagcctcccaaagtgctgggattacaggcatgtgccatcgtgcccggcctgctccttgctttttattatgtttttgctgattcaaagcatctgtaaatataaaaattgaacttactcttttgtgtgaactatttggtaaacattcacaagcatgaagaaggaagttaagatgtcttaatcccatgctgtagagataaaggattttgggcagtacatttgctgtcactttcaaatatttgtatggcgcgtaagaggggagtcataatgtctgcatggggtgtgcccccacttttctgctgggacagggactacacaaagcttcatattatcctgattaatggctgcagggtgctcggtgtgcagtggcctctctgggcaggtctccgggctgcacacagttggggactgttttaagctgctcagtgatgagtgtccttgctgtgaagtatttctgtgtttttcatgtttgtccagagtggccacgaggtcctcctaagagactttgatcaatgtatgtttctacagaaaatgttagaagctgctgctccttcacattagctaatgctggatcttgcccatctttcttccttgtgccaatctgctggcgaaaaattgcttgtctatattttcatcacttttatgtatttatttttttaaaaaagacatgttcccagaagtcactgcttggaaatatctctggtcatttctcttgcttcttttagtttctgggtgaggccagtggttataagccagttcctgagtctttggacagtttaatgggggcatggatcaggtcgcagatagcagactttgatagcactttgattcaatgagggcctactatgagctttgcaggttttatctcattcaatattcataaccacctgaggagctgggtgctatttatccccattttacaggtgaagaaactgagaactctctcaagtcctggtggatgagggacatagtctggatttgaacagagcatgtggccacctgagctcacactcctggtcagcacaccatgggaggcatggggaggggaaggggtgtgggagatggccaggaagacctggtctggatcggggctctgcttactggctgtgaggctctggacaaagttatgtgacctctcagagcctaaatttccccagctctcaaatggatatcaggatatttaccttgaggttgttgtaaatagaaatggagatgtgtatgaaggccctggcataattcctatacttcactgatgcttgataaatgatggctgttttctgtactattagcaatgattattaatacagtgatgaaaaatacagagcaaagatgataaacagaaagtgtctagaagatagttgctacctgagagttagctattgtttattctgttaatgtgttacagtgtaggtatttctacattcagtaacatcataagcaaagaagactttgcttgccaagggccctattgaaagccctcgatgggtacaggctgttatctcaccaacacagactctgatccaaggtgaccaggagaattttagaatgatctaggcaaggaaattgccgtgcttccaaagcaacctgctcctcaggctccctgtggggctgtctgccccagcttgccacacctctgcaggtttgtggctttgtttcctgtatggggtctgaaggtgagcagtacctttgtttcctgtatggggtctgttctgtgttcagaagcaggactcagggctgctggagctggagctggagcctctgagtcctcagggttctccacagctctcctgaccagctctgctagagcgatgtctctggcagatgccttttccctgttgccctgtggtctggcctttctgctgtaggttaaagaaatcacagtgtgggcaggtggcctagtctgtaagtgtgtcctctagtgacctttgttttacctctagccatgcttgctgtttgtcctttcttgggattacatagttggccaggccaaaacatcttagctcacatgaaatccaagttcacagctggtaaaaatgccacagattaaatgctccatagaaattcatgtctataatggatgcatttctcctgggaattcactccttaaataggatgaccttgtcattgactcctgtccctaccctcaaccctaacgtgaacaaatatgaaatgatccttaaccaaccaacatgctagaataaagacacaaagcattaaaaaaaaaaaaaaaaccaacaaacaatgaggagggaggagtaattcttttggcaaaacttgattccctattgtggttgatgtggctgcattctttttgctcgttgagaagttgctagaagacagggtcagtggtggttctatgagggtggctaccatttttcttgagggactgcttttatctgccaagcacatagttctttacatactttatcttcctgaagcctcatgagagctctaagagattcccattattattatccccattttgagcatgaggaaactaaagctcagggaagtatgggaatagaaaactacatggccagggtctgaatccaggctgttttgctgctggccccaaggtcttagccccagtgcatactattaaatgctgcctgagttccttgacacctgcaccactacccctccttccaccaaccaggtggggttcactggtataagctgtcttagcatgttgaaagtgctcttgtagtacttagaaacactgtcatttaactgctatttaggttcttagtagttgtagctatgttagatggatgggccaagccatagccttgtgaggacagggacagtatccagtttgttatccatcccttatctatgccttatacacagtagagtctccataagtgctgggtggatggatgggtgggttggtggtggatggatggatggatggatgggcaggtgggtgggtggatgaatggatgatggatgatggctaagtagatatatgagtggataggtagatgggtggatggatggatggatggatggatagattgattggtagatgggtggatggattgatggatgattgctaggtagatatatgagtggataggtgggtgggtgggtgcgtgagtggatggatggatggagattgatagatggataggtggatggattggagaatgggtggatgggtgggtgaatggattgacggatgatggctaggtagatataccagtggataggtgggtggagggatgggtgggtggatggatggatggataaatggggatggatagatggatggatggatgggtagatgcacggatggataaatggagatggatagatggatggatggacgaatggatgggtagatggatggatgggttgatgatggctaggtagatatatgagtggataggtgggtgggtgggtgagtggatgggtggatggatggagattgatagatggataggaggatggattggagaatgggtggatgggtgggtgaatggattgatggatgacggctaggtagacataccagtggataggtgggtgggtggatgggtggggtggatggacagatggataaatggagatggatagatggatggatggatggatggatggatggatggatggatgggtagacggatgtatgggttgatgatggctaggtagatatatgagtgggtaggtgggtgggtgggtctgtggatggatggatgagtgggtagaaatccaggcagctggaaggacagtggtggaaggacaggtatttggaaggacagtcatttgaagaggaaacaaagacatagtatttgaggggggaattatctgcacagcccccaatttgctgacattagctcctggagaaaggagcacctgcaggatgagcatttcccacctgtctgttcttttctcttggccaagaggacctcacagcaatgctctggttacagtcaggggaaggctgtactgaccacacaaagttccaagaggggacaagcatggtgtgacctccagccaacttgactctctcatcttctccccacgttcctaccttggacctcttctgggctggccgattgaaagagaatattcataaagctgactttgaggagtgttttgggaggcaggcacaaagattattggtattgagtcccagttctataacttactagctgtgtggctttgggcaagttaatccctctctctgagcttcagttcccatcctgatgccaaccttgggtactgctgagggaggaggggagaagggggatggatgcacatgaatggaaggcagtagcagttgttaattccccttatctgactttccattttactaccttcatttcttttctcttagactcttggaagagatgtactgtgctgggatataaatttttgaaacctgttctctttcctcttccatgttctccgtgataatgcaggaaaaaaactcgcaaacctggccatgatgcccctaggccgacagaggctttcctagttccaattctggcattgtaagagagagctctatggaatagcaaaaaacaggcacacttcatcctgtgcatgctggggttgaggctgtgaggtgtgcaacaggacagtagagcatagcagatgggttgatgagctgtgatctggattcagacctacttgtctcagaccctgggtcagcccgtcagcagctgagcaatattgggaaagattcttaaccttggatggttggtaggatcaagtacagtcagtgtagaaatgcttagctcaccacatggactcaggacatgtcaactctccctgctttggctataattactatcctactgtcaaggaactttctctctagttgggctaggtcatgtgcgcagaagggttggaggacaaggtgttgaagaaagatttctccaaagatcctggttggatgtgagctggatagagcaaggctggagagtgcagatgcccctggggccaggcggtcttcaaccagtcttggtgagaaatagtagctcgactcagctttggggtgcagagacactggggaggggcggggactgtagcaacctaaagtgctcctgccctgcctgcagaggatgatctgcacagccctgctcattatgatgacatgggcatgtgcgtgactgtcagctctttggttttcaagagaatttggaagtctaggtttccatgcatcaaaccagtagtagagaaggcaaccatggggagaacctaagtcttgtttctagagagatcatagggttgtaaattttaccttgcatctcagagaagggcagtgctattttagattagggaggttgcaaaggtgatgaactccaagaacactgacaaataccattatcattgcaaaagaatcttaaatgtgtctttgaaaagcaagcatttggcttctaagttgtaaaaatggaccaaaaatgaagcagtagagtagggactcataaccaagtttatgccattattgttacaggtttcttttactgtgtttctctctatatatatgcacatctatataaatatagatacatagatatatggggagaagatatagatagagataatgtatgcatatatatacatattatatttgtctgggttctccagaggaacaccatcaataggatatagagatttatctattgcctatctattcatctatttatctatctaccaatccatccatccatccacctctgttcatctatccatccattatcgtatctatcatctatccattcatccatccatgtatgtatgcatgtatgtatgtctctctctctctatcattttcatccattcatccattgtctgtctatctgtctatctagatgtattagaaggaattggcctatgtgttgtggagtctaaaaagtcccagcagtcagcaagctgaagacctgagagagccaatggtgtagttctagtgcgagtttgaaggcctgagaaacaggagagctaatggtgtaaatttcagtctgagtctgcagaagactgatgattcagctcgaagacagatagagagaattctttcttattccgtcttcctgctctattcagtccctcaatggattggatgaggcccactcatgctagggaaggccatctgctttacccagcctattgattcaaatgtcagtctcatccagaaactccctcatgggcacccaaaataatgtttcaccaaatgtgtgggcaccctcaggcccagtcaagttgacacattaaaggaaccatcccatgcatatctatagattgtgtgtgtatgtacatttgtgtatatataatatataattatcctgttaaggatgtctcacagccttgaggcagagattaattgtgacctggtggtttccaatgtttctgtatatacaaataaattatgcagcaatgataccctagtctcattttattaattgctcttctattagtctgtttaaagtcaattaaacctcccaaggcccctcacggaggaacctctcacaaaatcagtctctgtcacttaggaatcctgagtggatgtcacatggctgtcctagctcctggggagggtgcagacaacatctctgttggaactcctgggtctgtgggtgatcattggcttgcattttgtagtggcatggcccgtggaggtccggatgtagagaaggcagcctttctgcagagcgttagaatttgggaagaagtggtcaggattagagaggaaaaaaaagacttagacatggacaaggatgccaccccagcttacccttcctctagtttcctggacttttgcagggttcggtggataattagttatttgcttgcttggttggtatctgttcacttttatttcttttagactttttttttttctgattagaacaaaaattatatttattattgaaaattcagaatacataggagattatcaagaacatcaaaagcattcacaaatccccccacccccaccccagagataacccctgtggctacttttgtgtgtgttcctccagtacttttcctatagaaacatttttcccgtgtcgggattgttcagcctatatcctttattaaattaatacatcagaagcttttctccacactgcttaggacacttgggaccaaatgctccagaataggaatttgccaccatttattttcccattctgctttcattggaaactgagtctggcttgaggcttttgtttgcttctttcttgctatagtaattgggatggacttaaggctgcctgcctttttgtgtacatctctgattatttctttaggctaaattcctagaagctggaacccggggcagaaggaatgaagattggaaacccttggtgcatgacagcaacttgctgtcctgccaacattggggcgtttgcctacagaaagagctctctggttgaatcaaagaattttaagaatttaattcttcttcttgttttttgtttgtttgtttgtttgtttttgagacagagtctcactctgtcgcccaggctggagtgcagtggcacgatcttggctcactgcaagcaccacctcccaggttcacaccattctcctgcctcagcttcctgagtagctgggactacaggtgcccgccaccatgcccagctaattttttgtatttttagtagagacggggtttcaccatgttagccaggatggtctcgatctcatgaccttgtgatccgcccgcctcggcctcccaaagtgctgggattacaggcgtgagccactgcgccggcctaattcttcttttaaaagttggggatcagagtaaggtgagaaggtatcctgcacagcatcaatgcacacagcgcacattaaatgagtgctattccacttcatttgtagtattttttttcccatttgtaggaactacttttgtgcctgacttccttgttcctttaaatgagccttaaggaagtagtgttgggggaattcaacacacacagagcagttggtctttattatgattttaagcatcttgttttcatgtgagcaccccaactttgccttttgctaaattttgcaacaagttttgagtaattctgcacaaaacagtgcccttgctccaggaggagaacagacatttgctcgttcttcacaggataattagactctaaaattagaagtcaaacactgcatgttaaaatgcatctggataaaatcccagtgggagaattaatccttcttggcagtgcaggggaacttgggtgcacgcctgatggagcggcgagaagctgagagggagtgaggcagcccctctgtgtggagtgttcagggcaaatgcacgggtgctggtgacgcagtccctttacttgtctaaaagtattggattctaagtgaaaaggggggtggggatagaaggccttctgcctcgcctcctgtagtcacagtttggatatcctgtgaaagtagcacttaggcaggcattcggtcctgcttggcgttgtttggtggacttgttagagaacactactgactgtgtttgaggaaggaggtggagcagagggctcagggcttaagcggcatctcctcaagggcagcaagagacctggaacgttccagagtaacccctgcctgcatccgtcggacttgccaatacacactgagaaactgctaaaggttatggatgcaatggaggcttctggtatagtggggaggaaaagcctccattatgaagtcaaaggccattgcgtgcctgcagtgtgcgacaagagctagtggttgcagcaccctgatgggcagaagcttccctcacagagctatggtgatggagaaggcagctgcaaatcaagtcattaccagcaaggttataaaattatttgattgcatttcgaagtgaaaaacagttttgaattaacttctatttgttgtgatataaacaacagatataaaaagatataaaaggaaataaacagtgaccatgacattggttgttcagtttcaacactatcttcgggttccctggtccttgtcctccctcattcgcctcccccaccactgaattgtagactccaacagggggcgggagctgagtttgtttttgctcccagctgggactccagggtctagcactggcctggtgcttagcagcctgtagcaagtatgtgttgaatgggcaaatgtatcctttggcggtacgagacagaagctggtggtcctgtgctgcctgtggccagagcacttccagcatacggggccaggacacatttgccctggtgtcccaggttgctccaggcacaggctgcacctcctgggggctctccctgcaccagcctggtggttctctgtcgcttctcctgcaccctgcgccttccctttgtgtcacatccctacctcatcgctactcatttgttggccagtgttttttttagaggatctctttttataaaatttcagtttttattttaggttctggaggtacatgtgcaggtttgttaccagggcacatcgcctgatgctgaggctggggcttctgttcattctgtcacccagatagtaaacatagggcctgacagcacgtttttcagcccttgtccccctccttcgctccctccctttctctttcggagtcccctgtgtctgttgttctgtatgtttgtgtgtactcaagatttagctcccactcatgagtgagaataggcagtatttggttttctatttctgcgttaattcactcaggatagtggcctccagctgcatccatgttgctgcaaaggatatgattttgttcttttttatgttagcagatctttttttttttttttttttttacccactctctgattctccatgcatcatgagtcccccaaaggcagggctgggttaacctccctgggcccagagaacaggtgctcagtatttttagaatgaacaaaagttctcttgtggaatcatgagggaggtggagggaggaaggaaggagggaagacctctgccctggctctttctcctgcctgaaacagcctccctcagatcccagcctgtggcgcctttctcgtcacgtgtgtgtccgccccacactgccctccctggcctcggaggctaaagcgctggcccctgccagcctggacctctcctcgtcctgcttgatttgattctgagcgtgctcatcaccatctggacatatgttattcacgcacaattaaatgttgcttatattgcatataaaacataaatttatataatgatatacatgtacatatgtgtgtgtggcgtgtgtgtgtgtgcatatccctgtcgacaccaccagaatatgttttaatgaaaccgtcatgttttaatgaaaacagaaagccttctgtttcatgtcgtgacgctggaatgaaaacagtctctcccagcatctagctcagtgcctggcacatcatgaaagcttaataaatacggctagaattaatgaatgagtttctttcccctcccctgtcctgtatttttaataaggctgttgagcctggggcctctgccctctgctggtcactatcatcacacagcctcactcaggaggcccctggccccgttctgcctggagtgttggcaggtggcaagggttgtaagctcctgcccagtcccgtgggcagttctaggatcttacccccagcccctgcgattctgaggggacgtgtcagtcattcagcctccagccagtccctggggatgtctgagggaggaagtaaggctcaagtcccctgaagtgggcagctcctgtcatccacagctgctgcttgttagtgggagccctggggccctgggtaaatgtcctgccagagctgggctcactctggcctcctttgtatacctgggggcaaggtttagctattcagcaagggctgttttaaaaaattgggttggttctggatattataatacctttttataaaagaccacgaagaaaactacattttcttggtgacttttacaataggagcaagttaaattttctttcttcactgagttgtcattgttgccttttttttaaaatcagtttttccctgtcaaaagaaagtaccttaccatgtgatctactgaaatataggagttacactgaacgaagtgaaaatgaagcttgtttgtcagtccttcctgctgactttctcaatctgggcccagtgtaccctgggaggcacagccagagcccagggagtgaatccgattgttcagtagatgcagttccccagttcaggccctgcaactaccagtccaggcctggaggggagcatgcatcccccaggaacatgactcggagctggaatctgactaggcataggagttaattgggcctgaggcagggagggtgctgggaagaacattctagggagagcagacagcatgtatgcatgcacacatgttctgtggcagaagactgtgtgagtgtttggggaggtatgagtgactctgaaagggtttttcccagtggagcacaaagatgcccgtgttgtgggaggaagcccaaggtgggaccaggcagggctcattaaagggatttttgtctttaaatgaagagcaccaggaaagcctctgaggattttaaacatggtggttgcagtcgggcagatcagcttggcaaagatttgatgactagggtattagtctgttctcatgctgctaatacagacatatctaggactgggtaatttataaaggaaagaagtttaatggactccacagttccacatggctggggaggcctcacaatcatggcggaaggcaaaggagaagcaaaggcatgtcttacatggcagcaggcaagagagagcttgtgcagggaaactcccatttataaaaccatccaatatcgtgagacttactaccatgaaaacagtaggggggaaccacccacatgattcaattatctccatctggccccacccttgacatgtggagattattacaattcaaggtgagatttgggtggggacacagccaaaccatatcaactagcatggagaggccagtgtggagtttagggtaccaggtggaaggccccctgaggttggggagggtggtgcagggcagcaggtggcagccaggcccttggaggtccattggcaggactgagcagcagggtgttggagtgacatgcaggtgggggtacagtcctcttcattcttattcacatcttttctgttgatccctttccatctctttccccactagtttcctgtgttcttttgatccacaagctccacatttcctgaaagaaatgaatgccattattatcacatacagccacacacacaccctgtacaaactcatctcccacaacgcccaactccctaacatggttgcctaaatcagaattaagctccctggattcaggtcccagtcccacccttaatgtgcttgtgaatctcaatgaggtgcttggcctttcttggctgggtttcctcatctgtgaaatgggggattttgcactgttttatttttctactttttgccagccttgcaactttccataggactttgcttcatctagactgttggtgtaggaaaacatccttttggttaatggatagatgttataggctaggtgccttccctccaggaggttcctcatcttattagtgaagattctgtagttgcatatggctttagttgctgttgagaaacctacccagactggcttcaccatcaaaggtatttattgactgacaccgttttgtgattagtccagggggagtttggcttcaggcccattgaccacagggtctaattatactgttcaccattgcttctcgtccctctcactgcctggttctctgctggcctgctgtgaggccacatttccttctcctctgttcccccaggctccagccattttgaggaaggaggtgagtttctctttcctattagtgaagaataccaaagctgtaggaatcatatcttactggcctggaggtggtcagcttctttaaaatcacatggcctgattgggcaaggggtaggtcccttgagggaaatcaaggtgctgaaccagaaaaggtggtgatggcaattgggtaggaaaaaataagtccatctcagagtctttaaaaaacatctttaaaatctcctcgtgatttcttaatcagcaagagggtggcttaatctgtttatcccagaggccagggatggagggtcagggaggggttgaccttctggggctgatgatagcatttgtttttcttcccagtccaggcttacgctgaccttggtacttaaggcagggcctgtcctttcctctgctcagcaacatccatcactgccatgtccttttggcactaattaaagaggacacacttggattaggaaaatgatggattgggttgatgtgatttgatgtgaggtggagtgaataagtgacaagctcgcccttagagaaaccacctcggagtagccacaggcagcctgtgtcccccataggagggactgggacagcttggcaaccacctaccccagaacacctgctaggaggagagagtcctgttgttccggcttgggaatgtctgtgtttacatgatgaggctgggaatataggcatcgaagcatcagtttcctttgctccatctagatcagcgttgttgatggatgagtatggtaaagagttggatgattttcccccagagtttccatgctggacaattgtttatttacttgagctaattactgaaatttttttccatgacttggcctaatataaaaaaagacactaatgagagtgaggttttatggtaagcaaattgaaaagcaaatagcaaataactcatctatgaaatagttataagaaaagttattatggtaatggttagggcaaaacaactctatttaattcttgatgcttatggagattccagccaagatatgtgtattttccttaaaaagatttctttaaagcatgtgtcttaatttaatcctgttatacacaggcacatctattaatgaagtaaattcaacaaagagttaattataaatagcagcaacatgttttctttctttaaatattgtatatatttcatgttgtaactcgggggataaattatactaggtggattttgtggtaatataaaggacggttggaattttattgagtatttacttttatttggttttgaagaagagcttctccatacctcagactatcaaaaatcattctgttagagtcacagaaattccaattaagagcttagatgccaatacagactgattattttgaagacttttttcagttcatgactcagttaatattcagtggtgtattttctgtagtttaaaagtatcactgataagttgggagtatgccttccatatgagatacaaattgtccctaaccactcaatcaatgtttactttacatgttaaaaataagaaactaagacctcataatgtggttttaaaggttcctgttttttgccctgaaggtccaaaggtaaatttggcacatttgtcaaaatatagatgaataatttatagatgtgcatccattttatttttataagtatggaaatagatataaagggatttgctggaagaatttcttttggcaaatgagcaaaaaatttaactataaagaatgaaatactaggctctagatataaaataatattcacaatgcaatacaaaatgtgcaggcatttttggtcatattttctatgacaggtttcttagaaatctgtgtttctactatgaaacacatgaaacaaagaaatatttatacatcagcagaactataaattcaaaaattcagagaaaattccaaatgggtgtgatgttgatacttgcatttttctctaaaattaataaggtatgtgtgtatatatctgcatatacctatgattcatgtaaagggttgcagatacaaagattctaagttcataggtataagaataaatatatgaagctgtatcctgtcttttgcattatattgattgttctcgttggggggagggcgttaattttaaaaagtcaagtgaaagtaaattttcccatcaaaggaaggcactattgctttcaaacatcatcatattcaatacaaattaaaacaatgaactactgtatctacccatcagactagcaaaaatcaaagcatataacaatggcaagtgttgccaaaggatggagacctgctgatgttagtgtaaatgggtgtgaccgctttggagagcaatatgacctatcccgttgagctggggacactatgactcagcaatgcttctccaggccttttccctggagaaaatcacatttgtaagtggcaagagaattatccaggaatgttttccaatgcgttgatagcaaaaaaaaaaaaaaaaaaaaagtctcaggggttgggggtggtgggacagaccgttgatagtggaatgagaaatcgtaaacaagaaggatctacccagaagttgccctagttgttacctctgcagtgtggcagggttgggggctatgatagggcttctgaggtgactgtggaggcttacatttgatctataatgttttgtttttttcttgtgtcttttaacaaaaagaaaacctgatttaagcaagatgtcaagatgttaatctttgttaattctggctgttgaatgcatgaatgttgtgtgtgtgtgtgttgaaactgttaaaaaaaaatcatctttgggttgaccatggtggtgtacacctgtaatcccagcactttaggaggccaaggtgggagaatcatttgaatcaggagttcgaggctgcagtgagctatgattgcaccactgcccttcagcctgggtgagagtgagactttgtctaaagtaaaaaatgtaaatgaataaatacatcctcccattacattacattttctaaagtagcgtaacttttcatgtcagaaactagaataaattaagtcactgaatcatgtagtaaattatgaactattgcctctatagttggttgccaaaatggcctgccagtgtctattaatcaatataaaatataaaaatagaacatttaaaaattaaagcatcatgttatattgccattaccagctagccatatgaaccttatggaaggaaatctggctatatttagcaaaattacataaatagtccccctttggaccagtaatcccacttctaggaatctatcccaaaatatcttggcaaatggtaaaatagcacacaggcaatggtatttgttttgccattattcattatagcaaagtgttggaaacaatgcacatatcacgaagagtggactggctggataaataatggcatagccagacaaaggggtatcggaagacaataaaagaaatgagcgtgttctctctactcacatggaagtcatctccaggatatatcatagtattcattagtcagagttttccagagaaacccaaccaacaggatctttttggtaggtaggtaggtaggtaggtaggtaggtaggtaggtaggtaggtaggtagatagacggatagatatggagatacatacagatataaaaggagatttattatgaggaattgactcaagtgattatgaaggctgagaagttctacaatctgctgtctgcaagatggagctccaggaaagctgatggtgtaattctagtctgagtctgaaggcctgagaaccaggggaactggtaatgtaacttccagtctaagggcaggagaaggtccctatgctagctcaagcaggcagacaggaaggaaaaaaggctgacttcctcctttatctacctttttgttctattcaggcctctatcaggtcggatgttgctcactcacatgagggaaggcatgtgctttactgagttcaccaattcaaatgctagtctctgatagatgtggtggctcacacctgtaatcccagcactttggggtgggggcacctagcagggaggatcacttgaggccaggagttccagactagcctgggaaacataacaagaccccatctctgaaaaacaaaagtaaaaaattagctgggcatggtggcacacacttgtctgtagtgccagctactcaggaggctgaggcaggaggatccattgagccctaaagttcaaggctgtagtgaggtatgattgcactttgtgccactgcactccagcctgggcaacagagtgagaccttatctcttaaaataaaaaatgctaatctcatcaaaattagcattaatctactctataatttccattagattcttttaaataattagataatttctgtctctttattgacattatctgtcatcataccttctctttcctctttaagagtgtacattttttcatcgagattagcattttttaagatctggaaatacccttgtagacacgtccacaatccataatatcatttaatctggaaacctgtggccagattgacacataaaattaacatcacaatcattgagtgaaaaaaaaatcgggatatttttatagaatactgcctttcatgtaaaaaagagatgtgttcacgtgtgcattttcatgtgtgtgtgtacttagattgtttaaaataaatgctgggagtaaaaagcgagcactaacggttgcctatagtggaggaagtaacagaggggagggcagaaatagaagtgagacttctatgagtgtactttgttatatgattctgaattttaaagtgtgtaaatatttttacatattcaaaaaattaaaagggaaaatattcttataattgaagacagatggaaataattgaacctaactatatatcaagttggtagcttaacccgagaaagtaattttttttttttttttgagatggagtcttgctctggcacccaggctggagtgcagtggcaccatctctgctcactgcaaccttcgcctcccgggttcaagcgattttcctgtctcagccttctaagtagctgggattagaggtgcttgccaccatgcctggttaatttttgtaattttaatagagacggggtttcactatgttggtcaggctggtctcgaactcctgatcctgtgatccacctgccttggcctcccaaaagtgctaggattacaggcgtgagccactgcactcggctgtgagaaagtaatttctttaagtaacactaaaacccagtattttaactgtatatccatagtggggtggaatttaaggatgctagcatatgtaaataaaaagaatcatatatttcatgattagtgttattattagctgtaatatggatgttattattttgaaattataggactaacttggagaaagcaattaagcaatatgttaatgttgttatgaatcaagattcttattatgaaagaaaagagataaggtataatattttttaaagttatctgaaatcctaaaatcttacatttaaattagaaatattaatattcatgatattctttgctcttaaaatatctatttcataactctgtctactgaaaaagcctaaaagcagtgaaaaccctatagcaacgaacgctttctacacccagattttgtgtactaaataccattccccactaaaacgaagcagagttccttggagaagtgactgcttcctggtctaggatactttattatgccagaaagcaaataagctatcaaaggttaatgagatgattgcaaaagaattgaatgattttctgctggctaagaggaattgcttaatacatttccaacaggataatgactagaattgattgaaacacatcagaattataaaaatctgtgccttcagatggtacttcaaaaaataattggtcaccgttgtatattgctagaacaccagctctctattctgaaagttgctaaaaaaggaataagaaacaagcttttattctgccttcctgttttatttatatttcagggtaaccaaatagctgatgattgaacgtcttctttatagaaaaattttaattaataaatgcaaaaggaaagaatgagaaaattaccatttgacaacccaaatgaaataacaggtgtaggcaattattatcaataggtgttaacagcattaggtaactatcaatggggaattttataatggataaatcaggctgatataacctgaatgtactgatctcattttacctctctaaaggtaggacaaccagaagttatatgcctcctaatatgtaattggaaatataaaccactgcctctaaaggattctttcctaaaaaattaagcctgaatgtgaccaagcttttaaattttactaccagttttcaggaaatatggaggctaaaggaacgtgttaacaaattgaccagcttctcaaataaaatatggaaaagtcacatcactccagaaattttcccagtttactcttcgagccaattcctccttagctcacagagacaattactttccatagatctgtcaccatagattatcacataagtgcagtcatacagttggcatttgtgtgtgtgtgtctggattccttcactgaacataatattttagaaattcattcagtgtgtgtatgtgtgtgtgtgtatgtgttggtttctttgttttattgagtacttcattgcatgaatatcccataatttgtccagtctctcgttgcatatttgtgttttttccattttctggctgatgtaaataaagcttctgtgaggattcttgtacaagtccttttgcggatctatgtttttattttaattgtgtaaattataaaagtgaaattgctggaacatagggtaggtttatgtttaaaaagaacttccaaatagttctaagtggcatgagttctagttgcttcacacctttttcaaaagtgagtgttatctttcatttaattttcccagtcaggctgatatgaaatggtatctcattatggtttttaaatttttttatatatagctttattgagatacaattcacatactatacacttcacacttttgaaatgtaaactttaattgttttaaatatctttccagagttgtgcaactatcatcacaattggtagtctttggctttctaggagtttgtccatttcatctgagttactaatttattggcatgcagttatttatagtattcccttataatttatttctgtgatattggtagtgttggccccttttacactcttgattttagtaatttgagtcttctctctctcttctttatcagtctagctaaagatttataagtttattgatccttcaaagaaccaactctttattttattgattttctctgttgtttttctattctctatttcattaatttctgccctagcctttaattccttccttctgaatgttccaggcttagtttgttcttctttttctactcttttcgagtggaggatttggcttttattttgagatttttcttttaaatataggaatttagagctataggcttctatttaagcatttctgtgactctgtttcataaattttgcttcattgtttcttcattttcattcatctcaaagtactttctaatctcactcatgatttattctttgactcattggttatttagggccatattgtttaatttccatatgtttgtgaatcccctaagtttctttctgttattgctttctaatttcattccattgtggtcagaaattatactttttatgatttcaattattttgaatttattgtggtttgttttatggcccagcctatgatctgtcctggagaatgtcccatgtgcatttgagaatgtgtattctgctgtttctgggtaaagtgttctatagatgtctgtcatatggtatatagttcatttatactgttgttcatcttttcttttttctccttaatcttctgcccacttattctattcatgagtgaaagtgggatattgaagtctccgatttttattattgagttattttccctttaactctatcaatatttgcttcatatattttgggggtcttatattaggtacatatatatttatcatttttatgcctccctgatggattgactctttcatcactgtttcaccatcatctctctatatctatatctctagttttagagtagctttatctgatattggaatagccactctagcttttgtatgattgctgtttgcatgctatatctttttccattctttacttcaaactgtttgtatctttgaatctaaagtgttttctcttgtagctagcatatagtagtatcagatttttattcagtctgacagtctttacttttgttggattgtctaatccattcacatttattgttataatggatatagttagatttgcatctaccattttatttttcattttctatatctctcatgccttttttgttcctctatttttcctttactgctttatttggccttaaatgagtatttttagtgtaacattttaatttctttaatcattttttaaaaatttattttcttagtggttgctgtggggattaccatatacatcttaacttatcagaattcttcagattcatactaacttaatttcagttagatatagaaacattactcctgaatagcatgattttttcttctacctcatttttgcgctataattttatacatattacatctatatgctacaaactttacaatacattgttacaattaattattactttatatgaatttatgtctttcaaggaagctgagaaaataaagagcaagtgctcatttacagagtctgttatcttaaccttttaatttaccatttccggttctcttcatttgttcttgtggattcaagttactgtcttgtgtcattttcttactccaattcatctttgctcccatatacttcctttgcgttattgtcaaacattttacatttctgtatgttataggcacaatgatagaagtgtgttgtgtgtgtgtgtgtgtgtgtgtgtgtttgtgtgttattttatgcaattgtttattaaatcagtgaacagaataaagcagaggaaatatgcattcaggctgtctttcataattacatcattacctttactggagctccttgttttgtgtgtgtgtaaatttgaattactgtttggtgtcacttgatttcagcctcaaaactttcctagcttttcttatatggcagatcttttagcaatacattatcctattttatttatctatgaatgtcttgaattcactttcatttttgaaagatacttttgctgggcataacattcttggttaacagttgttttattttctccttcagcactttgaatatatttcatcccactgccttttggactccattacttctgatagaagtctgctgttaatcctattgaggcatccttgcagtgactagtcagttttctcttgctattttcatgatttttctctttgttgtttctcaacattttgatttttatgtgcttgggtgcaggtctctttgcatttatactatttagaatttgttgagtacctgggatgtatagattagggttttttcgcactaaatttggtaggctttagccattatttctttgaaaaaaatttctgcttctttttcactcttctcttattctggtactcccattatacatatgttggtccacttaatggtgtctacaatttactaagcctatgttcattttacttcattctttccctctgctcttcagattgaataatctctgactgtcttcaagttcaatgattcttttttctaccaattcaacaaagccactgttgatcccctctagtgaattttgaactttaattattataattttctactgtataatttacattagattattttaaataatttctatctctttattgacattatctatttgccaacataccttctctttcctctttaacagtgtacatatttataatattttggacatatttataatagttactttgaaatctttctaagtctgacacctgggccctttcataggcagcttcttttgaatgcttttttttaaatgtatttgttgcactttcctgtgtttttatacatactagatttttttcaaagctggacgttttagtagataatatattttagcaactctggatacttgttttcttttcctctgagcttgccattgttgtttgtttatgtgttttgtgacaggaataggctattttagtgtttatttctacccacagtgtggagcctttggtgttacttttctgacgctgcagccttgggagtgtgcacagtcaccttgagatgatagtagttttagcatgtgtctctttgacttctctcttctgcctccttccttaatctccctgttaatctgtctgcctctgttggtatcataccaagctattaggctccactaactgccaaattattgctccattatttttgacaatgtccagggcgcatgcattcctctacaacctgatccagttaaatttgaacccctttgcaaaggtattttttgaggtcagtctttgaggtttgaccaagagggctcttcttagctgtcttgctctgatcctctctgataaactatctggcctacaatttagcttgttgccatcatggagctgtcagccttctatacctgttttcatgcttacttgtcttttttttttttttttctctgcctattctgtcattaagaccatctaatgaatgttttaaatgataatatatttttcattatagcatttccatttggatatctattgcagtttccatgtggttcattttaaaaatctcttcatacatgtttacctttcacacactatttttaaaaactgctatcacgattatttcaaagttgtgtgataatttcaatagctgggctatttatgaatcttcttctattgtctgtttcctctttttgatcacaaatcaaatgttcttgcttcttcaggcatcatagtttatactacatgtcaggcattctgtgtcaaataacagcacattctttttctttccacttatcagagttggaacactgagtcagtcgtacctgtagatcagctgggtctgggactttttttttttttttttttttttgagacagtctcgctctgtcaccaggctggagtccagttgtgcaatctcagctgactgcaacctctgcctcctggattcaagtgattctcctgcctcagcctcccaagtagctgggactacaggcacgcaccaccatgcccagctactttttgtatttttagtagagacagggtttcaccatattggctaggatgatctggatctcttgacctcatgatttgcctgcctcagcctcccaaagtgctgggattacaggtgtgagccaccgcaactggccgggtctggagctttttgtagctttagtttcattccatgtattaccagcttcgagtgcttagagggaagggtcaggatttttcccttaccatagcttaggctctgagcactgagtggtttctttgtactttatatctgcagtactagctttctgaaccttggagtgctttgaccatgccacagcccggccagcagatgcaggggtcacagagagctacgtttgttttctagtcccactggagtgctccctctgccctgctactcagactttgtagggcatctgtcctgccctcagtaaagacttgcaatgccctggagaggtttctcccagctgtcttccctgcccccagccttcaataattgaatgtccggagttcccaggatagatttctcttgagtttcctccttagccccccactttcagaggacactgccttttacttaggtgaggccccacatatctctggggttcttgcaggtttcttgctttacctccaggaagacctgtacaaaacagtatccagtggttaaaaactcactctgggctgggcgcagtggctcacgcctgtaatcccagcactttgggaggctgaggtgggcagatcacgaggtcagaagatcgagatcatcctggctaacatggtgaaaccccgtctctactaaaaatacaaaaaattagccgggcatggtggcggatgcctgtagtcccagctactctggaggctgaggcaggagaatggcgtgaatccgggaggcggagcttgcagtgagccgagattgcgccactgcactccagcctgggggacagcgagactccgtctcaaaaaacaaacaaacaaacaaaaaactcactctgtggcttgggcttcttcacattctaatctgtcatctggccaccagaatttcattaaagtatcagcaagtttctccttcctccaatctatggcaattccctgttattgcactactgtcaggggtgaaagcagtcagctggcaaatgccttaaatagtgttttctatcacttcatctccataatctggatttcatacaaaagttagtcatatataaacactgagtatctacagcaagaacatcattctcttggagagccagaaagtgagttgttttatgaaacatttctaatttagtcaattttccaaaaatagggaaattatacaatagtcattgcctttgcctatgaaaagtagaaagaagggaaatcaggagaccattgcttcatctgtgggaaacactttctatttgtccttacatatattctttgtttttccataattctgagggataaggaagagaatgtggcagcctgaatgtctgtttgactgtatctcttcacactgtgattctcattttcctaatgtctgtttcagaattttaaagtgggcagtggattatgccagtttctagatcctcctattaccttccagggaaaggaaaattggattcgattctaggggcatgattagcagaagggcacgcccgggtaccgtgactttgttctgaattaaggaagtttgagtaagagaaagcactttttcctgctggactgggctgcttgttgatggctgtgccgttaggagtgtggagcaggatggtgtttcagacagaggtcctgagcaggagagagcaggatgtatggaccaacgacaggcccatgagtctggaaggtggggaaggggggagcatgcacgttgctaatggagagagcacgtctcagaggctgcatcctggcggctttgtggtcatttgttataacagccctaggagactcacatactctccttcaccctctcacagccattccctgtgagaaccagacagagtggctgagttcatcctgatactcaatggacaatggacaggaccccctttttaggacttggttcttcagccccatggcacaatgtgtaccagcaaatgggtttggccaggtcctcttaaacaagcttcaaaattgtccaacttggacttccacagggcttctttctgtggccagagatgccaatacatgtgattttctgcatgcatgtggtcttggctccttggactccaggttggccacgcagcgacagacctgcctctcggtgggagttctcaggaagtcaaatcagatggaaacctgatctgtgtgcacgactggcttcggcagttaggtggtgtgaaaaatgaaatttctactggcttctcttgtccacagggtgaccgctagtggcagggctgcttgctgcggctcctaatctccttgtgggatgccttgggttggatcagtttctcttggcccctgtgaaaggaactcgcggtggaatattgtattcggtgctgcacaggagaccccatttagagacaggaaacttgtgcttgaagggcactctttgtgcagctacagacgattcattcattccttcatttattctgtcaccccaaatctgtctgcatctactgtgttccaggcaccgcacagggcactaggattctggtggtgaacaagaggccggtctcaccctcaaaggcatgtagtcttgagagacacagacactagacaaggaatgacacatgggtgtatgtgaagatgcttaggatatggtgggggcatttagcagggagatttgacccagcttggggtggggtgggggacacagaggcggattctatgaggaagcagcctttaccctgagacctgcagtgggggagcattccctagatgaggaatgagaggtggagaggaatgtggagcaggatggtgtttcagacaggggtcctgagcaggagagagcaggatgtatggaccaacgaaaggcccatgagtctggaaggtggggaagggggaagcatgcacgttgctaatggagacagcacgtctcagaggctgcatcctggtggctttgtagctttgtgaagaaagtgggattttatccttaaaacgaaagggaagaagttggagctgttaagtagggagtgacatgatttgattgcttttttaagagagccctctggaggaaaaggggctggagggggcagggggtacagggcacggtggccgtttctgcaatcgctgaggcaggaggtgctgggggccagtcctgggctggaaatggggagtgggtgagggaactggactaacccagagtgttgcatgaggtgacattcatgccacatggtgacggacttcacagggagggtgaaggagagtatgtgagtctcctagggctgctataacaaatgaccacaaactggggggctttaaaccatggagatgtgttccctcgcagttcacggctctgcaggccagaggtctgaagtcaaggcatcagtagggctgaaacctgcccttgaaagtttctggggcaggatgcccctgggcctctctagcgtctgggggctgcaagccctgcttggctgcagccgtgtcaccgcagcctctgggcgccttcacgtggcctttactgtgcatgtctctgcacatcctctcctcctcttagaatgacacagtcattgggtttaggacccaccataggctagcatggtctcattttaacgaatgacatctgcaaaaatcctacttctaggcaaggttctgggtagacatgaatcttggcaggggaactattcaacctgctacagagagggaggcggatttgctaaggatggctccggctggctgtagcaactgggtggagacgtggaggacagaccgacgccagcagaaggacatcagggccactgaaccagaaacacacatggacgtgtgagtaagtgaggtgaccagacctagtgaggcccccagttcttttcaggttttttgtttgtttttaacaaatgagactgaaaatgtttcggttcactcttacttagtgaaagccgttcttgtgaagctgacatgtagtccagcgacagtgactcaggttagtaagggtgtgtgcttttcatggcgtgtcgacaccaagccctcacgcagagcaggctgactgacgatgccgcgtgcaggaggttccctggctctggggccggctgacctgggctgtcacctcagtgctgctgctttcgagctgtgtggccttgaggagggttctgggcttctctgagctgaagttatttccttgtgcaacggagatgaaaacacttgggaacaaggctgtggaaagacttatagcatggttgcacgtgcttggcaaagaaccagtctgtttagcttgcttgtttattttactgaaggcattatgtataacgattatattgtatattctaccaaacataccaacaagagtgtccaagatgttgatgcatattgaaacgtccatgttactctttagcataatttattgacaactgcttgttttcttgtgattctccctttttcctaaacacttatgagagaaaagccacacttaactgtaagttcttacttattaaggatagtctttatttagtagactgggaaagtggtggtagatggataagtaattaacaaatggataagaaaaatagtaggcttccccacaggaaggagataaggctgtgaacaatccacaaaaggagtgagtgtaaggactttttaattttgagagatattggatacatagttgttatctttctgttttcaaattcccccagcaacccacctccatggccatatccttgttccttgcatcaagcagaatggctcttcctccaaagtgaaccttgggcagcctactctggttacagtcctgcctgccaccgcctccttgtgaccttgtcctcccgccctcctggaggctcctccagggctgcttctcgtagccgtttcctggtgtggcttcagccacttgctgaccctgtctgggtccccaggatcatgcttggcttcactccccattggaccacagccttgaccttctcctacacctcccttcccaactccagacatccccctcctgatcccgggagccagtgcctcactgctggcagaaatcacataaccaagcttcaatacattttccacagccttggcaaaggccaaagggctgcttgccaatccttttgtgtatctcagtgtggcaaagttgttaagaccgtggttcaagtctcacctccacccctcactggaggcaccatacgtcttctgccaacctgccagatgccgcctttcacaagtcagcccctgaaatctgacattgtctgtgaagccttctgtctgattcatcagacgaaagtgaatacccgtgcggtatccattgcgggctgggtgcaggattctcctggacctttctgtgatctcaaccctctcgctggaattaggcacttgctcttgtctccttccctaatagtatactatgcttactttgcacctgatttatttggttttattttataatcaaatcaaataatttattccaagtagtctaaattgaagttttattttcaaaactacaggcataagcagtctttcagtagaatacccactgtagaaaaacttccttaacggttccccttgtgttgcagattttcaaggcttcaccattttcagtgtgattactaatatagcaggaaatccttcaagtatgtggctctctctctacctaggattctttctccaggacagattctcagacacgaatgtctgcagttaaatgccctgtgcttcttgagaaatgatgcagaattgccatttggaagggtcgtgctgacttgtgatgccaccaaagatactcaaaggtgtttgatttcactgcacctctgtgagaattgggaaatgggacagaacatcatctggggatacttaaagaacccgaaggtccttagcaccttgctcaagccaagtaaaatgaatttttcatattacgattttttttttccagcagattttaagctatctacttgggggcagaaataagaaaaagcagatggtaggggcaatgaggttgtggtggagttcgagggagtgattgaatcttgggtgctggttggaaatactgcccatgggggtctgggttgaattggatggaaacaacacttggagaagcctgcagaggggctgagaggggagggagagcctgtgtggactggaggctcaggagatgaagggcgagaggattgggtgcacgctgggactcagaggcttacattcttatgtgtggggagtacagaacccgccacaagctaactctatgttggccatgtttatggttatcagaagtggggttggcgttgaggacatcaaagcttcatgatgccaggggactgcaagagtcccctccgtgggcattgggcaacccaggagatggctaaggagactgaagccagctgctgggcactagtggtttgagtgaggaggaagagaccagagaggactggggcccaggggctgggacttagtggtggagggggctgtgaaggtctgtccagcttccatctgcctgttgtgcatgccttgcagggaggcatggcggcctgagctctctcctcacttggactttctgtggctgaggcagaaataaacagagatggacatcaatatgctggtgtgtgaaggcaccccatggggttagctccaggcagacctaggcattgtgtcctgccatctcctccctgcgccacatctcctgttcagctctatgcaagccacggccccacatgccctgtgagtctgccctctcccaccctgcctaaaccaggccactggtctattttacagaaagatagggttggacatagcatcaggggtcacttgaaagtcacagggctggaatgtcaggtggattcagggcctggggccaccattctgtgacagctgagctgtgggcacattgagctgtgggcaggtggagcagaaggagctcaatttcagaggaagagagagacagagacagaggtagagagagagagacaaagagagacagagacagagagacagggagagagagaaaggaagagaaagatggagagagacagagacagaggaagaaagagagagagagacaaagacagagagatagagaaacagggagagagagagagatagaaagagagtgacatttagagagacagagagagggagagagacctgatttccacatgcagactgaagcaggggcgggagcccactcccggagaggaaggggacatgcagggcaggctcgcggtccaggtcctgagatccagagaagtcccatcacgccccttctgatcaaactggtctgagtgggcttctggtccttacacggtgtaatctttaaaacagtaactgttattattatcacatgaaactgcagcacttccctttcattacctttgagggtcgtttattgaccaacagagagacccatgcttggggagcaacgtccaaggtgcccagcagaggcacagcagtgctgacagtcctgacaagtaacgtgggacacagaccacctggagatctcagcctggaggtgcctcagttgctcagggtgatgagattctattttaagttcccaggttgtcatttaaacctctctcttctgtcttgggatgggctaatggtgagatgaggtgatcgcagggcatgaggcaggggaggttgaggtaataacatcagaagtaaaagtaaaaaatcaaccaaccctctagcccagtgggcgtggctggcccaatgagctgtggggctcccacaataggagtataagcagcaggccctgccacctgggctgctttgccacagggcatttgctccagtgtactctgcctcccaactagcccgtctcattgtctcatttattgacttctcccacttgccttttcatgcatgtgacttgaagacccttggtctaagctgtgaatcctgaacacatgaggccttgtgatagatgcccctaaacatcacaggaaacaaagcagggacaccctcgccatgtaaattcagcttttctgattacaagacagaagggatttttctgactttcccctgtctccagaaattcatgcagaatcctgatttcatcacaactcaccagattttccttccaggccagcctgcctctggggcttaggttttagaccagagcgggtggaaatacagaggtggctccattgccaaggaagtcctgaaaggcttcctgtcctgcttcctttctcttgtgctgtggatggcctttctgtctaagcagatgtgtgtcacgagaaggggcaggtgtgtgtgatggccattcaggcactgctcatgcttccgagttaaaacctcctacttaatcactggctggaaataagcagtgaattctgcagggcgagccacaagggcagtgctaggaaagtcgctgtccttcctagaaccacagttgcttttgttagttttgtaaaggtgagtgtatacacctgtaccgaggcagaggtgggcatgtacacctgtacacagatagaggtgggcacatacacctgtacggacttagaggtgggcacatacacctgtatggggttagagatggacacgtatgcctgtacgggcttagaggtgggcacatacacctgtacggggttagaggtgggcacgtacgcctgtacagggttagaggtggacatgtatgcctgtacatggttagaggtgggcacatactcctgtatggggttagaggtgggcacgtacacctgtacggggttagaggtggacatatacgcctgtacatggttagaggtgggcacgtacgcctgtatgggcttagaggtgggcacgtacacccgtacggggttagaggtggacatgtacacctgtacataggctccaggctcttcctcctgcaacagtgagctgcctcgtttgggtcattggcctttctcacagtttgcaggggttgtgcagatacagctccttgctcagatgtcatttcaatttgtttcctgggaacaaagctctccaccatttaagatacatctcttttctctatgggaccctttgtccatattaggccaggtcctctcaaagctccttccagttaggcagttcaggaaatgacatgtgccttagatgacaattcaacagaacaattcaatgcctaagtttttaaaaaattattacttacttatgagccagagtttctttcttgttgcctaggctggagtgcaatggcatgatctcggctcactgcaactccgcctcctgggttcaagaggttctcctgcctcagcctcccaagtagctggaactacaggtgcccgtcaccacacacagctaatttttttattttattttattttattttattttattttattttattttattttgtatttttagtagagacagggtttcaccatgtcggccaggctggtcttgaactcctgaccttaaatgatcctcccaccttggcctcccaaagtgttgggattacaggtgtgaaccactgcgcccggcccaaagcctaagttttagtataagactgatgtgtcttcagatgctgcctctgccatttgcatgctgtgtgacttcagcctggcagctcaacctatctgagcctcagtttctgcagctgtaaaatggggaccagaactgtctctactccctagggttggagggagagccctcagtgtgacccccggtgtggagtagggagggtttcagcactgaggagttttctcagcattccctgtctcaagactgtgttaactactgaagatggggtcaattactgacccctggggacttaaaataatcagtgccgcttttcctcattgcctaatttattatactcaagaagtggcctccaaatgaggaaaacctgatccatggccaagctgccttgaaagttttctttcaattcttttggtaacagctgtattgagagataattcacatatcgtgcagctcacccattggcagtgtactgttcaatggttttgagtatgtgagcagtgttttgcaaccatcattgtggtgaaatttagaatattttcttctcctctaaagagaaccctgtgtccattaggaatcacttccattttcctttcccccggcccctggccacctgtaacccgctttctgtttctttagatttgcctattctggacacttcatagaaatggaatcacatgacatgtggcggttatgactggcttccttcatttggcatcatgttttcgaagctcatccgtgttgtagcatgtgtcagccctccattcctttttatgacagaatgatattccactgtctggatacatcacactttgtttccccattcatcaattgagggacgtttgtgttgtttctattaattgttttaacctaaattgcctttcacaacgttcttgttttgatgtaactgtctgcttatcaattgtagagttcattaattcatctctctatgtgcccagtgaatatttattgagtgcccagtaagtcttgggtgctgtgcaaggcattttgatgaatctgtgaactaggcaggtaagactcttgccatcacggaaggtcccattctagtgggggccatttaggtgctgctctttcttctgatctttagtggatgaccaacaacaaatagctattaatacacaccatgatgtcggtgatgacgaatgtggtgggaaatggagctgcctacagggaagaaggagtgatgggtgctgtttcagatgtgggcactgggaagatgtctctctgggcagggcaatgggtgcagagccatggatttcactggtctgggtcaagttcagaaatgggtggactatgatgaacctctgaagacctggagatggggccaccttttgaggcagaaacctctcttttgtcctgtgagaagtctgacttggcctcacagggtgcagtcgtcccctgccctggacaagctcatgtgaatggccagagtgtggacacacatccaccaacctgcattctcaattacgtggaagcctccatgttctctctgcatttgaccttctctggagggtaaatgaggacaggcatctgccgggggtggggggggggggcaggcacttttactgtttccatcctgcaaggtccggggagaccccaggcttttctgtcgttaaggtgtcctagagggagcattcaagcttatgtttgttggacctgtgacagcacgtggtgcttgtgtttacagcctgctccatgttccatcttctactgcacttggctatttacaggtccatagacccagatggtgctgtggtttctgtctccagaacgcctccccagtccggcacttattcccactctcactgccatctcctgggcgttgctcaccagcaccttaaatgttcttgccacttctcctctgcaatctcgtactttctgctcccagaccaagggctagaggcatgctttctgtgctcatgtgcgcatgctttctcagcaaccttgtgaggctgccccaccccctccacagctcctccctggtccaatgggagagagcatttggtttcagagagaaccatgtggttctccttctgtttattctgagcttttttttcttcatttagcatcaattcctgtcatggaaaatcacaggagccaactgaagggggatttccagaatatttggccttccttgggccttggtgaagtggcttccttggcctgggcaagtggggctgtgagcatctgtacattcacaagaaggctgggggtgcggctccatgctgggtgagcctcctctctccttgccggggaagggctagagtaagagtcggtttctccaaagtgatgatgcattctttctcttatgggtctggcttggaagccacagaattcaaaggcagtgctgggaggtggcttagccctcctctgctttagttggtggaaaggaaaggtagaaacctgaggtcaaaaacaggtggcccgtgggcctaggtcagcctgcagacttggttggtttgaacacagtgtttgtgtgtttcattgaaccaacatttaaatgtagggagatttcacaccaatatctggattttctttctggcttggcttgaaatactcagagctcgggtactgctggctattgccaggctagagggttcatgaggatggaattgtccagctgtgatattggctgtctccggggcctgcaccatgcctggtagatgaggtccatccacttaatgaaggaacggactggccatggctcttgccaggctgcgtggctgctgcctgctccaggcaggacctgccttctccagttaggccaagtccttgactacccacgtggagaatccacacctggttcacctcacctacttacctgtgtatccagcctggcctctctaggacatctgcatctggtccttgggagcaaccgtaggcatgaggaatgtgctgaaagggatcctcctttattctgaaatgtggcccatcaggcctcagctagagattcttccctaaggaagtctggagtcccgtggctgtaaccacagctttcagaagcggttctcaaatgtgggcagtttgggcaccgtctggaggcattttcagttgtcgcagctgggaggcatggtgccactggcatctcatgggcagaggccagggatactgctaagtacccccacagtgcccaggacggcccccgccacagagcatcatttagcttcaaatgtcagtattgctgaggctgcgcatccctgcgttggagtcacagtgccctgagtccctgtcccaatgctgcacttgcccttgaccttcctgcctcctcgaacctcagtttcccatctctaaagtggagtgatcctcacatgcacctctctcagctagatggagaggaaacgccatggcctgcatgtagaatcacactcagtggtcggggttgcagctctgatatttggggaggccctagccatgggggctaggatctgggctgtggaatccacctgtgtgactatgggtgggtcgtatgtcctcctgagcctcagtttcctcatctgggcatcaagagaggaatagggcagcctctaaggatgtgaggattaaatggtttaatgtctgcactcggcacatggaacctgataaacgtgcgtgagcagcgccatcctgactcagcggtgtggttctggggtctcctgagacaccactgtgtgcccgacacccagcttgcggcctccttccctccaccatctctctcctcatccacgagtcaggttaatcctcccccttgaccccacacaccgcagcaaagttttaggaagttgcctgtggttgccctttggtgtatggactccagggtggctcctgtggaggtgggaagagccttgggggcttccaggcaagagaggtgagtggggcttagcctaggctgtggtggtggggttggtgaagagggaaggaattggagagaggccctggacacagagcccagaggagttgcctgcaggttggatgtgtctgttacggtgagctgcaagcaatctgagggcaggagggtacctcatctccctcagcgtctctctagtgtgtgaggctgtgtagtttgtggatttgaatagacttggagcttttggggcatcttcctgggacaacctcaatttatttggcatcttctcagagtttatctgtgggcatggcaggagtgaccccagactgggttcagccctctcttcctggctgagcctctttgggtcttagtctgctcatctgtagaatgggaatagaatccttcactctgtggcctgttgttttaagttttcaataagacctggtattggaagcccccatcaaagtgaggagctcatgaagcacaggcgttgggcaccagatgcaggatctcttcctgatggccgagcaatgtggcgctaagcggggtgtctgcggttcgccccgcccaggtcagcagcacgacaaggggcaggccttggattctcttagacctgctcacagcctgggcttctggggccctgaatgtggccagtgctcaggtggttgggagctggcctggcagcacctggggctcccaaacacaagggaagacaggcagctgggatggtgaccctggggaccctgctatcctgtggaggccccaggattccgacttgtacccgggcttgcttggtgctgtcttgggactgtctctgggctgggacagtgagctcttggatgggccctcggctgtcagtgcctcagagctgcagaaggtcagagccaggcctggggtggaccaagtggtatctacacccctcccaaatgtgtccgaactgggtagttttgtgcagctcactctgcctctctgagccttggtttcctcacctgacctgcacagtggaagaggagaagagcctgacaggaaggccggatcaagctggtagggtttcagtgcaggccctggcagagcagccccgaagcttgggaaggccaggaaatcccgcgctggtctccagacctgcctgcccgaggagtcgagcttctgatgaaattcagctgagatttcggttttttgtgctctgtaccctgacaaggggcaggaatcgggagccagcctcggctgtcagtgtcctgggctggttccctcccacctcccgcttaaaggtgtcattagcaagggcaagacgtcttctaacaggtggaaacaacttgtcaagacagcctgtggctgctgcgtttagagacccagagaccctgaatgtggactaacgcccccagaatgttcagaattaatgtgctgccccaggcagtgctggggcggggggcatggctctgactcctgcccttgggtttgccccactctgccctcttccccttctcctgttccttccccttctcctgttcctccttctcctgttccttccccttctcctgtccccccttctcctgttccttccccttctcctgtcctctcttctcctgttcccccttgttctcgttccccttctcctgttcccccttctcctgtccccgcttcttctgtctccccttctgttccctccttctcctattccccgcttctcctgttccccccttctcctgtccccgcttctcctgttccccccttctcctgtccccgcttctcctgttcctctcccttctcctgttccccacttctcctcttcccaccttctcctgttcctgccttctcctgtccccccttctcctgttccccctcctcctgttccccccttctctggttccctccttctcctgttccccctccttctgtttccccccttctcctcttcccaccttctcctgtcccccacttctcctgtttctgccttctcctgccttctcctgttgccccttctcctgtcccccgcttctcctgtctctgccttctcctgccttctcctatccccccttctactgtccccccacttctcctgttcctcccccttctcctgttcctccccttctgttcccccctctcctgttcccccttctcctgttcctccccattctcctccctgttcctcccccttctcctccctgttcctccttttccccctctcttttcctccccttcctattcttttccctcttcccttccccctcctcccctccacttacccctctccctccctattcttttccctcttcccttccccctcctcccctccacttacccctctccctccctgtccttctccctcttcccagctaattgtattgaggctgtaccttgtgataggaactttgggtagctctcttagctcatatcacaccatccctggggaagggtaccccattgtacaggtgggtacacagaagaggggagagatgcccccactacaatgtgctgggagcagaatttggacctggatctgagtccagctcctccatcccctgcaggaaggatctgggctcttggggtgtcagggggcaactacctcttcatagcaaagcttcattcgttaagttcctggttctgggctattgtccctgtctccgaggatcagagaggtgaagtcccctgcctgggttcagatggttatggagtaggggtcctggttcagacccatggctgtctttcttgccagcagcacttctttctttggggtgatttttcccccaggggacactgcagtgcctggagacattctggttgttataactggggtggagggtgcttctggcctctggcatgtagctgtcagggatgcggctaaacctcctgcaatgcacagcacagcccccaccacagagaattgtgtggtcccaaatgtcaccagtgctgaggctgagaaaccctgcaccaggcccctccccagctgaccctatgttcctgcaactaagccagcagtagacatacctgcagcagcaggtgttggtgctacaggtgaccctaggtcctcgacctccccatctgtctgccacctgggcctgggcctgggcccggaataaaaggtgcaccaagggtccctggcttcagcattttttgttttcaggttgcatatcagactccttcttgcctcctgaggtcccttgggacttggctccaggcagcctccctgatctaagacttcagcagccgcctcaggactctgcatggccaaggtcccctctgccccaggtcaccaaggtcattgtggtagggaaggagaagagagggccctaagaaaaactccagtcccactagttcctggaacttgcctaaggccaggagaagttgctgccatcgtgggttctgtatatgggattcaggactttggttcaggtggtttctgccaggctctggccagatgccagcctaggcagtgtcctggcagtgctgagtgacacgtctcgggcacagagaggagtgggcgcctggccctgagcagaggggaggcttgttgggggccagcacttgatccactgagccggaccctcagaccctgggttgccctcctcacccccacccccacctcatctctgcttcctgcaacatctatatttaaaaatgttgacagataataatggtgttcagccccaaaatgcagacaggagcttcctgacaattgcagtgctgcgccgggttggaggttttctcagggagcggagcgagtccccaggagcaagtgagagtgccagggctgtgagggctctttgccaatcttgacctttcagggagatttgagagaaagactccagaagcccgcggggagagcaggggttctggggaagataaagcccttcatccaggatccctctgtgaccataaggtgagttgctttgccccacatctctggtgaggcagagggcagggactctgcttagggagcaggcttcttaaaggcaaagggtttgcaaattctagcagcagcagggccctaagagaatggctttttttttttgttcttgaatcggatgactgcatttggagtctggggtgaggggtgggggctgcccctcttggagccacagatgggtcatttttatgtatcaagggagtcagaccaggatcagccctgggtttctggcacagagtccagaaagagtcacgaaggtcttttgtttgcatgtgaatggtattttaacctattacttctgggctaaaaataaaaattcccctcagatgcctttttgtctgtagattgtaagatcgtttccaggaaataatagattgtcattgatgtgcgttttgactgcatggtgtcctattcttaagccaggttttataaaaattcaaagtagaggaggtttcccacagtggagattgaagccttcatttagtgtcaggaacatatgctccactatcaggagtcattgtccttccgggatctccaccactgaaccctgggtgggagtgtgggagtgggtgagggagaaggcacacttggcttttgtgtggttttacatttggtatcatttgtggacttttggttctgaaaaatggtttgcaagtgaagttggatgtctggagttggggcccaagaaggcgatggagaagtgaattctaattcacagttaatatgggtcatggttaagttcttggaagcaacattggtttccaaaggtgcctgctgcgtttttaagctgcaaggttttatgtttttttgacccagtggaaaatggcgattcaggatcccaaggacttcaggagaggttgtctgaatgctaaaaccccttccctgaaatgcttgctttctttttagaggacaggaaatatgggaaattaacagtccttttgtggagtgtggtttgcgtgttgttctttgaggaggaattacggaattatgtgcgtgtataatgatggtaaccacatacacaatcgaagaataacaagtcagaaaaatccatggtgaggttcattcagaaataatcaagagtgtattgtttaattaaggagaggatcagaggaatgcagtcccagagccaccatttcggttgtcacctaggtgcaactctcagcagaaggaagcattcccaataagatgttctgaaaacgtactgccgttgaatctcacaactttcaccccacaagctgcaataagaggccagtatgaaaatgcgctctttcttccccatacattttcttctgttcctgagccgagcccataggtagcttggcagtttgcaattctctgtctacacggaatagatatagatttttttttcctgtatgttttgggtattaactctttggttgccaagctgttgagccctgagtctatattatacaccttcagcccgtggcttacagggcttcaacacatcgttgttatataatgcagtagttttgcttgtggggtgactgttcatatcgtggatgctcagaaaattctatttttaaagtataaaataccactcttcagagcagcctgctcactcctgcctccctgggagccacacgctttgcaccgtggagttgttggcatgaaggcacatgacatatggatgggagtgcgttcctcctgtctagggcctcttaggacccgaggaatggctggaggcagtttctctccagtcctgaggttgatgatccgaagctcttggtgctgagcctgtgctgctatttttagcttcctttcttccctgcatcttgacataattcgacatgtcgcagctgaatctcatctacttgcagagcttaccgtgttttgtaatctgtgttttgtggggcagaaatagtccttgccagagcatattatatcattattattcagggggaaagttatgatactatcaattaactttagaagatgcaaaacacaattgatcctttgattttctttctactgctaatttcctggctgggagcacctggagggtaggcactcctcctccttctgccggaccagaaggcagcaagcagtggttctcacatcttgggaacctgtatcagaagcacctggaggggctgttacaaaggcaattgcagccccactggcagagtttctgagttagcaggtctgggtggggtgggggggcaagtaatttgcatctctcacaagttcccaggtgatgctgacgccggtccagcactgcactttgaatcacagatggagatcacggcagagggttggtaaatatttagggggtggacgatgcctacatgcagagagccaatttaagaaatatacagatggtggagcaggagattttcagttgttgtgtatcctgtccacgcggttgaagatggacttgattgaaaaagaaattaaagttgaaataaaattagctgactgagaggatggctcctgacagtgtccaatgctgtgatgttatttagggaggatgaagcatcacgactcagacaacttactttgagatggccaacagcacacacagacataaatgaagtgcgtgtacatgcacacacacgaaactcagcaaaatattaactgctgaaacaataggtgttcatattattctaatttcatactatttctatttctaatacttttcttcataacaaacattgtattaacatggcaaacacaataatagggcttaggacagcttttcttgtgtgtgtgcttaatagtaaatcaaggtcacccacatgttcacagctgtgttgctctgggtggcatgggcatcggtactgtattagtccatttttacactgctgataaagacgtacccaagactgggtaatttataaagaaaaagaggcttaatggactcacattaagcctctggggagccctcacaataatggcagaaggtgaaaggcatgtcttacgtggcagcagacaagagataatgaggaccaagtgaaaggggtttccccttataaaaccgtcagatctcatgagacttattcactaccacaagaacagtatgggggagactgcccccatgattcagttacctcctgctgggtccctcccgcaacacgtggaaactataggagctacaattcaagaagagatttgggtggggacacagccaaactgtatcaggcacacgcatcgctttagggagttctcatttccttccattcaacctgatcctttatctgcttgttctttcctcctttcccttccattctctttcactccctcctccctggcttccctctcttctgctctccctccctccttccttcttcctgtccccatctcctgtcttctggtgactctgggtcaaaggaccctggtccagaagggttccgtgtggggatgtgttgtgctgaacccctgttaacctcagtagggaaggtaccaggttcaagaggccaaagaagagacctggagccagcaaacaagacatacagttttattatggacttacatgcagggaagagagtccagtggtggcaggttgaagagaactgtcttaacatacagaaacggtccagtggtggcaggctggacaggagaactgccttaatgttcagaaacggtccagtggtggcaggctggacaacatatccaccttcctacagtctggtggtggcagactgggcaagaaaaccacaactgcaaccgcctgcgaacatcatgcagtttacgcagcattttcatttagcaccctcctcctaacagccctcacctggcaaccttcatgtaacccaagcttgtccaacccaaggcctgtgggacgcatgcagcccaggatggctttgaatgcggcgcaacacaaatttgtaaactttcttaaagtgttatgagatttttttttttagctcatcaactatcattagtgttagcgtattttatgtatggcccaagacaattcttctttttctaatgtggcccaaggaagccaaaagattggacacccctgatagtaacccaaaactcagggcctcaatcccctgtacagcccgtgttccacaggacaggccggaggctcagatgttgtggtagataggaacagatctctgggtgggccactcccggattccctagtttggaacacacattcaggtgcacctgtcatacagggtcattctaagggtatgcttaaaatattgatgtcaggtgtgtttaccctgcaggatgctgtggcatctgcccaggaaaaagttgaattatgccagttattgttttcccagggttttcaggctgcctccttgttttttaaataaagttttattagaacacactcacacccatttacttacacacttctctggctgctttccagcagcatagctgaggcagagaccatagatccacacaactgaaaatatttacttctggcctgttgcagaaaaaatttgcccatgctgatttgtttctgtgggctggctgtcttggagattccacacgtacacacatgtgcacatgtgcatacatactcatactaaggacatgcagcaagacgttaagggttgtggagtctagagtacatgtgattgttcattgtaccattttttttttctactttttcacgtgtccaaaaaatttgtaaaacattttgatgactgtggcagtgaccaccccagggtctctagaggaatgccacaggggtccatcccaggttctgagtcttcaacatttgcctcacccacttggcaggttaatcaaatgggtagatgacacaaatcaataaaagcattaacaaagtgtcccatatattcaagagccaaacagatatctcaacagactgttagggaggctgagtcaacaaggagaagtttaatgttcataagcttcaggtatccagctcagatttacaaagatctttgcccaggtcctgcaaggagcagactttgataggaatcaggcctctgggccaggcatggcggctcacccctgtaatctcagctctttgggaggccgaggtgggtggatcacctgaggtcgggagtttgagaccagcctgaccaacatggtgaaaccctgtctctactaaaaacacaaaattagctgggagtggtggcacatgcctttaatcccagctactcaggaggctgaggcaggagaatcatttgaacccagggggtggaggttgcggtgagcagagatcgtgccattgcaccccagactgggcaacaagagcgaaactctatctcaaaaaaaaaaaaagaaagaaagaaagaaaaaaataatcaggcctcttggctggacgcggtggctcatgcctgtaatcccagcattttgggaggccgaggcaggtggatcacttgaggccaggagttcgaggccagcctggccaacatggcaaaaccccgtctctactaaaaatacaaaaattagctgggtgtggtggcgtgcacctgtagtcccagctactcggcaggctgaggcaggagaatcgctccaacccaggaggcagaggttgcagtgagccaagatcatggtgctgcactccagcctgggcaacagagtgagactctgtctcaaaaacaaaaacaaacaaaacaaaaaaaagggaaagaaatctggcctcttaatggaaccaaagtctgcggggtccctagagtgtgtgcaaactgttccagtcactgggacatcagtgtgcaaagcctcctggagcttgtgtgctagtgggagaggacaatgaacggcacctataaccagtaggggatcgtcctgcatgttagtaataagtgttgtgggaaatgaacaggagaagtagggggaggtaagagaaggtataaatgtggtaggctgtagacatttgagtattacatggagtgtcaggattggcatcattacggaggtgacatttgagcaaagccgtgaaggcggtgaggaagtgagccatgtggatatctgaggcaagagcctttggggcaaagggaaccttcagtgaagacgccccgaataagagccggcctggtgggttccaggaacagggaggaggagcccgtggtggctggagtcacatgagattgctggggagggagacgggagagaagcagggacattgtagggaggggcctctgccagcacttgggcttttgctctgagtgtgacgggtcgggggggacattggagggtttgagatttaattatgattcatcaaataacttgagaacaggctagtgtccaggtggactgaccagcctagcagtcattgctgcaatccaggcgggagatgatgctaactggccacagtgaggttgtggacgtggacacttctagaaggtagaatgatgcagttggctgagggagcagatggggaaacagggacagtggagtttcaagggaggactctcaggttctgtcgtgagtaacagaaggatagagcgttggtcctggcctatgaggggaaggccgtggtggagcaggtttcagggagagagcagttcaattttggctacagtgaatttggagcatctatttgacatccgtgcaaagatgacaaattggcaattggctgcacaactctgtgcttgggagagaggtttgggctgaagctgtgcattcgggaggccgcagctgagcagaagctgaatgtgagctaacgcgctctctccctgacttagtcatttgtctgccacctgtagtctaatttgccaaatactttcttttaaaccaggtcttttttttttttttcaaatttaaactcattttaaaaggatatctatgttgcacttttaagtagaaatccaatattgcttgcctttgataaaaggtaaccataaaataaaacaatgacaacaaaacaacatttagttcaagttaggcatagtctctcactaaggattttgagccagagggtcttatgtattatccaaacacagagatcaacaagtgtcagatgccagggtcgtcataataccaaactaagactctcctcttgaagttcttggaagattggagggaaattggcaagaaattagcttctgttgctttgtcctgggtccacgaatcccttaaagtccccttttaccctgttatgtgcctggcccttggggagatgctgagctgagcagccgttatagtgggtagaagaaggaagcttggggtccagcttgaccctctgctagaggttgggtttgccttaggactatgtattttctgaaaggcaaactgcaatttgcaagaacgcagagaggggcaatggctgtttattctagaacagacttgggggatgagaaccttggaaagaaagggtgggatttttcctgcatggttctaggatgtggccctgcagccagctgggaaggataaaaggatacaagtgggttggtttcacttccctctgggcacaggctttctctctgagaattctcactggggctcatatcttttaaattaagtagtctgctcctgaataatatctttctttggggctgtttctttttcagtttatatattggggtccctttttgacattataggctttcctcaaatgcctggtgagccaggatcgaccttgttcattgcagaatgaagcagcaaagagctggtgtgtgctcacggtgtgtttcagctggtgggttttgtttcaggttgcccaggcctggaggtggccttggtgctgaggggcctttgcagaaccttctctttgtggctggtctggagacaggcaaggatgctcctgtactttttgcctggagatgggagttgtccatgttatctgcaatccaccctaggctgatggtgagggagggagtctgctgtcataggaagcatgtaaacagactcaggcttctctcagcatgagaagggattttggatctctgaggtccttcctactgtggatttgcagtttccctccacaacctcacccgcaggaatccggaagcgcctgatgccttccctgggctgggagcccctagagaggaggatctgctgagctgttatgacatcgtgcccacaactgtgcaggcatttgggagatgctctgaaaatgcccgatgaagggttgtgaggatgaaagaatctgctgctgaacacaaactgctgggctccaggctactgagcccaacttattccatggcccagcatgtcccacggctcagcatgtcctgtggctcagcacgtcccttggcttcccatggctcagcacgtcccgtggctcagctctcactcctttgcttctgcaggtcccttggtctggcgtgtcctccccactcttcctgagttctctgaattctacttgtggctccagggccccctctttcatgaaaccttgactcaccacctccacctctttccccacctcacccaccactgtcctgctcttggggccctgcacccacctcctgctgggcccctgcttctgccctgcagtgctgtggcccccttcctgcccagcagctgggaaggcatcctgaagtgcatatcagatcttgccctgtccctgcctcccattgcctctggaccacagcctctgagatcctgcctgccttcctcatcttgtcttccattcctggggaacagtggccacatagccaggtggctggcagcacggacttgggagaccctaccagcctgggtttgaaccctgtctctaccgcctgcttgctttgtgacctggttcctcattttcctcatctgtaagatggtggtgttgaaaggacccgtctggtagggttgttctgaaggttgagatattcaaatgctgagaacaccacccagcacaaggctggtgaatgctccaggagggttcactgcgccgttgccattttcctgttgatcctggagttccggccactctggcctctgctcacatagctggaactcgtcagaccatctcccacctcaaggtctttgcctctaccgtgctgtctcaggacactcgtcccctgccttaccattcggtcagcccattatccttcgggcctcaggttgaatgtcacttgctgagagcagccctctctgaccatccttttagagtggcttccccgcctcacattccccgttacagtctggcctgattgtatctgccagtgggttctgcttcccccaaccacaacttgcccatcatgagggggcagccttgcctgttgtcccctgcactgcatcaacactgcctggaccagaggccctcggtaactgccagttggctgaatgaatgcaggaatgaggcatgaacaatgcaaagatgctgaaccatgacatgagggactgtttcattcatgtggcatgggggtgggctaccccccccatacctaacttttccaatgtgacggttttccttctgaatttataaggtgcccaccttaaagacaggaattcagctcatatcttttaatagaccctgcaaggtatccagttcctaggacacagcattttgttggttattgaatgagactgaagggatgagaagagtggccaatagcatggagctggggcctaactgcccacgtgtggtcttggtccctagtatttattagccaagtgtccttggccaacttcattttatgccacaaaacctcagtctcctcatctatacaatgggaataataataataccttttctagagttggagggaggattaaatgagtcagttatgtttaaagtcctggaacagtgccaatgcccaccacatagtaatttccatgtaaatgtgagctgccatgatgatggtgatgatcatggttgtgatgatggtggtgatgattgtgatgttgatggtgatgatgatggtcgtgatgatgatggtgatgatgatggtcgtgatgattgtgatgatgatggtgatgatgatggtggtgatgatgatggttgtgatgattgtgatgatggtggtgatgatgatggtggtgatgatgatggtgatgatgatggtgatgatgatgattgtgatgatggtggtgatggtggtggttatgatgatggtggtgatgatggtgatgatgatggtgatgatgatggtgatgatgatggtgatgatgatggtggtgatgattgtgatgatgatggtgatggtggtggtgatgatgatggtgatgatggtgatgatgatggtggtgattgtgatgatggtggtgattgtgatgatggtggtggttgtgatggtgatgattgtgatgatggtggtgatgatggtggtgattgtgatgatgatggtgattgtgatgatggtgatgattgtgatgatggtggtgattgtgatgatggtggtgatgatgatggtggtgatgatgatggtggtgattgtgatgatggtggtgatgatgatcatggtgattgtgatgatggtggtgatagtggtggtgacggtgataatgatcatggtggtgacagtgatgatgacgatggtgattgtgatggtggtggtgatagtggtgatgacgatgatgatcatggcagtgatggtgatgatgacgatggtgattgtgatggtggtggtgatagtggtgatgatggtgatgatgatcatagtggtgttggtgatgataatggtggtggtgaatgtgacggtgtgatggtggtaatgagggtgatgttgttaccttgtagtagatttgaaaaagtggaatagagtggaattaaagaaaacactactgagttaataagaagaaaggtagggcgcaggaagtgtttgctaggaaatggaagagtccagcttattccagtatcagttgaatgcagcagactcatgaactttactgaaaccaaaatttaccgaagctgatgagaggatcatgatttcccagagtgtggactgaagcctccgggaggtgtcagagatgattttggagtagtgcttttcacaccctctgtaaaataggacccatttaaaaattttcaatctgttgcaaactgataatttcattaatgtgtagagaaacattttcacacttcacccctaagagaaggtttgtggactggtacctggaacagatacttatcttgtagctgccaccaagaaacactttccagatgggcaccgtagcaggacactgtgctaggacacgctttgagtagtgctgtttcagatgaaaatcacatcacatggggctttgaatttcacagaatcctgtggtcagctggttgctcccctgtgaattatctttcagttgtgtggttgtatatggaggagaaagttgtagtttgtggctcatgtgtcactgactggtgatgttggatgatttctcttttctaacaagcagagagcagcctcaggcacagaacccttgacgggcatggggtcttgccagaatggaattacactgacttgtttccattgcatttattttgtggccacttaatatttttggatgttgattctgattttcctattagagccaagatgtaaagtttctttaatagataatttaggtgcaaaaagtgagttgccttaaaacatagtgtacattatcatgcagctacgagtgaatatatgacaaaaatcatgaaagtggtacaagacaaatttgcagagaactctagtggaaggcaggatagaggagtgagaatagaccaaatggatgtttggggtcatttgggggccatgtaagcctctcccccttatccctggtggaacagcattaaggacatcctctccttcatcccaaacatctgctttatgggaaaccacaggactatattgttagtagtactgggaaagcctagtcggctttatcttttggattctgagaatgttgtcagtgatcatgtttctctcttcactggagttgctaggagttccagcatccaatttcagctccaacctccaatccttgcacagaaccctacagtacgtgttttgtgtattgaagccacagaagcatgtatttttcctcctcattctctccctgacctttttttgattttgttttttgtttttttttcttaactgcagttacatttttgtaagctgtgttacatcgttgtttggaacacagtgggggtaatgcataaatgctgaataaataaataatgatgaaactttttcctcaaactgtgagattggggccactccattgttagagttattttaatgtgatcaggacaaagaggccaagagtgttgtaggaagtaagctttgttctcgtgggcttgggctgggcaacgctgtggttgttgggaacgctaatttctgttatttggtggtgctcatatctcaggcctctgtttaagaaacaacatagattcctccaaggcacatatttgcatcctgtgtgggccgaggtgcctggcttcattctttctctagatacccacactatctcatgggtatttttaaatgcgtgtcttaagagccaacttctctgctgtgtgcaggcttttcatgatgccgggagagttgccacgtggatttgcaggcgctgagggcagaaacaaggaacaggcagcatcagctcaatgggtgggacccactgtcctttcagcccttggtggggcggccttggaggaagggtcattctccaagcagggcagaactcagttccaggttggccagaaggccaaatggactgtggggcaggtctgaggccaggtagtggggcgacccagaagcaggaagatggtgtgtcaaatgtagagtgagacagaaatggcaggggctgaggagttgttgagtcctgttttttcacacttgtgtggggatcttgaggagtttcgtagaggtgccgcagggtctgcctgttgaggagcaaaccaagctgaccgggttacaggtgccatccactgtcccctcccatctgattggtttggatactaggatgttgtgtggattctcctggagtccagacatagccagtgaaacaatattgaaccccctgcaatagtccagccccatcattccatttcataaaggaaactgaggccttgccagggatcccaaagtggtaatccctcttgtagagttccaggggagggcaccaacctctacctagctactgaagccagaaacctgggcattcacctgccctttccattttcctcctcatccccatccctgccacatccctgtatcctggcatctccagccttcagcacctctccaattcatctgcttctcattacccccagccacaccaggaaggtccaggcccccttgtctgtgcgctgggaggatacagatgcatcctgagccttccagcttcctctgttgggcccatctaattgggtttctgctgggcgatgggagtgatcatttgaaacttcaaatctcattatgacagtctatatcccttcctcaatgttcccatcttgtttcacatctttcagtggttgctcatggcttgtaaaatcaaaacaaaacaaaacaaaacacccaaattcctcaccaagccccctcctgcacctctggcctcatgatggcatgattctttgagtctggggacctgagcagatggtctgagctgtgctagaactctaacccacaccaccgcctaccatgcacaaacacagatgtttgctggctgactccagctcatcctctcatcttagcctcagcatcacttctgcaggaaggccccttccaatctcaccagggcccatcacgtcatcctgtctgatgccctttggcactctgggctaatcctttggggccctcagacgccgtccccactgtcttagttgtctggtttgctctctctcttcccctactggattgtcaacttcctgagagccaaggtcacatatagctttagcctgtgtcccaggccttcagcatggtgcttctttgggcacaggaggtgtgtgcagagtggaaggagaccttcatttggtggggagactgtattatagagaagtagtttcatgttccaaagaacaagcaggaaatatcttccttctcctcctctttctgctagtaaatcctccttcctcctcactggctggatgaagcatctcatggtggaatagtttcagatccagggttcccaggaaagggaaccacctccagttccccatcccctttcctttcctgggaggtctctggtgcttatgctactaataatgaacatttaactaatgagttgctacctgttcatattaccaaagcctccctgccaaaggccaccagagacattcctggggtcaaatcagattagatttatggagcttcctgcatcacagggtaacacagtattgagggccatgacaacatcccaatatacaggactgggagaggcttttttacagggcttgagtatgatctggatgattctagaagaaatgaaagaagcaagggccagctctatctgatactatcaagaaagaggcctcccactataggatatctcagtggtctttgttcaggaggttggaggaactagttgaggctgggtaagtgcaggatccctgcccgtggaggggacatcagtcacgtttgtagcttccatgtggcctcgggtgtcctggcggagaccttggctctcctgtcagaagcttcctctgattgtcaacagggatgattttattttactctttatgctttcatctttcatatttaaaactttgatcagtctagaatttcttttgatataaaatgtgagggacagagccaacctacttttctattttagattgccatcaattgtcccaactccatttattgaatgataatcgcttttctctgattttcttgcctcctttataaatatattagattctatacaattttgtgtctatttttggacttttcattttgtcccattgaattgtgtctatccttgcaacaaagccacattgttttaattattatcactatattatatgttttaataacagaagtccctttccctcataccttattcctcttgcagctttttctagttcttcttgtttattttttatataaattttatcttatttgctatatgtcttttaaatatctgataactttagcaggattttagttgtgtaagaattacagaattttaatcctggaaggatgctgaggaggtttctaactctctcattttctggagaggatatgattttatcaaagtgatgctgtgagtttatggcagtgagaaaccagggaatccccaaccctgaacccacctccagatccactcgccccaccaagcctccagcttttgaccctgcatatttttaggtacccagaaattacttaatatttagcttagtggactgccacgatttaaatttgaccttttaaatccaagcacctccttctgctatgttgcttttagaagaaaggacaaagctgaggaattcaacctttgtttccatttatctcttagccttccgagacaggacgcaatgtagccaacaccactcctttgtctccatggtcaaagtcggaaggaagttctttcagaggggttggcttcattgatcttgtggggaaaatcttacaagtacccagggcatggtgtttgataaggaagtgagtggtgtgaaatccaggctcaagaacaaaagccctacaagcctgtacccaacggggccactggcctagaatggtaataaatagaattgggtgacaaccttgaaggtcacccgtggttcagctctggaggtgtccttgtttgtactcactttgagtaaccatcaacttataaatagcctcaggccaattgcccagtgatgattttgactgtcgcttgccaggggcctgggcttgtggtttggttgtgagtctgtcatggtctctgtgacctcagaggaggaggaaggaagatgatgatggatgcttctagtgatgcaagcaacaaacatttttggacaatgtgcccaataccattctctgtactctgcatgagttaacccttcaggcttcaaacaacgctttgaggtaggtgaggagactgagcactaaaaaggtgaatgcggagccagtgtgagcacaaaaggcctggttccctgctagaccgtgcctcctcttggctggagctctatggaaagagttggaaccagggagccttggttaaaatatcagctccatcccttatgaccttgggcaacttacaaatctccaaatctgtattttcaccttttaactagaataatgtatgtcaattatagggtgttaggattaaatgagaaaatgtacataaaacttttggggcattgtctggcactgggtaagtactcaatgaaaaaaggtaatggttttttaacttgtttaatgtttctaagccttaggttttccacttataaaatgaaagcgtcattatatatggtgcgtggctgtcttctcttttggtttggttcggtttgaggatttgtcggggtcacattaccgtcatgaccacctgtgtgaccttgagcagattccttaacccctttatgttgcagttgcctccactctgaagtgggggtcctgatagtggctggctcagggttgtgtgataatcaaatgagagatgcttagagaataagcatcggcgtctggcacagacgtcctcatcctccaagatcctgtgacttgttgcatctatgtgcttgacttagcccacaatccgtccccatctcccttctcttctctttgttctgggaatctttaaaaacacttgttgagcttggggtcggtttgcagaatcatcacctacttttagggtagtctgtttcatttggggtaaacatttaggtttctaagacattgggacagtgatgtttgacttcacatctattcatgtgctctcactgagctctgaatatgatgtttccattcccccatctatcagagatgacacagaatcatttatatagactcaatagactcttaggggaggcaccagccctgtctgtagcttcactacttctgagactgaggtggtacctggtgtatcagttacctgtttctggcaacaaattattccagaatttagcttgtgattttgttgacaattaggctggacttagctgggtggttcttccaatcttggctgggcccctgcatgcatccgtattcaactgcaggctgggtataacactgtcagattttggtgtcagctgggataactgggatgactcaaccctcttctgtactcttcatcttggtcctgttcacatggtggaggcagagccccaggcaagagggaaatgtacaaagccccgttagtcctaggctcaaatcgggcccaccatctcttctgcaggcaattggcaacgtaagccccagtccagcccagattcaaaggaagggggcacacatcttctcttgatgggaagaacagagttcactgcagaggggcctagtctggggagatgaagaaatgtggccgtttttgcaatttgcctcactgaccacatagagggtgactggccctgtattttatgtcatatgtgactctatagaaatgtgtctcctagctgggctttgcagagatgcagactctatctgtctttctgttgtgggctttctaccttgtcatgaaaaggccagaaaattcctgaaatgagtgtccttttcagtccttcaggtgagaggctcctcagggatccacagaccattgttttggcttctgtctccctctgcttgtcacacagggatcacatacacaggtggaagtgaacttgtttgcttcccttcccaaactgtaagctctgtgaagacaggaatctccttgactcactattatatcattggcacctagtaggtcactgtaagtataaaatgaaagagggcaggaaggcaggaagggagtgaatgagttaggaagttaggcatctagataggaaggaaatgagagaaagcctcgatggaagaaggaaagaaagacactggaggtaaacagttgggaaagaaggaggtgaagagatataaggaatttaaattattcttcaacaagctaggtatggggcaaggcactggcctttctgaacctcattgactgcatctgtgtgatggagtaatagtagcacctacctggcttataatgaaataatacatagaagcttttagaatagggaccatcactgatggctgctctagttgttctagtttcagctgatgaaggcactaggatcctcagcatggaagacacagcagcagggacagggggaaatgctgtgggtccaaggagatagtgcaggtgctcagagggtcatggagagagagaagcagcccaatgattgccgggtgctatgccattcagtgcttcttctaggcatggctttgagcagcaattggccaggcttccagaaacttcagaacaagtggactgtgaactctctgcaaactagatgctgtgatatgcattttcataattcccccaaggatgtggacaggtggaaataaactcccagtcacacaaaaccccaccacccagagagcaatctggttgacatcctggctgagtttattaccataatttttcctacgggtacctgtgtaaatatagaaactgtagacaaaattggaattgtaccactgatatggtttggatttctgtccccatccaaatctcatgtcgaattgtaatccgtagtgttggaagaggggcctggtgggaggtgattggattctaggggtggatttccccttgctgttctcatgatagtgagtgtgttcttatgagatctgggtagcacctcctgcttcattctcttcctccttctccggctatgtcttgtgagatgtacctgcttcccctttgccttccgccgtgattataagtttcctgaggtctctacagtcgtgcttcctgtacagcctgtggaactgtgagtcaactaaaccttttttctttataaattacccagtctcaggtagttctttatagcaatccaagaatggactaatacaaccacttctgctgtatcttgggtttttaaaattcacattattttgtgagtattttctcactgcctgagaattttggggtcaggcatttttctcttcaccgcttagacactcaatttctgtttagaaaatggggagagtaagagtatctctctcctagaagttgtctattttttttttttatttgagatggagtctcactctgttgcccaggctggagtgcagaggcataatatcagctaactgcaatgtccacctctcgggttcaagcaattctcctgcctcagtctcctgagtagctgggactacaggctcacctcaccacatccagctaatttctgtatgtttactagatccagggtttctccatgttggccaggctggtctcaaactcctgacctcaagtgatccacccacctctgcctcccaaagtgctgggattacaaatgtgagccaccgcacccagactattttgttttgacctggggagagttaaatgagttaatatccttagcccagttccataacatccactgtaagcttttctatatgttcctttatttaggaagagtgaacatagtgccaagttttacttagagagcagtgctctgcatgctttggtgctagcacacaataaaattaaacggaggtcaaagcagagagcacttagggattcccaaagcgtccagaacaacagtagatggttataaaggacagcaatagtacaatgacgctgcctccaagacgaagtacagcattaattagtactgggcagtggatggccaggctctttcagggctttactgagagcctctgaagggtggcagtgatgaagagtggggccatgagtgaccatctcaggcccgtcgggaagatacttttcatgtggttgacccatggcagaaggaaggacctgtgtcatccctgagtgtctgagcatgttggggctgtgcttcgggacatggggtttttctccctggtctcgttgggatgctcttcacacctaagcagggtttgcacattcaaacatgggccgtttgtattccagccagcattgctgagaaggccggggagcagcttggtgcatactaaggagcagctcctgccctggctctgtccacaccaggctctctgggcagctgcccatggagaacacaagccagcaacctttgaggagagccaggccagcatttgaccatttgaggctgatggaccctgggtggcagggcctcggctctgcttttgggagaccttgaaggctgatgcatttcctccccagccccactcttactttacctggattgctgctgggactttgagacagtccacgctttcctattgtggaggctgtgccttgcctgggggatggagactgaatctattggtgatgatccagtaaagggtctcagagttcagcagagggtgctgggattcaccccaaatatttgggcagagggagagagacaggctgtgaaacagaatgaaataatgatgtgataggaagccctgcaagcattggcccctttaattctccctaggactctatgaggtaaggactgccccacttaccaggatatgaaacaaaggctcagaaggctcagaaggtggaaataaatctcccgggtttgaccaggagcccagcagcccttccccagagcctgttgacaaacagtgcaggcatgtgcctgtctcagggttatcttccgcctgctttcttctcagcatgcgattgcatcatattgtattgattgctactggaagactgaattcagaggcctcacagatctatatcatgactttacggaaatagaaaaagaaaaggtatttttcatggtggctcagacttacttcttatccccatccttgcaggcagaggcccctaacaaatgtcaaaggatgactgagggggctttggaagccaggagacttggctgtagatctcctctaccacttcttagccatgagaccattggtaactcatcgaaccttcctgaacctcaaatagctgctattgctatttgttacccatgagaccaaggaaatagtcttcatcatgaccaaggaatagtcatgttctagacagtgcacaagctaagaaaggagcagagattagaaggagaaaagaggaaaaaagaacaagcaggacatttttcacctaagagattgacaaaaaaatttaatttaatcaataaattacccagtcttgggtagttctttatggcaatccaagaatgaactaatgcaacaacttatgctgcatcctgtgttttattaactcacattattttgtgagcattttctcattgacaatatcaagtgttggcaaacacatgtggaaacagctcttacaagtctcagatataaattggtatggccatcttgcagacacagtttggcaatatcaagtaaaattggaaaaacaaatgctttgactgtccgtgactatttctaggtaaggaggcttggaccaggatgttcatcacaatatcaacattgtgtgtaattatgaaaaactgggaaaaaatcctaaatgaccattaacaggggactgaatacatcaaatgtggcatattcttacaatgggacacttggcaatagttaaaagtaatgaactaaatttctatgggaggaaaatgaagtggacagtataataccatgtttgtaaacctacccaccccaacaaaataatatcatatatagcatgtcaatgtgaaatgaaaaaaagactggatggagagagaggggcagggagatggagagacaaagacagagacagcaagcaagagaatgtgagagctgtaggtatcagactaaaaagacacataccaaatctctgataattgttccttctgggagtgttgaatgataaaaaaaaaaggatttcacctttatcaggaatgcttcattatatattataatagttatacatataaacacacaccagatgatagcttcaataccctccagttttgtgcatttgatatatgattccttgtgcttttaggttttcttaatgttactcaaagaaattggagaaataatttttaaaacaagagatttatttgaggagcttagagaaggggaaaagtttggatatctaatgatttttattttaaggtcaaggtatgatttgactttgctctgtaaagcaattttcttttctccgggagaatgtttgcagcaaacatttattaattagctaccatgttcatggcccacagaactctccatggtactagttctctaccaggcacacaaataaatcctcagctaagtaagtttatcttggatgactttttctctcagtttgataagaattcagcttgccatcctctggcctagctgagccacaggatgttgaaagaagatcaatgctgcctggtaagtacattcagaaacacaacttcccccagatattccagtgtttctgctgatgcccaaatccctaggtcatgtcagctatgaaaacatcagcaaatgtatggagtattaactggaaaggagtgttgttgcttcttactttttataagcccagaagattccaagaacagggaaaatatctaaaaccaagtcagaaaaggacgtaagtgcagagcccattggtgactgccgttatctgctttgaaaccccaggagttggcgatgttgtttgcaaggagacagctatgcttcctttcttgttttagtcttgggctgagacaaatatgacatttcctagatttggggcccagagctacagaaaacatggccccaaaccaaaaacttcaaattttaagtcattcatccttgaggaatatgctgatacctcatttaccccttgtgactcctaaaccctggacatacctttttatgctattaaaagaaggcttctagttttgtttactccagtctcctagatgttgtcattccccttgaatctcctgagaggctggagattatatttggtctggcaaatggttttctttctaccccctttctccttacatttattgtaaaaatattttaatagacaatacatgtatatggttacaaaattaagcagcatgaaaaggtgcacactgccatcatgaatactcttatcatcatcatcacctttattggatagtgaaaagtctgtggccgggcgcggtggctcacacctgtaatccaagcactttgggaggccgaggtgggtggatcatgaggtcaagagatcgagaccagcctggccaacatggtgaaaccccatctctactaaaaacacaaaaattagctggccatggtggcaggcacctgtaatcccagctactcaggaggctgaggcagaataatcatttgaacctgggaggtggaagttgcagtgagccaagatcgcgccactgcactccagcctggcaacagagcaaaactccgtcaaggaaaagaagatgagagaagagaagggaaaagttaagtttgcatactaaacttgctttctggttgaccagttctccttccctgaggcaaccactgttacaagtttctttttcatgatttcttgtggatttattcgtgttattcacgatatgtgtgtttgtcacatgaatgatggcaatctacacatactgttttgtaccttttcttactttgtaatatttcttggagatcatttcatggagatggatgttggtctttctcagttttttatgtgttgcctgataatctgtggaaaaggttcttctccactgccctgttggttgacactggggttgtttccaaacattcatcgatgaatcagtgctacctcgaataatcttttaaccatgtatgcatctttattttcaggtttgagtttatttgtaacatatgttctgatgactgcaactgcaagaccaaattatatgtgcattttaagtttgtctagatgtaaaacattggcctgcaaagatattatatcaacttataaaaagaaaaattaatggcagcactgtttgtcaatgccctcaccaaactaggtcattgacaattctaaaagatgggtctacaagggtagtgcttaaaaacatcatttttggtttaggttcaagccatgtttacacttgaaatggtatgatatcttacatggtatgagagtgagcaggtgggggcatatctggaaagagatcagtgtgctttggtagttgttgaagtgaagctgagtgatgagtgcatggtagttcacgtttccatgctctgtacttttgtaggtgcttactttttttgttttgtttttttgtttttgttttgagacaggggcttgctccatcatctaggcaggagtgcactggcacaattatggctctttgcagcctcgacctcctgggctcaagggatcctcccgcctcagcctcccaagtagctatgattacaggtgcaccacactatgtctggctaatttttaaaaaaattttttggcgacggggtctcactacattgcccaggctggtctcaaactcctgggctcatgtgatcctcctgcctcagcctcccaaaatgctgtaattacatgtgtgtaccattgcgtccagctctttttcctttttataacaggaatgtccaagccatatatgaaacagatccgacccacataataaaaatatggaccataaatcatcacgagttgttttctccttgtatttagcaaaagctcctcctgtgctcatggcaggctgagtgcctggcccgtgtcttcgtactctgcacagtatccttgtgaggctgagatcagtgtttttatttctgtctcacagatgagaaaacagtggtccagagagattaagtaggtagcagaaccagggaatgcagacttctcacaaagcaatacactgcttctgcctgaccatcactttgcctggctgctgcctctttggctaccatctgtctgccagtctctggggacactagttactctgacagtctagctaccagataggctccagtaagatgggaaagacctggatagaaataaaggcattctatgaacattacaccagcaactctttttaaaaaatagattttattttttagagctgttttaaatttacacaaaaatcttacaaaaagtgagttcccatatacctcctctccccttcccagtttctcctattattaacgtgttgcattgtgtgcacatttgttacaactgatcaacaaatgttgatgaattattaactcaagtccacagtttacatcagggcttacacttgctgtttacattctacgggttttgacaaatgcataatggaatgtattcaccattacagtatcatagaggatagtttcaccgaccccccaatcccctgtcctctgcttctgcagaacccctggcaaccacagatcttttggttgtcactatggttttgtcttttccaagatgtcatatagattgaatcatgcagtatgtggacttctcagactgtattctttgactaagcaagatgcctttaagtttcctccatgtctttcctgtctcgatagctcatttctttttattgttgcttaatagtccattgtcgggatgtaccccaatttgtttatccatttacctgtggaaggacatcttggcttcatcccattttttggcatatggtcatttttcagtattttccaaatggttagatttcatacgtgaatctcattgctcttagaaggtcattcagatgtgctcctgacctggacccaaatggcctggacccactgtcatcacctccctgtctggcctcttctcccactccatcttctttccccactctgcagaccctccagcctccttcctgttcttttgtgcaccatgttggatcctgcaccttcatccttttttcttctttttattcagaagactctcaccccaagtcttctcacatccagatctcagctgaaatgacacatcctctaagatgccctcctgacccccttactgaaagggttgcatgctgccaagcaaatgtccctcacagactgctctgggatttcctttactgcacttttcactctctgaagtggccttgcctgtttagctggccatcatctgtcccccacctctggaatgtcagcttcgcagagggagggaccacatctggcttatccctggctgtatcctagccctagaacagtgcctggggcctcacagaatatttgctggataagtaagtgatggattgattagtctgactactccagtgcttctcaagttgatggctttccatctacacatattgtattcatccgtgaaaagagagaagaaaccaggaaaagcacatctccaatgatgagggttatgtctctggcagcctgtattttggacctgggtgggatcatagtgtgtgttcttgtagcttttgcctgagtttcgtctacatggccctacttatggagtctaagatggagctgacagtgatgtatcattctaaacaagcgtgttgttgcaagaatccatttcaaagagatcctcttttaaatgctacttctctcccttcctcttcatctattctagcctttgaaaggtgtttatgttgattctgccattctccattcctgaggcacagataagcatcataaatatgttagttttgaacaggtcctgaaatttgccgacataattcccattttcttgtcagtacttccaagcatgaatagccttttttttcggtatggtgaattatctacagttagggatggtttaaaggtatttttatgaggacgtttagtcattgggatcacttgttcctgagtcatgcatttattttaagtctaagtcttttgaaaggtcatttagatttttcaaaaatagtagtcgtatcgttgtctcatattctttctccttgcccattttttgcttttaacaaaggaaattattttcaaggaaagcatcttcagataatgcacaaccagcccaggggaaacctagctttatagacacactagtgagatcgttgtgtaatttgatgggggaaggtttgtaaggtttgtgttctgtgtagaaaatggtgagattttaaaccaaagtttcattccagttatgaaaataagacatgtgcatgataaatattttcagatcagtgaaagaaataaaataatttttacccatagttcttctagatatcattaatattttggtgtatttccttggggtgtgtgtgtgtgagtgtgtgtgtgtgtaatttcatcagactggaaactctgagcagtcagagttcttgtctgtcgtcctcattgctctatagagagtactcctgagaagacactcagtgccaatttactgactgaatgaaagttaagtgtgtgtgtgtcacatatttcaaaacaaagtctagatagttctctatatttgattttgtgtccctccagcaatttctcatttttaaatttttctttgaaaacatgatttctaaatagtgggctgttatttcatgggatgaaaagttgtgttggaaagccccttcacactggaatctttgaaaccatcttcattcatttctttacaaaaaatctttagcagtgaaattcttgggttaaagggcctgaacactttaaagactttcatacatttttgctaagtaaccctccagagagaagggaacaagtggccttcccatcggcaaggaataaaatgacccatctttttatgttcccattaagagtggctttaagggttctcttgtaatgatgcatttttgttgtctacattagacttgttgtccctagtttcttagtagcattctgattttgctatggtatgttttcatgttcagaagtttgaaaaattgttaggtcaaatttagtatttttttctttaagacttcattaattgctcctatacttaagaaggtctccatcaccaagagaaagcaacctgctttctctcctggattattttcttctggctttcttgtaggttccttttctttccacttcagctcatgggaaatgcatttgaatgtgaggtgtagcttcctgatcattctgggtagcccagtcactcagcactctcctgagaatagtcttttttttttttttttttttttgccactgattggaaatgcacgtcttatagtattcccattttttacattatactaaattctctttctggactttttattttatttgtctggatctgccatgtcttcatgttaactgttttgataactacagctttattatatattctaatatccagccaaacacctcctttattatatttttttcaattttgagagccattctattatgtgtatgctacaagaagaatattatgagttatatcagatcagattataaaatacaatgagaattacataaaagttatacaatcattttggagaactgatatttttaccaaattgagtaatcccattcaaaagcctagtatgtctgtcctagtatttaagactttctcttttttttttttttttgagacagggtctcactctgtcgcccagactggagtgcagtggtgccatctgggctcactgcaacctccacctcctgggttcaagcaattctcctgcctcagccatccaagtagctgggattacaggtgtgcaccaccatacccagctaatttttgtatttttggtagacacgaggttttgccatgttgcccaggctggtctccaactcctgaacaaaaagtgatccgcccgcctcagcctcccaaagtgctggaattacaggcatgagccaccactcctggccagtatttgagaattttaaagtcaatataattctaagtttaaacgttatggtttcttcccagggagcacaacaatttattacgagttttatttctatgtgtttaatgttttgcattggttattgcagatgagatttttgttttcctgttaaactatctggtgattttgctaacactagaaaaaaatactaatttggattcattcattttgtaaccttaaaagagtgattcatcttactctcttagtatttatcttattacttattatttaatatttatgttaaataccctcttagtatttaaataaaatagttttcaagttggttctcttcagttctctgagtgtagattggttcatcagctgctcaaagggtgaacaatgaaaggggtgcttcctgtgaaatgttcccatggggctcatagtgcacctgagccgagacactcctggttcaagggcagttctgctgccctctgtctgtggagaaggcttgtctgttgaacctctcactgccatttcccttcctgcaggctgtgagcccaagaatgaagggctgctggatcactggtctttctgttttgctgtgagaggaattggtggtggccccctcatgcttggcctttgagcctgaggagggacgaggatctaccctgggtgtccagttactctttgagccaagtggtggatgaagactttgggggtgtggttgactcagaggccagagctgaagtgagcagaaagagcccacaccaccttccaaagcaccaattccaagtcagcaggtgaccttccagaagaattgtgcaataggctttaacttttattgtgcaaacaagtttctcacataattaactcaatggcctccagatgaaaacagtgacattaagaccccactggcttcctctgaattccctgacgaactcaaacttttcccatactggcctgtagtatctggatttctgcaaaagacaatagggttgattttggagtttcagactgtggaactctgtcctagttaatgagaagagtctgataaggccacccagagggcaagtgaggtctaggacgctgcataaacaaattaggaaatgacagagaggcaccaaaactgcagcacgtttcagctgtgtgttcctttctgtgtctctctgattcaatgtggccagtgttttctggagacttttgcaaaggtgggaatggggacacatggcactgtgaccccatctaggtggttgggcctggaggctactcatcaacccaccacccagagaacagaccatgcattcccagctcccaggagccagtgctgctcccggttcctgcctggatcacattagtgttcatggttgttaagcttgttcctataaagagagccctctccccaagagctggtaattggggaaagaagggctttttttctgctttgcttgttccaatcttgtgtttttgcttagaatatgaacacacatggtcacacacatacatgaaaagccagaacaaccagaggaccttctgtttgagcacccagactagacgcacagcagggaaaccatgcccagcctggttccctggggtctgggctcttggttctttcctttgcgattgaggaggaggcaacctgctttctctcctggatttaaaacaccctctacctctcaagtcctcacatcatctgtggaccttatcctcagtgcttctctagaaatgtcttattgttttctaactaaagagaatatgaaatttatttgcataaagaatcttttagtaatgagtacaggaaaaaaaatagtccgacttgagctggtgtaaatgaagagaggcattgattggttcaccgagctgaaaagctaagggcatcaggcaggtggctgcattcagtgatgtggaccacgccagcagggctctgctgtcttgtgcctggctctgtgtccatctgatttggcttcatcccccatcaggttctccccataagggaggaaatgactgtgtagagcccctgactcatattctcatagcttagcaatccttacttagtgatacggtttggaagtttgtccgctctaaatctcctgttgatttgtgatccccagtgttaaaggtggggcctagtggcttggggccctccccatggtgatgagttcctgacagctggtagctaaagagtctggggcctcccttcttctttctctctcttgctcccactctttttttttttttttttttttgaggcggagtctctctctgtctcccaggttggagtgcagtggcagtggcataatctcagctcactgcaacctctgcctcctgggttcaagtgattctcctgcttcagcctcccgagtggctgggactagggggcatgccaccaagcctggctaattttgtatttttagtagagacagggtttcactatgttgcccaggctggtcttgaactcctgagcaaaaaacgatcctcccacctcagcctcccaaagtgctgggattacaggcgtgagcccccttgcccagctcttgctccgactcttgccatcgaacgtgcctgctaccccttcaccttccaccatgagtggaacttcctgaggccctcaccagaagcagacatcagtgccgtatttcttgtacagtctgcagaaccatgagccaaataaacctcttttctttataaattacccattctcaagtgttcctttttaacaatgtgaaatggactaacctgggaaaacacatattttaaattttcctaacagttccagaaaaagtcctggaatggattctcattggcccagcctggtcacatgtccatcccctgaaccagtcatggtggccagtgaaatgtgatgctctgatttgattggccaggcctacctctgtctgtacagctgggtcactggggtgacagatgggagcatcagctccatccaagccaatggactgctgatggggacagggggagttcatcaggataagctgggcacgtgctactgtagtgatctgaacttttgaggggctcacaaccatggtgcctgtgtctctctaattcggcatgttgatcatgggatagcaaagggacgctgcttatggaagttctctgggcaccagctggaccgaggcaccacatccacatatcctccacaatcacagaggcaggaagggggaacatggagaaccgtgccctggctgggaaagcatccgcccagaaggggcagatgccacttgcactcctattcagttggccagaataagtcccatgtgcaggcctgggttctacaggtggggatgtgtaattccctcccgctgagaggcacagagcatttgtgagtcataatagagtctgctttcggttgccctgctggtccccagatatttaggtcctgcttcatgggagacagccccaaagtcccactcagtcactactcacagctcattgtctaggatctttgggtgatgaatcattatctttacatcgtgtttggacatggctcttctttattcagagacttatgacaagtgatctgcccccaccatcaaacacctaagatttaatcttgaaacagggataggataactgcagtaaacgttcagaaaagggacgatgaactgtcaaatgatcgctaccctgaagttctcccatgcaaatacagtgacattcccttctctgggggaaagagagttccttcattgagctggtttggctccatgggactaccttccagtcttcattggccttcttcattggctttagcgccacctttctgaagtcttccctttttggttatccttgctggcggaatcaaaagaagatattggaagacatgctcttcatagagtatgagcaggtgtctcagcctagaaaaatggagacccagggattattttctacaacgttcagtctcttttattcaatctggtgatggcttggacaataaaaatctctcaaaacttttttggtcccagttggcttcatctgccaaaacacacctacagtttttctgagatgtaccttttccatagatctaagaccctgatcttgtcaggctcccataaaagagctataaccatggtccctttgccaatgaattttgtcctagtttgctaacaccacataaatccatttgggatttttaaccacaggtgtgacagcagaccaattctaaaccaccctttgccagttaaaacctttttggctttcttttgttgcttttctcattggttctaagaagccagggttttttttccaatcttacaaaactttgaagttctagattctcttttatttttgccagaccctgttatctgcatagacactttcccagaagtactggttatattattgaataaagagagtagtttgttaccttcatcttaggaagggcaatttggtgacttcaaatgtgagagttagcacctacttgggagtaggaattgtccttagtatgttttaggaagaaattagatttttcatgccttgagcctcccctttgtccaggatgcatgaaggacctgatgggaattctgggtggtgttgggggagatggtgcaggtggaacactagtttcctgaggttgactcagcactttccattctgctgagtcagagtctcggtgccttccttgattaggtaaagccatcccttggcatctctgaagtgcagcttataggctacttgtagtgatatgggacatggtcttttatggggtcatgtgtattttgtcatctggtccttttgcagaacctgttgtgttctgacattcctgagttggcagaggaaaaaatcaggtctcagggaacatgttggtaagtggcaaagtcagggttgttgctcaggtcttcctggcttgaggtcttttcttctttctatttttgcagattggtttctggaaagatttatttaaatcctctctagttcacccctattcttgaatcaaaaggcttatcttaacaagcacaaaaagccccatttattcaggtattataaacaagaatggaaaagatagatgtggcctcatttactcatcccattctcctgctttttatcccacaccaggagtctaccaggctctaagcagacctcaggaaggatggggctgtcagatgtgagatgttagtggtcctcattggactgtgactgggtcctggtttttgaagcttgttttgtttcttgggaggcagcaataaggtcaagctggggctcaaagcatcatcgtaaccagcaaaatggggaccacagcagcgagttcactggctaggccctttaaaaggcaggcacacactttcaaatttcccactatttttaaccagcttgcttgcttgcttttaaattcatgtgtggttcctggaggcacttgacctctttctacagagccttcccctctgctattttaatgaacagctgcatcaatgactccctaaattccaactgcatcttcttcatcctcattaacctttaccttggcattcaagcctcttccaggcctcctcctcctttttcttcctcacctctcttaccatggctttccctcacccacttcttgatgttcctgcatcataccttcctttatgggaatgttctttgccacctgtcaggatcctacccacccctcaaggtctggttcaaatgctacaccttcagaaagattttgggggaaaaataaagtcttttttctttttgagtctaaaagtattgcacactcattatagaatatttataaataaaattaaagtcattcccagtcatatcaaccagttaatccctacaaatatttgcatattttcattcatctttcatgtatacatatatacagaaaatatttataatactgatgccatattgtatatataattacatatcccaattttaaatatagcatgtgtcttgaaaattttttggtatcattaaatgtttttcaaatacataattttcactggatacttgaaattctgttctacctctcttctacaattatgtaaacattcctcttactgtttggttgtttacattgttgtgcgtaaggctttgtctctatctctgattatgtatgtagaaatataagtatttttgaacagcgtaaacttttttaagctcttgacacacattgccaaacgttttctcagaaaggtggtatttgttttcactcccatatgtactgtaagctcatctttccaaatcttttccaatctgatgagttgatttttaagaaatcaactaccagtttggcaaaaatggaaactcattacagattcccctcaacttacagtagggttttgtcctgataaactcatcttaagttgacaatatcatgtcaaaaatgcatttaatatacctaatctactgaacatcatagcctcgcctgtcataaatgtgctcaaaacacttatgttagcctacatttaggcaaaaatcatctaccacagcctattttataataaaatatcaaatatctcatataatttatcaaatactgtttaccccgtcaaaattgcaatggtttcacgccattgtaaagttgaaaagtgttatgtagaaccatcgtaagtcagggatagtctgtatttaatttgtttcttttggggtaacttgtagagtttaattttcttttttaagttgtttactgctatattttttcttctgaaaacgattgaaaacatttgtactcttttcaatggggttaagagaagaggaagattttgtgcttcttgttcattttaaagaggtctttatatattaaggacttttttttcattgattgtgaatatattccagagttcattattttacttttttatatgaattttgaatgaaaagttttaaaaattcttatgtaatttggactagccattcttttgttcttgattggttctatttcttttaagcttaaaaattttatcttaaccctgaatcagtttttttccctagattttctacaactgtacttttcaaattaaactgaaatctatcttagtgggggtatgaaagatttccagtgtgacttttccccaaatatctgattatgattctgctatgcgttgcattgttgagaaatgcttttcccattggcttatggtgcttttgttcatcttgacctaacctatcccatatttcatgtagatgcaccccatgatctgagtaatgacacttccactgtggccatgcagttttgattattatagctttgagatgcatttccaggtctgttagatactcttccttgtcatttttttatactgtggtcccctcccagccataactttgcacactctcgagagttccagtgactgttgcaaatgcctttaactcttcagctcactgtgaacttcttgaggacgggactcaatttgtcctaatcaactacacatcctctgtatcatagcccatcatagcattggccagatagaattcactgaaaacacatttgttatgttgattgtgcaatttctttctggtcattttctgggtgacttgtatttttagaaaacctacaatcaggtgtattatttgattaaatttaggaaagaaatatatgctgtatttaattggcttgtgtttctcagcttcaacccaagttaattcaactttcagtgttgtttgtaattaccagacatttagtacattaatgaagacttctttccagtagcccatttatatttactcttgaaaaatgatttacttttgatttcaaaccaaaaacattatcattctaatttctggattctctcatttctattttcaacccaaaacattccgttgagatatgaaataatattggatcagcctggaaggagaccttgggtgaacaaagcgagtttgcctcatttctcacaacacggtctagggtctgagttctcattttgaatcagggtggaggtgggaaaacagctctcctgggtgcctgttgaatgtgtgcctttttgggcatctgtttacattcatgagggtccacagaggcccagagaaattccaactacttgagtttttttttctatctacattttaacacttaagtcgattcctggacatatctggtacttcttgtgttttctactaggcataggacattactttgcacagagcaggtgttcaatagacacgtttcttttaatgtaaaaaaatttattgaatatgaccctcacataacaaagcagcccagtagtccccttgtgtacccccacccaggtattcccagagagaaccactgtcttaatttacatcgtcttgattagttttacttgtttttgagtcttacataattggaactgaacaatatgtaatgttttgtatctgtcttcttttgttcaacattacatttctaagattggtccatgttaccgggtttgataatatttcatcattttctttgctgtatagtattccaatgtgtgaatatattctcaatttatccaatctactgttaataacatttgtgttatttctagtatttggctgttatgagtgatacctctggtaaccttcttgagctcgtttttgtcttttgctttttttttttctccttttttggtaaagaattgctgggtcatatggcttgcatatgtttggcattagtagatactgtgaaacagtattccaaaatgtttgaaccacggtcaactcccacagcagcatggaagttctagttgctctttaatctcccccacccacccttgatactgtcagctttttctaaacaattttagacatcatgatacttgtatggaaatattgcattgtggtttaattggtatttccttgaaaacgaatgaggttgagctcctttttattttttcatggctatttgtatgtcttctttatgaagtacctgttgagttttttgaaagttttaaaaattgaattctaggaatttaaaaaatatatattctggatatgagtctttggttgaagttcctcaatgtgctttgcctttacattcacttaattatatattttcaggaaaagaaatatttaattttaatgtaggtccatttagcaatcttttttcctttttgtatcttatgtaaggagtatttgcctacccacaaaccataaagcttttctcctgttttcttctagaagtgttatttgttttgctctgaaatttggaatcagaattaattttatgtatggtatgagggagggatcaggaatcaattttcccatatggatatcccattgatcctccaccatttggtgaaaggaccattcttttcctactgcacagctgtgttcttttctcataaatcagtcagtacactgcgtgggtctatttctgggctccatgttctgttccattggcctgtctgaacttgttccaatagcacatcatcataattgttggagatttaaaatcagtcatgatatctgatagtggaaatcctaccactttgttttttttcttcaagatcatcttagtcattcttggttctagacatttctatataaaaatttgaattaatttacacacatacacataaaccttttgtaagttggattggaattacattgaacttgtgggtcaatttaggaacaaataaaatctttaaaacattcagtaatttggtctgtgaacatggtatatcccaccttgtatttaggctatttttcttttttctcaataatgtattctatgtataggtcttatgcacatctttggctagatttattctggagtattttatgctgctttaatgacatttaagttatctcgtttaaatataattttctaattctttggttctggcatatagaaatacaatttatttttgtatatggacttcctatgtaagaaacttgctaaattattctaattaagattattttggattttctaaaaacatttctctggagaaaaaaaggaaagcttcattttttcctttccgatccttaaacattttattccttgttgttctggttaaaacctctaatacaattttaaataaagaccttcttgtctcattcccaatctcggagggaaagatttgaatatttcatccttaagtatgggtttgcaatagattttttgtatatattcctcatgaaattaaagaaatttccttttattcctaatctgctggcagtttctaatcataagtgtgttaggagttttatcaaatgctatctctgtatttgtggaagtgatcctataacttttctaatttattctgttaatgtggtgatttccactgattatttttaaatgtcaagctaatcttgcatttctagattaaacctaacttgttttccatgttttgtctttctgcatttctctgcctctggtttactaatgttttctttaggatttctgtatctatggtcacgaaagataggcctgtcattttcatttctagtgatgcccttttctggctttggtatgaaggttatgctggcctcttaaaattgattccctcatgttttttattctctctgacacttgtgtaagactggtattatttcttccttgagagcttggaggaatttactgtggggcccatacatccttcatcagatactcaaatgtttagaagaggtgacatcctttacgtgaggttccaagttaagaaaaaaaatgttaaaggtagaagcagaggtgcctgtccatattttctcctagtgggaatgattcatttgtatatttatttattcagcaaaaaatatcctaaatgtttgtagcacaccagacactgcagcagttaaggatacagcagaagtgaaacacacatgcctgccttctaggagttcacattctggaccaaggagtgttttctattccagtttgagagtgtgtgtccatgcacctggctgtgagctctgggtccctgtgtgctggccctgcccctcctctggctcatggtgctcactccactccagggctccaccccatgttttcagtctccacccagacattgcttcgggaccttcagcaatgaggttccctgcccctgctttgctcttcccttcaccctttgtgtgtgtgtgtgtgtgtgtgtgtgtgtgtgtgtgtgtgtgtgtgtgtgtgtgtgttgtgacagagtctcgttctgttgcccaggctggagtgcagtggtgcgatctcgatctcagctcactgcaacctctgcctcccaggttcaagcgattcttgtgcctcagcctcccaagaagctggaattataggtgtgtgccaccatacctgtctaattttcatatttttactagagacggggtttcaccatgttgcccaggctggtcttgaactcccaacctcagatgattcacacacctcagccacccagattacaggcatgatccactgcacccggccctcttcactcttcaactgagagtcctgctcattattaatgtcactttttttagagaggactttcttggtccctgggctaaaggagattctccagtcccctaagctcagagcccccatgctcttctctcctagcatttacatgttcataattcacacatttatctgtatgattatttttgttttaatgtcatttgttgtcaccaaattgcgggcttcatgatgaaaacagttgcacctcttctactcaccaatgatactcttgtgcccaatgcaaaaccaggcacacagtaggtgctcaataaatgcgccttgctctccttcctttctaaagggttccagaaggccattaataggcaaaaaacgcaagcgtgggtgaaggctgaatctatcatgctccctgatgggtccccatgcccagcactgggtgctctcttagtgttagtaaaatacatgaatgaatgaatgagtgaattaatggatggatgaagtgcaattgaaatttattatgctcataaacacaaaaattaaatagatttactgcattaagattattttaagaagttgttttattcctacattcattttgtttccaacacaaacagtacataaaaataattatttcttggattcatgaaaaattgaaagggcccttgagtgtttatttagtgtattctttttggcagaattaatgatcttaataatgaaaacagcactgggtgacttttttaaattgaagtttttattgagataattgtaaatgtgcatgcagctatgacaaatggcagggagatatcttgtgtaccctttcctcaattttcccccagtgctaaactagaatatacacacctaattgggatactgacacggatgaaatccactgaacttatcccactgtctaacttaattcacatttgcagcactgtgctgagtgctttatctcatttaactgtgacaacagccctgtaagggggatagcattatcactcaggttctagagcctgggacacccgtgctcagagaggtggagcaactcgctcacagcctggtgcatgctcaggggtggagctggaatccccactggaaacccaccccccagcccgtgttcttcctggtgctggcgtaaaccatgatatatagatctgttccttgttagagatctctaaagaagaaaactacttgcttaacaaaaatgactttgctatataaaggtgtggtttttttgactattcctccagaatggcattttttagaagtctgaagtctaagaaaacctctgcaaaaattcaaggcacttaaatctttgatgaagcactcaaatgtattcatttatcatccagtctttcagtttcattgtagacagatttatgtcctttgtgatggtagctccatgtcctggaatggacctcccatccaggttcacagatacagctaagaggctggaaaaggtcgcaagtggaaggaagcttgggtttgtagtttcctcacatattcttagaagctaggggctggggaaacccagaagttaggtggtcaagggcaaaaagattctcccttttctgtctttcttccccaaaccttgtcacatggaagatttgaaatggctcccccaggcctgagtcctgggcagctgtgtcactgttggtgcccacctcccaggctgcttgctctgccctgcttggagaatgacaacttcttaagttgccacacagtacccagagccaccagttcctctcctggttgctgtgtggctgagactgaccctggatcatgaggcatcctgctgcccagcccatcatttccatctggtcctgttggggaggaagaaaatgcagaggcaaatgcagatgcagtatctgtggctgggctccagcaagacccctccaaggtctctgaccccagggccagtggtttcacccacctggaccatctacaagggtcaaatccagtgtgtgcagtgcctggaattagaggaaagagacatgcaggtacagcatcgtgaaaggccccttttgatgctatagaaaaaaaaaaaacctccaaaataattttaatcatgttcctatctttgtttatatttcattatggaatgagatctggttttgacttatattaaggtgacctgtttgaaattgccaattttgtgggtcgatgacagctgaatattggcagttttaaatggttcaatctaatgcgagttaaattaaaaccttgaggaatatgcaacttttcactttacacggctctgttttaaaaagggtgtcaacatatttcagccttgcggagatggcggcgtatgtctatcctgtgttgcaagcagctgtgaatggttgcgtcgttttgcttggcctacgcatgggcgtgttgtcaccagaaagcgtctctgctcctccaagtggtggcaagcccctcctgagagccattcctcatccagacaagaatccatcagatcttatgaaaatttaatgtgtgaaagtgtacagttgcatgagggtttttttcttttaaataaattagtttgcagcccttgctaacaccagatgaatgaattaagaatgcacctcccccggggctgtcgggctgctaaactgcatgctggggcgaaattccctttctcttattcttagctttttctttttttttgaaacagaatctcactctgtccaccagactggagtgcagtggtgcgatctcagctcactataacttccacctcccgggttcaagcaattctctgcctcagcctcccgagtagctgggattacaggcgcctgccaccacacccggctaatttttgtatttttagtagagacagggttttaccatcttggccaggctggtcttgaactcctgaccttgtgatccacccacctcggcctcccaaagtgttgggattataggcatgagccaccgctcccggtctcttagcttattcttaaggggaatttcctaccttttatttttcttcttgagagagtttcaaatttgccagaacctgaagggttgttgtgctttcagccaaaaggatgtctcagtagcctttagcccaccttcccccagggcaatggtagcatggaacatgcaacccctagcttacttgaaagattggacttgaaaaaaatcagcagttccttctggaatctgcaaggattggggaatttgaaagattcaggggaattagttcggcttcccaaactagttggttttagtgaccccttcttcttcccgttgcatcactggtgtgactgatgttaacattattgttgccccgttttacaaatgatgaccctggaaaggcttggagggccctggggctgcctaaggtcataggccaggaagaaatggagcctgtccgagggcttgcgtctcctcattctgaagcccaggctttctccatgttttcaaaatgccagctggttgcattttgtttttccaaatgatattgtagatgccagaaagtggggcctgtgtttccatttcttggttttcctgcccttccagctctctcataggaggcatatgatgagcacagggaacaggcatctgtgctgggcagacctaaaacgaggaaggggcaccgtgaccagttaccttgcggtgtggcacagtgctatcttgaagaccataacatctctcgagcaggctagcatatctggtccgaaaagtcgccatttctttgggtgggcttgtacaaagtggtccacatctcacagggtggtctgctgggctctgcaggcccgtgttgtgtccataatacatgatcaataaacacaaaagctgcccatcaatgaatccaggtgttcacccggatgggcgtgggaaactcagacaggcagaggccacgggctcttctgtctctcaattcctgtcccctttgcatactgggggggcacttgctgggggtagtccagtaattttatctcatggtgctccaccagagaccatggtgctgatggcacctactaagcgcaacgctgtgcttgactctaccctctgagtgtgcccactcagggctggtctccctcatgcagcccgaggcctcctgccaaagtccacttcaaggggaagccgaaggtgcacacaatcccctacgtctcctttgatccaagtacatcagctcttccaaattgtgtttgccgtgcattttttttccagaatcctcttaagaaggatttaagaatcttgccaaagtggccacttctcctaaaaacatctaacccagtcctcgcagattccagaaggaactgctgattttttaatttatcttcagtcatttgctttcggaagggaacatttattgtgttgaaaattaaagacttgataaaaaatgtttgctttttgtggtgtccttgaaaatcgagtgattttcacccaggatttctgtagtgggtgtcaggcaccgtggatttctgtactgggtgtcagggaccgtggtacaccacggtgcttagaaaaatggatgatggaggtggtgctgtggctggctagcatttattaacattgttattgccaggcaccatgtcaaccctttcctatgcattagctcatttaattcttacagccactatttgtggcaggtactagtattatccccattgcacatgacaggaaacggaagctcagagaggttatgtaacttgcccaagtttgaacagttaataagagcttgcattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctgggtgagacatgatgatggggcgatggtgggggatgtggcagcacaaagcaactttgtccactgatgtcgggaacgccttttgaaggaagaaaagtgtaagttgttacccagagtagaagatggccaggccaggagttgggaagggggttctagaaggcaaagtgcgtgtaaagttcttgaaactagagatacctaaggaatctagatgaggccagtctggttggagcaaagggtgatgagtcgggaggctggagagtgacaaggaccagattgcgtggggaggatactgctgcctgggggcttcccatcctgagggcggaggaacttgaacacagtagttatttgctatcaactgaaatgtattgagcccctgctgctctgtgggcatacaatggttggacaaacagacaaagtccccgttctcaaggaacttgtattccaacagaaaagaaaagaaatacacaagacgacgtcaaagagtgacaagtggcccaaagaaagtaaaacaagggcccagtcagggtgactcacgcctgtaatcccagcactttgggaggccgatgcaggcagatcacaaggtcaggagatcgagaccatcctggctaacacagtgaaaccccatatctactaaaaaatacagaaaaattagccgggtgtggtggcgggcacctgtggtcccagctactcgggaggctgaggcaggagaatggtgtgaacctgggaggcggagcttgcagtgagccaagaacatgccactgcactccagcctgggcagcagagtgagactctgtctcaaaaaaaaaagtaaaacaaggtggcacctcagattgaactgaggaaggtacaggaagccactacagtgggtgggcagggtgggcacctctgtgcagtgggcattcaggggtgaggagtcagcactgtggcagtgttgggagaaggtattcctggcagagagggtggctgattggaaggccctgaggcagcaacaaacagggcacgatcagggacttccctgtgcagtcagcgtggctggaatggagggagcatgatggagaaggcaccaagtgaggccagaggctcctcagggggtttggattggatccttaatggaggggtgggaggatgccctggagggtttcagcacaggacggcaaggcctgctgtgcattgctggggatctctttgcttccataaggtcagtggaccgggaagtggccagaatggcagctgggatgggcaggggatgagggggacactcttgccatcatgcatgccacacatgatggggagtgggcttgaggggcagccatggcggaagaggagccctcaggggtttgggagaggttagcaaatactcatgcttgttttgggaggagcctctgctcacggtgggggcatgggggtggtggtgagcaccgcagcttgtaagaggcaagcttgtgtggctgctgggtcccacgtgctatcagatggactcctatatggtgtgctgggaaagacgccctgtggctctcaaccagctcagcctatggccctgagagaggatgtgggcaggccctgaccatcttggttttcttccctttttttcttttttatttatttctctttttctttctttctttctctttctttctttctttctttctttctttctttctttctttctttctttctttctttcttcagctttattgaactataattcacatattatacaattcacccttatacagttcacagttctgtggtttttgctacactcacgggtttgtgcaactgcaccacagtctaattttaaaacactttcatcatcccaagaggaaaccccatgtccattaagtgctccctccccacttcccctttccctacccctggcaaccgtgaatctactttctgtctctctggacacttcatacaaataggatcgtacagtgtggggtgtgctgtggcagggttgtttcacctaacaccgtgttttcaagttcacctgcattgcggcattgccagtttagggctgatagtattccatgatacatagaccatactctctttatccattcatccgttgatgggcatttgggtttctttcccactttgtgtctattatgagtagagctgctgtgcatattcacgtgcacatttttgtgtggacacctgttttcagttctacgggatctactcaggagtcagatggttatatggtgacccagtcttcggggcaagctcaggagcagaatcatcgtacggtgactcggtcattggggtctactgaggagtcgaatggtcatatggcgactcggtctttgggcaatggtaaggagtgagaatggtcatatggtgactcggtctctggggtgtggtcaggagtagaatgttcatggtgactcggtcctcaaggtctgctcaggagtagaatggttacatggcgactaggtctttgtggtctgctcaggagtagaatcactgtatggtgactcgatgttgaattatttgaggagttgccagactccttccatgttggctgcctggtctgcatcctccccactgtgtgtgaaggctctgatttctcacctccttgcccacaccttttattgagcctgaacacctttcacatggtcacacctgacctgagcagctgcccggccatagtgccaacacatccctggccacgagaggtggcgcctgggctggccaacgtgcaccctcagggtcgggatgtgatctagagcagggcttctctcattctgttcctgcccatgttcatttcaacccccaaaaggacttgagctctcaggcttaatttcatttacttaatgcatgaaggaggaaatgatttctgaggccaagaccggagtggtccccagggactccatttcaacagtgtatttaaaccaccacgtggaggttgcttgctaggctgggaactgtgatcaaagaacttccaatattttatgttcataaaggcagtttgagagtaatgttttttaaaaaggcatctgaatggggaggaataggatcattgtgaggtccacagtctctttgcctttgaagtttgcaagaagctactgaatgagttccatgctttgtaatactctggtctgggcaccctcaggcgtgcgtggccggcagggacctgtaggaatcctcttcacctggggagatttgaagcctagtgcatataaccagggccgtcacccaatgctgtgtgatcctgggccagtcagttagccttttgcagttagctgatcgttttcacctcagcttgaggcatctctttcaggaagtttctccagttccagtacacgctctcaagcgactctccccctctcctcaaaatgcttacctgcattttcatgatgcagctatgatgtgcaacattcactaattgatgtctgtgaaccctggtggctgtgtgccaggtaggtatgtgctcaggtgtgctgtgtgctcagtgaggctgtgaacccacgtgggtgtgagcccaggtaagctgtgtgctcaggaagctgtgagcctaggtgtgctctgtgcttagtgaggctgtgagcccaggtgggtttgagctcaggtatgttgagaggagggtggatgtgagcccaggtgtgctgtgtgctcagtgaggctgtgaacccaggtgtgctgtgtgctcagtaaggctgtgagcccaggtggatgtgagttcagtgaggctatgcactcaggtggctgcaagcccaggtgtgctgcgtgctcagtaaggctgtgaacccaggtgtgctgtgtgctcagtgaggttgtgagcccaggtgtcctgtgtgctcagtgaggttgtgagcccaggtgtcctgtgtgctcaggcagctgtgagtccaggtggatgtgagttcagtgaggctatgagctcaggtgggtgtgagcccaggtgtgccgtgagctcagtgagtccaggtgggctgtgtgcccaccgaggctgtgagcccagatcggtatgagcttaggtgggtgtgagctcaggtgggctgtgtgccttattgaggctgtgaacccaggtgggctgtgagctcagtgaggacagacaccacacctggttttgctcatgggtatcaccccagtacctggcccagagcagatgattgtcttgatttgggttttggggaggtgaccctggaatgaggatttgagagcaagtaatttataagaaagctgtcccaggagaagctggcaccagtgctgggaaagtggcacagggaggccaaggaggggtagtatcaggcacagctgtgcaggggcagttgcagcctgaccctgagggtactctgagcatgagtgtgtcagagtttgtctctgctgaggccaggggctaggctacattcttgccaccaccagtcattggctctcggctctgtgcaggaggacagagaggctgagaggctgggagttggcctgtaggggtgcccttaggggcaaaagcacatgggagctgggaggctccacagccttggactggaggggtgggcagagcactgacagtatccgcttggggtcaggccatgtggatccagtgttctactccgatcctctccgacaggccttccagaacagggtgtaccatgtgctccagcacgagggagacgtgcttctgatgtcagctatagcagtgcctccagggtcgatggcacgagcccagttgacaatccccacagccagatgctttgaaatatgtgatccttgataaatttttaatttagggtaattttaagtttgcatattgcatgagactttactgctctttgaaatctgcataaatcacagtcatgctgcatgtttgggttgtcacttggcatactggccagctttttgttggccccccaatcctacttctgctaagggctggcctggtgtgtgtgaccagaatgccaggcccagaagccaccagcactaagtcaatgggaagtgctttgctcagtgcagagctgctgctgctggaatcactgcaccacttattccccatgacactgggcctcctcgccaccaggtcaagccagactcaagacgcaggcaaacggaaaaatgcagaactgtttgctccttctccctccctggaaacccctgctcttataggttggctttgttggtccagccccagcttcttgacttggtagggagttccacaggatgaggacatgctttttgtgtttttctttgcactaaactatgtgtaacatcaaatttaccatttcaacccttttaaagggtacgattcatgtgtgccaatcatgctagatataatttgcattttcctgaatattaattagggggaacatcttttttatatgctgttgacggtttggatacctccttttggaaggtgttcccggactttgcatattttccacagggttatttgactttgttcatttgtgggagttcttttgatattctagaaactggactatgtccagttaaatatgttacaaacatcttttcctgcactgtgttttgtcttttcattttacagtgtttttgattaaattcttaatttaaataaccaaagagtacagttcagtgctctgtgcagtgagtgcagtcacattgttgcaaaaccatcactgctgtctaattccagaacctttcatcacctacaaggaaattgtgtgatactcctcattctcccctcctccaagcccctgataactacgcatctactttctgtctgtatgaattggtctgtgctgaacatttcatgtaaatggaatcatacgctgtacggacgctatatggacttttgtggccggctgtccccatgcagcatcatgttatcagggtccctccacactgtagcaggtgtccaggcctcattcccttttatggctggggaatgttccatggtctggatagactatacttgatgtgtccatttgtccgctgatggacatttgggctgtttttgctttaggtcatactttctgcctgatgtaaaagtgccagtcgtgtataaggactgtagtcagcgccaccatgccacagcttagagaagggatgggggaactactgggttgtcagaggcgccgttcttgaccctcagagactttctgtctcctggaggagaagtggctgtgttgggcaggtttgaatcttgagaattcacggtccctgggtttgaggcctcgctgtgccacttgatgccatgtgaccttgggcaagtcacctctccctctgagcctcacttttctcacctgttaaatgaggtacttataaagccgaatagcctaattcaaacattttaagtctgaaatgctctgaaattcgaaacttttttagtgttgacatgatgctcaaagaaaatattcatcagaacattttggatttcaaagttttggatgctcaactggtaatgcaaatattccaaaatcagaagaaatctgaaatccgaaacacttctggtcccaagtgtttcggatcaagaatactgcacctgtaacacctgcctccttagtggtgtgatgattgcgtggaatgagacatgaaaagggctcagcccaaaatcgtctggcaccaaatacccaatggataggggattttgtttattttgttgttactgttgttgaggtaaaattcatatagcacaaaattaactattttaaagtgtacaattcagtggcatttagtacattcatgatattggcatctgccacatgtgtctagttcccgaacattgtcacatcacatccaaaggagatcccatgcccattctcccctcccacatcccgcggcagccaccactctgccttgttgagtggtcttctgtgactggctcctttcgtttagcaccatgatcttgggggtcatctgtgctgcagtgggtgtcagtgctttcttcctggtaagagcgtaacatggtgcagtcattgtggaaaacaattgggtggttcttggaaatgtgaaatataggattactgtatgagctagcagctccacttccgggtatctaactaaaacaactgaaaacaggtattagggggaaaaaaacctgcacacgaatgtccaatagcagcactgttgttcacaatagccagtatgtggagacaacctaaatgcccatcgacagatcgatggattaacaatttccatacaatggactattaccttttgttattattattattattatagctttcttaactcctattgattttttcaaaagtgacctcagctgtcatctcttttccacaaagagtcttacctgagtctggagaccattcctttttctgaccacagaaccccgtcttaatctctgtcctgcctcttccactcattaattcattccctgattccttccaaagtatttgttgggtgcctgctatagacaaggtcactccagtggggagggaccgacaacaccaagtcagctgaaataacagcaccgtggagggagtgtgtgccatgcggagaattttgggttgggtgggagggtgcttggatgtctcactgttgctctgatggaccaggaggagatgtttgcaatgaaacccaagtgataagaaggaggcagctttgcaaaggtggaggagagcctcccttgaggggctgcttactaggatccggaggtggggatgagcctggggaggctgcagagaactgtgaggttggagctgctcacagggagaggtcacagggctttgagggccaaagggaggcctaactcctgtggaagccactggagggtttgaggcagggtaaggcggggtcaggggtgtatgccatgtgacccgaagggagggcattgcgggaacctgggagcgatgagggagacctgggccgggggagtcagggcagggcggatgtagcaaagtcacattgtcctgagtgaccattcacttggctgtccccgctcccaggcctcaggactgtgagggcaggcactgggtctcaggcccagagaagatgctcagaaaaggaaaaggagaccggggcacgagtgagccagtgcagtgtgcagagtgagggggcagtgggcaaagaaattgcatggcccagatcactcactggagaccagagacaccttagtgtcccaggatgatgaagagcgaggggccagagctaggggagttagtgatgcatctgctagccgggctggccctccctgtgggcacagagaaagtggttcctcaacagccatgggtgacctttaaggatgcccacagatggtgccatctcaggagaagggtcccagagggactggctctgtcacctgctgtcagctgctcccggaaagcccgcactgcatgacttgctggtttgttggaatggttccatcttgctgtgtcacttccatgacaatcaccagaggaaccaggcccaggcaaggggcctgtgatgaagcgagcagccctgatgacatcagaaatgcagacagttccagacattcaagcatgatgtccttggctcttgggtgaaaatcctcctcggtgtgtcagggaaagtcattgaattcacgttggacccggacttggtaaatcttcagaagcacgctctattctgcaggatttaagcttcagatgggcctagactggtatgcacaggtagggactgtgcacttgagcacagatggaccttcagcccatctccttttggttctcatatacttgttgagccctggctaggccctcctgagctctgtttcagggcctgcagaggctgctgtacaggtcacacttggtctctgctctcacggtcaagtagccaggatggacataaaactaatgaacacatacatcaagagctaattaaaaattgtgctgaaggccatggtggaaaaataacaggaaacctaacaggtgggtaggaagggtgagaccatgagggatgaataggagttcatcagagaaaagtgttgcctccagagggaatggcacagaaggcagccctattgtgggaaagcacttaatgagcgaggagggccatggtggtagagaagcttaagaaatggaggccagggctctggggttacagtgggggttttatatttcatcctaagagccactgtgatgtcatgtggggagcaatataaggccctgtttgcttgcttgcttgcggggtaggcaggagtggaagcgggaaaccagggcagaggctgcagaactgtacaggtgaaagtgatgctggactgcccccaggggttagaagtgaaatgaagataagagatcaggatccaaaaccatttattctctccctttttcttcttggggcacccagtagtattttttcccagaagacatttcttaaaggatcacttaagccaggaactgtcaaatgcacaaaccaaatgcactttctactagtttttgcaaataaagttttattgcaacatagccatgcccattaatttatgtcccatctgtggctgcttcacactacagcagcagagctgagtggcggcagcagagactgtgtggcccgcaaagcctcagagttttattatttggccccttacagaagacatttgccaattcctgacctaagcaaagtgagtgagggacgcattttcaaaacacaaatctgttggcttaaagtcttcctagcacttaaatgcatttaatccctctgaaaaatgctagagtagacacagtttttaaattgacttttgtttttctttaaccttttgctgatattatatataagaaactcaccttatgctttaggtttagaaagtcagggttggaactcagactttgaagatgttgtgtgatattatttctctaaatttctactacaatactaaagtctcctgatgtgttatttcactttttgtcctttctctgaaatgctcattttcctccttttctgtaaaatataatctcagggaagaagtttgtaaaagcagcttttagcctttgcaaagatataggtgggcctcttgtacaataatttttataagagtttgttctttgcaaatgcagatgcatcctactaagccacatacaaaaaaatcatcacaatgatgacaacaacaaagccaattttccagattccacctttctccttcctcatcctcttcatgtttgaatttgtgctgccaaattctatagagcattttcagatccacttgatttacagatttgagctgaatttcacttggaaaactgaccatatgtctggcaggcaccagcgaccattggcagtactatagggttgatactaaacagatgggctttctagttagatgtgctgttttttccacaatacatatgagaaagaaaagaagccactttaataatgtcttgatttttccactggtgtcagagtcatcaatgatgcccatttatgtagtcttaatttcagcatcattgcgtgcagggtgccttagacagctagaagaagcttaatgacttgggaaattttgaggcccaacttctgcctagatcttagagaatcttgttatctttggaatacagatagtggataaaagacttttatagtccaaaaataaattattaacactatttgtcaggaatacattcaaagttcttagtcctgggtttattgctcaaactatttgacagcttttgtggggttattgcagtctaggcagcaaggtgtaaatagcggttgtctgataggtctgtttaggaaaatctagctaaacaactgaatacgatttcttcctgcagaacttctcagagcctatactatgctaatatgcactggggctctcatgaagagggttttagtacagacagcattttctaactactttaatcctctcagcatctccctatgctagagttccatggaaaacactttgggaaacaccggtgtcatgcctagatggtaaactgaagagcagagaggctgcggcagacctgccatttaccagctgtgtgaccttgaacgagtgctttcgtgctctgagcctctactttttaaatgtaaaatggagctgaaaatataggccctgcctgttagggttgtttgcctggaatgaacatgcagaaggttttggtggcctccctttgggcattaaaatataagttctcctaaaattaagtatttattcaattcacaattttccaggggccaattattcactctgaagcttagccaggcttttgtcttttcttctctgtgcttcttagcacctccactaaccagtaaaggagagaaaggagatgccctttgagttaagggctgctgagggggcagccagaagaagccatggccaacatgaggtctagaggtggctcgggaattgcagttaccttccactgtcgggagtcagtgggacagctccaggccattgttaaaaaccattgccctgcatttgattctgcttccatttttgtatcatgggatcaatccactcattcatttattcactcgctcactcatttattcaacccacctgccaggcactgtgctaggtgccggaggaggaagcggaccctaagtctaggaattgcattgtgcagttgttgaggtctctgtttcccctatactggaaaagtcagcagttagtccatcaaacaagggctataatcagattacagattttgatgaatgaacttgcagggctgtagaaaaaagcctataagcttttaggaatagagccataggcatttagcagtattttcttcccttttttgaataaattcactcctttttttttttttttttgcatccctccctgccctccacccaacaccagcaagcagtttattcctccattataagcagtgtgactataagacacttgtcaaatggtctcactttgtccttggatggtatgacccttgttttgtttttattgatcagcacacccaaaatatcatgctcttcagtcattacttaggaattttctaggggtggaggaggtcaaaccaagaacttttacatttgggagattgaaatctatttctaaaacttgattttggaggttcagctccattctggtggtcactctctgaaaatgcccagcactttttctgtagatggctgtcaagccacatctcttgcagcctggccacaggcaattggattttcagtgctcagtgcttccgtgtgaggttattgtatgttgctttaaaggttaacttcttcctcctcccagccctatttctccttcctcctcccagatcttagacagcagtgttatcatctgctctgtgtcatctagcacaggactgggagaggggcggagttgtcaaagaggctgtggggttaagatcagggcttttacagcagatgacctgagttctaagctccactctgtcgctaactagcatgtgccctggggtaattatttcacatctgtgtgcctccattgtcctcatctgtaatgtaggtgatgaaaatagttcttcgcttgctagggtcttgatggaatacaatgagcaaattcatgccaggtgctcagcactgagcctgttgcacagcaaatgctcagtagatgcttccgttgctgatgacagtgatgacaaaaacaaaccttcgtattccttggctcttccatatgtgtgagtgcccccatcctctgccttcctgccttcagccttgttccccctacagtctgccatcctcaccgagattccacgtggtcttctcacaaggctgaacttgctccaggtccctcaatgactccacattgtccccaggactcttatcacagccacacagctcttcttggtcaggtccccacacgccttcctaagctcacctatgtcaactctgttccatagaccataagctccagcctaagggtcctcaagttccagtgcacagacccacaccagcaaattaagaacactaagagcaatgcagttgggttttcatttacgaatgtagaatcaattaatttttttaagagacagggtcttgctctgttgcccaggctggagcacagtggtgcaattcactgtaacctggaattcctgagctcaagcaatcctcctgcctcagcctcctgagttgctgggactacaggtgtgcataaccacaccgagctaatttttttttccttcgtttttgtagagacagggtctcactacgttgcccaggctgggcttgaactcatgccctcaagcagccctcctgcattggcttcccaagccactgagcccaggcctaaaaattctgtttgtttgtttttttctgagactatattttttctattatgtgtactaagttgtgatgaacatagatgattgctttgtgtagtgtgtgtgtgtgttggccattactgccataatgaacattagcatatctgtgtggatcccaattttatatgtggaaattttactgggtttctgagccttagagactggggacctcagacctagcttccccaaatgactccccattccccaaacaccatgtactgccatgcatttatgaatttgcacgttttactaaaatcctactcaacctctaatacccaactcaattatcactacctactacctcccctagcttctagtagccttcttagagttatcccaccctcaagcaggaaaagttgcttcctctgctattataatcctctttcttgattcttcctggtggttccaggtaccttagttttctcagtggtcactgagtcccccgggagagagggtacctagcaccactttgtccctcaggcctaacactgtgctttgttcaaagacaatggtctccacgtattggtgttacaggtaaggactcaaagaagaaatagaggtcatatctcagcttcttatttgcttctattgtggctcatgtcacattatgaggttgccttacactttctgtgttccttcttttctcctccataaatacatgagcttcatgcagcgggaaactgcaggcatgttgatggaatttactgctctgtcaaaactcagagcagtcctgacacacagcaggccctcagccgatatgatgaatgggtttgtgagtgaatgaataaaacaaacaaggaaaaaattattttgcaatattatctgatagagatggcacctttcttctctaagaaatcagccatgtagcacatggcactgagtacctgacctcactcccccagagatatggggctttccttccaatatgtttttggggaatttcgtgaagtggaaggataagataagatatcttagtggatgaaagatgaggatgaaaaaatacctgatgtcactaaagggtggacatcaaagtcagatggacgaggaacagaccctggctccagcgtttggcagccctgcactccggattcacagggtcgagcaggtgtttatttgggcagcccctgggtgccaggaaccagcaaagatgcgagacccagcaacaagcacgagagtgacggttctcattgtcatggagcttatgtttgttctcatgggaaatgcagatgacagtcaataaatagtgaatcccagggcacaatctgagagtaatcagagctaggatggaaggaaatgtgaataaagggattggccctgcaccaggcatggaaattagcctgtaagctccatgaggtcagtgttccgtcagtcctagaacagttcttgcctcatagctctgtgtggctgttgatgggggaaagggatggagttagttacccagggacaagtataccagctactgtgagcctgagagaggcctgggagagggctggctggagttgccaaagaggctggagcttgtcccttgagttgcaagcatgtgacatcagcaggggagggccagctgccccatccatcatctgaggactgaggctgtgtgtagcacttcctcacacagatgccaggtgtgacagacatttcccattaattaacctctaatgcctcagaggtggcagaggtgcagtggaacctggcactactgttattcagaggctggggggtggctgctaatgtgtttgcaccttccagagtctctccagtgtgagaaggcagttcctcaggaactgcagggagagacggggagagaattcctggagtggggggaggtgctcccatctgtcccttccctctgtggacaggtgtgcatgggccacatgcacccgcccacagatggcatcccacccatgcaggtgcacacccacccacgcccatgcacactggctccgcaggtgctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacacctgccccgctgtacacctgcagtgatgggctcatgtcctctgcccttggaggggtttgtaagtagttttctctgagcagcactattttgaagtttctcttcttgggcggagagtcatagctctcacaagccctcccctggcacagtcctgggcttgagccaccccagggaaggcagaggggagagggaatttcctcccaagggggatgcagagcagcacagcctggggcccctgggcatggggtcttcactcctctgatgacagttgagccccttgaggagctgcttagactaaggcatctgtcctggtcaatgcattggatttttggtttaggagcaaagggtcttttgagctgaagaccctctagtggctccctgctgaattctgaatcaggttcaagtccctgactacgaccctgcctgcctccccagcacatccacgcctctcaaccactgtttcctcctgtcttggacagcctgcccctttcccatcatagcccctgtcctgttccccactggggcggccctctggagcacccagtgctgaccctgtcacagtcggtcagtcgacacctgccctcgaggctccctgaggaggccctgggtcctgtccttcctcgcgtctgtggggatcctggttcagggctctctatgtccccctggcacgtgcctgagctgttgctggcactggagatacagctgcaaacatccatcaagggcctgcagtcaggagcttcagctcggggcatgggcaggaggagtggagacaactacaaacaggtaaacaaatgagtgtgtgcgtgcatgtgcgtgtgtgtgtgtctgtgtgcgtgcatgtgtgcgtgtatgtgtgtgcgtgcatgtgcatgtgtgtgtctctgtgtgcatgtgtgtgtgcgtgtgtgtgcatgcacaccagctgatacctgtgatgagaaaaataaagaggaaggcaagaaatagtgaggagtgccatcccacatggggtgagccaggactgtctaaattcatacctttattcattgttcatctcctgcaggtgagtacagccccacaaaggcaggcatcgtctcttttgttcacctctgcacaccctgtgcctattaggatacatggcacatggttggtgtcagtacgtatttgttgaaaggtggagtgagtgagtgagtgagtgagtgaattcttaaagggagagaggagtgcagtctcctcagtggccaaagtgctccctcgccagccctcagctctgctgtgaggaccactgtgtgtcagagacggggtgggaaccccagaacctgctccagccactagggcagaagtggggggaggcagctgattaaaatagtgcaggtagtgacggtggtcctggcagtgatggtggtagggagggggaggcgccactgcccctcctgcccaccttccaccagtggaagcagtcacatagccacagcaagaaggagacaccataccccccagcaaggccctggcaaaggggatgcagggagtcaatgcttcaacctcctgttagtaagtggcagggccaggaggggagcctggggtgcctggtcccagcccccatgttcttcacagctacgtcacactggcttccatggcacatggcaagcactaatgcacaataaggatgataataagggggagggagcagcagagcacagagagctgcacaagtttagtgattaacttggattttgtcctaaatgagaagggaagcgagcaggaagtgatagggttagagctctatttctaagacatcggatcacaggaagaccagttgctggggcagggatgctggtactggaccagggttgttatgatgcaggtggcaaagaaagttgggttcagggtctgatctgtagtttattctgtgtgctactccgttttgccttggctgctaggaagctcagggcacacaaataccctcctctggagcccgtgtggtgtctgtcgtggggacccacctaactccttgatgctgtggccctcagcagaccctgattcctccagatccttcctgacactcccttcatccttcagctgtgtatgtgtgtttctggtgattgctgccgatcctttgtgaaggaggtgagatataaataaagcaatgattatgctccatcctcgtctcctctgctcatccctggagatcttcgtcttcatcttcagctgagcttggaggcttggggagacctagcccatccttcccctcgtgcaaagcatgctcaggacagcaggctttcccagggccatgtggagtcacagtcttgctcccatctggtgtctgtaggtggaggaaggaaaggagaggatgagaacatggaatgcattgtctctgagaagagaaggatccctgtacatccctctgcctcccgtggccttggggagagggtggccgggaggatctgtggttaattggtgttctgcagctgccctggttccacacatttcctgggctcccactgggtaccaggcactaggtgctggggtcgcctcaaaaacacagtggaggatgccattgctgtagctcccttaatggtttgcagagcccagaatgtcaaacaagacattcctgggcttgtctttccccatggggctgctttgtggagcatctgtggacacagcacctagcacagttaacacttgtattagtccgttttcatactgctacaaagtgcccccgataaaacaaaaaagaactgcccaagactgcatgatttataaaagaaagaagtttaattggctcaaagtttagcatggttggggaagcctcagaaaacttacaatcatggcagaaggtgaaggggaagcaaggcaccttcttcacaaggcagcaggaaggagaagtgcagggcgaagggggaggagcctcccttataaaaccaacagatctcaagagaactcactcaatatcatgcggacagcatgggggaaaccacctccctgatccaatcacctccacctggtctttctcttgacacatggagattatggggattataattcaagatgagatttgggtggggacacaaagcctaaccatatcagcactctattagtaatgcctggagagaatgacctcatgccccaacccacctagggtgggcctggtttatcctcttgtcttggtgtcccatccttctgtgttctgctttgggtcccctcgatgcagctttggaaggtgagaggggcctctggagtcagggtgctcaaggtcctgccctgccacagcatttcccagctctgagaccaacaaaaaaatggctcagggctctgatcttcagtttgttcatctgtaaaatggatataaaatggaatgatctctagctcatagatttattgtgaaggtaaaataggacaatgccttaggatagtcctggccctgcacaggcagtgaccagcgtttactccatcatcattattctattgctcatatcatagaaattattataatataaattttgaccaaaagttacctgcactggcatggtatgttaatcagagtgatgataaagtctagacatatagataatattattttacatggatgataacatgaactattaataaactgtgtattgtggatgtttatctttgttttcagattgtttttcattttaatttttttttagagacagggtctctctctctgtagcccaggctggagtacaggtgcaaatcatagctcactgcagtcttgacctcctaggctcaagtgatcctcctgtctccgactcttaagtagcatgcaccaccatgcctggggaatttccaaaaatttttttgtagaggtggagtctctgtgttacccaggctggtctcaaactcttgggatcaagggatcctctagccttggcatcccaaagcattacgattacaggcatgagccactgtactggccttcccagaatttatgaccacactgagtcctcccctcaaccttacctatcagggatgattatcatggcatcttttttttttatcaacagatgtggaaaccgaggctccaaggggccgggtggcttactcaaaggccctgggttagagacaggtgcagccctttggaagccagaccccgtggaagctctagaggctgccaggcaggccgcctgtcactgggggcacagaggtcactgccatgtggggccttgggccctcgggtgctgcctcatatggctcttctcaggctgagctctgcagagcccagattcagagcaggccgtcctgggcctccttggggcagccagtggcatgcatgggtgccttaggtgggaaatgcgggagtgtgaccccttccctgggtctgaggggcctggcccatcataatccccggccccttggacactggtaatgccccttcccctcgaacactggtggtctccttccctgtcctctctgacaaaggtgacctccttcctcaggtgagcccttgtgttagccacaccgtccagcccttctccctgcatgtccatgcttcctggggctctgaggtctgcatcagcttagggctcccagccccttccacaggtaacaaggcaaattcacctgctggctgtggaactgaccacgcgctgaccatgggaggctgagccagctgtcggggagtgtgtatgttcgcagggcgaggggtcctggcagaggtctgggctcctgtggtagcagccgtgctggggagcaccccacgggtctgcgatcttcctcccccagcgacactgggaggttaaatcggagcctggttgggactcaggtccttgttgctgccagaagaaacgtcccttccctgtcccaggaggcatctggggcaatgtgctcatctattctcagtcctgcctgggtgacggcctgaactctgctctacactgtgaccctaggatggaggtgacgctggcttactttgtgagcttctctaactttaccattttgttagttgcattttgtttcattctaactaatctttcctactaagggacacacggcttgtgctacaaaaacagcctgtgaagcacatctccctctctcccccgcctgccaacagccagggctccccatttctttctttctttttttttttttttcttctttttttgagacagagtctcaccctgtcacccaggctggagtacaatggtgtgatcttggctcactgcaacctttgcctcccgggttgaaacaattatcctgtctcagcctcctgagtagctgggattacaggtacccgccaccacactcagctaatttttgtatttttagtagagacgggatttcaccatgtcggtcaggctggtctcgaactcctgaccttgtgatctgcctgcctgggcctcccaaagtgctgggattataggcgtaagccactgtgcccagccccggggttccccatttctttggagggcccacagacattttctctccacacaccagtgtgtgcctgtataccacccctgttcgcacactggtggcgtgtgcgtgtgaatttgtgcgctggggttttctttggcctgattatctcagatcagtttcctgtccgtgcttggagatccactttctttctttctgcatctgcacacaggtggttgacaggacagacgatgacttacccagtccccctgtggacgggtatgtaggtcggtatgagtctcttttacaacaaacagcactgccatgagcttcctaggacgttcatcttcacgtgtcccagagtctacaaacatggccgtttcatggacaaggaaggggtccaggagcactgcttcctctgcctgctcacagacgtgctcacagacgtgctcactctgcagccgtttgctcagaattctcaccggcctggctctgcgttgggttccaaggctgccccaggcctgggctctaccctagaagaggtggcagcctggtgggagggcaggcaggcagaggtctttgcggctcattggtgcctgcataggtagcttcatgggcgtaagacaagggagtgaccctgtctgggacaagaggaaggtaaagactctggacaaagtcctattcaatggaggagctgaagtttatgaggcagagaagcggctgggagggagagcagcgtgggtggagggcagagcacgagcaagggtcctgggcaggcagcgtttcatgctggaattaggaacatcttcacacgtggcgcgtcatatggcggaaggcgaaggcttctggtggccgtgagtgggtcgcaggagggagggtctcacagagggaaattcagcgcacgctgctgagctgctgcggccactgtgggtgcactgctggacaaccatcctggggtccaggctttggggggatcactggtgaccccttagggtgagaggtcatcaccttgggcccccaggagtcacataggtttggtggccacttgaggacccccttggttttcgtcttccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcaggtaaaggcctggtgacaggcgcgggcaggctgtggctgggaccagcgtccttggcatggtgctgcggcccctgctgatctgtgacttcctggcccctacacaggaggggcagatgtgcttcatggcctgtgatggccaggagccatgcaagttaccccgctggcccctccagggcccacctggcctccctgaagccctggggtggagttggcaccaggcaccccatgtgggacgctctgcccagaccctaaggtgcccacaagtccactgggaccttgttaaaaacgaagcctctgatttacttagggctgggttgggccgagacactggctttggagcaaggtctcacttgctggcttcacctgggtggtgagcccccagcccacgcgactcccgcaccacctcacctcccacacctgcaatctcacttggaggatgctggggcctgggtcgtacccccacagatgcaggtttagttggccaagagcctcctgggtgactcagggttgaggccgtcggtttggctttgacacctctgggcctctcttcttcctgaaagacagaggctgctcccctgctcctaagctgtctcagtgtgccttccctacaccctcccaccaaagcatccagaaggttcctccactcacctcctgctgccccctcacaccctgccagccctggctctgtgggaagcgggattgcgatggctggtcccgttgcccccgcctcctcggaatccagcttgggaactgcagccatgaggctgaaccacagacagggtggacacaggcagtgatgacgggacaagcagccgtaaggcacataacggcagaacacggccccccagcatttggcatggaggagccaactcaaccctcagaacctcctgctaggccagcactcccgcaggatcctgccccatcggaagggatggggaacaggcccagaaagggaaatcactcacccagggtcacacagccagcaggtggcggggctgaggcttggaccctggcagccgggtgtggtggctcgtcagcctgggctctgcagatggcagtgttctgagaagagagcccggaggaggccgcatctccaccccagggccccgcctccagccacatgcctgtgagccacacctaaaaacaattagtgagggagctgctgctgtggaatcagtcccaggcctcaggaaccagccctggcgagtgcccgtctcaggctgttgcctcggggggtccctggggtcccatttcctttccagctctgaagaggcgcaggctccagggctttgaggatggtggagacgaaggccaggtgttacagcgcccaggcccacagcaggggaggcggccaacaccgacagcaggccctccactcatgcttttctgtgtgctttacaaaattattattattatttttaccaaccaagaagttgatagatgaattcttgttgaagtggaaacagaacaagcatcatcattcggcagatcttgagcacctcctgtgtgcccagtaccaacaggaggggcccaggccctgcccacccagagctttccgcagagtagggagtcgagtgacaaagtgtggaagccaccaagtgaaccagcacgtgagtcgattgcagactccggcgaggctgcaaggcagcctccctcactggatgctaggctcagctaggtgggcgggttccatttgttcccctgcatctggcagggccccttgcacacacacggcactaatgggctcttagtgatccaggcttaatggcaggatcacggagcaggccctggggggtggaaatgagcagggcgggcactgctttgggcccagtggtccgagaagacccaggtgaggaggctgcattgagctgagatgtaattggttcattgagaaaggcagggaagagcatggcagcagtgggaacagccctcgaaaaggcagcgagctggggaaggcacgtctgtgcagcagtgaaaggccgggggactagagcagagtgacctccgtgacctcaggggggtctctgacattctccaggcctgctgaccccagcagtggaactggaaggctgaggtttgtcttctgaggactctgggctctttggcctactccaagctgtgccgtgtgagttcaccagcaagatgctctggggaccctgcaagggcattggaggtctcgaggtttttacctgcagcatccccaccttcaggaccgccattcgggcatctggaaattcgaggaacagtgctgcattttgtttacttattccaaaccactattttcctttaaagcagggggtgttatttgtttcagcatatcaaattcctgatttcacgggcatcacgggttaggatgagttgaagtgaatgcaaagatgattgaaagagaaatatgtagcaaacagtggttttggtaggcgaggctgggggaaccggctgaagatggctctcaggggctgcagggtggaccagcatctcagtccatgcctgccctggcaggtggctcagatccactcagccatttacacactgtaccaccttcacaagctgcaccaccactgacgtccccatccccgagagggggagggtagagcctcgcagctgcatctttgggtcatcgggaagtccttgagtcagtgcaggcaaagacctgtgatgtctgaggctagccaccatgagcaccgcctggtgccggcctggggacggggtccacacagagctcgaggcctccacccctgttcttcttatctgctttgtgagcctggctgcagcctctttgctgacacctcccaaggtcagcattcactttgtcaattttatccacaattctggcacctggaaattggcttggaaattgggaccacagaaaggaaattctgttttctctgcccaaaaatgtccccaccctgctgtgtttgggtttcccttttcatcctttggctttagggtaaatatcctcagggaagccacccgggaggtcaaggatgggatgggtttccccagacaactgccccccagtcagtcccccgccccaggcctgacttattcctcctcgcccacttctagacacttgccatctgtcctcccacctgtgctggcatcaggcagaggctgtgcctgtcttgctcatggcagaatctcctgtgcctgacatggtgcctggcacacagtaggtgctcagtaaatgtgtaaggggtttccatagattgaacacctgatcaccatggcctgttcccccagtggagccccacctgtgaaggctgcagggcttctgccctccgtgactccccagcacccagctcagcacttggcacatagcaggtgctcaggaaatgcttttgagtaagtgaaataattccattgccagtgcctgtttgtcatctgcctccccaactagacattaagctaagccaggtgggctgactctgtctgttccccggcagctggcagggccccctgcacacacagaacactgatggactctctgtgatccagggttaatggcaggatcacggagcaggccctggggtggaaatgagcagggcgggcactgctttgggcccagtggtcggagaagacccaggtgaggaggctgcattgagctgagatgtaattggttcattgggaaaggcggggaaatcatcacagcagtggaaacagcccttgcaaagctgcatctttcaaagaaagggttgaggtggttatgtagtcttgtatttggaaattggggctcacctgtaggcaaacagttttcctgacggaaggaagaagatgattgtggagcagcccgaggcctgcctgtgaaagaagggagaatgggacaaggtggtggccgtcgctcaagagtgttttgctccgggaaggggaggcagaaagggctattctgaaggcggaattgacaaagatttggcaaattaggcttggtggaaggggactgggggctggcctcctcccttcctgtccatctggtagactggaagcttttaacctgggtttattggaagaagctctagtgggagagccgcacaggagaatctcatctgtgagtggatgttaagagcggccaggaggcacttcgcaaaggcgaacaggaaccacggaaaggagcccggggtgttggcggcagagggagggcactttccttggttggtaatttagggaacatttggtgaagggcaggaatggctggtgagagctagcttagagaggggcgttatatgtgcaggggctttccagataaatcacagaaatgatcgctgtagaatatctactgcgtgcactgctctttagctgtggtttatgcacattgcttagcagcactcttggtaagaaagttgggcctcgccagtggactaggccccctaaccccgaggcgcctgctagctcagtgtttttggtctgtaaacttgagcctggcattggctgtggcttggacagggcccagtgacacctttgcctgagactcacctgtgtgtttgtgtgttgggcagcgctggagaagaagatggccggcaggcaaggccgagaggagctcatcaagaaggggctgctggagatgatggagcagggtaagtgggacccgtccctggcttggaagggcacggtgctgggaatgcagaatggaaagtctcacatgagcccaggaagcccatcagaaacagtgtagaatccaaggagggccgtgttcagatgaagcctgcaaggttggagagacaccccatgtcaggagccattccattggtccagcccccaggggcacgggagaccccattactgagctgaagagctccccctcatggcaccactcctctctggggaatgtctaacagagctgggtgtgcatgaatctggtggtttatcccaattcctttaaagtggtagcagtggttttttcagcattaatttttttttcatattcacatttcagtcctccatttgggcaaattatttttaattccactattacctactccccctaccaccatgtaggaagcattcaggacatgctggggcggggtgggatattgtgcacgccctgtctcattggtcttcccagcatccctggggagagaggcagcggctatcccacttgcagacgaggcgtgggagggtctgggtggtgactgccccaagtcattgcagcctgagagcagagacacagaacaaatcctgatctcttggtctctggtctagagagcttaatctcagtggggtctacataatcatctttgtttccatctttcagaaaggccagttattatcactcatgcaattaactgaacagagttctttaattcccaagtctttctctttgtgatggattcctggaggtgtgaggcccaggacttagatgctgacactagcccttggtgccttccggttccctgagaggctaaatcttggttaggaggtttcacaacacctcactgcctctggaagactctctggagctggaccaagctctggcctgctgatttgaggaatctggccatgcatagccagtttcctgaggcttgcatggatatattgaattcctctctccccacttcagccttaaaatattactagtgtctttgtaatttggcccaaatatcaggaattaggaaggaagctcatgaaataaacgaatccagattttatgcagccgggcctgtcagcacacaaacccgattgtgggcccaggcttttgtcattgtttcctctctttagactcgaagagtgaagtattttgatgatgctatttttaggggaaatctacatgggaaattgcttcatagtgataataaaaccttacatgtgcgaggaaagcttggtgtcaagtcccgtggcactcagatggttaacgccgtcgtgacgctcggatttggcggaatgcggttgctgagctagaaatctggaggattttcactgggatgggacaaaaaagtgtcaaactccggcattttgaatatgttgccaacaagcatacctttggatcttagggaaggagaaaggaagatgaaaacaatgctaaggccttttctcatctattctaaaaaaaacactacttttgttgagtaaagagtaagtatatagatttggttcctctcaaaaatgaagctatagtttgactaattaaaggggaaaacttctaggagcgttggcttttttccactctgaatttttgcaagatgactttgtctgatgaagtcatagcagaggctggagacgaatgcttggccgcggccaggctgacagtgtggctctcaccctgctgccgtgggagcctggtctctggcttccgtgcctctgacggcgacatcacacacccgcaggcttacagaatcactttagatcagggtcggcaaaccttttctggagagggtcagatagtgcatatttcagggggacgtgcagtctctgttgcaactacttgtctctgcttttgtagcgcaaaggcagccggagacaaaacatgcatgagagggcatggctgtgtcccaagaaaactttatttatggccactggcctttgaattttatataattttcatgtgccacaaactattatttttcttttgatttttttttcttttgtcaaccatttaaagatgtcaaatccaggtgggggagctggattggtccccacattgtggtttgctcatctctaccttccatactctctctcttgctaaatgattgtggaccagggactagagtggcctgaaacacagtctctttccttgagagggaaaatgcactcctaaattgatgccatgacattttattgagggcccactctgtgtcagggtctgtgctagctgctgaggacacaggtgagcaaaatactgttctgaacgcacatccagtggggccattaggtaatcccacaaaaagccggcaactcacgaccacagtgagtgcagtgaaggatgcagcaccctaagatcatgagacaggacctgacctggttctcggggggccgggagatgtttgagtcaggtccaaaggtgggcaggaggacctaggctggttctcagagtctgttgcatattaggatcacctggagagatttaataaccctccaccgctcaggcagcagttaaattagatgcgctgggcgtgggacccaggcagcagtgcttcctcatcctccacagctgattccgactttgatgcaggaaggttgaaaagccaagagacagaaggaagcggggagtgacttccagcccacaggagcagcaagcacaagtccccgcggtggaagggaccttgagatggtgggttgggttggaggaaaggaggaaggaggaagcaggaaagggagaggggcttgggtcaagacgcctcccgtcttccctgcccacacaccggctggggtggcagaggcatgaccacgctgctgcgggagcctggggcggccacagtgcgagtgggtgggatctgcgaggagcccgagtgtctctgcagggaaatatcagggaccgggcagcaggggttgctctgggaggggacttggacttgcttttcgcagtcgactcttctgtgctgcttgaatcctttactgtgtgccacctgtaatcaacctgtaatcaacgtgctgtaataacgggatccacgcagatgcttggccacaggctcccggctaaatccttccctgcaccgcagtttccgtcctgcactagcttcaaaaatgtcttttctcactgggtcgacctgaggtcagaccctgtctgtccctaatcctcctggtgctgggtcaccgggtcctcttgcaggatgactggaattgttggcggtggctgtgcacctgccctctccggctcaggggaggatcaggcttgagggctgttgctctggggtaggcacgcagtgccgccgcctctgctgtggatgtgaggactctccagggtgaggagcagaggcgctttcctggctttggggttaaggaaccggcttcagggttaaggaaccggcttcagccaccgccttccactgctggcagggacgaatctgcagccgggggcgccctcctgtggccggccaggctcatgagcctccctgcaaggtggacgggacttcatgcaggacaggccctgtgaggctgtgggagtggattgtcagggactccagagcctcatttgagccccctcgaaactcacatttgaacttccttggccaggacaaaccccaggattgccctctgccctgcacacgcgcatgtatgcacacacacatgtacatacacattggacaccctggagcttgccctgaagcaggtgggcagcctggtggagtgagccggactctgggcagggccagcagaagagagcccgccagctcccgggggtgaggcagcatccagggcatgagtttgctccctctggggtgttactttatgatcgatggtctgttttatgaaccactgtgaccccctcccctctcgttcctgtgactctagtcgccagcttggacctaggaaggaccctgctggtggcgttattacatgactagatgtgtgcagtggagcccgttgtgccctggggagggcagaggggacccctctgatctcttcagtgctccttccaccctcgtctcggatatccgtgactaagtgaggccagaccaaatctctggtacaaggggtccccttccccagcccccttgccctggtccccagcccacgtttctctgtgctagacactgtttatgttctgaatgactttcctccatctccctgtatgcgttgacttggcattttcttaaataatttaaggaatttcctaccccgtcattgggtataaaagaagagagtttattactctgtgctgtgttcagtgacttgagattgactaggcattctttcctcagggaattggacagtgacaaatcaagtctatctggtttccatgtggtaggaacgccgggggacacatgtctgcacgtgtgcacacacatgcacgtgcacctgtgtgcacccacctgtgcttgcactgtgcacatgtgccacgacacacgtgtgtgcctgcgtgtgcatctgtgagtgtgtgtgcatgtctgcaacacgttccctctcactgtggctgctcaggtgcactgccccgcgctcccctctgcagccctcagaaggagagtggccgggcggaggctggccttccagcgagaggagcagggcctgggctcccaccgctcccccaacccctccccaaccagcgtttcttagcaacggccctgccaccagggctattttgggaactgaaacttttcactgaacatgattatgagctggagctctgaccgcagcccagagaagtcctgcaagaagtccttgcagaaaacctgcaagaaagcaggggaaggttcaaagactgtggaggggcatggtgcttttctgagtctggagacctctgggccttccaggttctatgttctgacctttttatagtggcagttgtgatgattttgatgatgacgatggaggcatccttattattaacagcagtgacagtcatggcagcaaaagacctgtgcattctaaggtttggtgtccataactgcaagtggtgggtggcagccttgcctgtcacatagggtaggtgtgaagctcaagctggcagagccctgtgctcccctacgccagctctcacattccctgtgtgttgccaggggctgggtaagctgtgctgtcacggttgcacgtcaaatgcgagtaagtcggtcacgagaaggggctggtttcagttttcagctttgtgacctctaattttgtctactcggtgagctctcttggcttgtatctgggttggtgggctgttatagccaagggtcaaatgtggctcaggacctgtttttatgtggtctttgagctaagaatgctttttaaatagaaaagactttcataaaaattaaaaaaaaaaaatcaagggttgcagcacgggggatacagcacgtggcccacagagcccgtcacaatggccatctgcgccttatgggaagagcctgccagcctcgcctggacctctgggcaactgacgcggctgcatggatgagatcgtccagccctaaatctccagacttctggcatggctgaccttttcattctccccggaggagacgtgtgcggcagagggaatatgatcagcagcgatgacaagctcaaatctcttccagggtcccaggcaggaaatgggtctggcatgagtcctgggtgtggtgaggactctggagggagaaacggttctgtcctaagcctgctgttagcagatgggcccaaaggtgcagaccaaggggccagatcactcttgtcaccctcctcttctcgttgtcagaaaccatcaccaacaacaatgacagaaagcacatgtaaagtgcctaccttatgccagacacattccataccctagctccgttaattctcactatgttgccatgaagcaagcagaaatattatccccattttatagataaggaaattgagatccagaggaatttgctatttgggcacaaaacaccgtttgcaggtggtgggacgcatgatggggtgactgtatactgtttgtccaaacaggacacttttaggagtgaaagggacactgttgaaggacacagggatggcaggtaggaatcgggactgaccaggtcctatggaccctgaccctgaagtaaatgttgcctcctccttccactgccaggatgggacgtgtgtggaaggaggtcagcgtaggctagcatccccaaacggccacctcgtggctgtgtcgacatgtgcaggtcacactgccctctgcaccgggcctccaggaactgctgtagagattgagaggagtcctgcagggctatgtggaggctttgtgcatggggctgtaacgtgcatctcagtgacgtgactgtgacttgctggccgagggccctgccatcctgcagttgggtaactgagccatttattttgctctccaagtgctgagcccctcagcattaaggtgcaaacccagggatggcaagtgaagggccagaccctcagaggctgcagcagccgagcttcaagagacggaaagcaccaggtccttccttatgccctgctagtgcctcctcttctgggaaggctgcctgtcagacctagggacccccggctctgtggcccctccatccatgggtgtgccccgttcctgggctcacggtgccatgtgtggtcatctgcgtggcttcctcagagtgtgagacccctgggggcaaggactgtatcttactaacctccaccttgccagggtttattacagtgccagacacgtagccggtgatcagtaaacacctgtttaatgcctggctgagggtcaaacggtgggtgcagaggtgagttggttctctgcagccatgacaacccctgcatctcagagacctacagcaatcaccgtttgttgtcccctgtctgggttggcctgtgatctgccccgtgggtctgctgactccagccagctgctgggcatgtcttcaggacaaaggtccagggaaacaggagggacgagcagggatgtgcaagcacttctcatgccagtgctgcatcatacccactgtgtcccatcgaccaaagcaagctccagggcagaggccggggtcagagtggggctactgcaaaggtgcacggcagtgggtgtggacgtggctcaggggcactgcagtctcccacaggtgtcggaggaagagtgcacacagggagtggagtgtaagagcagaaaccaggctagggtgtgctgaggtgcccagggctcccctggaaagtccagacttggagagggactcctagggtgtgtggtgagggggagaggggtgggggaccacccagagcctagaatggatacttctcagaaagactcttgggacgacggaagggatgaaggaagggaggtgcaggcccagctgacagctacatttccttgtagatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcaggtactggctggagaccacgcgaagttgagctgctcctagaatggccatacgtccccactgttgtccttggctatagcttaggcaacagccctcgtagaacattgttctccagagagctgggcccgtgctctaagcgctgccatgctgtgctgcctggctgggttgaagtgtttgctggggcacttttctctactgtctctttccaagtctggcacggctgataagtgaaggtacttaacgatgttcatctccctggcacacctaccccccctcccagggcgtctttgtgtttccctgggaacttctaggcaggaaagtgctctctggaggggcaagtgcccagtggggggattttagtgaccctaaaagggtaggaggtagggttgagggacttttctgtggccgaaatcctgccacagggggcctcttggcctaagagatgctgaagtccctgcatgtgtgcatgcctgggagctggtcggtgctgatgcagtctcagcatgctgcagcctatgtggggctcttccgctgcttcttgaggggaggtgggcttggtgccttgctccaagcctcagtttccctctgttaaatgggaaaagtaatggacctacatcagggttgtttggagggtgggaggaacttagcagtgtctgacgtgtagagtgactattatcaaaggcagtaggggctttgcgtagtggtggtggtttttattttaattgaatagaccagggcgcttcccaaggataggggagaagggaggaaggatagaggggaggaaagcaggaactggccacagacacctgcagatgcttcaccagctcctcctcctcctgcccacctggcagagtgattcttacggagcttcactgttgacttggaatcctgatgtctcgtaaaatttcaagctataagcgagtctcacacggtttgggggtgggaaggtgaacgcgtctctccgtgagtgtgggaggttggaaatccaggccccaggacagcctgctgggcttctgcttcagagcgggtggacacctggtcctccgtgcccgggacttccttctgccacacaagggtggcaccacacactcgcaggccgcccgtccacaacgcccctgcagcgctagcggcacctgcccagaggcatgctcagccctcttcgggggtggccgtgtctctccagtttcacttggcttggaatttggggtctgagagttgtgacttctggagggtcccagctctcacgcagaggccccctccacacacacaggtctctgtgtgccccaggcatctgactttggggctggcgtggttctttttttttttaatactttaagttctagggtacatgtgcacaacgtgcaggtttgttacatatgtatacatgtgccacgttggtgtgctgcacccattaactcgtcatttacattaggtatatctcctaatgctttccctccccctccccccaccaagcaatggcaacaaaagccaaaattgacaaatgggatctaaactaaagagcttctttgcagcaaaagaaactcccattggagtgaacagacaacctacagaatgggggaacatttttgcaatctactcatctgacaaagggctaatatccagaatctacgaagaattcaaacaaattgataagaaaaaaaccccaccacaaagtgggtgaaggatatgaacagacacttctcaaaagaagatatttatgcaacccgctggcatggttcttaaggctgagcagagcctggccttcctgccgtggtgtggtccccacagcccagcccttgtgtgtggcctgtgagcctccccaagggaggcagggctgctgctcccagcccttgatgggggtcacgcttctccttggcagtgatttctgtagctcagctcagggcctgtgcctgctcccctcagtgccctcttctgacctcagacacgctcccgctctctctccagatgctgggtgtgcggatgggttcctgagagcagagtgggtctgttgagattacacatttgtatcagggaccctctcctgagtgaggcctgagggaggagtgggaatcagctgggcagagagcgaggtgcagagcatcccagaaaggggaatgacatgcaaagacaggggacaggaacacacacgttttctgtaaagggccagagaggaaagagcatgagctctgcaggctggaggtgtctgacacagccactcgcctctgccccctggtagcacaaaagcagcgtcggtggtgaaagggtggggctcttgtcggtggaactttagtgattaaaaacaatccagggcccggtgaggtgggtcacacctatcattccagcactttgggaagccaagacaggagaatcacttgaacctaggagttcaaagtcatcctggacagcatagcatgacgccatctctacaaaaaagttttgttttttgtttttggttttaattagctgagtgtgtgggcacacacctgtagtcctagctactcacgaagctgaggcgggaggatagcctgagcccgggaggtcaaggctgcagtgagctgtgatcacaccactgcactccagtctgggcgacagagccagaccctgcttcaaaaaaaattcaaaataaacagcccacagaatggagagagagaagagacctggcaggttatccctgagggcagctggaaccccccagggatggagagtcgatgggatttgccttgtaggaagcgctctgctggtgacccagcaagacctgggggagactggagccgtgcatggttccctggggacttgtctcattcccagcttccccagtgtgggtcttgtgctcctgggatttgtgagatgacttcttgtgaatggcatgtggacagacaatgagaaaacattattaatgttcaattaataatgaaaaagtttaaacattaataatgaaaatacttttcagtaattagggcaagtagtattggcttctcattttgggcaatgatagagatttgctttttcttataaacagagataaaaatataaattcacttaaagtaaaatatagcaaacaaaagtatagaaagtacagaggaatgtccaaaatgtctaaagcaggagccacaagtctgatttaagaaagaccattccattccctagggatgcagctggcttattagcagttagtgacatttgtcatcatgctggggataacaagaggtgacacaagtggctgcctgcatgcagggttggggagcgtgctctactaatgactgcacattcatttagcttacttagccctggaagcagcccccggagatctcacgcccatgatgaaatgctggcacaaaagtcgaataactggtccaaatgactggaaacagagggcaatgtctttgacatcaggccgacctgggtttgagacacacggctgaactccttactgagctgtgggaccatgggcaagtgacttaacctttctgattatgtttgatcaactgtaaaatgaggatagtagtcacactgacctcccagggtcgctaaaattaaattaagtgatccccaggaaagacttatctccctcctaacccacaccgagcacttggaaagtgtctgctgctgctactgtagcatcactgttactctcaccatcatcgttgtcatcgtcattgtcatctgttgtcttcattgtcaaaaacaacccttggaaagggacgcactaacacgcattatttagctgcctacagatgctcccagagaggccatctctctggtagcatgtgtgttttgggatgtggggccacctgcagtttgctatggctgggacaaccccgaggcctcatccagccctgcaggcctgggatcctgcgccagggaccctgcgccagggacatcggtcacctccacaacaccaggtcaatgttcagaagcttggccatgagcaacatccctataaacggggtataacttaacacagggacattaaatgcactggttaaaaatttgcaagccaatgtttaaaaatcaggagtgttcacagaaatccagatgtgcagtttcttttcagtcatcaaagttcaggcctccggatccctgttcccacacagccagggtcgctggagctgaacagagtctgtccctgtagatgggtgttggagtttgcaaccctttccatgaaggttaagagcctagtctttggagccaatccctgtgttactgacttaatcttctgctttgggccccagtattttgtgatagaaggagttaaagcttgaggccactgtgaggcaacgtggtcctaggtctccggtttctactgcagagctcagggggaccagctgttagatgctgtgtgtctgatgctgtctgttctcttcccacattctgcacctcagcacccaagggaactgcccacatctgggcccagtcgctctgtgttgtgggtaattccatgacagacagatgtcatctaatggcagacaaagccagatcctcaagtggcaaatgtgtcacgtgagtgctggaacctgggacctgcttctctccttgaccttggacaagttcagggaaacctcatgggggcccagaacatggtgccccgtgggtgatggtctacacctgcaggagcccctggggtgtctgcagtggtgctcattgctgtcctgaaaggtcagctgctttctcttaaaaagcaaacctcccatgagctttgctgggggtcggggagaggggtcatcaaaaagcacaaggggctgtcctgggtcactcctggcatccaggtggcaacatccaggactggagttgcagcttccccgtgccccaaccatgatgagtgtgggtgtcaggggatacatctgaatattgcaaatctctcaggaggaggacactgtcaatgattttgaccattattttccttgagcctttggtttggtgatttgggttgactttgggcttttgtgtttggggcgactttgcttttcctggttttgtttggatggtgcccgatatggtttggctgtgtccgcacccaaatctcatcttgaattgtagctcccataattcccacgtgtggtgggagggacctggtgggagatcattgaatcatgggggtggtttccccagtactgttctcatggtagtgaataagcctcatgagatctgatggttttataagggaaaaccccttttgcttcgttctcattctcttttgtctgccaccatgtaagatgtgcgtttcgccttccgccatgattgtgaggcctccccagctatatggaactatgagtccattaaacttctttttctttataaattactcagtctcaggtatgtctttatcagcagcatgaaaacggactaataagtgccacaccagcaacagagcattccctacaaagcccagaaggatccggtgttttgacacaaatgggaacagggtcctcttcagtgtttctactatgggacaggggctgagttctggccttcccacaagtgcactaattaaaaaggagagtgacactcagggagcgtgttctgtgtgcactctattatcttataacagcctcatatttttggatgagaaaacagagcccagagaggttaagtcactttcccaggccatagagcataaaaacagatcaaacccagtggcaggactgggtttgatcttcaccataacagtctacagcctaaactctagagccaaacaggagacaaacatttcttctgcttctggaatgttctggaatgtgagtctagaacaaggactgtcaaattgcaggcttcaggtcagatactgcccatgtctgtgtctgcatggctgtggagcactgctctagtgggccggtcctgggagccagggagggaggggtgcctccctccctgtgccctgctcctgtcttcctagctggtggctgcccttaaccactgcctggggcctatgctggtcccagctacccctggggcctgggctctgggcaactgctgggcaccgagtggaggaacctcatctgggagttggtgagccacctggcccacagccagctgcccaagctgagaccaaggttgtgctgggtgtacgggggtggagtacaagtgaccatggctcaccacatccatccttgggctggccacccttgaactccagaatgtcttcagtgggtggtaactggctgcaaagtgtgtcccctgccctggtagccctcttgaggcaagtggcagggcagagtttttcctcttgtttaagttcctacataatattcttgattttgcctcttagcctggaaagacaaaaatgtttactatctgcatctgaacagaaaaggtttatcagcccctgctctggaaaataagtggggattacacagaagggtgtcagtggaacatgctcagcaaagaggtaccagtaagtcatgaacttgtggcgctgtggttgagcttcaggtatttccattcctagccctgacccctgcattggggtttgtacagtgtagaagcttctggttgagactgcatttggtaagagggagcctctgctggtccagccccaagggagcggtcccccaaatgcagggaaccagtgtcttcttccactttttaaaaaattgattcagcacttgagatgttaacagatgttgcaatttcagttttgacaagattccaaaatacaacggtggctgcacactcacgtgagatgcagagggcggtgtcagagaggagagggaagatggggaggagggagggagagaggagatgctgaaaaccgtctcctgtccttagagccatcaggcaggctaaggatgtgagggttcagtgtgtggtgaggatggatgttttgggggagactttggaggagggttttggtcagcgtagctggtgtggtgagtctcatggccatcagggtgaagggtggggaacccatagtcccaccttgggcaggtggaatgaggggacctcagagacttaccctttaccctgtgccttaaggcagtggcactatgaccattgactcagtcctgggaaatccagagctcccctgtccagtgcagtagccactagccatgtgactgtttgaaataattaaaatttaagcttgtttttcactccagccgcttgtccagtgttcagtggtcatgagggtctagtggccaccatatggacaaggaagaaatgtgtccatcatctcagaaagtgctactgggtagtaccgagggtcagggtggctgcacatctactttgctgtgaaacaagggcagatgtagtttggattggctagccttccagagttctccatactaacagagactgtaatagcaacagaggccacatggcccaagctggaaatattttctacctggccctctgcagaaaaggcctgccaaaccctggtttggagaatgggtttccactggggtgggaagcattgccaggagctgggaggctggtgaggaggcccaggcagaagttctgacagctcacactgggaaacacgtgggtatttctgagaaatattttcgaagtagagttcgtgagacttgcctgtgaattagatacaaggggtgggtacagggtggagaggacaagagaaggatggcgtggggcatctggtctggctggacagctggtgggtcatggaacactgaacctggtgaaagtaggtgatatggtttcgctgtgtccccacccaaaatctcatcttgaattataatccccacaatccccataatctccacgtgtcaagggagaggccaggtggaggcaattgaatcacaggggggcagtttcctccatgctattctcacaatagtgagttctcacaagatctgatggttttataagagactcttcccccttcacttggtacatgtccttcctgccgccttgtgaagaaggtgcttacttctcctttgccttctgccatgattgtaagtttcctgaggcctccccagccatgctgaactgtgagccaattaaacctcttttctttataagttactcagtcttgggcagttatttttagcagtgtaagaagagactaatacagtagggatctgtctggattagtgccatgtccacagcttctagaatagtgcctggaacccatggttgttcaataacatttgcaagatgggttgatggttgaatgagcaagagggaagggaaggctcaggagaattttttgtggggaccaagattcaagtttggatgtgattggcctccagatggagatgccagtgtggccaactggtaacatatgagtctggagctcagagaaatggtccagggttaacagagaaatggaatcagttctgaagccaaaggagtggatgagaatgacctgtgagaaggttagacagggaagaggacctaggccttcatcctggggcagcccaggtggacattcagatgcaggaggtgggacctgccagagaggctgagcagaggtggccagagctccaggggagaaccaggagagtatgtgtcgggaagccagaggggaaagtgttaaagatggtggatggctgagtggggtggccctggctcagtgagggggccaggccttgctgggtggagatgcagtgttaaaggtcatctttcataagtttatttttcaaaggagcagataattgtaactaagctgggagtatacatgaggtcaagactgtttggtttggttttgggtagaatattttagatcttgttgggatcctgaaaagaaggataagtcagtgatgcaggccaagcgggacaacctgtcaatagctcagagggatgtggaactggcccaagtcagtgcttatctagtgaagtcttatgtggagatcagacatagaagatagatccagatgattggctggggctgacccagaagtgaggacactgaccccaggctgcccttcctccctggtatgaggacactgaccccaggctgcccttcctccctggtatgaggacactgaccccaggctgcccttcctccctggtaatgcttcctttggtggcacctctgagcagacccttggagcctggttcagacgctggccacattgtcctggaggagatgagtcagaggagtgctgagtagctctagacaaaccttccccaccatggtttcatgttggcctttccatacttgtagtgggcaggttcgggtattttatacagattattgtacagatgaggagactgagactcactaagcaaggtggaggccaaagtcactcgtctgtaaataggtcaaacgtatggaggaagggggcggatgctggatactggtgtaattgaggccgggtgagccagttccgtgacatctctgtctcccaaaagcaggactttggaaatgtgctgggtgaccagtaccctgagagcgtaacccattcacaaagaagcgttcaggaacaagaagtcctgtaaacccaaacaatcaaagcagggtgtggatgcaaggaccatattaaaggacttcagaataatagatgtgtgaatatctgaaaaggggtgggacccccccaggaagaaacttcctagaagaaaactaggcctgggctggctactgagagctcaccccatgcctggtggtcttggccaggaacttggctgccgaggaaatgggctgtgaagtgtggtgtcccaagaatgagggtgtccacttgcctgtgctgatttacacaagacagaaaactccacaaagttataactggaacctacatagagaaaatgggcatttctgtgcttacctgtggcttaacaaggacacctcacaactatttttacctagaaagcataaaatatttactttgatgttgttatcagggcaaaacttactaagtgaaacaactaatcagagttgtagactcttagacattataggttacaagtcagatgacataatgacagtctcaaagcataggagtcttaaaccctttttaacaagtaacacttttgaggacagtttaatgtaacaagaaaaataaaatgaaaacagcattttcatgtgggtatccatgcagaacaagagtatagagccagttgtaatggttgttctcagttcaggccaacttcataacacagagctgagtctgccgtctgcagctggagtatgtgttgttgagggagaacaacacatactccatctctgctttcagagattttgttctccaggcattaggagggctggcctttctgagataaggactccattgtcatgaacttaacataagaaagggctgggaatgagagtttaaaacttccaacatagccaataaaggaacggaaactaatgatagctaatgggatacaaggagcgtgcaatatttgcatctggtgtttagctggaggctctctgcaggcaggaattaggcctgttgtaacaccccctccctgaccactgtgttttcagcaccatggacagcacccaacagctcttgggtacctccagaaacagcagctgatagatgaatgaaccccataggagctaacacagtgacccaaggacaagccccagctccactaggcttttcccttagacatacagtggggagagtgttcgtgtgttcttcattgggtagttgtaaaaactgaataagatgatgtatgccaggtgccttccacaggccttagcactcaagagtgtgctgagagggcaggaagtgagggagtgctggtcccagggagaccatctctcttggatcagagggaaggaagaatagagatgctggggacagcagtttgcatttgagtcagaaatccaagaggagccccggtctgatgacctcagtttcccctgtaaagctggaggtgaagctgtgtggtgggagcaggcaaaggtgggaagctggaggtggggaagggacagaaagggcttgagcagtcatgcagagcacctgcaggaggaagctcctggccacgggtcctgcagagtgacagttcttcctgaagtggactccgtaggctcttcctcctgcaatagtaggcaagggcaggagcagacaagtggcagcttaatccccagatgaaacttttccagagagttaaatggaaaggaatccaggcaaaggacttagggactgttggtccgattgttgttgaaataatggatgatggaacccaagccaggcaaaaagagaaataagaaagggaaggattgataggttgagggaaagctggggatgggcaggctgaggggtggttgtgaaggaggtggatggagcctgaatcagcagctagaaagggagggatgagggttctgggtggcctgacccttcctccaagtcgatccttcctatcctcactcccactctaggctggcatgccagatgttagggctgctgcaaacagacaaataagaatgagagctgctggactggagggttacactgtgtcatggccacttcttgcttaaactgagaaacaatcctgtgagggactattgttaacacaatgccatgcatgagtaaatggagttttggagagatttagtaacttaaggtccaagagtaaattcagagaccacttgagcctgggtgtgtctgactccaaaacctggcatggtgaacactgctcctaggtgaggtgggagctgtggcatggacctctcatgtggaaaaaagaatggaatccctcatactattgaaatgacttccctctctccatattcctctctctgcttccgatggttctattgagagttgaacttgcaggaagtcaagtgcctgtgtgaggtcactgctctgtatgctcttcacgatcccatcccaccaaaccctcttgctttgctctcttacttccactgctgtcagaggaaacatgtttttaactctctgctttgcctttgaaccagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggtgggtccacatgcatcctgcccattctatttcctttctctgccccatccatccatctatcctacattcatccacccatccatcatctatctatttattcacccattcactcatccatccatccataccttcaaccagtcttgattgggcaccaactgtgggctggttctcatcattagcttctgtgactggggctcagggcaggcccagaggagtagatcttaccaaggaaactgtggttggcaggagtagactgcctaggctccctcaagcaaacaggggagtctctttgcaggagtcaaaggggggatcttccaggacctgaatgcaagaggtgcagccagttcccaggatggggcttggctttagcttggcttggcttttctttttcttttttcttttcctttccattctgttcctttccattccattccattcctttcctttccattcctttctgttccattccattctgttctgttccattccattctttctggatgctcatgtgtctgtctttctctttgtgcttctctctgagtctcagtctctttcagtcagtctctctcccttcctccctccctctctctgctggtctctgttttgctgtttcactttccagtgagttctgtccagcaaggcagagccaggagtaaacagcagacattggtggtcagataggggtgcacagctggacagaggcccccacagtcatacacttatgtagcttttgtcacactggcagaataatcctagcaagtagagataattactttgcaagcttaggtattttttatctggaattgactgctacaaacaggacacattgatggtctcagggaaaaagtaggctgttgatcaagagataatgacttttcagagtaaagccttgcgtgctgtctttgaaggctgtgggcgtgaaacatgatgcatagcagggtttgacagttttgttacaatcacctaaccagtgattaaccaccatcaataattgccatttgctgggtaggcacgaggtgccccatttatggttgagaaaacaggctcaggaaactccagtaacttgtcccaggtcctggaaatgattgagacttttgaacccagtttttgggcccaaagcttgttgctaccacacgtgtggccaggggctggtgccctcccctctgcgatctcacctaatcctcattgtgcttcttcccagttttcatgaaagagggaactgccaccttttggaagaggtgtcagctgctgagacaaggagagcccgggcatgagctcgggagggctgggtcccagcccttggctcttttctggggaccttactgccccttatggggtgaatgttcaatctggaggggactcttgggtggaaaatgctttcagtggggcattttccttgtacacctaacacgaattaagtattccagtctaactgatgattctcagccagataccacagaaacggaggaggtgagatgcaccccacagggggcctctttagctgggactgcagatgtcctggatgggttagatgtggggctgtggtgccctgtggttccccaagtagtattggtttgtgggagaatgtgctgctgggtgggtggagggatgagtgagggggcgcccccgccaccccaccaccctgagacttggccccagctgttctccctgacagaacattctcccttcctgctttgcctggtcagtacctttgcatgcttgggaccacagctcaagctgtttctcctccaggggagccagccctgacccttgacctcatagcaccatgcgccccatcttccagcatttaccacattgccccaccttgtttagtgggttgaatggtgtcaccccaaaattcccatccacctggaacctcagaacatgaccttgtttggaataagggtctctcaactgccattaagttaaagatcaagctgagctcatgctggattcggttaggccctgaatccaatgacagtgtccatgtgacaggcaggacaggacacacagggatgggactgatgcatccacagaacgccaagaattttccgggggagaggcctgggacggcatctccctcacagcctcagaaggaaccaacgctgccagcatcttgatttcagacttctggtctccaaaactgtgagagttgttctgttgctttgggctgcccaaggagccatacacgccttgtctgttggatggtttgcctctctctaaccacctgccccccagacagtagtccctgagagacggccacacgtctgtgttcactgtcaaatccaagtgcaggcatagtacagggcatacagcaggcactcagcaagtgcagatgatggttggatggatgaatgaatgagtgaatgaatgcatgcgtgctctgaaccctgtctgtctgctttctgcatctttctacatctctgtagatgaatccaaatattcagtctttatgcaacatggccacataaattacagtacaaagtttgaggcaaaactgtgctactttgcattttgttattgtctttgtgatagctccctttttcctccattgaaacctaaaaccatttaaagtccattcaattagccaccatccacctcattttattctggcgaatgtataatttgttcctggccctcaataacttggtaacccagagagtttcctgcctctcccaagcttgggaaggtcgagcctcagatggcacaggtcttcattctgactccacacgccctaaattctggcgttctgtccccagtctgcggacacttctggcttccgccctgccctcagttgcaaggacatcaggggatactctgacacttatgcgtttccatagggactgaattgagactgggaggtggaggagggtagttccgagctatgggtcctggcctggcttcttcctgcacagactacattttggtgactttgatttaattttctcagttcctctttttccttttcctttgggaaaaggttcatgtgcttcagcatgtgaacactagatggtagcaaagaagaaagtctccttacctgggcttcccttgctgcaggagggaccctggcccaactgagtctccacccaaggcaggactgcaggtgtcttagttcatctgagtgacttataaaccacagaaatttattcgtcactcttctagaggctggaagtccaagatcagggtgccggcagatttggtgtctctgatgagggcttgcttcctggttcataggccaaattcctggactttcttgaaaagtcttcatctctgatcaccctctgagtcactacaggcccattaaggtgggcaggttctcctctgtgtgctgtggtccccaccctgcccccatggagaaattgcaggaggtcctttgcattcctgggtttcacctgcctggtccctggagatgcgtttacccctctcccttttacctctcctttacccctgctgtcacctggtccagttggtaacgctcaactctgcgggatgggagtcccacagcctctgccaagtgtaagtggagctgggtgcgatgtgctgttctcagcccccaccttttcctggcagcctgcccctgaggtggcttctgaacctcagcttcctcatctgtgaaatgggggtgacaagtggtcccctgcacaagctgggtggggcgagccaggcaaagctctatgggggccgtgggggcagtgctggttgtcacatctgtgattgacagtggggcagagacctgggtgggatcccagctccaccaagctgagcgagagcaggcaaaccacgctgcctcagtttccctatttgtacaagagggctagtgattccttcctcatggggctggggtgagaagtagaggcaatgatggttagagacagaggggctgggggatgctgcgtgtcacctgcgtgtgctcaggagtggggcactgtcctgagcaggagcagcctggggaggctgaggccagtggggagaggacagcgcagtgtgcagaagctggggatgggtctccctgcagcccctgccctgcctggccacttcttgcatggctggctccttgtcatttctcaggtctcagctcaaagtttccctctgcagagcagcctttcctgacctccctctcccaaaccagctaccacctccccccgaccagcccagtactctcagcccacctgcgtggtgccctctcgcccccctccctccaccactctctctcccagcccttttctctccctctccttctgtctccttctctattctacaatcatctgctctctttctgtctgcctggcctctgtctgtctccaccagctgacggcagggcctggcccgtttccctgtggcctggccttgtgtggccaagcaggtgcttgtagagaaagcgaaataactaaagtcctccacgaggtttacagtttccttttgggttttgaggaatactttttattgatgctgtccacatcccaggattgtattggaagtttgtttctggtttttagggaatggggtagtttagatctggttgttttgctggtgggattaaagggatctggtgtttgcaccagtcctgccaggacgcttttggaatgagagtttgtgctgaacacctaagagcttctgggcctgtgccagctgctaggctcctgaaaaggagctgatggtctcattttacaggcaagtaggctaagcctttgagagcttcagtgacttgcccagagtcttgcatactgggaaatggcagatcaagaccagaggccaaatctgcagaagacaaagcccatgctctctgctcttccgggcacctgacaccctgctggcccggagcacatgcaggagactgtcattgatggaaggagggggtgtcccactcatttagacttgaatgagcaaagcctgtttagaatcatcttcaaagtcatttcatgtacacaagtgtttattgcccgtgttttaagtgccaggcctggggaaactgtaggaaggaaggtggacacaggcctgcccaggagcaagaaacagactgggcagcgtgattcactccaagtaagaggaaaagtgtcagggcaggctcaggtcccaggggacaggagacgagggatctgatcatggcctctctaaggaaatggtattctagcagaggagcggggaagcatttcaggcagaaagaacagcccatgcaaagactcaggttggacggagtgtggtgccttcaaagacgggagagatcttcacatgctggagtgaagagagtgaggtggagatgcagctagggagccgagtggggccacccccaggggccttgagactgggccatgagttcgaatcatgtcctaaggaagatgggagagtgatccaattcaccttctggggtgatcctcctggcagagatacagggagagggttggagcccagaaatttattccttactgttctgggggctggaagtgcaagcccaaggtgctggaatagatgctgtggggagggcagagcggaccatggtgctcatccaggctgaagggtggctgcacagattcttccgggtttcccaagaacaagaagcagcttcaggaagctgaattcatagcagagaagcaggaaggaggcttttctaagcccagcgccctgcagggaggatgctggtgctggtgtctgcaaggcttggcccctaacagggtttgccctacagatggagcagaactggacagagatgcaccctggcctctagctttgggagcagggatcccggtccagcatcttggcattagttggggcccctcctggaggtgcaggggagcgtcctttccgctcatggtccccagtctcagcaaaacccttggtcccagctcctgaagacctatgttcttgctgcttcctcccacaccccaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacaggtgaggccctgccccatgagggagacctgtgctgccagaatccctgcctggccagcctcaggctgtgcagctcatgccacgcccagggccttggctgggtgtcccgttctacagtcactttctgaacaaggaagtcacattttcattttgcacctcgctctgcagattgcatagctgatcttggttcccacattctgggacggggtgcacagtgaatgtgcactatgggaacctggccacaaagtcctgtgcgtgagcccctcaggacccagggtggggtgggagctttgcaggagagactgacttagagaaaagtggccgttccactttgtcccaggacactgagggcttcatagttgtcactgggcaagagtgtaaggcagcctgtgcctgcagcttactcttattttggatcacatgtgtctcatggactgtgaaagattagaggtaaaataggtaataggagacagtatgggttggaggaatattagacaaacaaaatgtccttctcagtttttgtgaagtcctcgccctgaacattgattgcatgtattttggcaggttttattacttgcatgttctgtgcttttcaaaacagcatgttgtaaacagccatttgccttgaactcaaatcctcatgctccttctggtgtgtccaggataaaaaccaagaggtcacatgcattttggggctgcctctgtgatattcattataagctccaaagtcaatcgtgctgggtttctgggtgaagggggtgacctataacctgaaccatctttctggtttagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggtgaggaaaggatggcccattaagtgtggggatctcggccagaggtctagtgtcaccagggggtcgaggacagagctcgtgcctgggggaggaacaggtcgaggggctgcacctggggagaaacaagaggggggctgtgtcctctggaaatgagcttctcctgaaacaagctggggtgggggtgcacagccaggcttagagcaaggaactagaaaataccccggtgaaattgttttgagagttgcatattagttttcatgtgtatgtgaaaaaaaaaaacaacataaaagtggtgaagcaagtgacttagagaatgccacccctgaggatgctgtggcgaacagtatatagttggtgtacagatgctcagtgtacagaagttatagcaaaaacaaaaacaaaaaaaaactgtaacaagtaaagcaggacgagatggaagcagggggagagggaggaagagagattgctctattgatctcaaatggccgtctcagaagtgctgtggatgggacaggcagcatacgcttgtttgggagcagatgctcacagggtccttggaagccagctccgtatttgtcctcatggtgcgttctcccatgaggtaattgctccatcctacccttgaggactccggggctcgggacgatagaggcctgcagaccaccctgtgatgaagggagaaggaggctcaggccaggaggaggaagtgctgagggggtttccctcccagctggtactggctgtgcggggccctctgattagtcccaggaaggtccagggcggccgtggtgtttggcctgcaagggaaggatcaggaagcgtccgttgctgttcttcctggaagcatctcatggtgactgttgcgggcatgggcaaagctcaggccacgtctccctgggtgtctgtggggagcaggaaagggcatcagatgtcggtgctgaccctggctggtactgaaggcatgcggtgggtactgtgatgggtggatagaccggcagcccagggctccatagcctcccgcttcctgctgctttggagcctttccaccgggtccgaggaagcaattctgagtatgtggctgcacaacatgaaaggggtgggggtgctgtcacctgtgcgtttggaggaggctgactgccaccgcggaaccagtgtctttgtggcagaaactaggagctggtcactggcctgagggcaccaacctctctgaagaggctggagcctgtggtgttcccaaactcgttaggccctggaatccttgcccttaaacacctgtgagcctccagcaggagggtgctatgagggtgcacttctgagtagagctggtgttgggatggtcaagggctagagcacggtccctcagcctcagcgctggtggcaagaggccaggcgattctctgctggggagggggctgtcctggacacattaggatatcctgcagcatccctggcctctccacactggattcccccagtgaagacaatctaaaatgtctccagacttggccagatgcccctgaggggcagaatcacccccagctgagaatcactggcatagtctgtgcccttggtttgggggtgcccttccataagtcccttatccactccaggacacaatgctttcattggtgaagagggagatgggaactgcttcctcttgacattgacaatgtcagcagccagggccccttaccgggtgtttcttgtgtccgggatgctggtctaaggttgtgacaagaaaggttttatcctcacaggagccccatgaggctatgacatcatagtccttattttacagatgtgtaaactgaggcatagggaggccatgtaactggccatggtcatgcagctcgttggtgccaggctgggacttgaacccaggctgccagcgccagctttccgctctgtgctagaccctctctgaggatgagtggattaatccatgtcagcccttggcacagggcctggctcagggtgcacctcggagagcacttcttcctgtcctcaccagccacacggggaggatagcccctggggaggacagcccctggggaggagagcctctggcccagaagggtctcccggcttgactttcctttagggcattgttaggccatccagatgcagtgtcctcacgcctggcgttaaaggtataatgcagtcattttatttaaacacagaagaggatgggaatctgcatttcacctctcgggagcctcaggcctggcccggatatgacctcaaaaccctctgtggcagcgtggttgagccagcagcgtggttgagacacagagtttctgcactggagacggcatcaaagcacatctagcagcacccttggctcccacctctgtccctcccgcccagtgccttccttctctgattgagtgctctgcacagggacgcctcctgctcagccaggtggcctggtcacagccagctgtgttagcctcttgtggctgttgtaacaccttatcatctgctgggtgacttatgaccacagaatttactcttctgcagttctagaagctagaaatccaaaatcaaagtgtgggtagggtcgtgctccctgcgagtgctccaaggaggagccattctcttccagtttctggtggttcctgcattcttggcctgagaatcccagccctgcctccgtgggcacatagctgcctcctctccctccttcctctccccttcatatgaggatagtagtattgcaggcagggcccatctggataatcctggatgatctcctcatctagagattaacttaattacttctgcaaagatccgatttccaaataaggtcactttcacaggttctggggatttggacttggcacatcttttagagaaccccctttcaaccccctgattccactcctcttggttaactcgttcctcttctcattgagctaaagctaggctctgggatttgacccacaaagtcccctccatccctgagatctctgtggctgggccggtccatggcctccaacagaatgtgctgtgaagcttggacttggccctgggcaggtccctcccctgtccctgccccatttccttgttgtcagacgaaggccctcattgttggcttctatgacaacactgaaccttccttcctagctgggacacagttgcagattcacactaattcttgtcattctctattctctgtctctttgctacctatcaattacttattgttgactgtctaattttgtctgtatgagggatcatgctggtatctgtctgtgtcccgtggtgtgtccatcatcccagggtacctggttctaagagtcagtaagcacctgttggttgtgtggctttaaacacatctgtgaccctgatgaatctgatttgtccctccagccgatggcccctgagctccagggtgtctctgtggactctacgcatgcgtccacgtggggactggtgtgcattgcatagcttacatctccagatctcggttcccatctgcgccctgtgctgggactcttctccatttcaatcaatacatctaagcctcctgtgaagcttttggctttgtgctgatgtccggatgaccctgaagtcctctctgttccccttggagcagttcgcgggtccagccaactccctcttctctggcaatggtttgctgtgctctcctgcctggacttggcctccaggcggtctctctgtgccaccattgccccatttctagttcattctccacacaggtggccacaggaccagggtctcatagaagttggataatgtcacctcttgctcaaatccctccagtggctccctgaggcactgaatgccacatcctccctagtgcctgtggccccaccccatgtggcctgcctccctctcccggctcgcctctcccttggacccagcccatgggcctctttgatggtcctcacaccccaaccacagcccctgagactcttgctgtccctggaggtgtgcaaggctccaccgcgtttaaaacatcgctcagtgcaggaagccacctggccgctgtgtggcaacacttggccccttcttctcacccaaccttatttcccctacggcagcgtccctgacgccaataccattggctttgcccatgcagcctctctaccagcacatgggctccgcgagaccaagtcttcgcctctgtagttcttactgtgcgcacagctcacgagtgctaagtgcaaaataaatatcagttacatgaatgagccagaatgggccaatgggggattagagaagccagtgcctgtaaagtactaacaggtgccaggtccagggagccctcatccctggactgtttctcccatggcgtggctcagacctgagcctcttgttatttgttctcgaaacccagtgtctgtaagtgaacacggattttgagctggggtctgagagtgggggaaggtagcactcattgtagaaactcattctggaaactgctgtcgtgaacgtggcccaggcccaccgctgtctgcaccgtgcaatgtgttacatggggtgtcatctgcaagccctgggtgaggccccctttcctccatgggccttttgtgggccaaggtcaggattcctgtctgaccctgagaaactccttgttgagggctgggctcattgcacaaactggcaggtatgtctgaggtgcaacctccagccatttgcaaattgaggcttctgtgtgctggtcccagggtatagagtctagggtccctgaagccctgaaatcaagtgcagaaagcagtgctttgcttttgtcacattctcaactgtgtccccaatgctccagaagtgatagatctctgagataaaatgctgtgggaaaattcaatattggtcatacagaaagtatataaatgttgctttttggggggaaaattactcacagtaggaaaggcctgtaagagtattttgctttgcctggtgcagacaatggtgaataatggttgttatttgcttctctctgcagtgtgttgagttcaaaccccattcccactgtctcgcctgatacattgttttcacatctccatggggtgaaagcagaaagcaccaggcagcaaattaatcaattattaatcgcaacaactactattttattcatttattcatttattctccctctctccctctctttcccctgttgagggaggtttggcagacgttgtcttatcccatgtgaaaaagaaaatttttgttatcaaacgtttttgtgaacttcagttctctattagaatggagaatgcatctgcatgagaatttaatttttggaaatggtggaggccctatgcccacatgcacatgcgtgcccacacacacaggcttgcacatggggtgccttcgtgggtatgcctggtcagcggtgggtgagcagggccttgcgctcattctccagtcatcaaaagcgaattttatgagaaacagtctttgtgttgtcactgccccaagatttaagttttaaaacctgtcaagaaaaagatgtttgtgttttgtcttttctctgtgctgaacccaagagtcatgaccacacctgtctggtttttcacagtgtcccagctctgggcgcagtagaaacacgtgatgagggggagcgagggactgaggggctgctatgggaatccgggctgcaagggaagaacctactgatggaaggaagctgacttctccagagccccccagctgcctgtgctgctgctcctcctgcagacagcttctcccaggtgctcatgacagcaaggctgcaggctaggactcaccactgtgtctcacctgggcccatgtaaggacagcacaggccctccacttcatccatgctgtagtcttagtccctttgagctgtcataacaaaatccctagactgggtgtcttataaacaacagaaattcattcctcacagttccagagacagggaagtccaagatcaaggttctgacacgtggggtttggcaaggccccactttctcataggtggtgccttctatgtgtcctcacatggcagaaggggccacagagctctctaaggcccctttcctaagggtaccaatcccattggtgagggttccacctaatgatctaatcaccttccaagaccctaccccccgaataccatcacattggggttaggcttcaacataggaattttgggggacacaaacatctggcccctggcattgggaatgtcacagggagggctgtctgtgcagctgggtgggcctccgtctctggggcttactctgcgtagagagacttgctgcaggatttgaccaccccacgtgcctcgacatgtttctttctagctctgtgaccttggaaaagtttcttaacctctctgtgcttcagttctatcccttgtaaatgggggtgacaagaaagttcttatgaaggtcaacaggggtgctcaccgaagtatagctttgtctcattgtgctcagtgagcgttctggttgccgtggtaatcagcactgtcaccctcatcatcactgtggttaaggagcatataggaacaaggaagcactgggcatccaccgctcatcaaaatactgcctcacaggcatgaagcaaagtttagctcccagtttgtcaatgttccgtagctgatttgtgctattcctcattcctcggccaattcatcagtgagagtgttgatgtccctgccgctgcataggtacatctgttctccatccagacatgcagttacatgtgtttgtgtaactggctgtggttttgcttgcctgcttagcaagggacaagggcaaggggaattaatcaccggggtctatgtgccaggacaggctggcggggacctttgggttggtcaggagaaacaagcctcaagaaggcctctcgatggcacctgccatgagccacccgtcccagaccaggttgggtaacccacggcgcccagcctcagattactctgcccattgggatgaccctgggcaggtggtggcacatctgggccctggctgcctttcggtagctcacaggtgatgtcagtgacccccttgtcaggttgtcctgggggcggatgagacaacgctcatggagggcctggcctgtgtgggcacatggcgctcacgtggtagccctgctgccaaggttttctgagggtgtgtcccagcggcaaaagaaaaaaatctgatatttgtacattatttatttataaactatacattaggggtaccatgctaatatactgtgtactttataaaatatacatgcaagatagtaataaaaggtgacccgagagagtgactatgtacatattaatatgttctagcacagcctgccccactgtgtcctaggagtaaggccctaggaagtatatttcagcaagcacaggggggttctagtgctggtgcaggagtgaaagagtaaatcctagcccccacaatcccatgagtcaattccagtcagctaggcggtacaagagtaaagggacatacgggatttcccggctttatagattttttttaaagcttcttaagacacacccttgctatgtattcagcaagtactatatgtcccaatctaggcctcaaggattctaaggagaaactagacacagtctccaaccctctaggagctcatgactgaccttaaaagctgatgttcaccataaactcaacaacgcaaaagagggctgggtcgggagttgaaaggtgtattagtccgttttcacactgctgataaaaacatacctgagactgggtaatttataaggaaaaagaggtggttgtttttttcattttgttttgctttgttttttgttttgttttttctaagacagagtcttgctctgttgcccaggctggagtatcgtggcacgatcttggctcactgcaacctccacctccggagttcaaacaattctcctgccccagcctcccaagtagctgggattacaggtgcataccaccatgcctggctaatttttgtatttttagtagaggcagagtttcaccatgttggccaggctggtctggaactcctgacctcaggtgatccacccacctcggcctctcaaagtgctgggattacaggtgtgagccaccacacccagccagaaaaagaggtttaatggacttacagttgcacctgcctggggaggcctcacaatcatggtggcaggcaagagagaatgagaaccacgcaaaaggagttttccctcataaaaccaccagatctcatgagacttattcactaccacgagaaaagtatgggggaaaccacccccatgattcaattatctcccattgggtccctcccacaacacttgggaattatgggagctacaattcaagatgagatttgggtggggacacagccaaaccatatcaaaatcctaagacaaatgtgtgacgccaagaatgtggtgacacgggcatttgatgacatggagaacgttacacggagagaggcaacactcaggcagttcctggtactgtctaaatgtaaagaaagccttctttgcaggctccgggatcctttccccagtagacatacttgtaaaaagtgaatgctaacgtgttatttgaatgccattttaagtgtggggagggtgtactgaaaggcttcgtgcagtgtatgcttctgtaaagtgaagagccacctgcagcgagtgaggactcccccacagtcgtctccatggtgacttcacagaacagcaggcagcccctgccttttcttgaaagttggggctagagatttgaaaggctgtggaaacccagccactccctgcactgacaccagatggcgctggagatgctcgctgggatgcaggatgcttgtgagaacctggtctcaggacgacctggtgggcgtcttgcagcggaggcaggtctggcccagggtggttctggctgagcaccaagcagcagagctctcagagtgggaacgcacagccccagtgacaatcagctgaaacagggctgccccccgccccgccccaccccggcccttttttttgtttgagctattatttcccatcaagtaccttgataagcacttttcatgcattttattgcctaagtcccttgacaaggtgataagacagctgctattaccgctttttttgtttgtttgtttgttaacagtagaggaaaatgaggcaaagagaggggatgaaacttgcccattttgaatccagggctttccagctccacagcacatgactgtagcctactgttcgtccaatgcgtaagcacatcataggtgccaggcactgccctgggtgctgtggacacagtgatacaagccagggtcccagcccgcaggtgcctgcagcaagggggaggcaggagcccccaggaggtgatttcaagattggggcatgagcaccagatggacacaggcaaagagtactctgtgatttgtgcatctgaaagcagctgttctgggccagccgtgtgctcttaaaagcattggtaggaactgtatccgtctccctggggcctgggcctctgcactttgcaggctccgcaagggtgaaggtcaatcttgtgtgtcctcttggctgagctgttccacccagctattgaaatgctagtctgcatgttgctgtgaaggtattttgtagatgtggttgtcacctgcagtcggtgactttaaggggctttgagtggccctctccagtcagttaaaggtttgagaataaattggagtttcccagagaagaggaaatcttgcctcaagactgcggaatccactccagccgctggcctgccctccaaatccaggactgtacagcccccgcaatcgcatgagtcaattccttaaaataaatgtcttaaaacacacacatatgcacatatatgtgtgtgtgtggatgtatatatatatatatgtgtatatatagaatgtgtatgtacaaacatgtatgtgtatgcatatgtatatgtgtgtgtggtgtgtgtctatcccattgcttctgtgtctctggagagccctgacccaaacaccaggtgactctcaagagctgccagggtggagaaccaaagctttaaaatgaggagtcctggtcatcaaggtaaaggctttccacatagggacagcttgagcctgggcgtggagatgagacgcgtgaggtgcacagggtagcgtggttgttgcatagcccagtgtgagacctagggactggccagggagagagacctttattcaccctgtaaagaaagctggaattcaaaagacaccaaagtgtgaagcctctgagggttgtcccaagtcactcacctcctggctatgtggccttgggctacactgtgggacgttgtcatctgcaaaataggaaaactaaatcctagcacctgccttatagggctgcggggagatgacatgggaaacgcattcaaaggctgcctctgggcctggcataccgcaagggctcattcaatcttggctgctcttgctgccactggtgggaagcagtgtgggatctcctgcagctgaactgatctttctggagtgcagacctgatgccgtctgtcatgattcaagccttggaaagggccccaggactttccgagggtgggagggtgggctccagagaaaagacagggaggggccatgaggaggctcaggcaggaggggatggggtctgcagggagtgtcagagtcagctccagctgccgtaacaggataccacagagtggatgcctgaaacgacagacgtttgttttcttaccattctggaggctgaaagtccaagaacaaggtgatttccagtgaggcctctctctgtgtctttatagggccgttcccctgtgtgctggttggtgagagtgggtgatgagtactctggcctctgtttcctctacagggacaccagttccatcagatcagggccccgctcttgcaacctcctttaaccttagttacctccttacaggccctacccacaaatacagtcacattgtgggtcaaagcttcaacttgtgaattctggggcagagcggtggtacacaggtgaatcataatgtgggagactgaggcagagaggagaaactggcaggagctggggagtggggatggtgctgctggactccattcttgcagctgtgggcccctggctgcaagagaaagcgcagaggggaggaagcgggagatgattcgccagcgacctgagttgactagagaggggccctgcccagctccacgctgacagggaccatatagtcagtcaagagcgtttattgagcacctcctgcatgcactgtgaggaaagccaagtcacatccacagaggaaggccgtggtcagcagcaccagcatctgtccagtgggtgtgtccctggcatgttgcaccagcacagcgtgtgaggtccgatccttaaagctgcttcattttgttttccagcagccctctgcatcccctgcttctgcatcccctacttcattttgttttccaacggccctctgcatcccctgcttctggttttccaacggccctctgcctcccctgcatccccaggtagcactagacttttctgtttatttgcaggtagtgaactgccactgagtctgagtcgtaaacactgtttggattcagaggtcagaatatccttcccctgtgatgctcaaacttctgagtcagttcggtgttttgccagctccctcctcaactgagcccctctgtggcaggaggcctggggctgggatcctcccctttgccctgctcattccccagcttctgcgtgtgtgcccccagggagtgcaggctagcctggtgtctgggggccttggctgggctctgagctctgtgtggccattcagtttgcccacttgggtcccagtctgtggggctggcacctgctggaggttcaatttcccttcaaaaaaggtcatggtgatccctctgagaattactttgagaacctgacaactcaatgatgtgagattgcctactccaaggcccttctgtgggggacagcgagggctgctgtggcctcctgctcctctctctttaagatgagcaggtccatccacagcagcccagggagcagccctgggggcagagccatcaaggacctggtggagccatcctgaaacttcaacaggtcagggtggccattgtgcgcggcatggcacttagcacagctgagcagttaaaggggtatatggagggccctctgtgcagttgacaggtgtctgtggagcactctctgtgccattgacgggtgtccatggagcgctgtctgtgcagctgacaggtctccacagagcactctctgtgcagttgacgggtgtccatggagctctttctgtgcagttgacagatgtccgtggagctctctctgtgcagttgacaggtgtttacagaagtctttttctgtgcagttgacgggtgtccatggagcgctctctgtgtagttaacaggtatttacagaagtctctttctgtgctgcttgtagaagtcctcaacaatggtgatcttcactaatcactatttttttttcaggaagtatgcaggacttttgcaatccaacgtgcgtgtgttattttaaatttcatggctatggtggcagtggtgtcagagtaagggaaatcatgcagagtggaagcaagaggaaaccctgtcacttgtgccctattctgttgcaaaaccatgtcccagtgctggcctagacacacggggtaggaaaatagacaccacgtttttgtaggaagattggagaatagtggtctccttgcacttgacctgctgtgaagagttgatgttaacttcttggtgagtatgtaaattacatccatgggcacaggcgttctcgcagaggatgccccatccaggcctgtgatgcaactgcagtgccctggcaagtgcactggcttccggggctgggctggggagggcactgagctgagatccagaggaggagcagaggtgggagggtctcacaggctcagaagctccagggtggaaggaagcccagcctttgagggacgaaagggaagaagacaggcagagatcattctggagaagccagtaggggagtggccatgtgcagccttgtctactatgccagtgatctcactctttatataaagaaaatgcacaagagatatagggacatctttgtggctgttgttctgccaacaaccgtggcacacacaaaaaccctcacagcaggagcccaggaggagaagagagtccccattccactccttagacagcccctctggccaggagctggagaggagagtttccagtgccattccttagtcaggcgccctgggctagagctcaggctttcagacagagcctgacttttccacacccacttcctactggtttacagctactgtataaagcaaagcaccctcactttcctctttgtgacaggtagtgatgctttttacagaaactagactttatagaagcctggaggtgtggaatggtagagatccacaggactctgtagtgaacatgcaacaccagctcccatctgaaatacacacccacagatgcatttttccgttttattttatttcttccataagttattggggtacaggtggtatttgcttatgtgagtaagttatttgtgagatccttgtgcactcatcacccaagcagtaaacactgcaccatatttgtttgtcttttatcctttgcccccctcccactcttctccccaagaccccaatgtccattgtatcattcttatgcctttgcattctcatagcttagctcccacacataagtgagaacatacgatgtttggttttccattcctgagttacttcacttagaataatagcctccaatctcatccacgtcatcgtacagatgcgtttttctctagagaaagttcatcagcccagaaggcctgcctgggcgcttccctttcagactgagggatagtgacacttcccttaccctcaggcacccattgcagggtctggatgccccccacgcctggcagcccctcctcccccattgttggctccctcctctcattaacctccaaccctgctctctccctggctcccaggacaccatccctgcctttcttcctgccatcctggcccctcttccctgacccgcccctaaaggtgagcaggcccaagcttcctggctccttcctttgctggctctgtgctctctcttgaggctcaacctcacatctgtccccatatgtggatcgtcacaaatctccatccctggctccagctctttctgatgctaaaacctcacatgtccatttgtccactgtccctgcagaggccctgatgcaccctgagttcagcagagccaaagctaaccttgtcctctttcccgggaaacccgctcaacttcccagatcctcatactcagctaatgtcatctccatgtttccacatcaaagcccaggcagtcccctcctccaacatcacagccccactcattcagaaaagatgtgccatgatgtatgtgtcaggcatggcagggagagtttgccctcaagacccccagagtctggtgtcggcatctataacagtgtcactgttgtttcagaaaacgtcaggcacttctgcctctggccatgatgaagcgatggtagctgccctcccactaaaatcaaacgagagactggacaaaatgaatgagaggactgtttcgaggcattgaacagaaacagtacatgcctgttatccttgagagagtggagacccctgggttagcccataattgatctccctggtttctgggggaggcatcttcctgcagggtgcagggaggtggcctctgagcagagtggtgatctcaccgagatgaggaggcagagactggagtctgggctactgaaacagctggagtttgtaggacaggaaggagctatgtaacgggttctgtgcagatccagttggccatagcctgggctatgcctatatgcagaattctacagacttagcagagattgcctgtgagcatgacagctgaaggtcagggggtgctaggagatgttgggagttcagctcaaacagaatgaagagatcttgatgaatgcaacagacttgaaatcccacaaagaccaagacttaggagtaaggggcataccttaaggctttgttcaaaaccaaaatggacctgcagttattataaatatgttagaggtcttagagtgtcaacaaaatgatcacaatgaatgaccagatggagaatcttagcagagaaacagaaacaaaaagaaaaccaaatggaagttctagaattaaaaggtacaatatctgaaaatgtcactgcttgtgcaaaacagactccaggactgttctcacacaggggcttataaagccaggacataggccaggctgggaggagttggggaatccctgccaccctcctctttcctgggattcattactccctctacccaaatgccaaagcctcatgcacatcaattcatgcagcctgaacccagcaggatccacgactgccaatcctggcttgcagtttgtgctgggaaatggctgcattagcaacgtggagacatacttccttgtaactaagactttgtgcatctctgtaattatgtccttaggataaattccaacatgcaggctaattgagaaaaagatatctcatcatgagtttattttaactccaaagcctctttgccttatgttcttatttatatacatttcctttttttctcttttttaaaatttaactttaaagttcaggggtacatgtgcaggtttgttatatagataaacttgtgtcatgagggtttgttgtacagattatttcgtcacccaggtattaatcttagtacccattagttagttttcctgatcctctcccttctcccaccacattggcatcctttttcttctctagagagtatctgagactggttctaaaagcagtagccagcccggtgatacagggagaaatagccaaaagagctcctgccaaaacctacagtaatcagaaactttgactcaggaattctcccctttctagggatcaagctgatggaaatattcatatgcatgcagagaaatgcaggaatgaggacattttctgcggctttggttagaagtagaaaaacaaacactaacctaagtgtccattcatggtgagctggaccaataaatgatgggattatgtgatgttcacactgtggggttattaacagctattgaaagagctggattaaaacaccctgctttggaaccaggaccagctgtggtgtggaggaaacagcatattgcaaagtagtgtgtatggtatgatcctacttttgtaagacatcagaattaagtgggagtctgtaaattgttaattgtgtagaagtaggtctggaagtagatactgcaaaatgttagcagtcgctttttttagaggtgagatgtgggcagagaaaggaatactatctttccttaatactattaggcttaagttgtttgcaacgagcatacattatttttgtagctgaggaagagaacatagttctttgagctttgctgggaggcagtcagctctctggtctcagctatgacctgggacaactcatatctccatgaactttggtgttcttttcattaattcaccagggaggtgagggtagaaggagagcctggtgagcacctttcagctccaccatggtatgaatgtttgtctcctccaaaactcatgttgaaatttaattgccattataacagtattaagaggtgggacttctaaaaggtgattgggccatgagagctccgccatcatggatgggattaatgctggtataaaagagtctgtctggccctctctcagcctctctttgcccttctgttatgttatgacataacaagaaggccccttgttatgctggtaccttgctgttggacttcccagcctccaaaactgtgagccaataaatttctgttcaatgtaaattacccagtcttgggtattctgttatagcagcatgaaacaaactaagatgggctctaattctgatggtcagagcaagctccctggtaggttgaagggtggctctgactgggactccccattgggaagcaaatcaccctacagccttgtcctctgggaagtcctgacctcaaggagcactgcccagaggagtggctagagggtcactctggagaagcatgtgagcacttttcttttttctttttttttttttaactgaagttttagggtacatgtgcacagtgctggtttgttacatatgtgtacatgtgccatgttggtgtgctgcacccattaactcgtcatttacattaggcatatcttctaatgctatccctcccccaccccccaccccacaacaggccccggtgtgtgatggtcctgttcctgtgtccatgtgttctcattgtttcatactgattgtatttctatttatttttgcaaacaggtggtatactcagtatacattgctcaaaggagccccagtgctactggtttcttatctgtcccattggggctgttttatgcttatacaagcgaagatacattaatatatgttaagcttttccatcttggagattaggtatcagggagaagactgatgtgagatctgcctcctcttctttgtccctttcctgtctccccactcacctaggaatagaagggaggattctgacgactagtcttagagccaggcacctctcttcactctagagagggcagctcttcctgggatcaaagtgccatgtgtggtcttcttggagtggggctatcaggaacagctgggaacaaatgaggggccttggaagcatcaaccaggtctcatctgttgatggacatatgggttgtttttagttattacaaataaatctgtgatcagcatttgtgtacaagtctttgtgtggacatatgctttcacttatcttggataaatagctagaagtggaatggctgagtcatgtggtaggtttttaactttttaataaccggaaaaatgtgaagtgatcctgccatttagagtggtcctctgatatattctcaccatcaaggtattagagtttcagttcctccacatcctctccaatacttgatgtggtcagtctttttaatttcatgtaaagaactctgtgcagatccagttggccaagggctgggctatgcctatatgcagaattccacagacttagcagagagttagaatttaatttttaattctagtgggtgtgttgtggtgtcttattatggttttaatttgcattttttctaataattaatgatgttgagcattttttcatatacttatcaccatatctttgttgggaaaatatctattaaaatcttcccatttttcaaaattaggtcaattgatttttatgtttgagagtttcattggtctgtgtgtctgtttttatgctgctttagttattataccaaaatattgtttggtaccatgctgttttggttactatagctttgtagtatatctatttattttattttatttttttagagacagggtctcactctgttgtccaggctggagtgcagtggtataaccacagctcactgaagccttgacctcttgggctcaagtgatcctcaaacattggctttctgagtagccgagactatagacatgtaccaccacacccagttaatttttgtattttttttttgtagagacgaggtctcactatgttttccagggtgctcttgaactcttgagctcaagcatttctcccaccttggcctctcaaagtgttgggattacaggtgtgagcccctgcacccagcctatagtagtatatcttgaagtcaggtagtgttgtgcctccagcttcgttcttgctcaagattgctgtaaatattcagtgtcttttgtggctccataccaattttagattcattgttttcctatttttatgaataatgtcattggtattttgataaagattgcattgaatctgtgtatcactttggataatatgggcattttagcaatgtttattcttcccagccatggacaaaggatattttttcatttatttgtgtcatcttcaatttctttcaatgattcataattttcagaatacagatctttcatctccttggttatatttattcccattttacttttttgtagctattgtgaatgggattattttcttgatttctttttcagatagtttgctattgctgtacagaaacagtagggatttttgtatgttgatttttgtatcctgcaactttatggaatttgtttattttaacagttttttggtgaggtctttagggttttctatatagaagttcatgtcatctgcagacaggaacaatttagcttttcctttctaatttggatgccttttttttttctgtagcctaattgctctggctaggacttctagtattttgttgaatgaaagtagtaaaagtgggcatccttagctgggcatggtggctcatgcctgtaatcccagcactttgggagggtgagacaggtggattacttgaggataaagagttcaagaccagcctggccaacacaaagaaacctcatttctactaaaaatacaaaaaattagccaggtgtgctggtgcatacctgtaatcccagctactcgggaggctgaggcaggaggatcacttgaacctgggaggccgaggttgcagtgagccaagattgtgccactgcactccagcctgggcaacagaacaagactccatctcaaaaaaaaaaaaaaaaaaaagagtggtcatccttgtcttgtttcagatcctggaggaaagactttcaattttcctccttcaaaatgatgttaactatggatttgtcatatatggcctttattatattgagttacaattcttctaaactgacttcattaagaggttttattatgaagtgatgttgaattttgtcaaatgctttttctgcatctatgatttaacatattaatttttacatattgaaccatgcttgcatccctgggataaattccacctgatcatgttgaaggatctttttaaatgtgttgttgaatctagtttgctattattttgttgaggatttttatatctatgttcatcagggatgctggcctatagttttctttttttgtgtccttatctggtcttagtaacaggtaatgctggccttgtagaatagtttggaaatactccttccttttcaatattttagaatagtttaggaagaactgatattagttccttaaatgtttggtggaattcagaagtgaagcagtcaagtcctggactttcctttgatgggagattttttagtactgactcaatctccttactcattattggtctgttctgattttctatttcttcataagtaaatcttggtaggctgtacgtgtccaggaaatgatccatttcttctaggttatccaattgttcgtactgtgcattgtgcaggtaattgttcataatagtgtcttatgattccttctgtggtatctaatgttccatttttcatctctgattttccttcatttcttagtctaaagatttgtcagctttgtcttttcaaaaaaacctcatttgttaatcttttgtattttctagtctttattttatttctgctctaacctttatttttttttccttctactaattttgggttgagtttggtcttttcctggtttcttgaggtatagtgttaggttgtttatttcacatcttattttttgatgtaggcaattgttgttgcatgcttccttgttacaactgcttttgctgtatctcatagggtttggtatgtttttacttttgtttgtctaaagatactttctaatttcccttttaattttgttgttgactccttggttattcaggagcatgatgttttatttcctcatatttgaaaagtttctgaagttcctcctgttactaatttctggctttatacctttgtagtcaaagaagatacttgatatgatttttatcttcttaaatttgttaagatttgttttctggcctaatatattatctaggagaatgttccatgtgcaattgagaagaatgtgtattctgcagctgctggatagaatgttctgtaaatgtacattatgtctgttttgtctaaagtacactttaaatccaatatttctctgttcattttttgactggatgatctgtccattgctgaagtaaggtgttgatatcacctgctattattgtgttgcaatttatgtcttcatttagatctaataatatgtgctttatatatttaggtacaaatttgtatgcatatatatttacaatggtaacatcctcttgttgaattgatttcatcattgtataatgaccttttacagtttttgacttaaactctaatttatcagatataagcatagctactcctgcttttctttgggtttcaatttgcatggagtatttttgtccttcccttcactttcagtctgtgtgtgtccttagaggtgaagtgaatctcttataggcagcatacaattaggtcttgtttttaaaaatctatttagccactctctattttagctggagactttattcatttatattcaaagttagtattgatgggtaaatactcctgccattttgttagttgttttctggttattttatagatcttttgatcctcttttcctctgttgttgtttacctttgtggtttgatggttttctgtagtgcaaagctttgattctttccttgttctcatttgtgtatctgctgtaatttttttgttaccatggggcttatataaaaaattataaagttataatacactattttaagtagaaaacaatgtaactctggtcacatacaaatactctagacttttaccttaccccactcccacagtttttaattatgctgccttaatttacatctttttaattttgtatgtttcttaacaacttattgtagctatagttatttttgaccattttgattttttaatcttcatactagagatttgaaagatttacctacaccattatcataatgtagattctgaagttgattatgaatttgcgtctaccagtgagttttatactttcacatgttttcatgatagtaattattgtcctttcacttctggttgaagtactctcttgagcatttcttgtaaaggcaatctagtggtaatgaatttcctcagcttattcttgcctgggaaagattgtatttcctccatttctcaaggatagctttgctggatataatattcttggttagtagagatttttttccccctctcttatcatcccattctctccaggcctgacaggtttctgctgagaagtttgctcatagactaatggggattcccctatatgtgactttgttatttttatttccttctgcttttagaatcttttcttgttttcaccttttggtggtttgattatgatgtatctgagagaggacttctttgagttaaagttatttggggatgtttgagtttcatggatctggatgtccatctctctgccaacacatgggaatttttcacctgtagttttgttaaataagttttctgtgtttttatctgtcttctttgaaaatttcataatgcaaacatttgtttacttaatggtgtctcataagtcccataggttttcttcattttttaatcctttgctctctctcttttcccctctggatgggttattttgagttcagaagttcattttgcttgatctagtctgttgttgaagctctcaatttaaaaaaattatttattgaattcttcagctacaagatttctgtttgttcctttttaaatgatgactctttgttgactttcttattcagatcataaattgttttcctgatttcattgaattttctactgtattctcttgtatcttgctaaggtttcttaaggtcattattttgaatttcttctcatgcgattcataaagttttatttctttagggtcagttactggagaattattgtggttttttttttggcagcatcatgtttccttgctttcttgtttcttgtgtccatgcattggtatctgcacatattgtggtacaatcacctcttctaattttacagattggcatattttgggaaaaacttttacctatagatgggacctagggtgtcagtagggtagagtacattgccctttgttccaggtgggtgcagtaatatagtctctgtgcaggtttttcagctgtaatcaatgtcagcaatgcctgtgagtacctctgttgcctagtctgcagaagtctgtggcaatagtggtagcaagctatagtgttagtttcctcattggctgccaaatactttttctatgtacattgaggtaattgtgtgctttccttttttcagtttgtgaattttggtaaattacactgttgctttttgagcgataaactaatcttgccttcctgaaataaaaactccacttggtcatggtgtatcacaatttttataaattgttgggtttgatttgcttttttttttagagttttacatcagtgtttttcaggaatattggtctttcattttcttttcttggaatattttctagttttactttgtcagagtaaattctggcttcacagaattatttgtagtctctcctgtcttagtttattcatgctgctataacaaaataccacagacaaggtggtaataaataacacaaatttatttttcccagttctggaggctaggagttcaagaagctggcaagttcaatgtctggtgagaacccattcttcataggtggcaccatctaggtgtccttacatgacaagagatggaaggacaaaaagatgtgaactattgtgaagcccttttttaagggccttaaatccattcattatggaggagccctcaagccattcatgatggaggagacctcctgaccctaatcacttgcaaaagtccctgtctgttaacactattacattggagattaagtttcaacatgaattttggaagggacacaaacattcaaaccataaaaacttcctttcacttttttgaaataatttacataaaattagtattattctctaaatgttttgtagaactcatcagtgcatgtgtctgagactgcagtgtgtatgtgcatgaagatttttaattagaaattctatttttaataaatataggtccattctggttacatatttcttcttaagtgaggtttggtagtttgtgttttttcaaggaagttgttcattttatatcaattgtcaaatttattagcatgaagtgattcactatattttttatatcttcttaacatctgtagaattagatgatgtcagtgtcacctctccagtttctgatataggtaatttgtgtgttcccttaccatctctttttccttcttcttcctgatgaattattttctttattattttttaaatttcattggtttctgctttgatccttattatctttttcttctactcttgtggtttattttgttcttctttgtctaggttcctaagatggaacctgatatcatcgatttgagacctttcttcttttttaatattggcatttaatgttataaatttccctgttaccattattttgatatattgtattttcatttgtttcaaaacactttcaaatttcccttttgatttcttattggagccatgaattattcaggaatttaatttagtttccaaatatgtgggtttttttagaggtatttttttttgttattgattgccaatttatttccactctggtcagagaacatacttggtatgactgagtcctttggcatttattgaagcttatttctggtccaaatatgtccaatcttggtaaatgttttgtgtgtacttgaaaagaatgcgtgctcttctgttgtttggtatagtgctttataagtgttagatcaaattggtcgataatgtcattcatgtcttcagtagccttacaagttttctatttattctatgaattatttagagaggggttttgaaatctccaagaaatgatgtgtggatttctttatttctttcctcaattctgtcactttttgctttaggtattttaaagctcacataggtttgtcaatatttagtatcattgtgctctcctgatgaaggtatctctttaccattataagatgacccttttcaaagaacctgatgaggtttcttgctctgaattctaccttgcttgacattaatgtgcccatttcagctctgtttgattagtgtcagaatggtacatcttttttaagattttatttttaatctatttgtaactttatatatagttttgttgttctttataggttctttatatataagacttgttggcagcacatagttttgtctcatgttttaatccattctgaaaatttttgccattaattagggtattctgaccatttgcacttaatgattattttattaggtttaactctaccgtctggcaatttattttctatttgttccatctagttttttccatcttttctatctttctgctttcttttggattgagtgattcttttattccactttatctcctctgttggcttattagctatatacctctttgactatttccatagttataatggttgctttagtggttatagcatacctctcttatcttatcactgcctacctcaagcaatagtatgctaattcacttttagtctcatgacctcaccagagtatacttctgttctcctttcccaacatttgttctattgttgttgtccattccactcatgttataaacctcatactactttatttttagtatcaaagtcagttttcttttaaagataaataataagaaaacaattatatatttacacttgtggttaccatttctattactcttctttccttggtatagattcaggtttctattggctatcatcttccttttgcctaaaggatttcctttgtcatttcttataatgcaggtctgctggtgatgaaatcttccagcttttttatgtccaagaaggtacttattttgtctttattttgaaagatagtttttccaagtatggaattccgagttgtctggggttttttttctttcattactttgtaattgttgctccactgtcttgtcatccacattgtttctcttgagacatctgctgtcattctctttgttactctatacagtgaatacagataatgtctttttatttctgtacacttttaatattttctcatggttatagattttgattaccatggcccagacacagttttctttatgtttcatgcataaagttcactgagccttttcctgcttctttgcaggcatggtaattttttattggatgacacatgtgaattttaccttcttgggtgttggatgttttttgtattcctataaatactcttgagttttgttctgggaagcagttaagttacttgaaaatagtctaattcatgccaggttttgctttaacatttgttagatagaaccagagcagtgctcaattattgagttagctcaacagctaactcccattccagaggcagaaccccgtgtactctattcaatgtctgtacaccatgaagttttctgtctggctgatgggaaccggccctccgtctagtgccatgtgtgcaccgggcactgctatctcatcatttcagaggattctttcctcagagtcacatattaatccactgagggttcaagggaccctctgcagatctttggatcttcttactatgcaactctctcctctccaggtctctttcacgctaactctggctgccctgatccccttggcctctcaggttcatattctcaactctgggagttttccaggctcttcctggattccccctccctggattgtggcctggcaactctctagaggcagtagctggccagtcatgggcctactccatttgattctcatttttcaagaatcactgtcttctgttgctgatttctagcacgttgaaaactacggttttatacattttgactttgtgtttgaggtttgagtgaggaagacaattcagtccatgtttgtccaccttggtcagaagcagaagttaatgtcatagctttttactttgaagactcagacaagttttcacaacacattccttctagagaataaagttaggctctgctattgggtgtccccagatgggaaccccacttatttttaggcttcagctcagacgctacttccttcagaagtccctttctggcacactaccttcctcatgtggcttatttgttcctcttgcaccagatcactccgcagcttttgagtttgtatatggcaacaatgaacaaggtataatcctcgctgtagataaactcatcatatttgtttttctccatggagtgaaaatgttttaagctcatataatgactatggtcagggaaaaagccacacaaataattaggatatgttgtgacagtgcacaaatagaaacacacataatgtgcttgagaacatgataaatgccggttttacctttccttccctcacctgaccaagcttagcgagacgtgtggcatcttcctcatctttgctcttcagtgccaggtatggaataggtccattatggacaggtgccttattgaactgagcagagccacgaatgtcaggctgggagtgtggtcgctggagtcaggccttggtttacatcctggttctgcttcttaaccactctgtgcttcgacaggagagcaggaggtcctacttagttttggacgtgctaagtttgggatgcctgctagagatctgggggaagcatggtgaagaaagctgaatgtgcaagcctggagttcaggagggaggtggtgtctggagatggaaatctcgagccagtagcagttggttcttagtgtcatgggacacaggaggtcatataggaagcaaatgtggacagagagtgaaggggtttgaggattgggtcctgggcacatccacctctggaggtaggggagatgatgaagagccagcaaagtaaactgagacataatcattgaggcaggaggatagcaggctagggcagagacctgcaaggagagagaagagagcctttcacaaagaagggagtgaccgatggtgtccatgcttctgtgtgcttgagtacagagtctgggattctcctgagcatcctttgctccactgggatggaagatgggacctgatgagaccggggctaggggaatgtcctgagccccacacgtttgtgtctgtgtgcagggagcgtggaaggcagttcctgcttggtgaggtggagctgagagcggtgccacttagcagctatctgtgccactctggtatccggagagaaggagccggcatttgcccatccttcctcctaagccctgtcagttgtgattggaacgatgcccccgcccaccacatttgctggagttggactagagctggtaatatcagggttttactttttagtttaatttcttgcacaatgcatggatgtttattgagttttgccaataaagagttccatagggtattactgagcaggactggtctgaagataaatgaaagttgtgtacttggaaagacaatgctgtattattttcaaacccccttgagaaaaaggccttttgcactgggtgagctctggatcaggtccaatacagacagccttgcaaaagtggtgtttcagggaacacaagatgggtcaaatgatgacagtttggggggaatgagtctttgaagagctctagccctgttcttttccctcggtggctgccaggcagctggtcttcactacaaatgcagactgtcacatgtcaagactactgcagagttgaagaatggggcacaggactggaaaaggtgaaacattcttctcaaaattccaccaatttttctggaataaacattccttgttttgctgtaaacatgtggttaatttcaagaattgtgaaaaaattgactgcaatctttttttgccagttttctctttgcttttacaaaggagagattttttttttgtcattttctgtgatgttacctaacaatgttctttctaagcaatgacttctttttttataaggaaactatataaaaaataaaatacagtaaccaaaattaagtaaaatgatcaattcttggcttttatttgccaatttattttaatatatatttacaaaattggacacatacacatatatattttggcatataatatgcatactttctgtcatttgctttccttagcaatatatagtgactatcttttgtcattccgtaacatatacgccaccatttttaataggtacacaatattcagatggaacagatgcatcgtaatttaacaggcatcctctgactggatgtttacgttgtgttcaatttcttacttttatgaaaaagtccgggatgaacatcctttcatgtactttttatgtgtttgtcccaatcattttaggagacagactcctagaagtgggatttccagatcaaaggttaggatgagaaagtaagcgtgtttgggggcatttggggagggtgatgtctgtcacacaatctagactgaaagctctccgtccgtccctgcacctgtttctcagcttctacctcctgctcagtgctaggcagcctgctctgggaaggcatgctcatttagattaattcaatcagtgggtagaagggtcactcaaatccatgaaaagtcctcattttaagctatgtcttttggaaatttcctcttttggcttttaagtagcaaaacctggtaaccttctgataccttggtgaagatcagtcagatctgtaagtttttgttgtggtcctactgtgtatccttgctgtgttcatagaggccggattaataagtaaatgagaatgacttgctcctagcacagatttcacacagagtgagttttcatttatgtctagaaatctgcaaagaagggaactttttctcggttaagagcaaatacgattgaaagtatgtgatgataagcctgagacatttgcaatgggcttaaggacttggttcatcaaaagctgaaaagattaaaccacgttcagtatagttttatgtttaagcataccatagttctctgaaaatggcagttccttttcctgtattagtcccttagcattatgaaggaatctgtcccgagacctttgagacttcctgcattcatgaatgtcaccgtcgcattcagtctctctcataacatgcagtaaaggccaactgaaaaatgcctgcaactcctccaggctcctgaggagactataaatacaagactgcagtcatttataaagctattaaaacaaagtggggcctgagcccttgctgaaatgattttcagagttgttttctctctaaaacacatggcaaacaatcgcatgttagaaattcaagacttggctgagttccactttttgtatcttactttatcccaaacttctgtgaaacgaccatgttgttcaactgactttcttgctttctattcccgcctccacactaggagttgacttccttttaggtaccatgtttcttaagaaataaaacctgccttcatctatggaagtgatcatattggataacaacttgagcccccaggaattaaatcccggcccaaaaaaactgcaaaaccacagactgcaaaactgcaacctacatcgcatgtagatactctggagttacttgcaggcagcagcatctgcagtggcagggcaggtggggactgtgctgttcggaaagctgaattaactagcacccacatttcctagtgcactaaggaatgacactctgcctgcgaaagagctaaaccccatctctgctcctaagtaaatataaacattccattccctaataccttcctctcatgctgttaacttcactcagctgattccagacacacatagaacacaagggctggcctagcagacctggagtcagcccaccgttaagttcacgcaacagtattcaccaatgatctgccatctccacaccctgctaggacatgggcgggtgggggaaaggctgtcacttaaagtctctgcaggagacagatggtaaacaaactgaaaagatatcagttggttggggggaattaagataagtggagtggtggtgattgaaggctcagagggtttctgaggacctgggtccaaccctggatggtcctggcaaggctgtgcggtaggcagaggaaggagatgacatggagaccctagcgtgggatatctagaaactgaaggaagagccatgtggctggggggacagtgggcagggagaaagtgcagggaccatgtggagctgggtgggggcagtggccaccatggggaaagtcactgtgtcatttttggtccaaactcagacgtttttgaaagaaaaatgtaggtgctattagtaatcatctgggacagcaggtgtcagccgggactgtacctggaaacccatgagtagggggcttagcggacagagatggtgacatcaccttacccctgtgttgcccactgttccactggaaagtgccgcaagctggcgagcgtgtgtcctctcagttctagccaccatcaccctggtctggagtccttcctctggcaggtgggcggctccattgacaagccagccctccgctaagacctgtctcctttgttcccttctctcctcttgccctggatggggcttttaggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaagtaagtggcagcttgcgggcacagccgggcctgtgctctggccttgcaggcggagcccctctgagatcccacatcctgggtgtgccaggccgggacgcacaacccaccgtctgcagcaggtctcttgaccccgccaccgttgacgtttggggccgtgtggaggccctttcctgtgggggctgtcccgtgcatgctcagatgtttagcggcattctcggcctctacacactacacctcccgtgacaatcaaaactgtccctggacatcatcaaatgcctcctggagggtgaattgctccactggcctgtagcagccaggcaaggactgggccaaactgatgaggacatggcttgtcagtgttagagacaggggcagtctctgttcacctctatctgatcattttcctgcaagaaggtggatccagtgttgccagatcttctaaatttgtcaagtaaagctacccccccacccacatacacacagttatgcagtcacgtgtcacttaatgacaggatacattctgagaaatgcgtcattaggagattttgttgttgtgggaacatcacagagcgcactacacaaacccagagggcgcggtctgcagcacgcctggctccacgctgtagctgatggctccgaggctacaaacccgtacagcacatgactctaccatatactgtaggcaattctagcacgttatggtatagaaacatttctcaacatagaaaaggtacagtaaaaatatgacatacaaaatacaaaatgtcacctctgtatagagcacttaccatgaatggagcttgcaggcctggaagttgctctgggtgagtcccgagtgagcagtgagtgaacgggaaggctagcacgcgaccgtgcacctccgcagacttcagaatcactgcacacttaggctacgctaaatttacataaactttttttttctttaatagtaactttttactggataaactttaactttcggactcttataataacacttagcacaaaacacaaattatacagctgtataaaagtaatttctctttacccttattctacaagctttttatatttttcaattttttaactttttaaatgttttattaaaaattaaaacacaaatgccgcattagcctaggcctgcacagggtcagaaccatcaatcactgtcatcttcctcctccacagcttgtcccactggaagatcttcaggggcagtaacatgcgtagagctgtcatctcctatgagaacagtgccttctggattccttctgagggacctgctggaggctgctttacagttaacttttttttaataagtaggagtacactctaaaataatcattaaaattatagtgactacatacagcagtaacatagtcctttcatatcatgatcacgtgtgatgtactgcacggttacacgcactagactttgagaggccttggcagcacagtaggttttttcacaccagcatcgccacacacgttaggaacgccttacaccacgatgtcatatgacagcaacaatgtcacgaggcataaggaattttacagctccattttcatcttctgggacaactatcttatatgtgtcgtatatgtcgtgtatcattgaaatgtcatgaggtgcatgtctgtgcatatatacacatacaggtatatccacatacgcatcattttctggacaatatgtgcaccaagtccacccatctgccgtctggctgtgacccagagccacgggtgggcaccttctgtgttgcacccccataagtttccctgggtggtccctgctgtctgctgggctggagttggactgtctcatggggcaggacagagtggagctgctgcgtcttgctggttgaggtctgaagggatccagtcatgcccctgagacagaatgggggccttcttttggaaggcaaggctaccatgagccgggtggagctgacttgtgtggctttccaggatcgggcacctccctagttgctttccacattccagagccactggagttcagaacccctcggagcttgctgcgtaccccagtttgcgcccacggacactgcccaaaggtgccaagagccactgagcaggcatcggtgggctttcagaggaaagtcatgccattctggcagggtgggcctctgtttcccctttcaccaggccagatggcaggctaacgtgtctcgtgtgcggtaggagaggaaattctgataaagctcaggtgcaccgtcccaggagccacagtccacatctcctgcccaccctgtgaggtgtgagtcagtctgtgtagggctgggcttggtagacagtgccctggacagcccctagtccgctccttccctctttaaacctcaaaagccaacccttccctggagggagagacagtgccccaggggtgaggggaaccagctcccggagcgccagtgcctctgttggtttgctctgcacccttgctgtccccaggcccctgagtcactggagaccctgggaaaatgcaggttctgatgctgcaggtgcagggaggcctgagaatctgcatttctagcaagcttctagggctgccgacactgctcgctgctgggctgcaggccacactttgagaagcgagggtctacagcagggtccccagccagggaaccattgatgtttgggcccagatcgttctccgtggaggggccgtcccgtgtgtgtagtgtgttagcagcattcctcccgccttccactagatactagtagtacaccctccgcttctgaccaccaaacgtgtcccagacaccgcccaacgtcccctgaggtcagagacaacagaacgctccccgggtgagaatccatgatctgaatgttggactcccgctctgggcagattttcctctgagcagtggggcttttcatttcgaggaagggttgtttctggtctccgctggggagcttgagccccagtgttcccaactcccaccaaaatccttacttgagtgttttcacggtggagggccgtgaacgtaagcaggtgaggccggcccggggtggggctgtggatagagcacgaggtcctacccttccaggtgttacagagttgtgcttggggcgcaggtgcaggttgcatttctaccagcggttgggacagccctgccgctcggcctctgcatcgtggtgtcgtcatcccaggctttcatttctgcaagtctcagtgatgggacgtgtgttcctaaggcttggtttcctgtttctctgatttctggtgaggttgagcattattttcagcgtttatcagctttttggtttcttctttatgtactttgcctgaagttttctttatcttaatgatttttaggagtttacttttgaagatgtagcttctaatccttccccattttgagttacatgattcttctctctggggcttgtattttcagttttaaaatacttttctttgaggcacaaaagttttgatttttaaggctgtcagattgctgatcataaacttgaggagctcacagcctttttctgtgaggaccaagttgtcagtactttgaggtttgtgagccaggctgtccccgccacccctactcagttcaggcgctgtagtgatgaagtagctgtagacaatctgaggatgaaggggcatggctgtgtgtcaataaaactttatttacaaaaatagccagcggtccattgggtccagctggcactttgctgacccctgatgtgctttatggttcgcactatttgtaccgtgtttaaaaatcctccccagcctagaggtcatcagaattttattcacttctgttatttgcggttgcctttacctgtaccagttaataatggttttctatttgatagtcaaaccaagttctttcaaattaaaatactaagtgaattgatctaaacaacaaaaaaaaaggtaagtaatggaagatagtacatgtggttcaaaaaacaacaaaaattatggtggggcttggaatgagagatgcctggggtccccaccgccgactgtgaaggttgagaggaagttgggagaaggttgggctgccggggataccccaaacgcccccctatgtaagaagtaccaaaaacatgggccctgtggcttgtttttactccattacttactgaatctggaactaattttaaaccttggactggaatgtagtagctccctgctatttgtcaccatgtttaaaaacctggaattagacacagagaaaacagcagcggagtagcagcatcccaggaggtcagacatggcttcctggaggcgccatttgttttccctacagcagtggcttaattggtctccctttgtctctgctctgcctcctttcagagattcctccaccgtctcttgctaagtaattcagcctctggttgccatggcaacgtgccatctactgtatcccaaagaacatttgcgatttcctttttttaatttccagaaccttcatattttatcttctgagtgttcctgggccttttcctggtgaagcagtcactgctccccacggctaccccagaacacatccgtgtgcttggtctgggacccccaggaaagtcagggtcccatttgaaagagtgaagctctatgctgattttcacccctctctgtgtaggagctcagcttacctttaaaacctgtgtggatgcatcagcagagtatgagaggcccgcagctcctgcacggtaggtgtgcactggaaattatgcacagaggcacgggctgttttgcctccatcctgtctacagccaccatctaaggagagcagtgggaagcacctgctgccggctttcagcataggtgccggcgatgtgcttgacgtctgccttactttctttcatttatctagtcttcacagtaacccagtaaagcaggtggtactatcatctccattttacagatgagaaaattaagccttggtgagaaggtaactggcccagggccacgtagcttgcagaagctgccgtgcagtgagataggccatttgttagagccctagccctgggcctgggagaagcattctagacacgaaagcactgtggctccttgtttatcttaggcatggctttgaattttcttatattggtttggctttgatcagggtatcagctggcaactgggcaatgcaccaggtgtctcgggcaaaggacttcacacttgctctaaagcagtgcagaatgttggccgggtccggtggctcatgcctgtaatcccagcactttgggaggctgaggcaggcagatcacttgaggtcaggagttcgagaccagcctggccaatatggtgaaacctcgtctctactgaaaatacaaaaattagccaggcgtggtggcaggtgcctgtagtccaagctactcaggaggctgaggcaggagaatcgcttgaacctgggaggcagagtttgcagtgagccaagatcatgctattgtactccagcctgggcaacagggcaaagacaggggggttgggggtggtggcagtgcagactgtcaacacagcatggagcagtggggggttggacatcctcagggggaacatatagaaagagacactgcccagcaagggctctggaacagtgcagcaagcaggctagagccccagccgtctttgtctcagctgcgtgagataggccagcaccagtgtctcagaatctctctccttgtttgtgaaatggggatggtggcaatacctgcctcagggccctctggaagattccacattggtccctgaagaaagtcataaaagcacattctcagcagggggtgctggggccagagctgctgctgtcacagtcaaggctggatgcactcctgggcgagctgtcacctgcacggggcagaggccagcagcaggccttgtggcaggatgaaatgaatgctgctgcatgaacagcggtcacgatgctagtgggccagggagtgcaggagcattgctgttgatggggcttgagtgtcattcccattcgtgactgttgtgtaattttgcccgaagagagaggaatagggtaggcacctcctaagtcatgcacaaactgtcattccccttggggcgttctttgctcccaggaacgtgtgtgagaagctgattaatgctcagtagcatctttcaggagggggcacttagcatgttcatacagcagttagcggatctctgagtggcttctctgcacgttttgtcctgtggcctccagaacacgctgcaccctcaggtgtcctcccgggctgtggcctcccactcctgctctgtctgcaggagcaggacacagcgtgcagcgagtttagacgctccctcctctagatgtgctttaggcaaggcaggcctatttttggtcctggagacagaacgcacagaaatgtggagacagacagtgtccccgcagaggctgtggtttgggctgcaaggcggaaaccgtgcctggccagccaggggaccagcctgtctcaatggggccttcgttctgctgtgagcttttacctgaaactgcatggacggaaattttcacttccacagaaatggtgtttggtaaatttcagacacgtggaagcgggggaggaatcagcttccaatgccagccttcataatgacaccactaatagcatctgagagggtctgccgtgacgctgggcaggtgcagtgctgattgcctgtgatgccgagcagggaccatcatccctgctctgcagatgaggagactgggcagagaggctaagcagtgtccctgggtctcacagttcatgaatggccaggctgtgggctccagggccctcgctcccagccactgagccttgctgcctgaggccaagcatccggctcacaccttgtggacagggccgggaagctgatgatacactatagctaaaggccagtttccggtgaatgtttgtgttaatgaggtggttatggtccacgttcactgggctgagtcctttgcccgctgatgtctgcaaccctgaagttctgtgctcggtatggtgtgggtgctgcacacaggctccttcatggatcttactaccttccccaagaccctcactgaggagcgaacacacctgacatgggtcactcccggagcagggctgagctgccgcaagcgctgacggtttctcttgtcacagttatcattgccgccctgaaaaggctgcaaagtttgccttctgcctcagggttaatccatggctgctgggatggaaggtagcatttgaaattacctacagggggaggctgcacctgcagaacgggcccagttgatcctgtcacatccaatgtcattgcccatctcttggggtgcttaccccccaattacagagatttcgaattcatgtagcgtgcacgtgctaggcgctggggtgcagagatgaaaagatgcactcacaggtgataaattattgtgtctggtgaaagatgtacagagatagatgtgtggaccagcttcaggagggagggtgagggtgtcccaggcagaccagccagtgagagctcgaaggtgggaagcagcaccgccttcccaggactaccctgggggctgagaaggttcagggctgggtgagggtggcagggcagagggagaagactggaggggccatgggtccaggtggtggaggctcctgtgctgcccgctatgggttcccaatccacacagacctcctcttgtcattctgggctcagctcagatgtcaccttcctgaccatctcccagtggcacagcctcgccattaccctgtgtcacatcgtcccctgctgtgtttttagccacttccacagctgctgaaagtgccgtttactcatctgttctgttcgcctcttcagggtgtgcccactggcgtggcggggccctgctctgctcttctgtgagggccttgcccaccaaggaggcgctggctaagctggtgggaaatggcagatgaggaggcctggctctcccgagaagcagccagggctccctgggggtcaggagcgagggcatgtctgggaaacgcccctctgctgcagtgcagggctggtttgggagagcaaggctagagctgggtggggagacaagggtttctcacatgctacaggcccaggagccagcaccatcctggggacgcggggctgcagagaggacggcagagctggtgaggatgaacggcaggcctgtggctgagggaggagggcctgccagcctaggggtgggtggatctgcaatggtggagagggaatccaggaagaaggcaggcagacacaggggaaaggttatatgtccaaagggtccctatgccgtcaggtgcctggggtttttggcagtgcttccatccacttgtgcaggtgagactgcccaaggagcacagggactggaacgggagactgcccggtccatgctggacttgctgatctcagctgaggtcgagggtattcagagcccgtcgtggtgttttatacggtcctgtacttcctgttatccttggtccattttcttctacactatcttccctccagtttcacacacttggacagaagggagtggttgtttttcactgaccgccaggaaccacaacaggcttctgtgtgttccagtgaaataagccctatctgtctctcgggaatggagcagtgttaagctttttttaaaagcacaatctgaagacactggggtctggaaacccattttttcttgttctgaagcctgtggggcctccgcggttgggccttgctgaataatttggggttttaggttgggtacatcaagggtaaagggcttctgtttggatcaaacaggaggtggggggagggtgagattccctcatattgctgagaagggagttgggggctgagttccccgacttcagaggtgagacatctcacaagccagaccttgggactgtccctgtggacccaggctggactgggaagttcagggaaccctcgactcgaagagggttcttgttaatgaacagtcttcaaggagcaaagcccagactgttctcccagtgtggtgtacacatgaggagggacctcatcggggggaatttggcttcctgatattcaaaagcacatttgtctgctcagtctctgaaattgccagtgggacaatttccaaagggatcaccagaaagaaggtaaatgcagagacgaacaaggaactcatcatacccaggatcgttcttgatcaaaatgccaacagctgggcatcttcagccaaaagaaatgcagttgtggcaggaaagactcagctgtacttggggttctggtttttttttttttgtttttttttttgagatggactctcactctgtctccaggctggagtgcagtggcgtgatctcggctcactgtaacctctgccttctgggttcaagcgattctcctgcctcagcctcccaattagctgggattacaggtgtgcaccaccatgcccagctaacttttgtatttttagtagaaacagtgtttcaccatgttggccaggatggtcttgatctcttgacctcatgatccgcctgccttggcctcccaaagtgctgggattgcaggcgtaagccaccacgcctggcttgggtttcctgttttatagtgaaccccaaggttgcaaaacaggcgatgaggcttgtgatcatttatctttatggatcatgggtctgcgaactggatgagagttttaagcatgtcaggtgtgcaaacatctcctatggttgtgggaatttctccttgcatagccaccattgtctagagcagcagtccccatccatttttgtaccaggaaccagtttcatggaagacagtttttccatggaccagggaggaggatggttttgggatgattcaagcacattacctttattgtacagtttatctctattattattacattgtaatatataatgaagttattatacaactcactgtaatatagaatcagtgggagccctgagcttgttttcctgcaactagatggtcccatctggaggtgatgggaaacagggatggatcatcaggcattagattctcataagaagtgtgcaacccagatccctcatatgcgtagttcacaatctgctgagaatcgaatgctgctgctgatctgacaggaggtggagctaaggcagtaatgcttgctcgccactactcacctcctgctgtgtggccaggttcctaataggctaggttgccccagatgggtactggggttgggacccctgttctagagcagtctgcacgctggggactctgggtccatgacagtatttccttcctgtgtgataggcctcacagcctccactttgcatgtgaggaaatggaggctcagaattgttagtagccagtgagtagctgagtgaggacatgaacctgagtctttccagctcaaagtccttttccttagcctatttcacaactccctggaactcatccatggccatcctctggttcaaattatcctccacctaggcagtagactttcctttaaggaaggaagaaacttcttcaatgttttatcctcagtgcctggtacacagtaggctcccagctaattactgttgaatggatggttggttagatggatagatggatgattgtatgattggataggtgggtggttgggtagttagatggatggccatctggatggtgggatgattgaacaggttaatggctgctggggtaattgcattataagatgcatgagtataggtagatggagagacagctggatgaataggtagatgggtggataagtggtgggatgttgtgtagttagatggatgaggaggtgaatggagacattgttgaactaaatggcatcctattcactgtgcttgatgtaccctaatatctgtccatccatccatgcaactgtctcagcacgcacagtgggttagatggaatttcctaagagtttatttcaataaaataagagtttagttcagtacaataagtgtttattgaatgaatatctctctttgcatagtgggctctttggatacatttaagcaatgattccatttactacattgattataaccaacctattcagaagtgtatttgtgaatagtgtgagccctcaggacctcagtggccattgccaattttggagactggttctgtgctgtctccaggccagggtctgcatacgcttctggcgacaccactgccgtctggctgctgaccagcctgggctatttctgagctgcaggtccttaggccctcaggtgaggatactccagaagcctccacttcaccctcactggaaggaagtctctggtggaaacaagctactcctaaagctttctgagcacttgtcaggaggaataggagagaaagctttatcggaatgagtaagaccaatagtattaacccatgactcgccacaggaggcgggtgggggatggtgtcttcacagctcattcaacagagtagaagtcacagacccaaatgctccataagtgacctgggccaggcagggctgtggcatcctggggagtgtgcactcttgctcaagagggcagctgtcactcagatcctgtgggccatcacccctggccacatgtcaggccattgtggccagaatttccaagagaaaccgaagatttgatttttttggtgaaatagccttcatgtaaatgttgagagcctcttcctatttttaaaagcaatgtgtgcacccagaaaacatatttgtggaccagatttggcccgggaccacccactggccacctctgatgtgaagtcacttatgcacttgtattgggagaagtacatgtttctttacactgaggttaaggggattttcaactcttgagttagcagggaaaataaatgggtcatcctgtaaagtgactgtcagcagcggaagcctccagggctaccactgtcagtatcctagggagcctcagcgaacctgtctccttcctcgcatatgtgagggggcccttgtgtgcggccctctcagctccacccttgctctaaggaagccgcacagtgcaccgctgagaagtcaggatggacagaatgcctcggttcccagccagctctgcagttttccagcatgtgggcatggggaagtcacctcctgacatgcgccttactttcctcctctgtaaaagggatgtgactacaacagagcctgtcttttggggccacgggaaggatgcaatgagccgtcacacgtagaatgcctggaatcatgcctggcagagaggaagctctccaggaagaaaaggaagaaatctgagttccatgaggatagggaatttgtctctttcagttttaacagctttgttgagacataattcacacaccacatgcttcacgcactttaagtgtccaattcagggcttccaacatactcatagagttgtatttccatcagcacaatcgattttaagatattttcctcactccaaaaagaagcctctccctctcagctgtatctccagtccctagaatggtactgagtcctgtgggtactcggtgattttgcagctactgctgcagggacgaaggggaaactgcatgggaaggcatctcctaaacatgaccagttattggtgtcaccattccctttgcttcaccaacttgatcttcttcagatccttttcttctgcttcggcatcttttcattgtcatcattttatcttcatcactatcatcaccttcactgcttgtttatcatcatctttgtcattttcatctttttcttcctcattatctttccatcatctttagcaacaactttgtcaacatttttatcctcatcatcattttcatcatttccataatcacgaatttgccccatctttgctccctaggagacactcggggaacttgggctctcaatccccttgacgtctgggggcttggcctatgaagggaatgaagcccacatctaaagcaggttccggagcctctgctgagtctgatcgtgcctggagtgaagaggactcttgagaatggtgggggctgggcgcagtggctcattcccgcaatcccagaactttgggaagccgaggcaggagaatcgcttgagtccaggatcacttgctgtgttgcccaggctggtcaccagacctgggtgcccacaggcagataagaggaaggtgcctgagtcaccaactgcccacgggactgaggcacctccctcttatcttcctgctattttccagatcagcctgggcaacacagccagactccatctctacaaaaaatagaaatttaaaaacagctaggcatggtggtgcacacctgtgatctcagctacttgggaggctcaggagggagagaggatggcttgagcctaggagttagaggctgcagtgaactatgatggtgccattgcactccagcccgggcaacagattgagaccctgtcgttaaaaaaaaaaaaaaaaagaaaacaaaatggtgggaaggtgagtctgagccgggaccctgcagatcccacaggtccagctcaggttgccacccccgtgtgtggcctggttgggccggtgctgtcccagtactggccacccgtcaactgaggcacctggttgggccagtgctgtcccagtactggccacccgtcaactgaggcacctgattgggccggtgctgtcccggtactggccacccgtcagctgaggcacctggctgggccggtgctgtcccggtactggccacccatcaactgaggcacctggttgggccggtgctgtaccggtactggccacacgtcagctgaggcatgcagggctctgccatctatagccttctttggattccgagatcccaagaacagaagctgttggcatttagcaatttatgattttcttcctttttttgatgctgcagatttatccgactgactttcccagccctccagggggaccgttgctggggcttccggtctctctttgtttagaaatctcagggcaagtggagatcaggtctgttctgcacagatgcaccttcctgagctcttggcgtggcaccacctcctgcttcaccactgtggtgaggggtctgcctgtgaacactgcagagcctccaaggtcaagaagaccaccaagatttatgagggcactttcaaggatttgttgcaaaaatgcgaaggagctcacgaggcagtgctgtgagcaggctctgtgtggtattgtgggcagaaatcaacctcagccctaaagggaggggcctggtagtcctgcaaaggccggggcaggcaaggccagcacggatcaggcaaaatggtggctatcatgtatggatcttgtacgttctgcttttagatggaggtagctaagcaacagaacacacagcttccaaattgggacaagtttaaactggcaaatctcagccccagaggatataaatatgacgcttcatcgtcttgggtggaagtccccgtgtacagggagggaaagcccatctgtgtgtggcatgcagggtacagggagtgggtcccgagtcccatcctgtgcaggggagaggctcaggccccttctgtgcagtgtcaatatgaagtggccctgtccctgctgagggctccagggagggtcagctgctgtttgttttccttggttgcttgggaatctgtagaggatggtacagcatgttttgtaagaaaatgcaaaacaacatcaacccccattcagtgtcaataaaacatgattcccaaaccagggagcaggtggtttggtggacttggaggctgcctggctgagagccatgggctgagtgagcccagggaagtcacatggtgagtccaagccttgaaatgggtgtgtgatgtctgcctgctcagatgcttgcagggactaaataccacacagtcctgcttcacccaggatcggggcttagcgtgtgtgagtagtagtcatggtaataagagcacaaccatagctcactaacatgtatgaaacccatgttatgtatgaggggtggtgtttgcctgcattcatataaacataagacgtaaatgctattattggatgttcttagcagctaaggaaatggaggcccagagagattgggtaagatgctcaaagtcacacagctagtaagctagtggagctgagatgtgacccaggtgggccgactccagaccgcacgttagagccaccccactccctggaatagttgcacaggcggtcaggactggcatggttgttccaaaatcaacaaggacgcagactcctcttaccttcctgctatttacccttatgccggtgttgatcctccatggtccagggtggctgcaaaggcaccagacatcatattcaagtcccaaaggggcatacatctcagctgagtcagcttttccagagggctcctcccagaagctcctccacacacatctacctactgctccttggttggaccctcctcatgtggccgtggtcagctggaaaagagactgctctgaataggaccagcattcaggcataagaaggggagaagggagatggggtaggaaactcgcggcttctgctgctttaggtgttcaagttaattttgttacattaaaggaagaaaagaagcaacaaatgaagagatggatgagtgaatggaaagcattctgtctgttaggtagcaatgatttctaagtgatttctggagcagcctggtttgaggagtgcatgtggatccctatgggcttggagagcaccgccggggaatttaaaaatgccccattcctgaccctcccacactgggccagggaggtgagcagctggcaggaagttgaggaggaggagggaaagaggaaccctgagaggcgctgagagtgatgtggacaaacacagctaccccctccccagcaatcctaccctttctgcagcgatcccaccccttccccagcaatcccaccccttccccagcgatcccaccccttccccagcgatcccaccccttccccagcgatccgccccgcaacgatcccaccccttctccagcgatcccaccccctccgcagcgatcccaccccctccgcagcgatcccaccccctccgcagcgatcccaccccttccgcagcgatcccaccccctccgcagccatcccaccccctccgcagccatcccaccccctcccctgccatcccaccccctccccacagtgatcccaccccctccgcagtgatcccaccccctccccaatattttagttcagcaacagatgtttcctgaacagcctctgtgtgccactctccgcactgggcctaggatggggggaagaacaaagcagatgcgggggctgccttccgaagcttccattccaccagcaggcgtgggggaggggaggtcaggtgaacatgtgtgtggcacatgtggaatatgtggctatggctagacacgggaagggctgcagtgcagagtgaccgtgttccactcaggtggcttccagcatcccctcctgggctggtgggcgctggtgcacctcagtgccattgctgatgaaggtctgggtccggtggaaatggtgtggtctgcagatgaggtgcgcctgtcttttcttaaatcaaggacactttcagatggatttggtttctctctgactcggctcgttcagtcagcctgacgggcacctaccgtgtggctcgggccccgtgctgggcaagaccctgcctccagctcccagcctcactaggagtgggggatgggagtcacaggatgtgcccagtggaacagccgccagggcaggtgaatcctggagagcggcgggctgttcaggtctgggaccctgggaagccacagggaggagtgcatgggagtgaccctggaagcccagagatggagatggggaggggaagggctggcaggggccctgcccgagcaaaagatcagaggcagacaatgctcagcgtccaaggaggaaagcggaaggagctggagggcaaggcaggccctggtacctggcaggtgctccattggtgcctgtggaatggaccccaaaggatcttagccctgggagcaggcagtggggagcattacgtattctttccattttcaaaatttgaagaagggacttatatacatggtaaaaaataaaacggtacttctcactcccacctcatccatctgtccggagtcagccactgtccacggggccatttgtgatcattcagaagtgggtctttataggagtcctaacgcccagaacagtaatctgcagatattacctcccatgtgctgtgcccagctcggggtgagctggaacctgcggtagatccttcgctcggcatcagtctctggagggaggtaaagacctgtcctcagtgctcagccccaggtgactactcaaaaagccatttgaaagaagagatcataagcatgatttgttcatgctttaaacacaattttaaaccatacagatgtcacttgtttggccgtcactttgaggtagaatccaaggacatttctttgaggaaggatctaccaacttaagttatttttgctctaaacaaaggctggatgtgtctcctccaagttccactgacagtttctttggagaggagtgagtatttaaaggcacttggaagcaatctcagtgcagaatccttccagagttttaaggccccacctccccagatctcacttctctctcccacgcaaactgcacagtggtatttttagcaacttgcctctactgactccaaagcttagttttcatggaatttacattttcattttacacccatatgagatcatttaatcaatgtgcattaaaagcttaattacatttattacagagacaagtacacctggtacaaataggtttgggaacagaagcaaccagttcctgatccatgcacagctcagctggtgtggccaggcagttctgaaatcaacagggaggccacgaagtcagcacgggatgcccagcatggctggagccactgaaggatttctgcttcaagaagcctcaaccggtatctaaggccttcccactgatcagatcaggcccacccatttcagccaggacactctccttgacttaaagtcagctgatcacggcccttggtcacatctaccagacgccgtcacagcagcacctagaggagtgtttggttgagtaactggggactgggaccccaccccccataccattcaggttgacacatcaaattgaccctcacagattcaaggttggcagaaagctcatgagcagatgtaagattgcactcagtctctcactcacagcctctctcctcaggtgatttgtagagaagccactattcaagcaaagggcaagttcaaagcttagactcttaatgatgatgtggttttgcagtttctatattcacgtttattcccttttatcttccccagagtctggctgggagagccttccacataagggctaatggagcagcacccggttcctttctgtaatggcattgaattccactgcagggttgaacacaggtcctttaggcccaatgggcattaaggctctgccctgtgcttggctataatgaacatcctcatacgtgtgtctgtaagaggcccatgtggaaggatgttcacacacatcagaaatcttggaactggaactggcaggttagagaatatatgcatctgtcatttttgacctgagcattgaccaccagggaatgcccctgattgacagccccaccagtgggggggcggggggaggggctctgtctacactcctgtcaacattgtggattttccaactttctgccctctgctgatctggaggtggcacagtgacgtgctgtttggcacaaccacacactccatgtggttgttatttccatggaggtctgtgaatgacgatgaactttggacttgccccacaacagcagcccagttctactagtaaggcagagctgtgtcccacaagcccagaaccatgccccctgcagcggggcccctgtattgccagtggcttctctgttcattttgctgtgccagcttgagaggctgtgcaggggctggggattcagcagtgaccaggtagacaaagtctctgcccttggaggggtcctgagtccctaactggccagcttggtgccttgtcctgggttggcacacatactgccttttgtactctggtggcagctgtgcaagcgtgggactgtggtgtctctttcacaggcttggagggtggcttgcccaaggttgccttgttgctgtcaaaaccagcctttgggctcaagtttctcaatgtaaacctggcgttgccttgatgtcccattcatgtatccactcatgcattcagacactcattcattcattcagtcacttgttcattcattcactcgttcattcactcattcactcattcattcattcagtcactcattcattggtcacttatcacggaccaggcttggttccagggccctgagtacacagcattgggtactactgatgcagttcttaccattgaggtactcaaaacataaataatcaattctggccatgaaggccacaaaatacacaaatgcactggggagcaacctgtgcagaaaggagccagttacttcagctggaggagtcggggtgggctttctggaagaagaggtttaagctgaaccatggggagatctgggtaacaactttctcagcagagggaagggcccaggcagaggcgctgggtgggaatcagcttggcatgtgctgtggtctgaatgtttgtgtcctccccaaattcatgtgtcacccccagtatgatggtggttgtacatggggcctttgggaggtgattaggtcatgagggtgcagtgctcttgagcgggattagcgccctcaaaaaagggacccctgagggctgcattgctccctccaccatgtgaggacacagtgagaagatgctgtctctgggaaagtgggtcctccccggatgccgaatctgctggcacctcaaccttggacttcccagactccagaacagggagaaatggatttttgttgtttataagacactgagcttaggggactgtgttgtagcagccgcgctgggcaagggcagctcagcaggtcagcatgaccaaaggaggacaaggtatggggaggagggagatcagtggggtgggggaggggaggggtgctcaggggcttcgaggaggctggagctctgctcctcagcaggttgtctccctccaggaattccctgccacaggctcgggcctctgggtcctggtggctgagcacagatcttcgctgagtgtccctggtctgggccaatgtggggccagcatcttggttcttcccagctgactcaacctgggcttggctcacccttggctgggacccaaggaggccaggcagggtggtggggcccagtggggtgtggggcacattccttccagtgcgctcccctgccccagccttacacctggcattacagggcacatgctgtcctcaccctgcctctcacacctgctgtctctgcacacaccctcctggccctgcctctcacacctgctctctctgtacacactgtcctcactctgcctctcatacccactctcccacacactctgtccctgccctgtctctcatgcctgctctgcacacacagtcctggccctgcctgttacgcctgctgtctctgcttccctctctcacgtccttccctgcagggtgcgtctctccctcctctttgcacacatgttcttggcctttcttcctcactccactttcctcctttcaaaagtagcattggcagggctgggtgtcactgtgaatgacattctctgcgttaccttgactgtgagaacagaaagtgcctctctacaggtagatgcgagtttggtcctgaaagtcaagggcctggttttcctccggaggatttgaatccttccctctccctgctcccctcccttctctccttccctccctccttccctcccatagttctcaggcaccaggtgattcctcagtacctctgagagtccccagatggaaggtgacctggatgtcccttggtgtccatgttgctgtctttagcacctggaagaggaggtagaaggggcatgttcacggtggggttggggaagcctctcagggcagcccgggaaccatccggagagactggtgctggtgaccagctggccttcatgggcgggggtgcacgtgatcttggtgcctcacctgagcccttggaacacccggctccaggaggctgattggaggcgagacccctccccaccaccactggggctgttcctggtgcagagggtgaaggactcatctcatctgtatcccaggggcactaacccaaccctgggcagggcagtctagagtccctttttggcttagggtgggccacagagccaggctgacaaaacagaaatagcaacagtgatggagacagtgcggtgtgcagcttgcggagcccagggcacagcggcctggctagccccctcacatacggctctctcctttcagtctcaccaggtgagaccatggaggtgcagagaggagactggctgcacccaggaggtggaggacaagagacactggagagtctgggaggccaactccacgtacctggagttcttttctgtgctgccctgggagggagcccaggctccaggggacatatttctcctgcagggtggggttgggaggacagagtaggcaggagcctttggcctgaaggcttgtcactgtgggcacaagaggcatgggacaccttcccgacatcagaagccccccactgcaccaagcttggcggggcttcctggtggagttgaagttgccctgcctcctatgccctcaggacacaggaggcaggccagccgttctgttgccttttggaaactcagggcagctctgtggattgtcacagcaactggagctcctgctgtattttcaggatggtcccgggaggcaggtgttctgcagccatggggcactcccttagcaatgaagactggccccccattccacttgacttctgaatgtccctgggacactcatgagagtccgaagcctgtttatgatgacctgagcctcatcccaagtgcattgtggacacacacaggaggtattttggtggagctgtattacaggtggcgtctcctggaatgcaaaatgccagaaacctctcccacagattggggagggaaccttgctttgtccagagcttcaccaagaagcattcctccactagtgtctctcagggcatggagtgaccagtgtggcagctgtgggtctgtctgcattggtggctggcactgtgatggtgatttttctgtagcggcagcattggcattgtgtgctgtgtcacccaatccagccatgcctggcacttacttacctatcggaatatgtgttatttgattaaaacttaatttcctttttcctcctttatattgcagatagggtgttatgttgtttttttggttatgcgtgtcagggatttggaggaaaagggacaagacagaacaattgtaataatgggggtgtgtggggtacagtggggctgcggacccgtgtgaggagaaggacatctttgccggacagggacagtgtgaacagccacttattggtaaatgcagctcgacgtggggccatcacccggcatggagttttgggaggggtgggagtaggaggggctgctggaggggtcaccgtaaactgaaaggctttgctgagggccttggagtttgtcctgaggatggtgggaacccgggcttgagctcatcgtgggagtaggagttagagttatgctgctgtgggcagggaggtggacagtgtggaagtctccatcatccagggctgaggcttgtggcctggatcagggaagtggccttggggatggagagaggcagatggatggatggacggatggatggatgcaagcagaacccagcagacttggagcttcctggggtgttggacgtagggagtaagaggagccagttctcccaggggtctggtgtgtgcctgggtggtggctggagccagcccctgagcccaggatgctgggcacggagcaggtgtgaggaggtggggaacagggtgtgaaaaggtcggctttggactcagagtgcctggagtcacatcctccccggcatcccagaagtcaggactgctggctgctgagatggggcttgccccaggcatgtggaccagcagccagcacctctcagctgagccctcagtcggcagaacatccctgcttgctgtttcctagtgtggacacactccatcccctctgcctggatgcccatcccaggtctttccctgggcggtttctttcatcatccaggcctcatcttatggcctggagagtcctcttctcttcctgaacttctctccagacacacccacattgctctgacgctctgagacatagggtcaatgtgcctgtcatccgtgcacccagatggtgtgcgcctgggggcaagcagacgagacatctgccccattcaccatcagatgtctgaggatgcatcaatgcgtcgtgtgaatggtgtgtggagacgctgcctcgctggggaatcccatctccaggcgggggccgccagcttttctcagtgactcaaggcggctgtggggcaggattggcattcccagaaaggagcctcccaaaatagcccgggcgtcccctgtgggtgtcgagctgtctgttctctctaggaaggcattctgccttgtatggaaggaattgcttctcaatttctgctccacactgaggtgactttagatgttgattcaaaccttttctgtgacatctgtgctggggtgagatcaagatttgggggatgtgcgtttagtggggcagcctggctgggtggggcttcattggggaagcaaagcttggggagctggaactatgcttctcctgaccccgtgtccttccacttcctgaaattacctgcagcccctgctgctgtgctcatcatgcaggaaggcagtcagctgagcagtgtgtgcagaggacgattcagaaactggtacaaacttggcactgagacggcgtctgatgggagaagagggggtgtctgatgaaagaggctatgacagacaggagcatgtgcgtgtctggtggaagagggtgtgcgtgtctgatggaagagggtatgagtgtctgatagaagagggcgtgagtgtctgatggaagagggtatgagtgtctgatagaagagggtatgagtgtctgatggaagcaagtgagtgatggacagtgtgagtagatgatgaaagaaggtgtgagtatttgatggaggagggtgtgtctgatggagacggtgtgaatgtctgatggagagagcatgagtgatgaagagggtgtgagtgtctgatggaggaatgtgtgggcatctgatggaggaagatgtgaacatctgatggaggtgtgaatgagcagatgttgaaagagggtgtgagcatccgtctgatggaggaggctgtgagtgtctgaaggaggagtgattcttggggatccaggcctgcaaggaggcgctgggcaggatggagcctgcagctctgctggctgaaggtggaagagacctgggctcagcacgccaggtgaataatatcagtgctatagtagtaatgatgccacctatttgtgtgtcaacctcctcctgtatttagtgttctcgactctcccagcatccctgtgggttttgttggcaggtgttcacctggggaatcagaggctcaagtaagggagggcgtgacgccatcacccagctggcaggggtcagagctggaactggaatcctagctctgtgccagtgctggggcaccagtgctgactgtggaatagacagttgacagcctccacagacctggaaatgtgggtggcacagtggcatcatgactcctggagcctctccaggcgtcctgactgtccaggctgtcggcggtctcatcagctccacctctaggccccttcctccccattgtttgtcccctgctccctgtctcctctgtgctactcacagcacagggccaggtgtgtcgtaggtgactgctacagatctgtcgtgtgagaggcactcggaaccaggaagtgcctgtggggtcacctgtttggctggtgcccccttggcccccagaaatgactcacatccacacttgaacatacagacatccttttccagggtgtgttgtgctcgatacctttaattcctgtctgcattccagggcctgcccagcctcttcctggctccccagcccagcctggtccttccggcctccctgtcatccccacctctcgtgtgtgcacaagcagggaccaggtagggagaccggcagatgctgctctctgtccctggggtttcttttcttagtgttgctcccacacccacgcgatgctttaattaactgccacactcaggctttctcagtggggagagtcagaaatagactgtggcttccccagctccaggcggcaccaggacgtcaccagcagccccatttctgaatcaggagtctcaagcagctgcagagggtggggaggtttggggaatcccacaggggttctacacccccacctaccccgccccacccctctgcagggccttctgcagcttccaaagcccagctatgctccggccacgtctctagcggctcctcggagagcaacttgatactgaagctcaaagcccaggaagccctggcggcatccctgccccagccaggtccaagcaggctatgtagtgagggagaggaaccggcgcccattcctttgctcctcgacacaggctgctccccttgcctgcgccggctctgggggtctgctctcacagagcttcatgactcgttcaacctgactgcccttttcctggccatggttctgcctagaaaatttcctgggccaccctggcctgagtggcgactgtgtgtcagggcaggggtcagcacactgtggggcaggggtggtggcctgtgatgcatgcctctgcctgggcctgactctctgtgctgggagaatgcttcctgggcctcatcccagctgtgtccctgctggctagttcctgccagctggtgttgccggtgttcctccctgcctcagccctcccagcatctggaactggctgtgggttctgattccagctgtagtagctgctgatcacattcctctctctgagcctcaagggtctcgcctgtaatgttggcaaagtaattgtctgtccttggcatcaggctcgtcaccatttttccttttggaagccccaactctgcatgaagagttagcatagcttcaggtagcaggtggacaaaagggtatcttttatgtatacttagggtaacaagtattaatttggagtgtggggtgtttttgctctgtggccaacttcttccccaagtcttgaacacttcagggggccctcacaggcctgcagcacactttgtccttggtatctggtgggggtctgggcaggtccgtatctcttggtagtgggttcatctccatctctgttggacagaaatctggaagagtccggagagtgtttgcaaatgcaaatctagtcctggcacgcccacaccccatctcacccaggtctgctttaaatccttcagtgccgctctggggttccaggagtgaatccagactctctctccagcgatgccaggctgtgtgggtcctgcccctgctcagcctcggtgcacacacacctccatgcgatctaaacgaccccacctcaggacctttgcacatgtcctctcctcacctagcgatccccaatcatcctctggatcccaactaaagtgtcaccttctgggaagccattcatgtgcagattagagcctagtctgaacggtggcctggccttgttgggttggcagaaccaccctaagaccctgcttagcaccctcacctggcagtcaggggtcttcttgctcacctcaatcccctccactggtgagaaccacagggagggtcttggggcccacagcactgtctagggttctgcatccacccttccaggtgtggggtcctggcactctgtaagtagagaggcaggttggtgacaagccagtggggtcctggcctgagcacccttttgctctgtttacaaccctgtgcctccggggctgtgtctacccagaggactgcatattctagaccattcaggggtaccctgttgacattcagtgagaagcttggcagctagatgaagccctgcagtgagcgattggaccactaccagactgcctctgtgccttgggaccaattgcacagtttttgctggcttgatgtccacgctttcctgaggtgtaccagttggatgaaatgcttttctgggaacatggtccgcgatcagctggcaagtcacaggttgggttttcttgagaaattactatatcccaagcatgcattgtcacaaacatttttgtgcattatctcatttaatgctcattaagagggtctggtactaattctcattttggatgagaaagacaaggttccaacaaagggcggggggaagccttgttcgggggccatgccagtggacactagcctccagggacatttggggtacttctcagatttgaggaaatgcacagcctcactcctcaggtgtccctatgggtgttcctggctgggcagctggctcaagaattgtcttgagccacacacaaaatacaaatggctggggccagcatcgcggacagtgaaagagtttaccaaggcagttataggtaaagaaaggcaaatttattagagaaagtatgaagatccgttgcaagggtgcaatgggcagcacagtagagaaggggctgctggaaagaggcaggcgctggagggaagttttatagggttgtgccagaggggcttatgtgcagataagatagtactgctgggtcttcgagtggaacaaggtgtttggaaataggatgtcatgccagtgggttgtctgtgattagctggctctcagaacaattcttctcccccacctaggaccccttcctcattgttgcttacttattaggactccacgttttacttcccaagatcccattcctatacacagcctctccctcttagccagaggagctgtgcaaaggaagtaccttttcatgggtaaaagactcatggtgcgctcactcttgctgggcttcagggatttttcatttctattgctctaaaagtgcctgtgtgccttccccctccatcccatctccttcctgcttccgagcccttctgtgggcagcatgggggccaggaatctggcttgttcctgcttttcctatggtggtctgccccaccattattcacacacagaggctgttgggttctcttaccattccctgtttacagagactcagatacattcagaagcgagctaatgctgggtgcccagctctaaggggagaccccagacaactccaatttcctgatgatttctcttcctttacctaattccttctccaagacccttgcagacactgctgtaccaagtggattctgtgtaactctctcagaagtttcctcttccatgaagcctgccttgattacccacccccatcctcactccctcagtgtttaagcccagtgtgtgaacagttaagagacgctatggtcttcccacactggtttcttctcttcatttgggtctcagcgaaatgtatctctgccagattctgaatgtatctgcccctgcccaaccactcacccaccatatccgccatttcctccacggcattgaccactctctcagatgattttgttcatttgtctgcctttacctctagaccaggggcatccaatctttcagcttccctgggccacactggaagaattgtcttgagccgcatacataaaatacactaacgataggtgattagctaaaaataattgcaaaaaaaccctcataatttgtgttttcagaaagtttatgaatttgtgttgggcctccttcaaagctgtcctgagctgcatgcagcctgcaggccacgggttagacaagcttgctctagactatgagcttcccaagggcagggaagacttcccatactcagcactctgttctgggggcttggaacagtgcctggcacatagcaaatatgtcatagtcatctcctgagtgcttgaatgagtggcctttggggtgttttgactagactgcaaaagcaacacttaagtgagctaggctttgcatacattgtttgggactggggaggattccagccaggaattgtcagggggggaggttcaagtctcactgaacatcgagatatgatgtggaagcaaccacccacagagccagaagacaaagcccccaggggagcagaaccacaaagggttgtgttctagtggggagggaggagtggctgagccccgcaatgccctaggctttctgctgggacaaggattataaataggagataaataatttttaaatggaggcaacatcctcactggggcaaaatattatggccctaaattctaggcattcaaatactgggccctgttgtctccctgctgtggttagaggatctggaagtgggaaggtttctggctctggcccaaggacaatattattgtagtcataaaaataatcagagcttggcattaattttggatgatgatgcctccttctcctgacaagccctttatgttttttggtggtgactgttggctgcatcctccaacttcctcaatgagagaccacttgaaaaagaaataataatttgtcttcatatcgcacactccgtctgggctgatggtgggaggggaatgcgtgtgggtgggctcagctctgttagctgcgctggctggaagagattcccagtttttattcagcgctcgagctgggctgcatgcttgctgacaagaggcgggaggccccttagacgtctttagacactccccctgtgctgggctgggcacaggcggctctactcagcagttcagcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaggtttgggcgacagatcagaaaaatgaagacctgcacatgtggagctggagcaaggactagtctagtattagctctgtgacgggagagctttgactgtcacctggaagtctgacttgattttgccagcaagaggcaacaaccaaaggttcactttctctccttccaattttgggaggcgatctataggggtttgccagccacctctcatccttgcagaccccaggtggaatttgcaggcagccactatggtgcaaaatgtaattttagtgtttttccgcagacggctgagccaaagacctgccgtggaagagctggagagaagaaatatcttgaaacgtgagtagctggtgattcctctagaggttttccttcacgtgtggtgaggctgttgcacaaatcctgagttcccataacccagcccttctctgcaagcggaatgctccatgctcccagtaaacctgagctgctgctgaattctgaaagcaagccccaaaggaaagctgatatacctagaaacattttttttaatttaaaaaaactcctttcctcttagcataaagatgtttttattttcagggttagtcccatatgtctaagtgcgttaggtttcaagcaggtcttcctggcagtttgggtcggggttcttcatggctatagaaatcacaaagcatgaaccgcatgaacacactagagaaggacacgccccttgcctgttacacttgggaggaataaagcagtcagctcagggaaacggtgaagccatgagaagctttcctgtggctcaggactttgaggttccaggaccctctgttgctcccagccttgcaaccccttgcatttcccgttaggtggacaattatagcatatgctgagcataggtgttcatgagtaacctccatgctctagggcactatattccattaaatattccataaagtcagtgatttaggggtggccaaacctcttgaaaaagtgtttctccaatagttctttatctagtcattttcagtttttaaaacattttccacagaaagtgtcttctaatggcttggatttttaaaggactttttttctctttatgtgatgaatactgcagactttctctgagtttgttttcttatttgtgaacatctttttatgaagttataatggtaccaagctgactttctgtcagaaaataccgcagagccccttgttggtctgggtactgaacttgaattgattcctccctcctttctttgcctcagtgccttcattaactgcctaaaacaatcccctcctttatagattgttgaaaataaccctcagataaagacttcttcattttactttttaaacttaagatatagtgactactgttctatgttaactataccatctctgaggatttaaagaaaagctcttcattgataacatgcttaattaagtaggcagacagaaaagtcaagctgtttcagttgccaaatatttgaatttttaaaaattaagtcacttatttataaagcttgtaagttgcagatgctactaaaagtagcagtccagacttgaaccaggcaagttcaagacacaggaagcaccacattccaagtagcctgctgtcagcaacaggaagagagtactacagcccagacctttaacccaggaaccatgtcttctttcagtagcagcctcttccttcctatcgtgggcaaccaggtcttcccatcagcaagtacttctaattgtgttaatctttggaaataaatatcagagccttagaaatagaactatctttggtgaatagggagctagcaaatgcataactgaaactgactgcccttaccttcagtgcatgaaagggaaaatgggtttcctctgcggtggccatggcaatcccgccataaacactgtgccttcatcagtgaatgtaggtttgtccttagctcggaagccctctctagtgtcctgagtggaaggacctgagaattttactgctaggtttgtggtgggtgtttggttttacttttgttctgtggagatgagaatagggtaactatatatagcctagtatgaaacatcatactcataggctctagatacacaggacttcaagcactcatactgtattgtattttcttcttgtaaccaattcttagaatatcacttttgtatttgcttcaagggggaactcatgactaactgcagtcatatctgaggagcactcaaaactccgcccatataacactataacgtggatagaaaagcagaagagcaggggtccctttatatggtgatggtaattctttattaggcccaatctgtgccagggactatattcagtacttggtatatattccctcatttaatcattgcaacatatttgtgaggtttgcactttttaataaatgaatattgggaaaaggatagcactagagttcaaccccaggtctgcctaactccattgcccatcttcttaactactgcatcagaagcagtaatacatttctggatattcatggaagtctcaggtataactgtccaagctgctggagctatttccagaaaatatgagtatagcagtcctgattatgggtcccttgctttgtataatgcagagggtgttctgggtctggaaataagaaatccataaacatatcactaaggggagctcagaaggggaggtctgtgggcttaggctaacagggaggacttcttggaggaggtctccaacagagcgcctggcacaaagcagcactctgacaggaactttcaaagatcagttctccaaagaccctgctggtgaccttcgtagtaattatggcatttttcaggattaaaaaaaaaaaaaagatctgactttgtttcaatcttttcacatggaagctgcacttgggagctgcccatggcctattttaaagaaatctgaaacattttacgtcacgtaaatccctcatggcttgccttgtctggacactttcacaatgtctctctaattgtatcagctttctgatgataccttaaaagtatggtttcttctggtttctcacttgtataaagaattaagcagaaagaggatttcattaccttttctaaaacaccctaatccaagatgactcacttaaaaaaaattactggaaagcacaatatattaaactctcatataaccaatcccacaaatgtataaatatttgaaacgcatcttttacataaaggcagataatgtgaaattgtgttaattgcaagtggcaggatttcccttaccaaaacctaccagtgtttctaggagtgctgattgttgaaatctctttcctaggaatggagctatgttcaggtcagggacataaggctttatttagcaacagagaacaccagaaataggacagccattatcttgtatcccagggggaagcttacgttttatactatatctcagcactttcgtctatttttggcttccaagggtaggtgcgagcacagcttgaatgttaatagtcacaacttaccaagcaaagctaattttgctgagggacttgggctcctttaaaaggcactgtcatataacagtgttcacgcttcagcaatggagagtcagcgaggttcatagatgtgttaagatttgaaatatagtctgaacatataaattccaggcaagcatatgctgcccaggagctgaagaaggtgttccatgttttatgttggttaaaaagtctgtacgcttattaaggaaaaaaattagtggcagtgctatttatattgaaatgtacatatacatttatttacttagtctactacagctttttttatgtggcatctaagtgctagatgtaaatataaagatatttggggagaaagacagacacagaggtgtctacttccttaaacaaacagcagccatatctgtggttgtttctaatgcacagaagggctgaggagaccaggttgggatgacagcaaagctttgcttagtacaagtatttctgtgtaatgagaccatgatctcctgagcagtgactgacaaagtgggaagaaaacaccatgagtgatgtggaattaacttcagctcccagaaatatggatatcttgggaacacttccctgctgaagagaagaacgtttcaacctgtttctctttgttattttttttttcctattttaatctttcacagaaaggaatgatcagacagagcaggaagaaagaagagaaatcaagcaaagattgacaagaaaggtagtataagcattttattgcctgaataataaaaggtggtctagagaacagctgcttcggtagcaggtgggatgggtaatgctaggtatcactctgtgatcatgaataatgttctcctggacatcatggcatcagttaaatcaggatatttgctcagcaacaatgaattaactccctctgacgttccctatggacgaagtccttccctagcacggtagcacttggagaggtgcacaatgcacatgacattttttacttatgttcaggtggaagccagaagttgattggcattttcttaatttacagtgtctaggaaaagcatacctgggtatcagtgttttagtcacattttacactcatcgcttttgttcacctccaatatgtctagaagttcctcagttgcagaaagctttattagactcaaaggtttgttctctgtgactcaaacagttaacatttactatggccaatacaggtagcaactctataaatcttaatctacttttaaagccttgaccatttctaaattcaagtgttctggattccccttcttcgttgtgctgctccataataattctcttgaaattaacagaatatccttcctaagctggacatataataactttattagtacttttaaaaagcttatctaattgtatctgaagccagtgatgccataaaatctaagttaattcactaaccattccttgagctggtgctatgtactactgggggtgtgactccttctgataaaatatgttggaggaagggggattgtgatttaagagtacagtatataatttcagcccttcacattagagattgcttgtatttgggttatattttccagtttcaggttttttttgttttgttttgttttttaagagaagtgctgtttgttcagagtacttcaaaaaagctagtttggcatgtgatacttaactatgatgatctttaattttagcttaatcagagacccactgttgatgaattaagagacagaaaaattctgatacgattcagtgattacgtggaagtagcaaaagcgcaggactatgacaggagggcagacaaaccctggacgagactgtcagcagcagataaggtacctaactgcctgtgctggtggggggtgttggatgatataataaaggcaaaatatgtcatgccagggagtttattcatagacaatgggagccctcaactatttaagggtatactgcagtaaatattggtttctcaaagataattcagggtcagattgagaagtggttctcagctaggtgacagttttgccccgagggacatttggcaatgtctagagacatttttgattgtcacaactcgggatgctactggcatctcctggtagaggccagggacactgctcagcatctcacaatgcacataacagcccccacaacaaaggattatctagtaccaaatgtcaagactgtggaaattgagaaaccttggtataagggataaatcaaaggtgggcaaggctgccataagagatcaactgacaagtttaaacaaaaagagctacagtggggacaaagaggcattcaagaaagcctctacagtatagaaaaggttctagattctccccctggacttgtgcagtttgaggtatctctgagaacctcctaagaagtctgaactgaacagctagagaggcaggaagaacacaaggaggtagtaggtcatagagtctctgcatgacatttggtgagcacagagagggtcagttcttgtctgtgatcaaacacttgactggcaagatttaagcccaagagtgtccatagagttttgtcaccttcttgcttctattaattttcagaagacttaaagcctttaggaagagaaaaattatacattcaggcaaggaatttgctaattgttcttcattcttcatatgctgagtatgagtatgtacacagatattgcatcaacttggagaaatgtgaacgtgttggactaacttgcctggttctttgtgactgatgtgcccagaggatcacagtgatgcgaggagaagtatctttggtggtctgcagatgtgtttgagtatgagaataatatacccctaaagttcttaaagactttccttgtcccagaggctgtgtttgatgttttcagtctcatcaggtccctcgagtgtttatctgagaaagaagtacatgatgcaagtgggcctggggaagccaaaatattaatgtatgctgaagttagaaaggcttatttctagattatctctgattataaaattccaagttcaccaaaagctgaagtttactcattatcttggtgttcctgtttcattagtgccctaagcatgtgcttggtccgtttaggtatggagtgaacggagtttggggaagggttgtcttcccactacagttcagcaaattaatgaatggaacacttacataatactagtcctagccagagcaatcgagcaacagaaagaaagggcatccaaactggaaaagagaaagtcaagttatccctctttacagacaatatgatcttatacctagagaaacctaaagactccaccaaaaacttagatctgataaattcactaaagccataggatacacaaaatcacacaaaaattagtagcatttctataaactaataatggactagctaagaaagaaatcaagaaggcaatcttatttaaaataggtaccaaaaatacctgaaaatgaattgaaccaaggaggtgaaagacctctacaaggaaaactacaaaacaatgatgaaagaaattgaagaggccacacacaaatggaaagatatctcatgctcatggatagaaaggactaatactgctaaaatgaccataaaatgaccaatgcaatccctatcaaaataccaatgtcatttttcacaaaaatagtaaaagccatcctaaaattcatgtgaaacccaaaaagaacctgaatagccaaagtaatccttagcaaaaagaacaaagctggaggcatcacactaacttcaaaatgtattataaggttatactaccagcataatattggtataaaagacacatagaccaatggaaaagaatagaaaacccagaaaaaattcacttatttacagccaactgatttttgacaaaggtgccaagaacataaactggggaaaggacactcttcaataaatggtgctgggaaaattggatatccatatggcaaaagaatgaaactgtacccctatttcttactatatacaaaaatcaacttgaagaataaagacttaaatgtaagaccccaaactataaaaccactaaaagaaaacacagaagaaacagtccaggacattggtctaggcaaacattttatggctaagacctcaaaagcacagatagcaaccaaaataaacaaatgagactatattaaactacaaagcttctacacaacaaatcaacagagtaaagagacaacagggaatatgagaaaatattaatatctgcaaactattcatccaaaaagggactaatatccagaatatacaaggaactcaacagtcaaaaaacaaaacaaataatcccattagaaagtagacaaaagacatgagtagacatttctcaaaagatgacatacaaatcgccaacaggtatatggaaaaaatgctcaacatcattaatcaacagggaaatgcaaatcaaaaccacgatgagatatcatcttattccagttagaatagttattaaaaaaataaaaacatgctggaaaggattaggagaaaagtgaacttttatatactgttgatgggaatgtaaattaatgcagccattatggaaaacagtatggagactcctcaaaatattgtttaaaaactatatgatccagaaatgccacttctaggtatacacgcaaaggaaatcaaatcagtacattgaagagatatctgtactcccctgttcactgcagcattattaacaatagccaagatacaaaatcatccaagtgtccatcaatagattaatggataaagaaaatgtagtgcgtgtatatatgtatatgtgaatacagtgtgtatacacagccacacaaaatggaatattccaccttaagaaaatccagtcatttttgacaacatgtatggaactggatgttattatgttaaataagccaggcacagaaaaacaaatatcgcatgttctcactcatgtgggatcaaaaaagttgatgtcatggaggtagacagtagaatgatagataccaaaggctgggaagggtggcagggtttggggagagaaagagaggttggttaaccagtagtaacatacaattagaaggaataagttctaatgttctatagcagagtagggtcactacagttaacaactatgttgtgtatatttcaaaacagctagaagagaggacttaaaatgttcccaacacatagaaatgataaatactggaggtagacatcctaaatacttgatcatcacacagtctatgcatataacaaaatatcacatgtaccctgtatatatgtacaaatattatgtatcaataaaatttttacaaagacttccagaatattagctacatactagcttggtaggactataataatgagtatggcagttttaatgatgaaccaaaaaattgtttgtttttttctgtatattacataatagagtcaacaaggattaggaatggttaatttataaacacgatgctaatttcctgatttttttaatatcctgtaaaacaatgtcttgtttttaaatttcaggcagcaattcgtaaagaattaaatgagtacaaaagtaatgaaatggaggtacatgcatcaagcaagcacttgacaaggtcagatttgtttctgtgaatttcatggtacttatttttgaaacacacaccgccttcccccgtcccccgccacaaaccatgtatccagctatacaaattcagcatttttccagagaactctattgaacaaatagaatgtacctcaagtaagaatgctgcctgctcccattatttcctttaggacttggtgaaaggtgatatgtatggtaacaatatcggtttatttaagtagttaatgcatatttaacaaaaataagcctcaaggcaatgaaagtaatttttctgtgtatttaattcccctctaatattcagaattcctccaatttatagaactcacctgtttatacttacagatttttgtgaaattagtcactccccaccttcacatttactttttcctatcgtaaattattagtcacatctttaacacagccagcgttctcctaaagctgagtatttgtttcctcagtaaatatttgagtaagtgctgagaatgcaatagtgaatatgataaaggaggctcccatcttcatggagtttatgtcccattgggaatatattggctgattctcccataatcaagacttttcccattaagatgaatatattctctgtctatgctatgatatgcaagggatgacactgggcttcttagtgatgacgaagttgggaaaagatttaactctctttacttattgaactgcatattttttcagtatttccccccacttcttttccatggccatgaccggtagtaattatgtgaagttctcaaacatctctgattctaaagcagatgactgtgatgcaacaagccttcaactgtatcagttgctttgtcttctcctttatctgaagatgctcaaggcccacatacaaagagaaaggaaatcctgcatatagatactgccttaaactaaaataatagctttagttttctgtttgttccaaagtggccactgcaattgttatctgaaagatttactctgtaagattaatgtggctatagaacagaaactaagtacaatggaattccaccttaaccaatggttttagggtgaatatatcaaggggaagggaaagttggatgaataggaaaaaattatgcaaagagtttgttttttaaggttccctcccatgactaacatacttttggggaggaataggtcatatggaggaataggtcatatgaatgtttaggaaaaacagtttcagtaaatcatgcacaattacatttaatgttcattctgtcttaaatagaatgaatacatattctatatattgcaatctcaattttgtacattttccgattatacattattaaatgtttagtaaagatgtttattgtcctaagttgatagctttctaaaataatgactctaatacttaaaatgtggtataaagaccctaaaattatttcaacaattcaagagtcagaacggtatttttggttatgagattttaagagttttaaaattactatgaacatattactctacaaaaagtcataactctactataattttcaataatttattaacaaattcatcatttctactgatttagcaaagccctggcctttctgtgtacttcaagggcttttaactcacaggtttaaaactaagttctagatagtcctaagaattcagcatataacaggggcctgagagtggggagccctctgagactctaccctattttaaccagagtagctccatcctcatgttttacatatgggacttctgagaatctttttaatagcagcaaatttatttgtataaggtttttggctattttaactgctagaaatgaataaccttaaattctttgtcttttttataatctctagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 779 - DNA, 171051 bp, Homo sapiens
acctttcagggagatttgagagaaagactccagaagcccgcggggagagcaggggttctggggaagataaagcccttcatccaggatccctctgtgaccataaggtgagttgctttgccccacatctctggtgaggcagagggcagggactctgcttagggagcaggcttcttaaaggcaaagggtttgcaaattctagcagcagcagggccctaagagaatggctttttttttttgttcttgaatcggatgactgcatttggagtctggggtgaggggtgggggctgcccctcttggagccacagatgggtcatttttatgtatcaagggagtcagaccaggatcagccctgggtttctggcacagagtccagaaagagtcacgaaggtcttttgtttgcatgtgaatggtattttaacctattacttctgggctaaaaataaaaattcccctcagatgcctttttgtctgtagattgtaagatcgtttccaggaaataatagattgtcattgatgtgcgttttgactgcatggtgtcctattcttaagccaggttttataaaaattcaaagtagaggaggtttcccacagtggagattgaagccttcatttagtgtcaggaacatatgctccactatcaggagtcattgtccttccgggatctccaccactgaaccctgggtgggagtgtgggagtgggtgagggagaaggcacacttggcttttgtgtggttttacatttggtatcatttgtggacttttggttctgaaaaatggtttgcaagtgaagttggatgtctggagttggggcccaagaaggcgatggagaagtgaattctaattcacagttaatatgggtcatggttaagttcttggaagcaacattggtttccaaaggtgcctgctgcgtttttaagctgcaaggttttatgtttttttgacccagtggaaaatggcgattcaggatcccaaggacttcaggagaggttgtctgaatgctaaaaccccttccctgaaatgcttgctttctttttagaggacaggaaatatgggaaattaacagtccttttgtggagtgtggtttgcgtgttgttctttgaggaggaattacggaattatgtgcgtgtataatgatggtaaccacatacacaatcgaagaataacaagtcagaaaaatccatggtgaggttcattcagaaataatcaagagtgtattgtttaattaaggagaggatcagaggaatgcagtcccagagccaccatttcggttgtcacctaggtgcaactctcagcagaaggaagcattcccaataagatgttctgaaaacgtactgccgttgaatctcacaactttcaccccacaagctgcaataagaggccagtatgaaaatgcgctctttcttccccatacattttcttctgttcctgagccgagcccataggtagcttggcagtttgcaattctctgtctacacggaatagatatagatttttttttcctgtatgttttgggtattaactctttggttgccaagctgttgagccctgagtctatattatacaccttcagcccgtggcttacagggcttcaacacatcgttgttatataatgcagtagttttgcttgtggggtgactgttcatatcgtggatgctcagaaaattctatttttaaagtataaaataccactcttcagagcagcctgctcactcctgcctccctgggagccacacgctttgcaccgtggagttgttggcatgaaggcacatgacatatggatgggagtgcgttcctcctgtctagggcctcttaggacccgaggaatggctggaggcagtttctctccagtcctgaggttgatgatccgaagctcttggtgctgagcctgtgctgctatttttagcttcctttcttccctgcatcttgacataattcgacatgtcgcagctgaatctcatctacttgcagagcttaccgtgttttgtaatctgtgttttgtggggcagaaatagtccttgccagagcatattatatcattattattcagggggaaagttatgatactatcaattaactttagaagatgcaaaacacaattgatcctttgattttctttctactgctaatttcctggctgggagcacctggagggtaggcactcctcctccttctgccggaccagaaggcagcaagcagtggttctcacatcttgggaacctgtatcagaagcacctggaggggctgttacaaaggcaattgcagccccactggcagagtttctgagttagcaggtctgggtggggtgggggggcaagtaatttgcatctctcacaagttcccaggtgatgctgacgccggtccagcactgcactttgaatcacagatggagatcacggcagagggttggtaaatatttagggggtggacgatgcctacatgcagagagccaatttaagaaatatacagatggtggagcaggagattttcagttgttgtgtatcctgtccacgcggttgaagatggacttgattgaaaaagaaattaaagttgaaataaaattagctgactgagaggatggctcctgacagtgtccaatgctgtgatgttatttagggaggatgaagcatcacgactcagacaacttactttgagatggccaacagcacacacagacataaatgaagtgcgtgtacatgcacacacacgaaactcagcaaaatattaactgctgaaacaataggtgttcatattattctaatttcatactatttctatttctaatacttttcttcataacaaacattgtattaacatggcaaacacaataatagggcttaggacagcttttcttgtgtgtgtgcttaatagtaaatcaaggtcacccacatgttcacagctgtgttgctctgggtggcatgggcatcggtactgtattagtccatttttacactgctgataaagacgtacccaagactgggtaatttataaagaaaaagaggcttaatggactcacattaagcctctggggagccctcacaataatggcagaaggtgaaaggcatgtcttacgtggcagcagacaagagataatgaggaccaagtgaaaggggtttccccttataaaaccgtcagatctcatgagacttattcactaccacaagaacagtatgggggagactgcccccatgattcagttacctcctgctgggtccctcccgcaacacgtggaaactataggagctacaattcaagaagagatttgggtggggacacagccaaactgtatcaggcacacgcatcgctttagggagttctcatttccttccattcaacctgatcctttatctgcttgttctttcctcctttcccttccattctctttcactccctcctccctggcttccctctcttctgctctccctccctccttccttcttcctgtccccatctcctgtcttctggtgactctgggtcaaaggaccctggtccagaagggttccgtgtggggatgtgttgtgctgaacccctgttaacctcagtagggaaggtaccaggttcaagaggccaaagaagagacctggagccagcaaacaagacatacagttttattatggacttacatgcagggaagagagtccagtggtggcaggttgaagagaactgtcttaacatacagaaacggtccagtggtggcaggctggacaggagaactgccttaatgttcagaaacggtccagtggtggcaggctggacaacatatccaccttcctacagtctggtggtggcagactgggcaagaaaaccacaactgcaaccgcctgcgaacatcatgcagtttacgcagcattttcatttagcaccctcctcctaacagccctcacctggcaaccttcatgtaacccaagcttgtccaacccaaggcctgtgggacgcatgcagcccaggatggctttgaatgcggcgcaacacaaatttgtaaactttcttaaagtgttatgagatttttttttttagctcatcaactatcattagtgttagcgtattttatgtatggcccaagacaattcttctttttctaatgtggcccaaggaagccaaaagattggacacccctgatagtaacccaaaactcagggcctcaatcccctgtacagcccgtgttccacaggacaggccggaggctcagatgttgtggtagataggaacagatctctgggtgggccactcccggattccctagtttggaacacacattcaggtgcacctgtcatacagggtcattctaagggtatgcttaaaatattgatgtcaggtgtgtttaccctgcaggatgctgtggcatctgcccaggaaaaagttgaattatgccagttattgttttcccagggttttcaggctgcctccttgttttttaaataaagttttattagaacacactcacacccatttacttacacacttctctggctgctttccagcagcatagctgaggcagagaccatagatccacacaactgaaaatatttacttctggcctgttgcagaaaaaatttgcccatgctgatttgtttctgtgggctggctgtcttggagattccacacgtacacacatgtgcacatgtgcatacatactcatactaaggacatgcagcaagacgttaagggttgtggagtctagagtacatgtgattgttcattgtaccattttttttttctactttttcacgtgtccaaaaaatttgtaaaacattttgatgactgtggcagtgaccaccccagggtctctagaggaatgccacaggggtccatcccaggttctgagtcttcaacatttgcctcacccacttggcaggttaatcaaatgggtagatgacacaaatcaataaaagcattaacaaagtgtcccatatattcaagagccaaacagatatctcaacagactgttagggaggctgagtcaacaaggagaagtttaatgttcataagcttcaggtatccagctcagatttacaaagatctttgcccaggtcctgcaaggagcagactttgataggaatcaggcctctgggccaggcatggcggctcacccctgtaatctcagctctttgggaggccgaggtgggtggatcacctgaggtcgggagtttgagaccagcctgaccaacatggtgaaaccctgtctctactaaaaacacaaaattagctgggagtggtggcacatgcctttaatcccagctactcaggaggctgaggcaggagaatcatttgaacccagggggtggaggttgcggtgagcagagatcgtgccattgcaccccagactgggcaacaagagcgaaactctatctcaaaaaaaaaaaaagaaagaaagaaagaaaaaaataatcaggcctcttggctggacgcggtggctcatgcctgtaatcccagcattttgggaggccgaggcaggtggatcacttgaggccaggagttcgaggccagcctggccaacatggcaaaaccccgtctctactaaaaatacaaaaattagctgggtgtggtggcgtgcacctgtagtcccagctactcggcaggctgaggcaggagaatcgctccaacccaggaggcagaggttgcagtgagccaagatcatggtgctgcactccagcctgggcaacagagtgagactctgtctcaaaaacaaaaacaaacaaaacaaaaaaaagggaaagaaatctggcctcttaatggaaccaaagtctgcggggtccctagagtgtgtgcaaactgttccagtcactgggacatcagtgtgcaaagcctcctggagcttgtgtgctagtgggagaggacaatgaacggcacctataaccagtaggggatcgtcctgcatgttagtaataagtgttgtgggaaatgaacaggagaagtagggggaggtaagagaaggtataaatgtggtaggctgtagacatttgagtattacatggagtgtcaggattggcatcattacggaggtgacatttgagcaaagccgtgaaggcggtgaggaagtgagccatgtggatatctgaggcaagagcctttggggcaaagggaaccttcagtgaagacgccccgaataagagccggcctggtgggttccaggaacagggaggaggagcccgtggtggctggagtcacatgagattgctggggagggagacgggagagaagcagggacattgtagggaggggcctctgccagcacttgggcttttgctctgagtgtgacgggtcgggggggacattggagggtttgagatttaattatgattcatcaaataacttgagaacaggctagtgtccaggtggactgaccagcctagcagtcattgctgcaatccaggcgggagatgatgctaactggccacagtgaggttgtggacgtggacacttctagaaggtagaatgatgcagttggctgagggagcagatggggaaacagggacagtggagtttcaagggaggactctcaggttctgtcgtgagtaacagaaggatagagcgttggtcctggcctatgaggggaaggccgtggtggagcaggtttcagggagagagcagttcaattttggctacagtgaatttggagcatctatttgacatccgtgcaaagatgacaaattggcaattggctgcacaactctgtgcttgggagagaggtttgggctgaagctgtgcattcgggaggccgcagctgagcagaagctgaatgtgagctaacgcgctctctccctgacttagtcatttgtctgccacctgtagtctaatttgccaaatactttcttttaaaccaggtcttttttttttttttcaaatttaaactcattttaaaaggatatctatgttgcacttttaagtagaaatccaatattgcttgcctttgataaaaggtaaccataaaataaaacaatgacaacaaaacaacatttagttcaagttaggcatagtctctcactaaggattttgagccagagggtcttatgtattatccaaacacagagatcaacaagtgtcagatgccagggtcgtcataataccaaactaagactctcctcttgaagttcttggaagattggagggaaattggcaagaaattagcttctgttgctttgtcctgggtccacgaatcccttaaagtccccttttaccctgttatgtgcctggcccttggggagatgctgagctgagcagccgttatagtgggtagaagaaggaagcttggggtccagcttgaccctctgctagaggttgggtttgccttaggactatgtattttctgaaaggcaaactgcaatttgcaagaacgcagagaggggcaatggctgtttattctagaacagacttgggggatgagaaccttggaaagaaagggtgggatttttcctgcatggttctaggatgtggccctgcagccagctgggaaggataaaaggatacaagtgggttggtttcacttccctctgggcacaggctttctctctgagaattctcactggggctcatatcttttaaattaagtagtctgctcctgaataatatctttctttggggctgtttctttttcagtttatatattggggtccctttttgacattataggctttcctcaaatgcctggtgagccaggatcgaccttgttcattgcagaatgaagcagcaaagagctggtgtgtgctcacggtgtgtttcagctggtgggttttgtttcaggttgcccaggcctggaggtggccttggtgctgaggggcctttgcagaaccttctctttgtggctggtctggagacaggcaaggatgctcctgtactttttgcctggagatgggagttgtccatgttatctgcaatccaccctaggctgatggtgagggagggagtctgctgtcataggaagcatgtaaacagactcaggcttctctcagcatgagaagggattttggatctctgaggtccttcctactgtggatttgcagtttccctccacaacctcacccgcaggaatccggaagcgcctgatgccttccctgggctgggagcccctagagaggaggatctgctgagctgttatgacatcgtgcccacaactgtgcaggcatttgggagatgctctgaaaatgcccgatgaagggttgtgaggatgaaagaatctgctgctgaacacaaactgctgggctccaggctactgagcccaacttattccatggcccagcatgtcccacggctcagcatgtcctgtggctcagcacgtcccttggcttcccatggctcagcacgtcccgtggctcagctctcactcctttgcttctgcaggtcccttggtctggcgtgtcctccccactcttcctgagttctctgaattctacttgtggctccagggccccctctttcatgaaaccttgactcaccacctccacctctttccccacctcacccaccactgtcctgctcttggggccctgcacccacctcctgctgggcccctgcttctgccctgcagtgctgtggcccccttcctgcccagcagctgggaaggcatcctgaagtgcatatcagatcttgccctgtccctgcctcccattgcctctggaccacagcctctgagatcctgcctgccttcctcatcttgtcttccattcctggggaacagtggccacatagccaggtggctggcagcacggacttgggagaccctaccagcctgggtttgaaccctgtctctaccgcctgcttgctttgtgacctggttcctcattttcctcatctgtaagatggtggtgttgaaaggacccgtctggtagggttgttctgaaggttgagatattcaaatgctgagaacaccacccagcacaaggctggtgaatgctccaggagggttcactgcgccgttgccattttcctgttgatcctggagttccggccactctggcctctgctcacatagctggaactcgtcagaccatctcccacctcaaggtctttgcctctaccgtgctgtctcaggacactcgtcccctgccttaccattcggtcagcccattatccttcgggcctcaggttgaatgtcacttgctgagagcagccctctctgaccatccttttagagtggcttccccgcctcacattccccgttacagtctggcctgattgtatctgccagtgggttctgcttcccccaaccacaacttgcccatcatgagggggcagccttgcctgttgtcccctgcactgcatcaacactgcctggaccagaggccctcggtaactgccagttggctgaatgaatgcaggaatgaggcatgaacaatgcaaagatgctgaaccatgacatgagggactgtttcattcatgtggcatgggggtgggctaccccccccatacctaacttttccaatgtgacggttttccttctgaatttataaggtgcccaccttaaagacaggaattcagctcatatcttttaatagaccctgcaaggtatccagttcctaggacacagcattttgttggttattgaatgagactgaagggatgagaagagtggccaatagcatggagctggggcctaactgcccacgtgtggtcttggtccctagtatttattagccaagtgtccttggccaacttcattttatgccacaaaacctcagtctcctcatctatacaatgggaataataataataccttttctagagttggagggaggattaaatgagtcagttatgtttaaagtcctggaacagtgccaatgcccaccacatagtaatttccatgtaaatgtgagctgccatgatgatggtgatgatcatggttgtgatgatggtggtgatgattgtgatgttgatggtgatgatgatggtcgtgatgatgatggtgatgatgatggtcgtgatgattgtgatgatgatggtgatgatgatggtggtgatgatgatggttgtgatgattgtgatgatggtggtgatgatgatggtggtgatgatgatggtgatgatgatggtgatgatgatgattgtgatgatggtggtgatggtggtggttatgatgatggtggtgatgatggtgatgatgatggtgatgatgatggtgatgatgatggtgatgatgatggtggtgatgattgtgatgatgatggtgatggtggtggtgatgatgatggtgatgatggtgatgatgatggtggtgattgtgatgatggtggtgattgtgatgatggtggtggttgtgatggtgatgattgtgatgatggtggtgatgatggtggtgattgtgatgatgatggtgattgtgatgatggtgatgattgtgatgatggtggtgattgtgatgatggtggtgatgatgatggtggtgatgatgatggtggtgattgtgatgatggtggtgatgatgatcatggtgattgtgatgatggtggtgatagtggtggtgacggtgataatgatcatggtggtgacagtgatgatgacgatggtgattgtgatggtggtggtgatagtggtgatgacgatgatgatcatggcagtgatggtgatgatgacgatggtgattgtgatggtggtggtgatagtggtgatgatggtgatgatgatcatagtggtgttggtgatgataatggtggtggtgaatgtgacggtgtgatggtggtaatgagggtgatgttgttaccttgtagtagatttgaaaaagtggaatagagtggaattaaagaaaacactactgagttaataagaagaaaggtagggcgcaggaagtgtttgctaggaaatggaagagtccagcttattccagtatcagttgaatgcagcagactcatgaactttactgaaaccaaaatttaccgaagctgatgagaggatcatgatttcccagagtgtggactgaagcctccgggaggtgtcagagatgattttggagtagtgcttttcacaccctctgtaaaataggacccatttaaaaattttcaatctgttgcaaactgataatttcattaatgtgtagagaaacattttcacacttcacccctaagagaaggtttgtggactggtacctggaacagatacttatcttgtagctgccaccaagaaacactttccagatgggcaccgtagcaggacactgtgctaggacacgctttgagtagtgctgtttcagatgaaaatcacatcacatggggctttgaatttcacagaatcctgtggtcagctggttgctcccctgtgaattatctttcagttgtgtggttgtatatggaggagaaagttgtagtttgtggctcatgtgtcactgactggtgatgttggatgatttctcttttctaacaagcagagagcagcctcaggcacagaacccttgacgggcatggggtcttgccagaatggaattacactgacttgtttccattgcatttattttgtggccacttaatatttttggatgttgattctgattttcctattagagccaagatgtaaagtttctttaatagataatttaggtgcaaaaagtgagttgccttaaaacatagtgtacattatcatgcagctacgagtgaatatatgacaaaaatcatgaaagtggtacaagacaaatttgcagagaactctagtggaaggcaggatagaggagtgagaatagaccaaatggatgtttggggtcatttgggggccatgtaagcctctcccccttatccctggtggaacagcattaaggacatcctctccttcatcccaaacatctgctttatgggaaaccacaggactatattgttagtagtactgggaaagcctagtcggctttatcttttggattctgagaatgttgtcagtgatcatgtttctctcttcactggagttgctaggagttccagcatccaatttcagctccaacctccaatccttgcacagaaccctacagtacgtgttttgtgtattgaagccacagaagcatgtatttttcctcctcattctctccctgacctttttttgattttgttttttgtttttttttcttaactgcagttacatttttgtaagctgtgttacatcgttgtttggaacacagtgggggtaatgcataaatgctgaataaataaataatgatgaaactttttcctcaaactgtgagattggggccactccattgttagagttattttaatgtgatcaggacaaagaggccaagagtgttgtaggaagtaagctttgttctcgtgggcttgggctgggcaacgctgtggttgttgggaacgctaatttctgttatttggtggtgctcatatctcaggcctctgtttaagaaacaacatagattcctccaaggcacatatttgcatcctgtgtgggccgaggtgcctggcttcattctttctctagatacccacactatctcatgggtatttttaaatgcgtgtcttaagagccaacttctctgctgtgtgcaggcttttcatgatgccgggagagttgccacgtggatttgcaggcgctgagggcagaaacaaggaacaggcagcatcagctcaatgggtgggacccactgtcctttcagcccttggtggggcggccttggaggaagggtcattctccaagcagggcagaactcagttccaggttggccagaaggccaaatggactgtggggcaggtctgaggccaggtagtggggcgacccagaagcaggaagatggtgtgtcaaatgtagagtgagacagaaatggcaggggctgaggagttgttgagtcctgttttttcacacttgtgtggggatcttgaggagtttcgtagaggtgccgcagggtctgcctgttgaggagcaaaccaagctgaccgggttacaggtgccatccactgtcccctcccatctgattggtttggatactaggatgttgtgtggattctcctggagtccagacatagccagtgaaacaatattgaaccccctgcaatagtccagccccatcattccatttcataaaggaaactgaggccttgccagggatcccaaagtggtaatccctcttgtagagttccaggggagggcaccaacctctacctagctactgaagccagaaacctgggcattcacctgccctttccattttcctcctcatccccatccctgccacatccctgtatcctggcatctccagccttcagcacctctccaattcatctgcttctcattacccccagccacaccaggaaggtccaggcccccttgtctgtgcgctgggaggatacagatgcatcctgagccttccagcttcctctgttgggcccatctaattgggtttctgctgggcgatgggagtgatcatttgaaacttcaaatctcattatgacagtctatatcccttcctcaatgttcccatcttgtttcacatctttcagtggttgctcatggcttgtaaaatcaaaacaaaacaaaacaaaacacccaaattcctcaccaagccccctcctgcacctctggcctcatgatggcatgattctttgagtctggggacctgagcagatggtctgagctgtgctagaactctaacccacaccaccgcctaccatgcacaaacacagatgtttgctggctgactccagctcatcctctcatcttagcctcagcatcacttctgcaggaaggccccttccaatctcaccagggcccatcacgtcatcctgtctgatgccctttggcactctgggctaatcctttggggccctcagacgccgtccccactgtcttagttgtctggtttgctctctctcttcccctactggattgtcaacttcctgagagccaaggtcacatatagctttagcctgtgtcccaggccttcagcatggtgcttctttgggcacaggaggtgtgtgcagagtggaaggagaccttcatttggtggggagactgtattatagagaagtagtttcatgttccaaagaacaagcaggaaatatcttccttctcctcctctttctgctagtaaatcctccttcctcctcactggctggatgaagcatctcatggtggaatagtttcagatccagggttcccaggaaagggaaccacctccagttccccatcccctttcctttcctgggaggtctctggtgcttatgctactaataatgaacatttaactaatgagttgctacctgttcatattaccaaagcctccctgccaaaggccaccagagacattcctggggtcaaatcagattagatttatggagcttcctgcatcacagggtaacacagtattgagggccatgacaacatcccaatatacaggactgggagaggcttttttacagggcttgagtatgatctggatgattctagaagaaatgaaagaagcaagggccagctctatctgatactatcaagaaagaggcctcccactataggatatctcagtggtctttgttcaggaggttggaggaactagttgaggctgggtaagtgcaggatccctgcccgtggaggggacatcagtcacgtttgtagcttccatgtggcctcgggtgtcctggcggagaccttggctctcctgtcagaagcttcctctgattgtcaacagggatgattttattttactctttatgctttcatctttcatatttaaaactttgatcagtctagaatttcttttgatataaaatgtgagggacagagccaacctacttttctattttagattgccatcaattgtcccaactccatttattgaatgataatcgcttttctctgattttcttgcctcctttataaatatattagattctatacaattttgtgtctatttttggacttttcattttgtcccattgaattgtgtctatccttgcaacaaagccacattgttttaattattatcactatattatatgttttaataacagaagtccctttccctcataccttattcctcttgcagctttttctagttcttcttgtttattttttatataaattttatcttatttgctatatgtcttttaaatatctgataactttagcaggattttagttgtgtaagaattacagaattttaatcctggaaggatgctgaggaggtttctaactctctcattttctggagaggatatgattttatcaaagtgatgctgtgagtttatggcagtgagaaaccagggaatccccaaccctgaacccacctccagatccactcgccccaccaagcctccagcttttgaccctgcatatttttaggtacccagaaattacttaatatttagcttagtggactgccacgatttaaatttgaccttttaaatccaagcacctccttctgctatgttgcttttagaagaaaggacaaagctgaggaattcaacctttgtttccatttatctcttagccttccgagacaggacgcaatgtagccaacaccactcctttgtctccatggtcaaagtcggaaggaagttctttcagaggggttggcttcattgatcttgtggggaaaatcttacaagtacccagggcatggtgtttgataaggaagtgagtggtgtgaaatccaggctcaagaacaaaagccctacaagcctgtacccaacggggccactggcctagaatggtaataaatagaattgggtgacaaccttgaaggtcacccgtggttcagctctggaggtgtccttgtttgtactcactttgagtaaccatcaacttataaatagcctcaggccaattgcccagtgatgattttgactgtcgcttgccaggggcctgggcttgtggtttggttgtgagtctgtcatggtctctgtgacctcagaggaggaggaaggaagatgatgatggatgcttctagtgatgcaagcaacaaacatttttggacaatgtgcccaataccattctctgtactctgcatgagttaacccttcaggcttcaaacaacgctttgaggtaggtgaggagactgagcactaaaaaggtgaatgcggagccagtgtgagcacaaaaggcctggttccctgctagaccgtgcctcctcttggctggagctctatggaaagagttggaaccagggagccttggttaaaatatcagctccatcccttatgaccttgggcaacttacaaatctccaaatctgtattttcaccttttaactagaataatgtatgtcaattatagggtgttaggattaaatgagaaaatgtacataaaacttttggggcattgtctggcactgggtaagtactcaatgaaaaaaggtaatggttttttaacttgtttaatgtttctaagccttaggttttccacttataaaatgaaagcgtcattatatatggtgcgtggctgtcttctcttttggtttggttcggtttgaggatttgtcggggtcacattaccgtcatgaccacctgtgtgaccttgagcagattccttaacccctttatgttgcagttgcctccactctgaagtgggggtcctgatagtggctggctcagggttgtgtgataatcaaatgagagatgcttagagaataagcatcggcgtctggcacagacgtcctcatcctccaagatcctgtgacttgttgcatctatgtgcttgacttagcccacaatccgtccccatctcccttctcttctctttgttctgggaatctttaaaaacacttgttgagcttggggtcggtttgcagaatcatcacctacttttagggtagtctgtttcatttggggtaaacatttaggtttctaagacattgggacagtgatgtttgacttcacatctattcatgtgctctcactgagctctgaatatgatgtttccattcccccatctatcagagatgacacagaatcatttatatagactcaatagactcttaggggaggcaccagccctgtctgtagcttcactacttctgagactgaggtggtacctggtgtatcagttacctgtttctggcaacaaattattccagaatttagcttgtgattttgttgacaattaggctggacttagctgggtggttcttccaatcttggctgggcccctgcatgcatccgtattcaactgcaggctgggtataacactgtcagattttggtgtcagctgggataactgggatgactcaaccctcttctgtactcttcatcttggtcctgttcacatggtggaggcagagccccaggcaagagggaaatgtacaaagccccgttagtcctaggctcaaatcgggcccaccatctcttctgcaggcaattggcaacgtaagccccagtccagcccagattcaaaggaagggggcacacatcttctcttgatgggaagaacagagttcactgcagaggggcctagtctggggagatgaagaaatgtggccgtttttgcaatttgcctcactgaccacatagagggtgactggccctgtattttatgtcatatgtgactctatagaaatgtgtctcctagctgggctttgcagagatgcagactctatctgtctttctgttgtgggctttctaccttgtcatgaaaaggccagaaaattcctgaaatgagtgtccttttcagtccttcaggtgagaggctcctcagggatccacagaccattgttttggcttctgtctccctctgcttgtcacacagggatcacatacacaggtggaagtgaacttgtttgcttcccttcccaaactgtaagctctgtgaagacaggaatctccttgactcactattatatcattggcacctagtaggtcactgtaagtataaaatgaaagagggcaggaaggcaggaagggagtgaatgagttaggaagttaggcatctagataggaaggaaatgagagaaagcctcgatggaagaaggaaagaaagacactggaggtaaacagttgggaaagaaggaggtgaagagatataaggaatttaaattattcttcaacaagctaggtatggggcaaggcactggcctttctgaacctcattgactgcatctgtgtgatggagtaatagtagcacctacctggcttataatgaaataatacatagaagcttttagaatagggaccatcactgatggctgctctagttgttctagtttcagctgatgaaggcactaggatcctcagcatggaagacacagcagcagggacagggggaaatgctgtgggtccaaggagatagtgcaggtgctcagagggtcatggagagagagaagcagcccaatgattgccgggtgctatgccattcagtgcttcttctaggcatggctttgagcagcaattggccaggcttccagaaacttcagaacaagtggactgtgaactctctgcaaactagatgctgtgatatgcattttcataattcccccaaggatgtggacaggtggaaataaactcccagtcacacaaaaccccaccacccagagagcaatctggttgacatcctggctgagtttattaccataatttttcctacgggtacctgtgtaaatatagaaactgtagacaaaattggaattgtaccactgatatggtttggatttctgtccccatccaaatctcatgtcgaattgtaatccgtagtgttggaagaggggcctggtgggaggtgattggattctaggggtggatttccccttgctgttctcatgatagtgagtgtgttcttatgagatctgggtagcacctcctgcttcattctcttcctccttctccggctatgtcttgtgagatgtacctgcttcccctttgccttccgccgtgattataagtttcctgaggtctctacagtcgtgcttcctgtacagcctgtggaactgtgagtcaactaaaccttttttctttataaattacccagtctcaggtagttctttatagcaatccaagaatggactaatacaaccacttctgctgtatcttgggtttttaaaattcacattattttgtgagtattttctcactgcctgagaattttggggtcaggcatttttctcttcaccgcttagacactcaatttctgtttagaaaatggggagagtaagagtatctctctcctagaagttgtctattttttttttttatttgagatggagtctcactctgttgcccaggctggagtgcagaggcataatatcagctaactgcaatgtccacctctcgggttcaagcaattctcctgcctcagtctcctgagtagctgggactacaggctcacctcaccacatccagctaatttctgtatgtttactagatccagggtttctccatgttggccaggctggtctcaaactcctgacctcaagtgatccacccacctctgcctcccaaagtgctgggattacaaatgtgagccaccgcacccagactattttgttttgacctggggagagttaaatgagttaatatccttagcccagttccataacatccactgtaagcttttctatatgttcctttatttaggaagagtgaacatagtgccaagttttacttagagagcagtgctctgcatgctttggtgctagcacacaataaaattaaacggaggtcaaagcagagagcacttagggattcccaaagcgtccagaacaacagtagatggttataaaggacagcaatagtacaatgacgctgcctccaagacgaagtacagcattaattagtactgggcagtggatggccaggctctttcagggctttactgagagcctctgaagggtggcagtgatgaagagtggggccatgagtgaccatctcaggcccgtcgggaagatacttttcatgtggttgacccatggcagaaggaaggacctgtgtcatccctgagtgtctgagcatgttggggctgtgcttcgggacatggggtttttctccctggtctcgttgggatgctcttcacacctaagcagggtttgcacattcaaacatgggccgtttgtattccagccagcattgctgagaaggccggggagcagcttggtgcatactaaggagcagctcctgccctggctctgtccacaccaggctctctgggcagctgcccatggagaacacaagccagcaacctttgaggagagccaggccagcatttgaccatttgaggctgatggaccctgggtggcagggcctcggctctgcttttgggagaccttgaaggctgatgcatttcctccccagccccactcttactttacctggattgctgctgggactttgagacagtccacgctttcctattgtggaggctgtgccttgcctgggggatggagactgaatctattggtgatgatccagtaaagggtctcagagttcagcagagggtgctgggattcaccccaaatatttgggcagagggagagagacaggctgtgaaacagaatgaaataatgatgtgataggaagccctgcaagcattggcccctttaattctccctaggactctatgaggtaaggactgccccacttaccaggatatgaaacaaaggctcagaaggctcagaaggtggaaataaatctcccgggtttgaccaggagcccagcagcccttccccagagcctgttgacaaacagtgcaggcatgtgcctgtctcagggttatcttccgcctgctttcttctcagcatgcgattgcatcatattgtattgattgctactggaagactgaattcagaggcctcacagatctatatcatgactttacggaaatagaaaaagaaaaggtatttttcatggtggctcagacttacttcttatccccatccttgcaggcagaggcccctaacaaatgtcaaaggatgactgagggggctttggaagccaggagacttggctgtagatctcctctaccacttcttagccatgagaccattggtaactcatcgaaccttcctgaacctcaaatagctgctattgctatttgttacccatgagaccaaggaaatagtcttcatcatgaccaaggaatagtcatgttctagacagtgcacaagctaagaaaggagcagagattagaaggagaaaagaggaaaaaagaacaagcaggacatttttcacctaagagattgacaaaaaaatttaatttaatcaataaattacccagtcttgggtagttctttatggcaatccaagaatgaactaatgcaacaacttatgctgcatcctgtgttttattaactcacattattttgtgagcattttctcattgacaatatcaagtgttggcaaacacatgtggaaacagctcttacaagtctcagatataaattggtatggccatcttgcagacacagtttggcaatatcaagtaaaattggaaaaacaaatgctttgactgtccgtgactatttctaggtaaggaggcttggaccaggatgttcatcacaatatcaacattgtgtgtaattatgaaaaactgggaaaaaatcctaaatgaccattaacaggggactgaatacatcaaatgtggcatattcttacaatgggacacttggcaatagttaaaagtaatgaactaaatttctatgggaggaaaatgaagtggacagtataataccatgtttgtaaacctacccaccccaacaaaataatatcatatatagcatgtcaatgtgaaatgaaaaaaagactggatggagagagaggggcagggagatggagagacaaagacagagacagcaagcaagagaatgtgagagctgtaggtatcagactaaaaagacacataccaaatctctgataattgttccttctgggagtgttgaatgataaaaaaaaaaggatttcacctttatcaggaatgcttcattatatattataatagttatacatataaacacacaccagatgatagcttcaataccctccagttttgtgcatttgatatatgattccttgtgcttttaggttttcttaatgttactcaaagaaattggagaaataatttttaaaacaagagatttatttgaggagcttagagaaggggaaaagtttggatatctaatgatttttattttaaggtcaaggtatgatttgactttgctctgtaaagcaattttcttttctccgggagaatgtttgcagcaaacatttattaattagctaccatgttcatggcccacagaactctccatggtactagttctctaccaggcacacaaataaatcctcagctaagtaagtttatcttggatgactttttctctcagtttgataagaattcagcttgccatcctctggcctagctgagccacaggatgttgaaagaagatcaatgctgcctggtaagtacattcagaaacacaacttcccccagatattccagtgtttctgctgatgcccaaatccctaggtcatgtcagctatgaaaacatcagcaaatgtatggagtattaactggaaaggagtgttgttgcttcttactttttataagcccagaagattccaagaacagggaaaatatctaaaaccaagtcagaaaaggacgtaagtgcagagcccattggtgactgccgttatctgctttgaaaccccaggagttggcgatgttgtttgcaaggagacagctatgcttcctttcttgttttagtcttgggctgagacaaatatgacatttcctagatttggggcccagagctacagaaaacatggccccaaaccaaaaacttcaaattttaagtcattcatccttgaggaatatgctgatacctcatttaccccttgtgactcctaaaccctggacatacctttttatgctattaaaagaaggcttctagttttgtttactccagtctcctagatgttgtcattccccttgaatctcctgagaggctggagattatatttggtctggcaaatggttttctttctaccccctttctccttacatttattgtaaaaatattttaatagacaatacatgtatatggttacaaaattaagcagcatgaaaaggtgcacactgccatcatgaatactcttatcatcatcatcacctttattggatagtgaaaagtctgtggccgggcgcggtggctcacacctgtaatccaagcactttgggaggccgaggtgggtggatcatgaggtcaagagatcgagaccagcctggccaacatggtgaaaccccatctctactaaaaacacaaaaattagctggccatggtggcaggcacctgtaatcccagctactcaggaggctgaggcagaataatcatttgaacctgggaggtggaagttgcagtgagccaagatcgcgccactgcactccagcctggcaacagagcaaaactccgtcaaggaaaagaagatgagagaagagaagggaaaagttaagtttgcatactaaacttgctttctggttgaccagttctccttccctgaggcaaccactgttacaagtttctttttcatgatttcttgtggatttattcgtgttattcacgatatgtgtgtttgtcacatgaatgatggcaatctacacatactgttttgtaccttttcttactttgtaatatttcttggagatcatttcatggagatggatgttggtctttctcagttttttatgtgttgcctgataatctgtggaaaaggttcttctccactgccctgttggttgacactggggttgtttccaaacattcatcgatgaatcagtgctacctcgaataatcttttaaccatgtatgcatctttattttcaggtttgagtttatttgtaacatatgttctgatgactgcaactgcaagaccaaattatatgtgcattttaagtttgtctagatgtaaaacattggcctgcaaagatattatatcaacttataaaaagaaaaattaatggcagcactgtttgtcaatgccctcaccaaactaggtcattgacaattctaaaagatgggtctacaagggtagtgcttaaaaacatcatttttggtttaggttcaagccatgtttacacttgaaatggtatgatatcttacatggtatgagagtgagcaggtgggggcatatctggaaagagatcagtgtgctttggtagttgttgaagtgaagctgagtgatgagtgcatggtagttcacgtttccatgctctgtacttttgtaggtgcttactttttttgttttgtttttttgtttttgttttgagacaggggcttgctccatcatctaggcaggagtgcactggcacaattatggctctttgcagcctcgacctcctgggctcaagggatcctcccgcctcagcctcccaagtagctatgattacaggtgcaccacactatgtctggctaatttttaaaaaaattttttggcgacggggtctcactacattgcccaggctggtctcaaactcctgggctcatgtgatcctcctgcctcagcctcccaaaatgctgtaattacatgtgtgtaccattgcgtccagctctttttcctttttataacaggaatgtccaagccatatatgaaacagatccgacccacataataaaaatatggaccataaatcatcacgagttgttttctccttgtatttagcaaaagctcctcctgtgctcatggcaggctgagtgcctggcccgtgtcttcgtactctgcacagtatccttgtgaggctgagatcagtgtttttatttctgtctcacagatgagaaaacagtggtccagagagattaagtaggtagcagaaccagggaatgcagacttctcacaaagcaatacactgcttctgcctgaccatcactttgcctggctgctgcctctttggctaccatctgtctgccagtctctggggacactagttactctgacagtctagctaccagataggctccagtaagatgggaaagacctggatagaaataaaggcattctatgaacattacaccagcaactctttttaaaaaatagattttattttttagagctgttttaaatttacacaaaaatcttacaaaaagtgagttcccatatacctcctctccccttcccagtttctcctattattaacgtgttgcattgtgtgcacatttgttacaactgatcaacaaatgttgatgaattattaactcaagtccacagtttacatcagggcttacacttgctgtttacattctacgggttttgacaaatgcataatggaatgtattcaccattacagtatcatagaggatagtttcaccgaccccccaatcccctgtcctctgcttctgcagaacccctggcaaccacagatcttttggttgtcactatggttttgtcttttccaagatgtcatatagattgaatcatgcagtatgtggacttctcagactgtattctttgactaagcaagatgcctttaagtttcctccatgtctttcctgtctcgatagctcatttctttttattgttgcttaatagtccattgtcgggatgtaccccaatttgtttatccatttacctgtggaaggacatcttggcttcatcccattttttggcatatggtcatttttcagtattttccaaatggttagatttcatacgtgaatctcattgctcttagaaggtcattcagatgtgctcctgacctggacccaaatggcctggacccactgtcatcacctccctgtctggcctcttctcccactccatcttctttccccactctgcagaccctccagcctccttcctgttcttttgtgcaccatgttggatcctgcaccttcatccttttttcttctttttattcagaagactctcaccccaagtcttctcacatccagatctcagctgaaatgacacatcctctaagatgccctcctgacccccttactgaaagggttgcatgctgccaagcaaatgtccctcacagactgctctgggatttcctttactgcacttttcactctctgaagtggccttgcctgtttagctggccatcatctgtcccccacctctggaatgtcagcttcgcagagggagggaccacatctggcttatccctggctgtatcctagccctagaacagtgcctggggcctcacagaatatttgctggataagtaagtgatggattgattagtctgactactccagtgcttctcaagttgatggctttccatctacacatattgtattcatccgtgaaaagagagaagaaaccaggaaaagcacatctccaatgatgagggttatgtctctggcagcctgtattttggacctgggtgggatcatagtgtgtgttcttgtagcttttgcctgagtttcgtctacatggccctacttatggagtctaagatggagctgacagtgatgtatcattctaaacaagcgtgttgttgcaagaatccatttcaaagagatcctcttttaaatgctacttctctcccttcctcttcatctattctagcctttgaaaggtgtttatgttgattctgccattctccattcctgaggcacagataagcatcataaatatgttagttttgaacaggtcctgaaatttgccgacataattcccattttcttgtcagtacttccaagcatgaatagccttttttttcggtatggtgaattatctacagttagggatggtttaaaggtatttttatgaggacgtttagtcattgggatcacttgttcctgagtcatgcatttattttaagtctaagtcttttgaaaggtcatttagatttttcaaaaatagtagtcgtatcgttgtctcatattctttctccttgcccattttttgcttttaacaaaggaaattattttcaaggaaagcatcttcagataatgcacaaccagcccaggggaaacctagctttatagacacactagtgagatcgttgtgtaatttgatgggggaaggtttgtaaggtttgtgttctgtgtagaaaatggtgagattttaaaccaaagtttcattccagttatgaaaataagacatgtgcatgataaatattttcagatcagtgaaagaaataaaataatttttacccatagttcttctagatatcattaatattttggtgtatttccttggggtgtgtgtgtgtgagtgtgtgtgtgtgtaatttcatcagactggaaactctgagcagtcagagttcttgtctgtcgtcctcattgctctatagagagtactcctgagaagacactcagtgccaatttactgactgaatgaaagttaagtgtgtgtgtgtcacatatttcaaaacaaagtctagatagttctctatatttgattttgtgtccctccagcaatttctcatttttaaatttttctttgaaaacatgatttctaaatagtgggctgttatttcatgggatgaaaagttgtgttggaaagccccttcacactggaatctttgaaaccatcttcattcatttctttacaaaaaatctttagcagtgaaattcttgggttaaagggcctgaacactttaaagactttcatacatttttgctaagtaaccctccagagagaagggaacaagtggccttcccatcggcaaggaataaaatgacccatctttttatgttcccattaagagtggctttaagggttctcttgtaatgatgcatttttgttgtctacattagacttgttgtccctagtttcttagtagcattctgattttgctatggtatgttttcatgttcagaagtttgaaaaattgttaggtcaaatttagtatttttttctttaagacttcattaattgctcctatacttaagaaggtctccatcaccaagagaaagcaacctgctttctctcctggattattttcttctggctttcttgtaggttccttttctttccacttcagctcatgggaaatgcatttgaatgtgaggtgtagcttcctgatcattctgggtagcccagtcactcagcactctcctgagaatagtcttttttttttttttttttttttgccactgattggaaatgcacgtcttatagtattcccattttttacattatactaaattctctttctggactttttattttatttgtctggatctgccatgtcttcatgttaactgttttgataactacagctttattatatattctaatatccagccaaacacctcctttattatatttttttcaattttgagagccattctattatgtgtatgctacaagaagaatattatgagttatatcagatcagattataaaatacaatgagaattacataaaagttatacaatcattttggagaactgatatttttaccaaattgagtaatcccattcaaaagcctagtatgtctgtcctagtatttaagactttctcttttttttttttttttgagacagggtctcactctgtcgcccagactggagtgcagtggtgccatctgggctcactgcaacctccacctcctgggttcaagcaattctcctgcctcagccatccaagtagctgggattacaggtgtgcaccaccatacccagctaatttttgtatttttggtagacacgaggttttgccatgttgcccaggctggtctccaactcctgaacaaaaagtgatccgcccgcctcagcctcccaaagtgctggaattacaggcatgagccaccactcctggccagtatttgagaattttaaagtcaatataattctaagtttaaacgttatggtttcttcccagggagcacaacaatttattacgagttttatttctatgtgtttaatgttttgcattggttattgcagatgagatttttgttttcctgttaaactatctggtgattttgctaacactagaaaaaaatactaatttggattcattcattttgtaaccttaaaagagtgattcatcttactctcttagtatttatcttattacttattatttaatatttatgttaaataccctcttagtatttaaataaaatagttttcaagttggttctcttcagttctctgagtgtagattggttcatcagctgctcaaagggtgaacaatgaaaggggtgcttcctgtgaaatgttcccatggggctcatagtgcacctgagccgagacactcctggttcaagggcagttctgctgccctctgtctgtggagaaggcttgtctgttgaacctctcactgccatttcccttcctgcaggctgtgagcccaagaatgaagggctgctggatcactggtctttctgttttgctgtgagaggaattggtggtggccccctcatgcttggcctttgagcctgaggagggacgaggatctaccctgggtgtccagttactctttgagccaagtggtggatgaagactttgggggtgtggttgactcagaggccagagctgaagtgagcagaaagagcccacaccaccttccaaagcaccaattccaagtcagcaggtgaccttccagaagaattgtgcaataggctttaacttttattgtgcaaacaagtttctcacataattaactcaatggcctccagatgaaaacagtgacattaagaccccactggcttcctctgaattccctgacgaactcaaacttttcccatactggcctgtagtatctggatttctgcaaaagacaatagggttgattttggagtttcagactgtggaactctgtcctagttaatgagaagagtctgataaggccacccagagggcaagtgaggtctaggacgctgcataaacaaattaggaaatgacagagaggcaccaaaactgcagcacgtttcagctgtgtgttcctttctgtgtctctctgattcaatgtggccagtgttttctggagacttttgcaaaggtgggaatggggacacatggcactgtgaccccatctaggtggttgggcctggaggctactcatcaacccaccacccagagaacagaccatgcattcccagctcccaggagccagtgctgctcccggttcctgcctggatcacattagtgttcatggttgttaagcttgttcctataaagagagccctctccccaagagctggtaattggggaaagaagggctttttttctgctttgcttgttccaatcttgtgtttttgcttagaatatgaacacacatggtcacacacatacatgaaaagccagaacaaccagaggaccttctgtttgagcacccagactagacgcacagcagggaaaccatgcccagcctggttccctggggtctgggctcttggttctttcctttgcgattgaggaggaggcaacctgctttctctcctggatttaaaacaccctctacctctcaagtcctcacatcatctgtggaccttatcctcagtgcttctctagaaatgtcttattgttttctaactaaagagaatatgaaatttatttgcataaagaatcttttagtaatgagtacaggaaaaaaaatagtccgacttgagctggtgtaaatgaagagaggcattgattggttcaccgagctgaaaagctaagggcatcaggcaggtggctgcattcagtgatgtggaccacgccagcagggctctgctgtcttgtgcctggctctgtgtccatctgatttggcttcatcccccatcaggttctccccataagggaggaaatgactgtgtagagcccctgactcatattctcatagcttagcaatccttacttagtgatacggtttggaagtttgtccgctctaaatctcctgttgatttgtgatccccagtgttaaaggtggggcctagtggcttggggccctccccatggtgatgagttcctgacagctggtagctaaagagtctggggcctcccttcttctttctctctcttgctcccactctttttttttttttttttttttgaggcggagtctctctctgtctcccaggttggagtgcagtggcagtggcataatctcagctcactgcaacctctgcctcctgggttcaagtgattctcctgcttcagcctcccgagtggctgggactagggggcatgccaccaagcctggctaattttgtatttttagtagagacagggtttcactatgttgcccaggctggtcttgaactcctgagcaaaaaacgatcctcccacctcagcctcccaaagtgctgggattacaggcgtgagcccccttgcccagctcttgctccgactcttgccatcgaacgtgcctgctaccccttcaccttccaccatgagtggaacttcctgaggccctcaccagaagcagacatcagtgccgtatttcttgtacagtctgcagaaccatgagccaaataaacctcttttctttataaattacccattctcaagtgttcctttttaacaatgtgaaatggactaacctgggaaaacacatattttaaattttcctaacagttccagaaaaagtcctggaatggattctcattggcccagcctggtcacatgtccatcccctgaaccagtcatggtggccagtgaaatgtgatgctctgatttgattggccaggcctacctctgtctgtacagctgggtcactggggtgacagatgggagcatcagctccatccaagccaatggactgctgatggggacagggggagttcatcaggataagctgggcacgtgctactgtagtgatctgaacttttgaggggctcacaaccatggtgcctgtgtctctctaattcggcatgttgatcatgggatagcaaagggacgctgcttatggaagttctctgggcaccagctggaccgaggcaccacatccacatatcctccacaatcacagaggcaggaagggggaacatggagaaccgtgccctggctgggaaagcatccgcccagaaggggcagatgccacttgcactcctattcagttggccagaataagtcccatgtgcaggcctgggttctacaggtggggatgtgtaattccctcccgctgagaggcacagagcatttgtgagtcataatagagtctgctttcggttgccctgctggtccccagatatttaggtcctgcttcatgggagacagccccaaagtcccactcagtcactactcacagctcattgtctaggatctttgggtgatgaatcattatctttacatcgtgtttggacatggctcttctttattcagagacttatgacaagtgatctgcccccaccatcaaacacctaagatttaatcttgaaacagggataggataactgcagtaaacgttcagaaaagggacgatgaactgtcaaatgatcgctaccctgaagttctcccatgcaaatacagtgacattcccttctctgggggaaagagagttccttcattgagctggtttggctccatgggactaccttccagtcttcattggccttcttcattggctttagcgccacctttctgaagtcttccctttttggttatccttgctggcggaatcaaaagaagatattggaagacatgctcttcatagagtatgagcaggtgtctcagcctagaaaaatggagacccagggattattttctacaacgttcagtctcttttattcaatctggtgatggcttggacaataaaaatctctcaaaacttttttggtcccagttggcttcatctgccaaaacacacctacagtttttctgagatgtaccttttccatagatctaagaccctgatcttgtcaggctcccataaaagagctataaccatggtccctttgccaatgaattttgtcctagtttgctaacaccacataaatccatttgggatttttaaccacaggtgtgacagcagaccaattctaaaccaccctttgccagttaaaacctttttggctttcttttgttgcttttctcattggttctaagaagccagggttttttttccaatcttacaaaactttgaagttctagattctcttttatttttgccagaccctgttatctgcatagacactttcccagaagtactggttatattattgaataaagagagtagtttgttaccttcatcttaggaagggcaatttggtgacttcaaatgtgagagttagcacctacttgggagtaggaattgtccttagtatgttttaggaagaaattagatttttcatgccttgagcctcccctttgtccaggatgcatgaaggacctgatgggaattctgggtggtgttgggggagatggtgcaggtggaacactagtttcctgaggttgactcagcactttccattctgctgagtcagagtctcggtgccttccttgattaggtaaagccatcccttggcatctctgaagtgcagcttataggctacttgtagtgatatgggacatggtcttttatggggtcatgtgtattttgtcatctggtccttttgcagaacctgttgtgttctgacattcctgagttggcagaggaaaaaatcaggtctcagggaacatgttggtaagtggcaaagtcagggttgttgctcaggtcttcctggcttgaggtcttttcttctttctatttttgcagattggtttctggaaagatttatttaaatcctctctagttcacccctattcttgaatcaaaaggcttatcttaacaagcacaaaaagccccatttattcaggtattataaacaagaatggaaaagatagatgtggcctcatttactcatcccattctcctgctttttatcccacaccaggagtctaccaggctctaagcagacctcaggaaggatggggctgtcagatgtgagatgttagtggtcctcattggactgtgactgggtcctggtttttgaagcttgttttgtttcttgggaggcagcaataaggtcaagctggggctcaaagcatcatcgtaaccagcaaaatggggaccacagcagcgagttcactggctaggccctttaaaaggcaggcacacactttcaaatttcccactatttttaaccagcttgcttgcttgcttttaaattcatgtgtggttcctggaggcacttgacctctttctacagagccttcccctctgctattttaatgaacagctgcatcaatgactccctaaattccaactgcatcttcttcatcctcattaacctttaccttggcattcaagcctcttccaggcctcctcctcctttttcttcctcacctctcttaccatggctttccctcacccacttcttgatgttcctgcatcataccttcctttatgggaatgttctttgccacctgtcaggatcctacccacccctcaaggtctggttcaaatgctacaccttcagaaagattttgggggaaaaataaagtcttttttctttttgagtctaaaagtattgcacactcattatagaatatttataaataaaattaaagtcattcccagtcatatcaaccagttaatccctacaaatatttgcatattttcattcatctttcatgtatacatatatacagaaaatatttataatactgatgccatattgtatatataattacatatcccaattttaaatatagcatgtgtcttgaaaattttttggtatcattaaatgtttttcaaatacataattttcactggatacttgaaattctgttctacctctcttctacaattatgtaaacattcctcttactgtttggttgtttacattgttgtgcgtaaggctttgtctctatctctgattatgtatgtagaaatataagtatttttgaacagcgtaaacttttttaagctcttgacacacattgccaaacgttttctcagaaaggtggtatttgttttcactcccatatgtactgtaagctcatctttccaaatcttttccaatctgatgagttgatttttaagaaatcaactaccagtttggcaaaaatggaaactcattacagattcccctcaacttacagtagggttttgtcctgataaactcatcttaagttgacaatatcatgtcaaaaatgcatttaatatacctaatctactgaacatcatagcctcgcctgtcataaatgtgctcaaaacacttatgttagcctacatttaggcaaaaatcatctaccacagcctattttataataaaatatcaaatatctcatataatttatcaaatactgtttaccccgtcaaaattgcaatggtttcacgccattgtaaagttgaaaagtgttatgtagaaccatcgtaagtcagggatagtctgtatttaatttgtttcttttggggtaacttgtagagtttaattttcttttttaagttgtttactgctatattttttcttctgaaaacgattgaaaacatttgtactcttttcaatggggttaagagaagaggaagattttgtgcttcttgttcattttaaagaggtctttatatattaaggacttttttttcattgattgtgaatatattccagagttcattattttacttttttatatgaattttgaatgaaaagttttaaaaattcttatgtaatttggactagccattcttttgttcttgattggttctatttcttttaagcttaaaaattttatcttaaccctgaatcagtttttttccctagattttctacaactgtacttttcaaattaaactgaaatctatcttagtgggggtatgaaagatttccagtgtgacttttccccaaatatctgattatgattctgctatgcgttgcattgttgagaaatgcttttcccattggcttatggtgcttttgttcatcttgacctaacctatcccatatttcatgtagatgcaccccatgatctgagtaatgacacttccactgtggccatgcagttttgattattatagctttgagatgcatttccaggtctgttagatactcttccttgtcatttttttatactgtggtcccctcccagccataactttgcacactctcgagagttccagtgactgttgcaaatgcctttaactcttcagctcactgtgaacttcttgaggacgggactcaatttgtcctaatcaactacacatcctctgtatcatagcccatcatagcattggccagatagaattcactgaaaacacatttgttatgttgattgtgcaatttctttctggtcattttctgggtgacttgtatttttagaaaacctacaatcaggtgtattatttgattaaatttaggaaagaaatatatgctgtatttaattggcttgtgtttctcagcttcaacccaagttaattcaactttcagtgttgtttgtaattaccagacatttagtacattaatgaagacttctttccagtagcccatttatatttactcttgaaaaatgatttacttttgatttcaaaccaaaaacattatcattctaatttctggattctctcatttctattttcaacccaaaacattccgttgagatatgaaataatattggatcagcctggaaggagaccttgggtgaacaaagcgagtttgcctcatttctcacaacacggtctagggtctgagttctcattttgaatcagggtggaggtgggaaaacagctctcctgggtgcctgttgaatgtgtgcctttttgggcatctgtttacattcatgagggtccacagaggcccagagaaattccaactacttgagtttttttttctatctacattttaacacttaagtcgattcctggacatatctggtacttcttgtgttttctactaggcataggacattactttgcacagagcaggtgttcaatagacacgtttcttttaatgtaaaaaaatttattgaatatgaccctcacataacaaagcagcccagtagtccccttgtgtacccccacccaggtattcccagagagaaccactgtcttaatttacatcgtcttgattagttttacttgtttttgagtcttacataattggaactgaacaatatgtaatgttttgtatctgtcttcttttgttcaacattacatttctaagattggtccatgttaccgggtttgataatatttcatcattttctttgctgtatagtattccaatgtgtgaatatattctcaatttatccaatctactgttaataacatttgtgttatttctagtatttggctgttatgagtgatacctctggtaaccttcttgagctcgtttttgtcttttgctttttttttttctccttttttggtaaagaattgctgggtcatatggcttgcatatgtttggcattagtagatactgtgaaacagtattccaaaatgtttgaaccacggtcaactcccacagcagcatggaagttctagttgctctttaatctcccccacccacccttgatactgtcagctttttctaaacaattttagacatcatgatacttgtatggaaatattgcattgtggtttaattggtatttccttgaaaacgaatgaggttgagctcctttttattttttcatggctatttgtatgtcttctttatgaagtacctgttgagttttttgaaagttttaaaaattgaattctaggaatttaaaaaatatatattctggatatgagtctttggttgaagttcctcaatgtgctttgcctttacattcacttaattatatattttcaggaaaagaaatatttaattttaatgtaggtccatttagcaatcttttttcctttttgtatcttatgtaaggagtatttgcctacccacaaaccataaagcttttctcctgttttcttctagaagtgttatttgttttgctctgaaatttggaatcagaattaattttatgtatggtatgagggagggatcaggaatcaattttcccatatggatatcccattgatcctccaccatttggtgaaaggaccattcttttcctactgcacagctgtgttcttttctcataaatcagtcagtacactgcgtgggtctatttctgggctccatgttctgttccattggcctgtctgaacttgttccaatagcacatcatcataattgttggagatttaaaatcagtcatgatatctgatagtggaaatcctaccactttgttttttttcttcaagatcatcttagtcattcttggttctagacatttctatataaaaatttgaattaatttacacacatacacataaaccttttgtaagttggattggaattacattgaacttgtgggtcaatttaggaacaaataaaatctttaaaacattcagtaatttggtctgtgaacatggtatatcccaccttgtatttaggctatttttcttttttctcaataatgtattctatgtataggtcttatgcacatctttggctagatttattctggagtattttatgctgctttaatgacatttaagttatctcgtttaaatataattttctaattctttggttctggcatatagaaatacaatttatttttgtatatggacttcctatgtaagaaacttgctaaattattctaattaagattattttggattttctaaaaacatttctctggagaaaaaaaggaaagcttcattttttcctttccgatccttaaacattttattccttgttgttctggttaaaacctctaatacaattttaaataaagaccttcttgtctcattcccaatctcggagggaaagatttgaatatttcatccttaagtatgggtttgcaatagattttttgtatatattcctcatgaaattaaagaaatttccttttattcctaatctgctggcagtttctaatcataagtgtgttaggagttttatcaaatgctatctctgtatttgtggaagtgatcctataacttttctaatttattctgttaatgtggtgatttccactgattatttttaaatgtcaagctaatcttgcatttctagattaaacctaacttgttttccatgttttgtctttctgcatttctctgcctctggtttactaatgttttctttaggatttctgtatctatggtcacgaaagataggcctgtcattttcatttctagtgatgcccttttctggctttggtatgaaggttatgctggcctcttaaaattgattccctcatgttttttattctctctgacacttgtgtaagactggtattatttcttccttgagagcttggaggaatttactgtggggcccatacatccttcatcagatactcaaatgtttagaagaggtgacatcctttacgtgaggttccaagttaagaaaaaaaatgttaaaggtagaagcagaggtgcctgtccatattttctcctagtgggaatgattcatttgtatatttatttattcagcaaaaaatatcctaaatgtttgtagcacaccagacactgcagcagttaaggatacagcagaagtgaaacacacatgcctgccttctaggagttcacattctggaccaaggagtgttttctattccagtttgagagtgtgtgtccatgcacctggctgtgagctctgggtccctgtgtgctggccctgcccctcctctggctcatggtgctcactccactccagggctccaccccatgttttcagtctccacccagacattgcttcgggaccttcagcaatgaggttccctgcccctgctttgctcttcccttcaccctttgtgtgtgtgtgtgtgtgtgtgtgtgtgtgtgtgtgtgtgtgtgtgtgtgtgtgtgttgtgacagagtctcgttctgttgcccaggctggagtgcagtggtgcgatctcgatctcagctcactgcaacctctgcctcccaggttcaagcgattcttgtgcctcagcctcccaagaagctggaattataggtgtgtgccaccatacctgtctaattttcatatttttactagagacggggtttcaccatgttgcccaggctggtcttgaactcccaacctcagatgattcacacacctcagccacccagattacaggcatgatccactgcacccggccctcttcactcttcaactgagagtcctgctcattattaatgtcactttttttagagaggactttcttggtccctgggctaaaggagattctccagtcccctaagctcagagcccccatgctcttctctcctagcatttacatgttcataattcacacatttatctgtatgattatttttgttttaatgtcatttgttgtcaccaaattgcgggcttcatgatgaaaacagttgcacctcttctactcaccaatgatactcttgtgcccaatgcaaaaccaggcacacagtaggtgctcaataaatgcgccttgctctccttcctttctaaagggttccagaaggccattaataggcaaaaaacgcaagcgtgggtgaaggctgaatctatcatgctccctgatgggtccccatgcccagcactgggtgctctcttagtgttagtaaaatacatgaatgaatgaatgagtgaattaatggatggatgaagtgcaattgaaatttattatgctcataaacacaaaaattaaatagatttactgcattaagattattttaagaagttgttttattcctacattcattttgtttccaacacaaacagtacataaaaataattatttcttggattcatgaaaaattgaaagggcccttgagtgtttatttagtgtattctttttggcagaattaatgatcttaataatgaaaacagcactgggtgacttttttaaattgaagtttttattgagataattgtaaatgtgcatgcagctatgacaaatggcagggagatatcttgtgtaccctttcctcaattttcccccagtgctaaactagaatatacacacctaattgggatactgacacggatgaaatccactgaacttatcccactgtctaacttaattcacatttgcagcactgtgctgagtgctttatctcatttaactgtgacaacagccctgtaagggggatagcattatcactcaggttctagagcctgggacacccgtgctcagagaggtggagcaactcgctcacagcctggtgcatgctcaggggtggagctggaatccccactggaaacccaccccccagcccgtgttcttcctggtgctggcgtaaaccatgatatatagatctgttccttgttagagatctctaaagaagaaaactacttgcttaacaaaaatgactttgctatataaaggtgtggtttttttgactattcctccagaatggcattttttagaagtctgaagtctaagaaaacctctgcaaaaattcaaggcacttaaatctttgatgaagcactcaaatgtattcatttatcatccagtctttcagtttcattgtagacagatttatgtcctttgtgatggtagctccatgtcctggaatggacctcccatccaggttcacagatacagctaagaggctggaaaaggtcgcaagtggaaggaagcttgggtttgtagtttcctcacatattcttagaagctaggggctggggaaacccagaagttaggtggtcaagggcaaaaagattctcccttttctgtctttcttccccaaaccttgtcacatggaagatttgaaatggctcccccaggcctgagtcctgggcagctgtgtcactgttggtgcccacctcccaggctgcttgctctgccctgcttggagaatgacaacttcttaagttgccacacagtacccagagccaccagttcctctcctggttgctgtgtggctgagactgaccctggatcatgaggcatcctgctgcccagcccatcatttccatctggtcctgttggggaggaagaaaatgcagaggcaaatgcagatgcagtatctgtggctgggctccagcaagacccctccaaggtctctgaccccagggccagtggtttcacccacctggaccatctacaagggtcaaatccagtgtgtgcagtgcctggaattagaggaaagagacatgcaggtacagcatcgtgaaaggccccttttgatgctatagaaaaaaaaaaaacctccaaaataattttaatcatgttcctatctttgtttatatttcattatggaatgagatctggttttgacttatattaaggtgacctgtttgaaattgccaattttgtgggtcgatgacagctgaatattggcagttttaaatggttcaatctaatgcgagttaaattaaaaccttgaggaatatgcaacttttcactttacacggctctgttttaaaaagggtgtcaacatatttcagccttgcggagatggcggcgtatgtctatcctgtgttgcaagcagctgtgaatggttgcgtcgttttgcttggcctacgcatgggcgtgttgtcaccagaaagcgtctctgctcctccaagtggtggcaagcccctcctgagagccattcctcatccagacaagaatccatcagatcttatgaaaatttaatgtgtgaaagtgtacagttgcatgagggtttttttcttttaaataaattagtttgcagcccttgctaacaccagatgaatgaattaagaatgcacctcccccggggctgtcgggctgctaaactgcatgctggggcgaaattccctttctcttattcttagctttttctttttttttgaaacagaatctcactctgtccaccagactggagtgcagtggtgcgatctcagctcactataacttccacctcccgggttcaagcaattctctgcctcagcctcccgagtagctgggattacaggcgcctgccaccacacccggctaatttttgtatttttagtagagacagggttttaccatcttggccaggctggtcttgaactcctgaccttgtgatccacccacctcggcctcccaaagtgttgggattataggcatgagccaccgctcccggtctcttagcttattcttaaggggaatttcctaccttttatttttcttcttgagagagtttcaaatttgccagaacctgaagggttgttgtgctttcagccaaaaggatgtctcagtagcctttagcccaccttcccccagggcaatggtagcatggaacatgcaacccctagcttacttgaaagattggacttgaaaaaaatcagcagttccttctggaatctgcaaggattggggaatttgaaagattcaggggaattagttcggcttcccaaactagttggttttagtgaccccttcttcttcccgttgcatcactggtgtgactgatgttaacattattgttgccccgttttacaaatgatgaccctggaaaggcttggagggccctggggctgcctaaggtcataggccaggaagaaatggagcctgtccgagggcttgcgtctcctcattctgaagcccaggctttctccatgttttcaaaatgccagctggttgcattttgtttttccaaatgatattgtagatgccagaaagtggggcctgtgtttccatttcttggttttcctgcccttccagctctctcataggaggcatatgatgagcacagggaacaggcatctgtgctgggcagacctaaaacgaggaaggggcaccgtgaccagttaccttgcggtgtggcacagtgctatcttgaagaccataacatctctcgagcaggctagcatatctggtccgaaaagtcgccatttctttgggtgggcttgtacaaagtggtccacatctcacagggtggtctgctgggctctgcaggcccgtgttgtgtccataatacatgatcaataaacacaaaagctgcccatcaatgaatccaggtgttcacccggatgggcgtgggaaactcagacaggcagaggccacgggctcttctgtctctcaattcctgtcccctttgcatactgggggggcacttgctgggggtagtccagtaattttatctcatggtgctccaccagagaccatggtgctgatggcacctactaagcgcaacgctgtgcttgactctaccctctgagtgtgcccactcagggctggtctccctcatgcagcccgaggcctcctgccaaagtccacttcaaggggaagccgaaggtgcacacaatcccctacgtctcctttgatccaagtacatcagctcttccaaattgtgtttgccgtgcattttttttccagaatcctcttaagaaggatttaagaatcttgccaaagtggccacttctcctaaaaacatctaacccagtcctcgcagattccagaaggaactgctgattttttaatttatcttcagtcatttgctttcggaagggaacatttattgtgttgaaaattaaagacttgataaaaaatgtttgctttttgtggtgtccttgaaaatcgagtgattttcacccaggatttctgtagtgggtgtcaggcaccgtggatttctgtactgggtgtcagggaccgtggtacaccacggtgcttagaaaaatggatgatggaggtggtgctgtggctggctagcatttattaacattgttattgccaggcaccatgtcaaccctttcctatgcattagctcatttaattcttacagccactatttgtggcaggtactagtattatccccattgcacatgacaggaaacggaagctcagagaggttatgtaacttgcccaagtttgaacagttaataagagcttgcattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctgggtgagacatgatgatggggcgatggtgggggatgtggcagcacaaagcaactttgtccactgatgtcgggaacgccttttgaaggaagaaaagtgtaagttgttacccagagtagaagatggccaggccaggagttgggaagggggttctagaaggcaaagtgcgtgtaaagttcttgaaactagagatacctaaggaatctagatgaggccagtctggttggagcaaagggtgatgagtcgggaggctggagagtgacaaggaccagattgcgtggggaggatactgctgcctgggggcttcccatcctgagggcggaggaacttgaacacagtagttatttgctatcaactgaaatgtattgagcccctgctgctctgtgggcatacaatggttggacaaacagacaaagtccccgttctcaaggaacttgtattccaacagaaaagaaaagaaatacacaagacgacgtcaaagagtgacaagtggcccaaagaaagtaaaacaagggcccagtcagggtgactcacgcctgtaatcccagcactttgggaggccgatgcaggcagatcacaaggtcaggagatcgagaccatcctggctaacacagtgaaaccccatatctactaaaaaatacagaaaaattagccgggtgtggtggcgggcacctgtggtcccagctactcgggaggctgaggcaggagaatggtgtgaacctgggaggcggagcttgcagtgagccaagaacatgccactgcactccagcctgggcagcagagtgagactctgtctcaaaaaaaaaagtaaaacaaggtggcacctcagattgaactgaggaaggtacaggaagccactacagtgggtgggcagggtgggcacctctgtgcagtgggcattcaggggtgaggagtcagcactgtggcagtgttgggagaaggtattcctggcagagagggtggctgattggaaggccctgaggcagcaacaaacagggcacgatcagggacttccctgtgcagtcagcgtggctggaatggagggagcatgatggagaaggcaccaagtgaggccagaggctcctcagggggtttggattggatccttaatggaggggtgggaggatgccctggagggtttcagcacaggacggcaaggcctgctgtgcattgctggggatctctttgcttccataaggtcagtggaccgggaagtggccagaatggcagctgggatgggcaggggatgagggggacactcttgccatcatgcatgccacacatgatggggagtgggcttgaggggcagccatggcggaagaggagccctcaggggtttgggagaggttagcaaatactcatgcttgttttgggaggagcctctgctcacggtgggggcatgggggtggtggtgagcaccgcagcttgtaagaggcaagcttgtgtggctgctgggtcccacgtgctatcagatggactcctatatggtgtgctgggaaagacgccctgtggctctcaaccagctcagcctatggccctgagagaggatgtgggcaggccctgaccatcttggttttcttccctttttttcttttttatttatttctctttttctttctttctttctctttctttctttctttctttctttctttctttctttctttctttctttctttctttcttcagctttattgaactataattcacatattatacaattcacccttatacagttcacagttctgtggtttttgctacactcacgggtttgtgcaactgcaccacagtctaattttaaaacactttcatcatcccaagaggaaaccccatgtccattaagtgctccctccccacttcccctttccctacccctggcaaccgtgaatctactttctgtctctctggacacttcatacaaataggatcgtacagtgtggggtgtgctgtggcagggttgtttcacctaacaccgtgttttcaagttcacctgcattgcggcattgccagtttagggctgatagtattccatgatacatagaccatactctctttatccattcatccgttgatgggcatttgggtttctttcccactttgtgtctattatgagtagagctgctgtgcatattcacgtgcacatttttgtgtggacacctgttttcagttctacgggatctactcaggagtcagatggttatatggtgacccagtcttcggggcaagctcaggagcagaatcatcgtacggtgactcggtcattggggtctactgaggagtcgaatggtcatatggcgactcggtctttgggcaatggtaaggagtgagaatggtcatatggtgactcggtctctggggtgtggtcaggagtagaatgttcatggtgactcggtcctcaaggtctgctcaggagtagaatggttacatggcgactaggtctttgtggtctgctcaggagtagaatcactgtatggtgactcgatgttgaattatttgaggagttgccagactccttccatgttggctgcctggtctgcatcctccccactgtgtgtgaaggctctgatttctcacctccttgcccacaccttttattgagcctgaacacctttcacatggtcacacctgacctgagcagctgcccggccatagtgccaacacatccctggccacgagaggtggcgcctgggctggccaacgtgcaccctcagggtcgggatgtgatctagagcagggcttctctcattctgttcctgcccatgttcatttcaacccccaaaaggacttgagctctcaggcttaatttcatttacttaatgcatgaaggaggaaatgatttctgaggccaagaccggagtggtccccagggactccatttcaacagtgtatttaaaccaccacgtggaggttgcttgctaggctgggaactgtgatcaaagaacttccaatattttatgttcataaaggcagtttgagagtaatgttttttaaaaaggcatctgaatggggaggaataggatcattgtgaggtccacagtctctttgcctttgaagtttgcaagaagctactgaatgagttccatgctttgtaatactctggtctgggcaccctcaggcgtgcgtggccggcagggacctgtaggaatcctcttcacctggggagatttgaagcctagtgcatataaccagggccgtcacccaatgctgtgtgatcctgggccagtcagttagccttttgcagttagctgatcgttttcacctcagcttgaggcatctctttcaggaagtttctccagttccagtacacgctctcaagcgactctccccctctcctcaaaatgcttacctgcattttcatgatgcagctatgatgtgcaacattcactaattgatgtctgtgaaccctggtggctgtgtgccaggtaggtatgtgctcaggtgtgctgtgtgctcagtgaggctgtgaacccacgtgggtgtgagcccaggtaagctgtgtgctcaggaagctgtgagcctaggtgtgctctgtgcttagtgaggctgtgagcccaggtgggtttgagctcaggtatgttgagaggagggtggatgtgagcccaggtgtgctgtgtgctcagtgaggctgtgaacccaggtgtgctgtgtgctcagtaaggctgtgagcccaggtggatgtgagttcagtgaggctatgcactcaggtggctgcaagcccaggtgtgctgcgtgctcagtaaggctgtgaacccaggtgtgctgtgtgctcagtgaggttgtgagcccaggtgtcctgtgtgctcagtgaggttgtgagcccaggtgtcctgtgtgctcaggcagctgtgagtccaggtggatgtgagttcagtgaggctatgagctcaggtgggtgtgagcccaggtgtgccgtgagctcagtgagtccaggtgggctgtgtgcccaccgaggctgtgagcccagatcggtatgagcttaggtgggtgtgagctcaggtgggctgtgtgccttattgaggctgtgaacccaggtgggctgtgagctcagtgaggacagacaccacacctggttttgctcatgggtatcaccccagtacctggcccagagcagatgattgtcttgatttgggttttggggaggtgaccctggaatgaggatttgagagcaagtaatttataagaaagctgtcccaggagaagctggcaccagtgctgggaaagtggcacagggaggccaaggaggggtagtatcaggcacagctgtgcaggggcagttgcagcctgaccctgagggtactctgagcatgagtgtgtcagagtttgtctctgctgaggccaggggctaggctacattcttgccaccaccagtcattggctctcggctctgtgcaggaggacagagaggctgagaggctgggagttggcctgtaggggtgcccttaggggcaaaagcacatgggagctgggaggctccacagccttggactggaggggtgggcagagcactgacagtatccgcttggggtcaggccatgtggatccagtgttctactccgatcctctccgacaggccttccagaacagggtgtaccatgtgctccagcacgagggagacgtgcttctgatgtcagctatagcagtgcctccagggtcgatggcacgagcccagttgacaatccccacagccagatgctttgaaatatgtgatccttgataaatttttaatttagggtaattttaagtttgcatattgcatgagactttactgctctttgaaatctgcataaatcacagtcatgctgcatgtttgggttgtcacttggcatactggccagctttttgttggccccccaatcctacttctgctaagggctggcctggtgtgtgtgaccagaatgccaggcccagaagccaccagcactaagtcaatgggaagtgctttgctcagtgcagagctgctgctgctggaatcactgcaccacttattccccatgacactgggcctcctcgccaccaggtcaagccagactcaagacgcaggcaaacggaaaaatgcagaactgtttgctccttctccctccctggaaacccctgctcttataggttggctttgttggtccagccccagcttcttgacttggtagggagttccacaggatgaggacatgctttttgtgtttttctttgcactaaactatgtgtaacatcaaatttaccatttcaacccttttaaagggtacgattcatgtgtgccaatcatgctagatataatttgcattttcctgaatattaattagggggaacatcttttttatatgctgttgacggtttggatacctccttttggaaggtgttcccggactttgcatattttccacagggttatttgactttgttcatttgtgggagttcttttgatattctagaaactggactatgtccagttaaatatgttacaaacatcttttcctgcactgtgttttgtcttttcattttacagtgtttttgattaaattcttaatttaaataaccaaagagtacagttcagtgctctgtgcagtgagtgcagtcacattgttgcaaaaccatcactgctgtctaattccagaacctttcatcacctacaaggaaattgtgtgatactcctcattctcccctcctccaagcccctgataactacgcatctactttctgtctgtatgaattggtctgtgctgaacatttcatgtaaatggaatcatacgctgtacggacgctatatggacttttgtggccggctgtccccatgcagcatcatgttatcagggtccctccacactgtagcaggtgtccaggcctcattcccttttatggctggggaatgttccatggtctggatagactatacttgatgtgtccatttgtccgctgatggacatttgggctgtttttgctttaggtcatactttctgcctgatgtaaaagtgccagtcgtgtataaggactgtagtcagcgccaccatgccacagcttagagaagggatgggggaactactgggttgtcagaggcgccgttcttgaccctcagagactttctgtctcctggaggagaagtggctgtgttgggcaggtttgaatcttgagaattcacggtccctgggtttgaggcctcgctgtgccacttgatgccatgtgaccttgggcaagtcacctctccctctgagcctcacttttctcacctgttaaatgaggtacttataaagccgaatagcctaattcaaacattttaagtctgaaatgctctgaaattcgaaacttttttagtgttgacatgatgctcaaagaaaatattcatcagaacattttggatttcaaagttttggatgctcaactggtaatgcaaatattccaaaatcagaagaaatctgaaatccgaaacacttctggtcccaagtgtttcggatcaagaatactgcacctgtaacacctgcctccttagtggtgtgatgattgcgtggaatgagacatgaaaagggctcagcccaaaatcgtctggcaccaaatacccaatggataggggattttgtttattttgttgttactgttgttgaggtaaaattcatatagcacaaaattaactattttaaagtgtacaattcagtggcatttagtacattcatgatattggcatctgccacatgtgtctagttcccgaacattgtcacatcacatccaaaggagatcccatgcccattctcccctcccacatcccgcggcagccaccactctgccttgttgagtggtcttctgtgactggctcctttcgtttagcaccatgatcttgggggtcatctgtgctgcagtgggtgtcagtgctttcttcctggtaagagcgtaacatggtgcagtcattgtggaaaacaattgggtggttcttggaaatgtgaaatataggattactgtatgagctagcagctccacttccgggtatctaactaaaacaactgaaaacaggtattagggggaaaaaaacctgcacacgaatgtccaatagcagcactgttgttcacaatagccagtatgtggagacaacctaaatgcccatcgacagatcgatggattaacaatttccatacaatggactattaccttttgttattattattattattatagctttcttaactcctattgattttttcaaaagtgacctcagctgtcatctcttttccacaaagagtcttacctgagtctggagaccattcctttttctgaccacagaaccccgtcttaatctctgtcctgcctcttccactcattaattcattccctgattccttccaaagtatttgttgggtgcctgctatagacaaggtcactccagtggggagggaccgacaacaccaagtcagctgaaataacagcaccgtggagggagtgtgtgccatgcggagaattttgggttgggtgggagggtgcttggatgtctcactgttgctctgatggaccaggaggagatgtttgcaatgaaacccaagtgataagaaggaggcagctttgcaaaggtggaggagagcctcccttgaggggctgcttactaggatccggaggtggggatgagcctggggaggctgcagagaactgtgaggttggagctgctcacagggagaggtcacagggctttgagggccaaagggaggcctaactcctgtggaagccactggagggtttgaggcagggtaaggcggggtcaggggtgtatgccatgtgacccgaagggagggcattgcgggaacctgggagcgatgagggagacctgggccgggggagtcagggcagggcggatgtagcaaagtcacattgtcctgagtgaccattcacttggctgtccccgctcccaggcctcaggactgtgagggcaggcactgggtctcaggcccagagaagatgctcagaaaaggaaaaggagaccggggcacgagtgagccagtgcagtgtgcagagtgagggggcagtgggcaaagaaattgcatggcccagatcactcactggagaccagagacaccttagtgtcccaggatgatgaagagcgaggggccagagctaggggagttagtgatgcatctgctagccgggctggccctccctgtgggcacagagaaagtggttcctcaacagccatgggtgacctttaaggatgcccacagatggtgccatctcaggagaagggtcccagagggactggctctgtcacctgctgtcagctgctcccggaaagcccgcactgcatgacttgctggtttgttggaatggttccatcttgctgtgtcacttccatgacaatcaccagaggaaccaggcccaggcaaggggcctgtgatgaagcgagcagccctgatgacatcagaaatgcagacagttccagacattcaagcatgatgtccttggctcttgggtgaaaatcctcctcggtgtgtcagggaaagtcattgaattcacgttggacccggacttggtaaatcttcagaagcacgctctattctgcaggatttaagcttcagatgggcctagactggtatgcacaggtagggactgtgcacttgagcacagatggaccttcagcccatctccttttggttctcatatacttgttgagccctggctaggccctcctgagctctgtttcagggcctgcagaggctgctgtacaggtcacacttggtctctgctctcacggtcaagtagccaggatggacataaaactaatgaacacatacatcaagagctaattaaaaattgtgctgaaggccatggtggaaaaataacaggaaacctaacaggtgggtaggaagggtgagaccatgagggatgaataggagttcatcagagaaaagtgttgcctccagagggaatggcacagaaggcagccctattgtgggaaagcacttaatgagcgaggagggccatggtggtagagaagcttaagaaatggaggccagggctctggggttacagtgggggttttatatttcatcctaagagccactgtgatgtcatgtggggagcaatataaggccctgtttgcttgcttgcttgcggggtaggcaggagtggaagcgggaaaccagggcagaggctgcagaactgtacaggtgaaagtgatgctggactgcccccaggggttagaagtgaaatgaagataagagatcaggatccaaaaccatttattctctccctttttcttcttggggcacccagtagtattttttcccagaagacatttcttaaaggatcacttaagccaggaactgtcaaatgcacaaaccaaatgcactttctactagtttttgcaaataaagttttattgcaacatagccatgcccattaatttatgtcccatctgtggctgcttcacactacagcagcagagctgagtggcggcagcagagactgtgtggcccgcaaagcctcagagttttattatttggccccttacagaagacatttgccaattcctgacctaagcaaagtgagtgagggacgcattttcaaaacacaaatctgttggcttaaagtcttcctagcacttaaatgcatttaatccctctgaaaaatgctagagtagacacagtttttaaattgacttttgtttttctttaaccttttgctgatattatatataagaaactcaccttatgctttaggtttagaaagtcagggttggaactcagactttgaagatgttgtgtgatattatttctctaaatttctactacaatactaaagtctcctgatgtgttatttcactttttgtcctttctctgaaatgctcattttcctccttttctgtaaaatataatctcagggaagaagtttgtaaaagcagcttttagcctttgcaaagatataggtgggcctcttgtacaataatttttataagagtttgttctttgcaaatgcagatgcatcctactaagccacatacaaaaaaatcatcacaatgatgacaacaacaaagccaattttccagattccacctttctccttcctcatcctcttcatgtttgaatttgtgctgccaaattctatagagcattttcagatccacttgatttacagatttgagctgaatttcacttggaaaactgaccatatgtctggcaggcaccagcgaccattggcagtactatagggttgatactaaacagatgggctttctagttagatgtgctgttttttccacaatacatatgagaaagaaaagaagccactttaataatgtcttgatttttccactggtgtcagagtcatcaatgatgcccatttatgtagtcttaatttcagcatcattgcgtgcagggtgccttagacagctagaagaagcttaatgacttgggaaattttgaggcccaacttctgcctagatcttagagaatcttgttatctttggaatacagatagtggataaaagacttttatagtccaaaaataaattattaacactatttgtcaggaatacattcaaagttcttagtcctgggtttattgctcaaactatttgacagcttttgtggggttattgcagtctaggcagcaaggtgtaaatagcggttgtctgataggtctgtttaggaaaatctagctaaacaactgaatacgatttcttcctgcagaacttctcagagcctatactatgctaatatgcactggggctctcatgaagagggttttagtacagacagcattttctaactactttaatcctctcagcatctccctatgctagagttccatggaaaacactttgggaaacaccggtgtcatgcctagatggtaaactgaagagcagagaggctgcggcagacctgccatttaccagctgtgtgaccttgaacgagtgctttcgtgctctgagcctctactttttaaatgtaaaatggagctgaaaatataggccctgcctgttagggttgtttgcctggaatgaacatgcagaaggttttggtggcctccctttgggcattaaaatataagttctcctaaaattaagtatttattcaattcacaattttccaggggccaattattcactctgaagcttagccaggcttttgtcttttcttctctgtgcttcttagcacctccactaaccagtaaaggagagaaaggagatgccctttgagttaagggctgctgagggggcagccagaagaagccatggccaacatgaggtctagaggtggctcgggaattgcagttaccttccactgtcgggagtcagtgggacagctccaggccattgttaaaaaccattgccctgcatttgattctgcttccatttttgtatcatgggatcaatccactcattcatttattcactcgctcactcatttattcaacccacctgccaggcactgtgctaggtgccggaggaggaagcggaccctaagtctaggaattgcattgtgcagttgttgaggtctctgtttcccctatactggaaaagtcagcagttagtccatcaaacaagggctataatcagattacagattttgatgaatgaacttgcagggctgtagaaaaaagcctataagcttttaggaatagagccataggcatttagcagtattttcttcccttttttgaataaattcactcctttttttttttttttttgcatccctccctgccctccacccaacaccagcaagcagtttattcctccattataagcagtgtgactataagacacttgtcaaatggtctcactttgtccttggatggtatgacccttgttttgtttttattgatcagcacacccaaaatatcatgctcttcagtcattacttaggaattttctaggggtggaggaggtcaaaccaagaacttttacatttgggagattgaaatctatttctaaaacttgattttggaggttcagctccattctggtggtcactctctgaaaatgcccagcactttttctgtagatggctgtcaagccacatctcttgcagcctggccacaggcaattggattttcagtgctcagtgcttccgtgtgaggttattgtatgttgctttaaaggttaacttcttcctcctcccagccctatttctccttcctcctcccagatcttagacagcagtgttatcatctgctctgtgtcatctagcacaggactgggagaggggcggagttgtcaaagaggctgtggggttaagatcagggcttttacagcagatgacctgagttctaagctccactctgtcgctaactagcatgtgccctggggtaattatttcacatctgtgtgcctccattgtcctcatctgtaatgtaggtgatgaaaatagttcttcgcttgctagggtcttgatggaatacaatgagcaaattcatgccaggtgctcagcactgagcctgttgcacagcaaatgctcagtagatgcttccgttgctgatgacagtgatgacaaaaacaaaccttcgtattccttggctcttccatatgtgtgagtgcccccatcctctgccttcctgccttcagccttgttccccctacagtctgccatcctcaccgagattccacgtggtcttctcacaaggctgaacttgctccaggtccctcaatgactccacattgtccccaggactcttatcacagccacacagctcttcttggtcaggtccccacacgccttcctaagctcacctatgtcaactctgttccatagaccataagctccagcctaagggtcctcaagttccagtgcacagacccacaccagcaaattaagaacactaagagcaatgcagttgggttttcatttacgaatgtagaatcaattaatttttttaagagacagggtcttgctctgttgcccaggctggagcacagtggtgcaattcactgtaacctggaattcctgagctcaagcaatcctcctgcctcagcctcctgagttgctgggactacaggtgtgcataaccacaccgagctaatttttttttccttcgtttttgtagagacagggtctcactacgttgcccaggctgggcttgaactcatgccctcaagcagccctcctgcattggcttcccaagccactgagcccaggcctaaaaattctgtttgtttgtttttttctgagactatattttttctattatgtgtactaagttgtgatgaacatagatgattgctttgtgtagtgtgtgtgtgtgttggccattactgccataatgaacattagcatatctgtgtggatcccaattttatatgtggaaattttactgggtttctgagccttagagactggggacctcagacctagcttccccaaatgactccccattccccaaacaccatgtactgccatgcatttatgaatttgcacgttttactaaaatcctactcaacctctaatacccaactcaattatcactacctactacctcccctagcttctagtagccttcttagagttatcccaccctcaagcaggaaaagttgcttcctctgctattataatcctctttcttgattcttcctggtggttccaggtaccttagttttctcagtggtcactgagtcccccgggagagagggtacctagcaccactttgtccctcaggcctaacactgtgctttgttcaaagacaatggtctccacgtattggtgttacaggtaaggactcaaagaagaaatagaggtcatatctcagcttcttatttgcttctattgtggctcatgtcacattatgaggttgccttacactttctgtgttccttcttttctcctccataaatacatgagcttcatgcagcgggaaactgcaggcatgttgatggaatttactgctctgtcaaaactcagagcagtcctgacacacagcaggccctcagccgatatgatgaatgggtttgtgagtgaatgaataaaacaaacaaggaaaaaattattttgcaatattatctgatagagatggcacctttcttctctaagaaatcagccatgtagcacatggcactgagtacctgacctcactcccccagagatatggggctttccttccaatatgtttttggggaatttcgtgaagtggaaggataagataagatatcttagtggatgaaagatgaggatgaaaaaatacctgatgtcactaaagggtggacatcaaagtcagatggacgaggaacagaccctggctccagcgtttggcagccctgcactccggattcacagggtcgagcaggtgtttatttgggcagcccctgggtgccaggaaccagcaaagatgcgagacccagcaacaagcacgagagtgacggttctcattgtcatggagcttatgtttgttctcatgggaaatgcagatgacagtcaataaatagtgaatcccagggcacaatctgagagtaatcagagctaggatggaaggaaatgtgaataaagggattggccctgcaccaggcatggaaattagcctgtaagctccatgaggtcagtgttccgtcagtcctagaacagttcttgcctcatagctctgtgtggctgttgatgggggaaagggatggagttagttacccagggacaagtataccagctactgtgagcctgagagaggcctgggagagggctggctggagttgccaaagaggctggagcttgtcccttgagttgcaagcatgtgacatcagcaggggagggccagctgccccatccatcatctgaggactgaggctgtgtgtagcacttcctcacacagatgccaggtgtgacagacatttcccattaattaacctctaatgcctcagaggtggcagaggtgcagtggaacctggcactactgttattcagaggctggggggtggctgctaatgtgtttgcaccttccagagtctctccagtgtgagaaggcagttcctcaggaactgcagggagagacggggagagaattcctggagtggggggaggtgctcccatctgtcccttccctctgtggacaggtgtgcatgggccacatgcacccgcccacagatggcatcccacccatgcaggtgcacacccacccacgcccatgcacactggctccgcaggtgctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacacctgccccgctgtacacctgcagtgatgggctcatgtcctctgcccttggaggggtttgtaagtagttttctctgagcagcactattttgaagtttctcttcttgggcggagagtcatagctctcacaagccctcccctggcacagtcctgggcttgagccaccccagggaaggcagaggggagagggaatttcctcccaagggggatgcagagcagcacagcctggggcccctgggcatggggtcttcactcctctgatgacagttgagccccttgaggagctgcttagactaaggcatctgtcctggtcaatgcattggatttttggtttaggagcaaagggtcttttgagctgaagaccctctagtggctccctgctgaattctgaatcaggttcaagtccctgactacgaccctgcctgcctccccagcacatccacgcctctcaaccactgtttcctcctgtcttggacagcctgcccctttcccatcatagcccctgtcctgttccccactggggcggccctctggagcacccagtgctgaccctgtcacagtcggtcagtcgacacctgccctcgaggctccctgaggaggccctgggtcctgtccttcctcgcgtctgtggggatcctggttcagggctctctatgtccccctggcacgtgcctgagctgttgctggcactggagatacagctgcaaacatccatcaagggcctgcagtcaggagcttcagctcggggcatgggcaggaggagtggagacaactacaaacaggtaaacaaatgagtgtgtgcgtgcatgtgcgtgtgtgtgtgtctgtgtgcgtgcatgtgtgcgtgtatgtgtgtgcgtgcatgtgcatgtgtgtgtctctgtgtgcatgtgtgtgtgcgtgtgtgtgcatgcacaccagctgatacctgtgatgagaaaaataaagaggaaggcaagaaatagtgaggagtgccatcccacatggggtgagccaggactgtctaaattcatacctttattcattgttcatctcctgcaggtgagtacagccccacaaaggcaggcatcgtctcttttgttcacctctgcacaccctgtgcctattaggatacatggcacatggttggtgtcagtacgtatttgttgaaaggtggagtgagtgagtgagtgagtgagtgaattcttaaagggagagaggagtgcagtctcctcagtggccaaagtgctccctcgccagccctcagctctgctgtgaggaccactgtgtgtcagagacggggtgggaaccccagaacctgctccagccactagggcagaagtggggggaggcagctgattaaaatagtgcaggtagtgacggtggtcctggcagtgatggtggtagggagggggaggcgccactgcccctcctgcccaccttccaccagtggaagcagtcacatagccacagcaagaaggagacaccataccccccagcaaggccctggcaaaggggatgcagggagtcaatgcttcaacctcctgttagtaagtggcagggccaggaggggagcctggggtgcctggtcccagcccccatgttcttcacagctacgtcacactggcttccatggcacatggcaagcactaatgcacaataaggatgataataagggggagggagcagcagagcacagagagctgcacaagtttagtgattaacttggattttgtcctaaatgagaagggaagcgagcaggaagtgatagggttagagctctatttctaagacatcggatcacaggaagaccagttgctggggcagggatgctggtactggaccagggttgttatgatgcaggtggcaaagaaagttgggttcagggtctgatctgtagtttattctgtgtgctactccgttttgccttggctgctaggaagctcagggcacacaaataccctcctctggagcccgtgtggtgtctgtcgtggggacccacctaactccttgatgctgtggccctcagcagaccctgattcctccagatccttcctgacactcccttcatccttcagctgtgtatgtgtgtttctggtgattgctgccgatcctttgtgaaggaggtgagatataaataaagcaatgattatgctccatcctcgtctcctctgctcatccctggagatcttcgtcttcatcttcagctgagcttggaggcttggggagacctagcccatccttcccctcgtgcaaagcatgctcaggacagcaggctttcccagggccatgtggagtcacagtcttgctcccatctggtgtctgtaggtggaggaaggaaaggagaggatgagaacatggaatgcattgtctctgagaagagaaggatccctgtacatccctctgcctcccgtggccttggggagagggtggccgggaggatctgtggttaattggtgttctgcagctgccctggttccacacatttcctgggctcccactgggtaccaggcactaggtgctggggtcgcctcaaaaacacagtggaggatgccattgctgtagctcccttaatggtttgcagagcccagaatgtcaaacaagacattcctgggcttgtctttccccatggggctgctttgtggagcatctgtggacacagcacctagcacagttaacacttgtattagtccgttttcatactgctacaaagtgcccccgataaaacaaaaaagaactgcccaagactgcatgatttataaaagaaagaagtttaattggctcaaagtttagcatggttggggaagcctcagaaaacttacaatcatggcagaaggtgaaggggaagcaaggcaccttcttcacaaggcagcaggaaggagaagtgcagggcgaagggggaggagcctcccttataaaaccaacagatctcaagagaactcactcaatatcatgcggacagcatgggggaaaccacctccctgatccaatcacctccacctggtctttctcttgacacatggagattatggggattataattcaagatgagatttgggtggggacacaaagcctaaccatatcagcactctattagtaatgcctggagagaatgacctcatgccccaacccacctagggtgggcctggtttatcctcttgtcttggtgtcccatccttctgtgttctgctttgggtcccctcgatgcagctttggaaggtgagaggggcctctggagtcagggtgctcaaggtcctgccctgccacagcatttcccagctctgagaccaacaaaaaaatggctcagggctctgatcttcagtttgttcatctgtaaaatggatataaaatggaatgatctctagctcatagatttattgtgaaggtaaaataggacaatgccttaggatagtcctggccctgcacaggcagtgaccagcgtttactccatcatcattattctattgctcatatcatagaaattattataatataaattttgaccaaaagttacctgcactggcatggtatgttaatcagagtgatgataaagtctagacatatagataatattattttacatggatgataacatgaactattaataaactgtgtattgtggatgtttatctttgttttcagattgtttttcattttaatttttttttagagacagggtctctctctctgtagcccaggctggagtacaggtgcaaatcatagctcactgcagtcttgacctcctaggctcaagtgatcctcctgtctccgactcttaagtagcatgcaccaccatgcctggggaatttccaaaaatttttttgtagaggtggagtctctgtgttacccaggctggtctcaaactcttgggatcaagggatcctctagccttggcatcccaaagcattacgattacaggcatgagccactgtactggccttcccagaatttatgaccacactgagtcctcccctcaaccttacctatcagggatgattatcatggcatcttttttttttatcaacagatgtggaaaccgaggctccaaggggccgggtggcttactcaaaggccctgggttagagacaggtgcagccctttggaagccagaccccgtggaagctctagaggctgccaggcaggccgcctgtcactgggggcacagaggtcactgccatgtggggccttgggccctcgggtgctgcctcatatggctcttctcaggctgagctctgcagagcccagattcagagcaggccgtcctgggcctccttggggcagccagtggcatgcatgggtgccttaggtgggaaatgcgggagtgtgaccccttccctgggtctgaggggcctggcccatcataatccccggccccttggacactggtaatgccccttcccctcgaacactggtggtctccttccctgtcctctctgacaaaggtgacctccttcctcaggtgagcccttgtgttagccacaccgtccagcccttctccctgcatgtccatgcttcctggggctctgaggtctgcatcagcttagggctcccagccccttccacaggtaacaaggcaaattcacctgctggctgtggaactgaccacgcgctgaccatgggaggctgagccagctgtcggggagtgtgtatgttcgcagggcgaggggtcctggcagaggtctgggctcctgtggtagcagccgtgctggggagcaccccacgggtctgcgatcttcctcccccagcgacactgggaggttaaatcggagcctggttgggactcaggtccttgttgctgccagaagaaacgtcccttccctgtcccaggaggcatctggggcaatgtgctcatctattctcagtcctgcctgggtgacggcctgaactctgctctacactgtgaccctaggatggaggtgacgctggcttactttgtgagcttctctaactttaccattttgttagttgcattttgtttcattctaactaatctttcctactaagggacacacggcttgtgctacaaaaacagcctgtgaagcacatctccctctctcccccgcctgccaacagccagggctccccatttctttctttctttttttttttttttcttctttttttgagacagagtctcaccctgtcacccaggctggagtacaatggtgtgatcttggctcactgcaacctttgcctcccgggttgaaacaattatcctgtctcagcctcctgagtagctgggattacaggtacccgccaccacactcagctaatttttgtatttttagtagagacgggatttcaccatgtcggtcaggctggtctcgaactcctgaccttgtgatctgcctgcctgggcctcccaaagtgctgggattataggcgtaagccactgtgcccagccccggggttccccatttctttggagggcccacagacattttctctccacacaccagtgtgtgcctgtataccacccctgttcgcacactggtggcgtgtgcgtgtgaatttgtgcgctggggttttctttggcctgattatctcagatcagtttcctgtccgtgcttggagatccactttctttctttctgcatctgcacacaggtggttgacaggacagacgatgacttacccagtccccctgtggacgggtatgtaggtcggtatgagtctcttttacaacaaacagcactgccatgagcttcctaggacgttcatcttcacgtgtcccagagtctacaaacatggccgtttcatggacaaggaaggggtccaggagcactgcttcctctgcctgctcacagacgtgctcacagacgtgctcactctgcagccgtttgctcagaattctcaccggcctggctctgcgttgggttccaaggctgccccaggcctgggctctaccctagaagaggtggcagcctggtgggagggcaggcaggcagaggtctttgcggctcattggtgcctgcataggtagcttcatgggcgtaagacaagggagtgaccctgtctgggacaagaggaaggtaaagactctggacaaagtcctattcaatggaggagctgaagtttatgaggcagagaagcggctgggagggagagcagcgtgggtggagggcagagcacgagcaagggtcctgggcaggcagcgtttcatgctggaattaggaacatcttcacacgtggcgcgtcatatggcggaaggcgaaggcttctggtggccgtgagtgggtcgcaggagggagggtctcacagagggaaattcagcgcacgctgctgagctgctgcggccactgtgggtgcactgctggacaaccatcctggggtccaggctttggggggatcactggtgaccccttagggtgagaggtcatcaccttgggcccccaggagtcacataggtttggtggccacttgaggacccccttggttttcgtcttccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcaggtaaaggcctggtgacaggcgcgggcaggctgtggctgggaccagcgtccttggcatggtgctgcggcccctgctgatctgtgacttcctggcccctacacaggaggggcagatgtgcttcatggcctgtgatggccaggagccatgcaagttaccccgctggcccctccagggcccacctggcctccctgaagccctggggtggagttggcaccaggcaccccatgtgggacgctctgcccagaccctaaggtgcccacaagtccactgggaccttgttaaaaacgaagcctctgatttacttagggctgggttgggccgagacactggctttggagcaaggtctcacttgctggcttcacctgggtggtgagcccccagcccacgcgactcccgcaccacctcacctcccacacctgcaatctcacttggaggatgctggggcctgggtcgtacccccacagatgcaggtttagttggccaagagcctcctgggtgactcagggttgaggccgtcggtttggctttgacacctctgggcctctcttcttcctgaaagacagaggctgctcccctgctcctaagctgtctcagtgtgccttccctacaccctcccaccaaagcatccagaaggttcctccactcacctcctgctgccccctcacaccctgccagccctggctctgtgggaagcgggattgcgatggctggtcccgttgcccccgcctcctcggaatccagcttgggaactgcagccatgaggctgaaccacagacagggtggacacaggcagtgatgacgggacaagcagccgtaaggcacataacggcagaacacggccccccagcatttggcatggaggagccaactcaaccctcagaacctcctgctaggccagcactcccgcaggatcctgccccatcggaagggatggggaacaggcccagaaagggaaatcactcacccagggtcacacagccagcaggtggcggggctgaggcttggaccctggcagccgggtgtggtggctcgtcagcctgggctctgcagatggcagtgttctgagaagagagcccggaggaggccgcatctccaccccagggccccgcctccagccacatgcctgtgagccacacctaaaaacaattagtgagggagctgctgctgtggaatcagtcccaggcctcaggaaccagccctggcgagtgcccgtctcaggctgttgcctcggggggtccctggggtcccatttcctttccagctctgaagaggcgcaggctccagggctttgaggatggtggagacgaaggccaggtgttacagcgcccaggcccacagcaggggaggcggccaacaccgacagcaggccctccactcatgcttttctgtgtgctttacaaaattattattattatttttaccaaccaagaagttgatagatgaattcttgttgaagtggaaacagaacaagcatcatcattcggcagatcttgagcacctcctgtgtgcccagtaccaacaggaggggcccaggccctgcccacccagagctttccgcagagtagggagtcgagtgacaaagtgtggaagccaccaagtgaaccagcacgtgagtcgattgcagactccggcgaggctgcaaggcagcctccctcactggatgctaggctcagctaggtgggcgggttccatttgttcccctgcatctggcagggccccttgcacacacacggcactaatgggctcttagtgatccaggcttaatggcaggatcacggagcaggccctggggggtggaaatgagcagggcgggcactgctttgggcccagtggtccgagaagacccaggtgaggaggctgcattgagctgagatgtaattggttcattgagaaaggcagggaagagcatggcagcagtgggaacagccctcgaaaaggcagcgagctggggaaggcacgtctgtgcagcagtgaaaggccgggggactagagcagagtgacctccgtgacctcaggggggtctctgacattctccaggcctgctgaccccagcagtggaactggaaggctgaggtttgtcttctgaggactctgggctctttggcctactccaagctgtgccgtgtgagttcaccagcaagatgctctggggaccctgcaagggcattggaggtctcgaggtttttacctgcagcatccccaccttcaggaccgccattcgggcatctggaaattcgaggaacagtgctgcattttgtttacttattccaaaccactattttcctttaaagcagggggtgttatttgtttcagcatatcaaattcctgatttcacgggcatcacgggttaggatgagttgaagtgaatgcaaagatgattgaaagagaaatatgtagcaaacagtggttttggtaggcgaggctgggggaaccggctgaagatggctctcaggggctgcagggtggaccagcatctcagtccatgcctgccctggcaggtggctcagatccactcagccatttacacactgtaccaccttcacaagctgcaccaccactgacgtccccatccccgagagggggagggtagagcctcgcagctgcatctttgggtcatcgggaagtccttgagtcagtgcaggcaaagacctgtgatgtctgaggctagccaccatgagcaccgcctggtgccggcctggggacggggtccacacagagctcgaggcctccacccctgttcttcttatctgctttgtgagcctggctgcagcctctttgctgacacctcccaaggtcagcattcactttgtcaattttatccacaattctggcacctggaaattggcttggaaattgggaccacagaaaggaaattctgttttctctgcccaaaaatgtccccaccctgctgtgtttgggtttcccttttcatcctttggctttagggtaaatatcctcagggaagccacccgggaggtcaaggatgggatgggtttccccagacaactgccccccagtcagtcccccgccccaggcctgacttattcctcctcgcccacttctagacacttgccatctgtcctcccacctgtgctggcatcaggcagaggctgtgcctgtcttgctcatggcagaatctcctgtgcctgacatggtgcctggcacacagtaggtgctcagtaaatgtgtaaggggtttccatagattgaacacctgatcaccatggcctgttcccccagtggagccccacctgtgaaggctgcagggcttctgccctccgtgactccccagcacccagctcagcacttggcacatagcaggtgctcaggaaatgcttttgagtaagtgaaataattccattgccagtgcctgtttgtcatctgcctccccaactagacattaagctaagccaggtgggctgactctgtctgttccccggcagctggcagggccccctgcacacacagaacactgatggactctctgtgatccagggttaatggcaggatcacggagcaggccctggggtggaaatgagcagggcgggcactgctttgggcccagtggtcggagaagacccaggtgaggaggctgcattgagctgagatgtaattggttcattgggaaaggcggggaaatcatcacagcagtggaaacagcccttgcaaagctgcatctttcaaagaaagggttgaggtggttatgtagtcttgtatttggaaattggggctcacctgtaggcaaacagttttcctgacggaaggaagaagatgattgtggagcagcccgaggcctgcctgtgaaagaagggagaatgggacaaggtggtggccgtcgctcaagagtgttttgctccgggaaggggaggcagaaagggctattctgaaggcggaattgacaaagatttggcaaattaggcttggtggaaggggactgggggctggcctcctcccttcctgtccatctggtagactggaagcttttaacctgggtttattggaagaagctctagtgggagagccgcacaggagaatctcatctgtgagtggatgttaagagcggccaggaggcacttcgcaaaggcgaacaggaaccacggaaaggagcccggggtgttggcggcagagggagggcactttccttggttggtaatttagggaacatttggtgaagggcaggaatggctggtgagagctagcttagagaggggcgttatatgtgcaggggctttccagataaatcacagaaatgatcgctgtagaatatctactgcgtgcactgctctttagctgtggtttatgcacattgcttagcagcactcttggtaagaaagttgggcctcgccagtggactaggccccctaaccccgaggcgcctgctagctcagtgtttttggtctgtaaacttgagcctggcattggctgtggcttggacagggcccagtgacacctttgcctgagactcacctgtgtgtttgtgtgttgggcagcgctggagaagaagatggccggcaggcaaggccgagaggagctcatcaagaaggggctgctggagatgatggagcagggtaagtgggacccgtccctggcttggaagggcacggtgctgggaatgcagaatggaaagtctcacatgagcccaggaagcccatcagaaacagtgtagaatccaaggagggccgtgttcagatgaagcctgcaaggttggagagacaccccatgtcaggagccattccattggtccagcccccaggggcacgggagaccccattactgagctgaagagctccccctcatggcaccactcctctctggggaatgtctaacagagctgggtgtgcatgaatctggtggtttatcccaattcctttaaagtggtagcagtggttttttcagcattaatttttttttcatattcacatttcagtcctccatttgggcaaattatttttaattccactattacctactccccctaccaccatgtaggaagcattcaggacatgctggggcggggtgggatattgtgcacgccctgtctcattggtcttcccagcatccctggggagagaggcagcggctatcccacttgcagacgaggcgtgggagggtctgggtggtgactgccccaagtcattgcagcctgagagcagagacacagaacaaatcctgatctcttggtctctggtctagagagcttaatctcagtggggtctacataatcatctttgtttccatctttcagaaaggccagttattatcactcatgcaattaactgaacagagttctttaattcccaagtctttctctttgtgatggattcctggaggtgtgaggcccaggacttagatgctgacactagcccttggtgccttccggttccctgagaggctaaatcttggttaggaggtttcacaacacctcactgcctctggaagactctctggagctggaccaagctctggcctgctgatttgaggaatctggccatgcatagccagtttcctgaggcttgcatggatatattgaattcctctctccccacttcagccttaaaatattactagtgtctttgtaatttggcccaaatatcaggaattaggaaggaagctcatgaaataaacgaatccagattttatgcagccgggcctgtcagcacacaaacccgattgtgggcccaggcttttgtcattgtttcctctctttagactcgaagagtgaagtattttgatgatgctatttttaggggaaatctacatgggaaattgcttcatagtgataataaaaccttacatgtgcgaggaaagcttggtgtcaagtcccgtggcactcagatggttaacgccgtcgtgacgctcggatttggcggaatgcggttgctgagctagaaatctggaggattttcactgggatgggacaaaaaagtgtcaaactccggcattttgaatatgttgccaacaagcatacctttggatcttagggaaggagaaaggaagatgaaaacaatgctaaggccttttctcatctattctaaaaaaaacactacttttgttgagtaaagagtaagtatatagatttggttcctctcaaaaatgaagctatagtttgactaattaaaggggaaaacttctaggagcgttggcttttttccactctgaatttttgcaagatgactttgtctgatgaagtcatagcagaggctggagacgaatgcttggccgcggccaggctgacagtgtggctctcaccctgctgccgtgggagcctggtctctggcttccgtgcctctgacggcgacatcacacacccgcaggcttacagaatcactttagatcagggtcggcaaaccttttctggagagggtcagatagtgcatatttcagggggacgtgcagtctctgttgcaactacttgtctctgcttttgtagcgcaaaggcagccggagacaaaacatgcatgagagggcatggctgtgtcccaagaaaactttatttatggccactggcctttgaattttatataattttcatgtgccacaaactattatttttcttttgatttttttttcttttgtcaaccatttaaagatgtcaaatccaggtgggggagctggattggtccccacattgtggtttgctcatctctaccttccatactctctctcttgctaaatgattgtggaccagggactagagtggcctgaaacacagtctctttccttgagagggaaaatgcactcctaaattgatgccatgacattttattgagggcccactctgtgtcagggtctgtgctagctgctgaggacacaggtgagcaaaatactgttctgaacgcacatccagtggggccattaggtaatcccacaaaaagccggcaactcacgaccacagtgagtgcagtgaaggatgcagcaccctaagatcatgagacaggacctgacctggttctcggggggccgggagatgtttgagtcaggtccaaaggtgggcaggaggacctaggctggttctcagagtctgttgcatattaggatcacctggagagatttaataaccctccaccgctcaggcagcagttaaattagatgcgctgggcgtgggacccaggcagcagtgcttcctcatcctccacagctgattccgactttgatgcaggaaggttgaaaagccaagagacagaaggaagcggggagtgacttccagcccacaggagcagcaagcacaagtccccgcggtggaagggaccttgagatggtgggttgggttggaggaaaggaggaaggaggaagcaggaaagggagaggggcttgggtcaagacgcctcccgtcttccctgcccacacaccggctggggtggcagaggcatgaccacgctgctgcgggagcctggggcggccacagtgcgagtgggtgggatctgcgaggagcccgagtgtctctgcagggaaatatcagggaccgggcagcaggggttgctctgggaggggacttggacttgcttttcgcagtcgactcttctgtgctgcttgaatcctttactgtgtgccacctgtaatcaacctgtaatcaacgtgctgtaataacgggatccacgcagatgcttggccacaggctcccggctaaatccttccctgcaccgcagtttccgtcctgcactagcttcaaaaatgtcttttctcactgggtcgacctgaggtcagaccctgtctgtccctaatcctcctggtgctgggtcaccgggtcctcttgcaggatgactggaattgttggcggtggctgtgcacctgccctctccggctcaggggaggatcaggcttgagggctgttgctctggggtaggcacgcagtgccgccgcctctgctgtggatgtgaggactctccagggtgaggagcagaggcgctttcctggctttggggttaaggaaccggcttcagggttaaggaaccggcttcagccaccgccttccactgctggcagggacgaatctgcagccgggggcgccctcctgtggccggccaggctcatgagcctccctgcaaggtggacgggacttcatgcaggacaggccctgtgaggctgtgggagtggattgtcagggactccagagcctcatttgagccccctcgaaactcacatttgaacttccttggccaggacaaaccccaggattgccctctgccctgcacacgcgcatgtatgcacacacacatgtacatacacattggacaccctggagcttgccctgaagcaggtgggcagcctggtggagtgagccggactctgggcagggccagcagaagagagcccgccagctcccgggggtgaggcagcatccagggcatgagtttgctccctctggggtgttactttatgatcgatggtctgttttatgaaccactgtgaccccctcccctctcgttcctgtgactctagtcgccagcttggacctaggaaggaccctgctggtggcgttattacatgactagatgtgtgcagtggagcccgttgtgccctggggagggcagaggggacccctctgatctcttcagtgctccttccaccctcgtctcggatatccgtgactaagtgaggccagaccaaatctctggtacaaggggtccccttccccagcccccttgccctggtccccagcccacgtttctctgtgctagacactgtttatgttctgaatgactttcctccatctccctgtatgcgttgacttggcattttcttaaataatttaaggaatttcctaccccgtcattgggtataaaagaagagagtttattactctgtgctgtgttcagtgacttgagattgactaggcattctttcctcagggaattggacagtgacaaatcaagtctatctggtttccatgtggtaggaacgccgggggacacatgtctgcacgtgtgcacacacatgcacgtgcacctgtgtgcacccacctgtgcttgcactgtgcacatgtgccacgacacacgtgtgtgcctgcgtgtgcatctgtgagtgtgtgtgcatgtctgcaacacgttccctctcactgtggctgctcaggtgcactgccccgcgctcccctctgcagccctcagaaggagagtggccgggcggaggctggccttccagcgagaggagcagggcctgggctcccaccgctcccccaacccctccccaaccagcgtttcttagcaacggccctgccaccagggctattttgggaactgaaacttttcactgaacatgattatgagctggagctctgaccgcagcccagagaagtcctgcaagaagtccttgcagaaaacctgcaagaaagcaggggaaggttcaaagactgtggaggggcatggtgcttttctgagtctggagacctctgggccttccaggttctatgttctgacctttttatagtggcagttgtgatgattttgatgatgacgatggaggcatccttattattaacagcagtgacagtcatggcagcaaaagacctgtgcattctaaggtttggtgtccataactgcaagtggtgggtggcagccttgcctgtcacatagggtaggtgtgaagctcaagctggcagagccctgtgctcccctacgccagctctcacattccctgtgtgttgccaggggctgggtaagctgtgctgtcacggttgcacgtcaaatgcgagtaagtcggtcacgagaaggggctggtttcagttttcagctttgtgacctctaattttgtctactcggtgagctctcttggcttgtatctgggttggtgggctgttatagccaagggtcaaatgtggctcaggacctgtttttatgtggtctttgagctaagaatgctttttaaatagaaaagactttcataaaaattaaaaaaaaaaaatcaagggttgcagcacgggggatacagcacgtggcccacagagcccgtcacaatggccatctgcgccttatgggaagagcctgccagcctcgcctggacctctgggcaactgacgcggctgcatggatgagatcgtccagccctaaatctccagacttctggcatggctgaccttttcattctccccggaggagacgtgtgcggcagagggaatatgatcagcagcgatgacaagctcaaatctcttccagggtcccaggcaggaaatgggtctggcatgagtcctgggtgtggtgaggactctggagggagaaacggttctgtcctaagcctgctgttagcagatgggcccaaaggtgcagaccaaggggccagatcactcttgtcaccctcctcttctcgttgtcagaaaccatcaccaacaacaatgacagaaagcacatgtaaagtgcctaccttatgccagacacattccataccctagctccgttaattctcactatgttgccatgaagcaagcagaaatattatccccattttatagataaggaaattgagatccagaggaatttgctatttgggcacaaaacaccgtttgcaggtggtgggacgcatgatggggtgactgtatactgtttgtccaaacaggacacttttaggagtgaaagggacactgttgaaggacacagggatggcaggtaggaatcgggactgaccaggtcctatggaccctgaccctgaagtaaatgttgcctcctccttccactgccaggatgggacgtgtgtggaaggaggtcagcgtaggctagcatccccaaacggccacctcgtggctgtgtcgacatgtgcaggtcacactgccctctgcaccgggcctccaggaactgctgtagagattgagaggagtcctgcagggctatgtggaggctttgtgcatggggctgtaacgtgcatctcagtgacgtgactgtgacttgctggccgagggccctgccatcctgcagttgggtaactgagccatttattttgctctccaagtgctgagcccctcagcattaaggtgcaaacccagggatggcaagtgaagggccagaccctcagaggctgcagcagccgagcttcaagagacggaaagcaccaggtccttccttatgccctgctagtgcctcctcttctgggaaggctgcctgtcagacctagggacccccggctctgtggcccctccatccatgggtgtgccccgttcctgggctcacggtgccatgtgtggtcatctgcgtggcttcctcagagtgtgagacccctgggggcaaggactgtatcttactaacctccaccttgccagggtttattacagtgccagacacgtagccggtgatcagtaaacacctgtttaatgcctggctgagggtcaaacggtgggtgcagaggtgagttggttctctgcagccatgacaacccctgcatctcagagacctacagcaatcaccgtttgttgtcccctgtctgggttggcctgtgatctgccccgtgggtctgctgactccagccagctgctgggcatgtcttcaggacaaaggtccagggaaacaggagggacgagcagggatgtgcaagcacttctcatgccagtgctgcatcatacccactgtgtcccatcgaccaaagcaagctccagggcagaggccggggtcagagtggggctactgcaaaggtgcacggcagtgggtgtggacgtggctcaggggcactgcagtctcccacaggtgtcggaggaagagtgcacacagggagtggagtgtaagagcagaaaccaggctagggtgtgctgaggtgcccagggctcccctggaaagtccagacttggagagggactcctagggtgtgtggtgagggggagaggggtgggggaccacccagagcctagaatggatacttctcagaaagactcttgggacgacggaagggatgaaggaagggaggtgcaggcccagctgacagctacatttccttgtagatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcaggtactggctggagaccacgcgaagttgagctgctcctagaatggccatacgtccccactgttgtccttggctatagcttaggcaacagccctcgtagaacattgttctccagagagctgggcccgtgctctaagcgctgccatgctgtgctgcctggctgggttgaagtgtttgctggggcacttttctctactgtctctttccaagtctggcacggctgataagtgaaggtacttaacgatgttcatctccctggcacacctaccccccctcccagggcgtctttgtgtttccctgggaacttctaggcaggaaagtgctctctggaggggcaagtgcccagtggggggattttagtgaccctaaaagggtaggaggtagggttgagggacttttctgtggccgaaatcctgccacagggggcctcttggcctaagagatgctgaagtccctgcatgtgtgcatgcctgggagctggtcggtgctgatgcagtctcagcatgctgcagcctatgtggggctcttccgctgcttcttgaggggaggtgggcttggtgccttgctccaagcctcagtttccctctgttaaatgggaaaagtaatggacctacatcagggttgtttggagggtgggaggaacttagcagtgtctgacgtgtagagtgactattatcaaaggcagtaggggctttgcgtagtggtggtggtttttattttaattgaatagaccagggcgcttcccaaggataggggagaagggaggaaggatagaggggaggaaagcaggaactggccacagacacctgcagatgcttcaccagctcctcctcctcctgcccacctggcagagtgattcttacggagcttcactgttgacttggaatcctgatgtctcgtaaaatttcaagctataagcgagtctcacacggtttgggggtgggaaggtgaacgcgtctctccgtgagtgtgggaggttggaaatccaggccccaggacagcctgctgggcttctgcttcagagcgggtggacacctggtcctccgtgcccgggacttccttctgccacacaagggtggcaccacacactcgcaggccgcccgtccacaacgcccctgcagcgctagcggcacctgcccagaggcatgctcagccctcttcgggggtggccgtgtctctccagtttcacttggcttggaatttggggtctgagagttgtgacttctggagggtcccagctctcacgcagaggccccctccacacacacaggtctctgtgtgccccaggcatctgactttggggctggcgtggttctttttttttttaatactttaagttctagggtacatgtgcacaacgtgcaggtttgttacatatgtatacatgtgccacgttggtgtgctgcacccattaactcgtcatttacattaggtatatctcctaatgctttccctccccctccccccaccaagcaatggcaacaaaagccaaaattgacaaatgggatctaaactaaagagcttctttgcagcaaaagaaactcccattggagtgaacagacaacctacagaatgggggaacatttttgcaatctactcatctgacaaagggctaatatccagaatctacgaagaattcaaacaaattgataagaaaaaaaccccaccacaaagtgggtgaaggatatgaacagacacttctcaaaagaagatatttatgcaacccgctggcatggttcttaaggctgagcagagcctggccttcctgccgtggtgtggtccccacagcccagcccttgtgtgtggcctgtgagcctccccaagggaggcagggctgctgctcccagcccttgatgggggtcacgcttctccttggcagtgatttctgtagctcagctcagggcctgtgcctgctcccctcagtgccctcttctgacctcagacacgctcccgctctctctccagatgctgggtgtgcggatgggttcctgagagcagagtgggtctgttgagattacacatttgtatcagggaccctctcctgagtgaggcctgagggaggagtgggaatcagctgggcagagagcgaggtgcagagcatcccagaaaggggaatgacatgcaaagacaggggacaggaacacacacgttttctgtaaagggccagagaggaaagagcatgagctctgcaggctggaggtgtctgacacagccactcgcctctgccccctggtagcacaaaagcagcgtcggtggtgaaagggtggggctcttgtcggtggaactttagtgattaaaaacaatccagggcccggtgaggtgggtcacacctatcattccagcactttgggaagccaagacaggagaatcacttgaacctaggagttcaaagtcatcctggacagcatagcatgacgccatctctacaaaaaagttttgttttttgtttttggttttaattagctgagtgtgtgggcacacacctgtagtcctagctactcacgaagctgaggcgggaggatagcctgagcccgggaggtcaaggctgcagtgagctgtgatcacaccactgcactccagtctgggcgacagagccagaccctgcttcaaaaaaaattcaaaataaacagcccacagaatggagagagagaagagacctggcaggttatccctgagggcagctggaaccccccagggatggagagtcgatgggatttgccttgtaggaagcgctctgctggtgacccagcaagacctgggggagactggagccgtgcatggttccctggggacttgtctcattcccagcttccccagtgtgggtcttgtgctcctgggatttgtgagatgacttcttgtgaatggcatgtggacagacaatgagaaaacattattaatgttcaattaataatgaaaaagtttaaacattaataatgaaaatacttttcagtaattagggcaagtagtattggcttctcattttgggcaatgatagagatttgctttttcttataaacagagataaaaatataaattcacttaaagtaaaatatagcaaacaaaagtatagaaagtacagaggaatgtccaaaatgtctaaagcaggagccacaagtctgatttaagaaagaccattccattccctagggatgcagctggcttattagcagttagtgacatttgtcatcatgctggggataacaagaggtgacacaagtggctgcctgcatgcagggttggggagcgtgctctactaatgactgcacattcatttagcttacttagccctggaagcagcccccggagatctcacgcccatgatgaaatgctggcacaaaagtcgaataactggtccaaatgactggaaacagagggcaatgtctttgacatcaggccgacctgggtttgagacacacggctgaactccttactgagctgtgggaccatgggcaagtgacttaacctttctgattatgtttgatcaactgtaaaatgaggatagtagtcacactgacctcccagggtcgctaaaattaaattaagtgatccccaggaaagacttatctccctcctaacccacaccgagcacttggaaagtgtctgctgctgctactgtagcatcactgttactctcaccatcatcgttgtcatcgtcattgtcatctgttgtcttcattgtcaaaaacaacccttggaaagggacgcactaacacgcattatttagctgcctacagatgctcccagagaggccatctctctggtagcatgtgtgttttgggatgtggggccacctgcagtttgctatggctgggacaaccccgaggcctcatccagccctgcaggcctgggatcctgcgccagggaccctgcgccagggacatcggtcacctccacaacaccaggtcaatgttcagaagcttggccatgagcaacatccctataaacggggtataacttaacacagggacattaaatgcactggttaaaaatttgcaagccaatgtttaaaaatcaggagtgttcacagaaatccagatgtgcagtttcttttcagtcatcaaagttcaggcctccggatccctgttcccacacagccagggtcgctggagctgaacagagtctgtccctgtagatgggtgttggagtttgcaaccctttccatgaaggttaagagcctagtctttggagccaatccctgtgttactgacttaatcttctgctttgggccccagtattttgtgatagaaggagttaaagcttgaggccactgtgaggcaacgtggtcctaggtctccggtttctactgcagagctcagggggaccagctgttagatgctgtgtgtctgatgctgtctgttctcttcccacattctgcacctcagcacccaagggaactgcccacatctgggcccagtcgctctgtgttgtgggtaattccatgacagacagatgtcatctaatggcagacaaagccagatcctcaagtggcaaatgtgtcacgtgagtgctggaacctgggacctgcttctctccttgaccttggacaagttcagggaaacctcatgggggcccagaacatggtgccccgtgggtgatggtctacacctgcaggagcccctggggtgtctgcagtggtgctcattgctgtcctgaaaggtcagctgctttctcttaaaaagcaaacctcccatgagctttgctgggggtcggggagaggggtcatcaaaaagcacaaggggctgtcctgggtcactcctggcatccaggtggcaacatccaggactggagttgcagcttccccgtgccccaaccatgatgagtgtgggtgtcaggggatacatctgaatattgcaaatctctcaggaggaggacactgtcaatgattttgaccattattttccttgagcctttggtttggtgatttgggttgactttgggcttttgtgtttggggcgactttgcttttcctggttttgtttggatggtgcccgatatggtttggctgtgtccgcacccaaatctcatcttgaattgtagctcccataattcccacgtgtggtgggagggacctggtgggagatcattgaatcatgggggtggtttccccagtactgttctcatggtagtgaataagcctcatgagatctgatggttttataagggaaaaccccttttgcttcgttctcattctcttttgtctgccaccatgtaagatgtgcgtttcgccttccgccatgattgtgaggcctccccagctatatggaactatgagtccattaaacttctttttctttataaattactcagtctcaggtatgtctttatcagcagcatgaaaacggactaataagtgccacaccagcaacagagcattccctacaaagcccagaaggatccggtgttttgacacaaatgggaacagggtcctcttcagtgtttctactatgggacaggggctgagttctggccttcccacaagtgcactaattaaaaaggagagtgacactcagggagcgtgttctgtgtgcactctattatcttataacagcctcatatttttggatgagaaaacagagcccagagaggttaagtcactttcccaggccatagagcataaaaacagatcaaacccagtggcaggactgggtttgatcttcaccataacagtctacagcctaaactctagagccaaacaggagacaaacatttcttctgcttctggaatgttctggaatgtgagtctagaacaaggactgtcaaattgcaggcttcaggtcagatactgcccatgtctgtgtctgcatggctgtggagcactgctctagtgggccggtcctgggagccagggagggaggggtgcctccctccctgtgccctgctcctgtcttcctagctggtggctgcccttaaccactgcctggggcctatgctggtcccagctacccctggggcctgggctctgggcaactgctgggcaccgagtggaggaacctcatctgggagttggtgagccacctggcccacagccagctgcccaagctgagaccaaggttgtgctgggtgtacgggggtggagtacaagtgaccatggctcaccacatccatccttgggctggccacccttgaactccagaatgtcttcagtgggtggtaactggctgcaaagtgtgtcccctgccctggtagccctcttgaggcaagtggcagggcagagtttttcctcttgtttaagttcctacataatattcttgattttgcctcttagcctggaaagacaaaaatgtttactatctgcatctgaacagaaaaggtttatcagcccctgctctggaaaataagtggggattacacagaagggtgtcagtggaacatgctcagcaaagaggtaccagtaagtcatgaacttgtggcgctgtggttgagcttcaggtatttccattcctagccctgacccctgcattggggtttgtacagtgtagaagcttctggttgagactgcatttggtaagagggagcctctgctggtccagccccaagggagcggtcccccaaatgcagggaaccagtgtcttcttccactttttaaaaaattgattcagcacttgagatgttaacagatgttgcaatttcagttttgacaagattccaaaatacaacggtggctgcacactcacgtgagatgcagagggcggtgtcagagaggagagggaagatggggaggagggagggagagaggagatgctgaaaaccgtctcctgtccttagagccatcaggcaggctaaggatgtgagggttcagtgtgtggtgaggatggatgttttgggggagactttggaggagggttttggtcagcgtagctggtgtggtgagtctcatggccatcagggtgaagggtggggaacccatagtcccaccttgggcaggtggaatgaggggacctcagagacttaccctttaccctgtgccttaaggcagtggcactatgaccattgactcagtcctgggaaatccagagctcccctgtccagtgcagtagccactagccatgtgactgtttgaaataattaaaatttaagcttgtttttcactccagccgcttgtccagtgttcagtggtcatgagggtctagtggccaccatatggacaaggaagaaatgtgtccatcatctcagaaagtgctactgggtagtaccgagggtcagggtggctgcacatctactttgctgtgaaacaagggcagatgtagtttggattggctagccttccagagttctccatactaacagagactgtaatagcaacagaggccacatggcccaagctggaaatattttctacctggccctctgcagaaaaggcctgccaaaccctggtttggagaatgggtttccactggggtgggaagcattgccaggagctgggaggctggtgaggaggcccaggcagaagttctgacagctcacactgggaaacacgtgggtatttctgagaaatattttcgaagtagagttcgtgagacttgcctgtgaattagatacaaggggtgggtacagggtggagaggacaagagaaggatggcgtggggcatctggtctggctggacagctggtgggtcatggaacactgaacctggtgaaagtaggtgatatggtttcgctgtgtccccacccaaaatctcatcttgaattataatccccacaatccccataatctccacgtgtcaagggagaggccaggtggaggcaattgaatcacaggggggcagtttcctccatgctattctcacaatagtgagttctcacaagatctgatggttttataagagactcttcccccttcacttggtacatgtccttcctgccgccttgtgaagaaggtgcttacttctcctttgccttctgccatgattgtaagtttcctgaggcctccccagccatgctgaactgtgagccaattaaacctcttttctttataagttactcagtcttgggcagttatttttagcagtgtaagaagagactaatacagtagggatctgtctggattagtgccatgtccacagcttctagaatagtgcctggaacccatggttgttcaataacatttgcaagatgggttgatggttgaatgagcaagagggaagggaaggctcaggagaattttttgtggggaccaagattcaagtttggatgtgattggcctccagatggagatgccagtgtggccaactggtaacatatgagtctggagctcagagaaatggtccagggttaacagagaaatggaatcagttctgaagccaaaggagtggatgagaatgacctgtgagaaggttagacagggaagaggacctaggccttcatcctggggcagcccaggtggacattcagatgcaggaggtgggacctgccagagaggctgagcagaggtggccagagctccaggggagaaccaggagagtatgtgtcgggaagccagaggggaaagtgttaaagatggtggatggctgagtggggtggccctggctcagtgagggggccaggccttgctgggtggagatgcagtgttaaaggtcatctttcataagtttatttttcaaaggagcagataattgtaactaagctgggagtatacatgaggtcaagactgtttggtttggttttgggtagaatattttagatcttgttgggatcctgaaaagaaggataagtcagtgatgcaggccaagcgggacaacctgtcaatagctcagagggatgtggaactggcccaagtcagtgcttatctagtgaagtcttatgtggagatcagacatagaagatagatccagatgattggctggggctgacccagaagtgaggacactgaccccaggctgcccttcctccctggtatgaggacactgaccccaggctgcccttcctccctggtatgaggacactgaccccaggctgcccttcctccctggtaatgcttcctttggtggcacctctgagcagacccttggagcctggttcagacgctggccacattgtcctggaggagatgagtcagaggagtgctgagtagctctagacaaaccttccccaccatggtttcatgttggcctttccatacttgtagtgggcaggttcgggtattttatacagattattgtacagatgaggagactgagactcactaagcaaggtggaggccaaagtcactcgtctgtaaataggtcaaacgtatggaggaagggggcggatgctggatactggtgtaattgaggccgggtgagccagttccgtgacatctctgtctcccaaaagcaggactttggaaatgtgctgggtgaccagtaccctgagagcgtaacccattcacaaagaagcgttcaggaacaagaagtcctgtaaacccaaacaatcaaagcagggtgtggatgcaaggaccatattaaaggacttcagaataatagatgtgtgaatatctgaaaaggggtgggacccccccaggaagaaacttcctagaagaaaactaggcctgggctggctactgagagctcaccccatgcctggtggtcttggccaggaacttggctgccgaggaaatgggctgtgaagtgtggtgtcccaagaatgagggtgtccacttgcctgtgctgatttacacaagacagaaaactccacaaagttataactggaacctacatagagaaaatgggcatttctgtgcttacctgtggcttaacaaggacacctcacaactatttttacctagaaagcataaaatatttactttgatgttgttatcagggcaaaacttactaagtgaaacaactaatcagagttgtagactcttagacattataggttacaagtcagatgacataatgacagtctcaaagcataggagtcttaaaccctttttaacaagtaacacttttgaggacagtttaatgtaacaagaaaaataaaatgaaaacagcattttcatgtgggtatccatgcagaacaagagtatagagccagttgtaatggttgttctcagttcaggccaacttcataacacagagctgagtctgccgtctgcagctggagtatgtgttgttgagggagaacaacacatactccatctctgctttcagagattttgttctccaggcattaggagggctggcctttctgagataaggactccattgtcatgaacttaacataagaaagggctgggaatgagagtttaaaacttccaacatagccaataaaggaacggaaactaatgatagctaatgggatacaaggagcgtgcaatatttgcatctggtgtttagctggaggctctctgcaggcaggaattaggcctgttgtaacaccccctccctgaccactgtgttttcagcaccatggacagcacccaacagctcttgggtacctccagaaacagcagctgatagatgaatgaaccccataggagctaacacagtgacccaaggacaagccccagctccactaggcttttcccttagacatacagtggggagagtgttcgtgtgttcttcattgggtagttgtaaaaactgaataagatgatgtatgccaggtgccttccacaggccttagcactcaagagtgtgctgagagggcaggaagtgagggagtgctggtcccagggagaccatctctcttggatcagagggaaggaagaatagagatgctggggacagcagtttgcatttgagtcagaaatccaagaggagccccggtctgatgacctcagtttcccctgtaaagctggaggtgaagctgtgtggtgggagcaggcaaaggtgggaagctggaggtggggaagggacagaaagggcttgagcagtcatgcagagcacctgcaggaggaagctcctggccacgggtcctgcagagtgacagttcttcctgaagtggactccgtaggctcttcctcctgcaatagtaggcaagggcaggagcagacaagtggcagcttaatccccagatgaaacttttccagagagttaaatggaaaggaatccaggcaaaggacttagggactgttggtccgattgttgttgaaataatggatgatggaacccaagccaggcaaaaagagaaataagaaagggaaggattgataggttgagggaaagctggggatgggcaggctgaggggtggttgtgaaggaggtggatggagcctgaatcagcagctagaaagggagggatgagggttctgggtggcctgacccttcctccaagtcgatccttcctatcctcactcccactctaggctggcatgccagatgttagggctgctgcaaacagacaaataagaatgagagctgctggactggagggttacactgtgtcatggccacttcttgcttaaactgagaaacaatcctgtgagggactattgttaacacaatgccatgcatgagtaaatggagttttggagagatttagtaacttaaggtccaagagtaaattcagagaccacttgagcctgggtgtgtctgactccaaaacctggcatggtgaacactgctcctaggtgaggtgggagctgtggcatggacctctcatgtggaaaaaagaatggaatccctcatactattgaaatgacttccctctctccatattcctctctctgcttccgatggttctattgagagttgaacttgcaggaagtcaagtgcctgtgtgaggtcactgctctgtatgctcttcacgatcccatcccaccaaaccctcttgctttgctctcttacttccactgctgtcagaggaaacatgtttttaactctctgctttgcctttgaaccagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggtgggtccacatgcatcctgcccattctatttcctttctctgccccatccatccatctatcctacattcatccacccatccatcatctatctatttattcacccattcactcatccatccatccataccttcaaccagtcttgattgggcaccaactgtgggctggttctcatcattagcttctgtgactggggctcagggcaggcccagaggagtagatcttaccaaggaaactgtggttggcaggagtagactgcctaggctccctcaagcaaacaggggagtctctttgcaggagtcaaaggggggatcttccaggacctgaatgcaagaggtgcagccagttcccaggatggggcttggctttagcttggcttggcttttctttttcttttttcttttcctttccattctgttcctttccattccattccattcctttcctttccattcctttctgttccattccattctgttctgttccattccattctttctggatgctcatgtgtctgtctttctctttgtgcttctctctgagtctcagtctctttcagtcagtctctctcccttcctccctccctctctctgctggtctctgttttgctgtttcactttccagtgagttctgtccagcaaggcagagccaggagtaaacagcagacattggtggtcagataggggtgcacagctggacagaggcccccacagtcatacacttatgtagcttttgtcacactggcagaataatcctagcaagtagagataattactttgcaagcttaggtattttttatctggaattgactgctacaaacaggacacattgatggtctcagggaaaaagtaggctgttgatcaagagataatgacttttcagagtaaagccttgcgtgctgtctttgaaggctgtgggcgtgaaacatgatgcatagcagggtttgacagttttgttacaatcacctaaccagtgattaaccaccatcaataattgccatttgctgggtaggcacgaggtgccccatttatggttgagaaaacaggctcaggaaactccagtaacttgtcccaggtcctggaaatgattgagacttttgaacccagtttttgggcccaaagcttgttgctaccacacgtgtggccaggggctggtgccctcccctctgcgatctcacctaatcctcattgtgcttcttcccagttttcatgaaagagggaactgccaccttttggaagaggtgtcagctgctgagacaaggagagcccgggcatgagctcgggagggctgggtcccagcccttggctcttttctggggaccttactgccccttatggggtgaatgttcaatctggaggggactcttgggtggaaaatgctttcagtggggcattttccttgtacacctaacacgaattaagtattccagtctaactgatgattctcagccagataccacagaaacggaggaggtgagatgcaccccacagggggcctctttagctgggactgcagatgtcctggatgggttagatgtggggctgtggtgccctgtggttccccaagtagtattggtttgtgggagaatgtgctgctgggtgggtggagggatgagtgagggggcgcccccgccaccccaccaccctgagacttggccccagctgttctccctgacagaacattctcccttcctgctttgcctggtcagtacctttgcatgcttgggaccacagctcaagctgtttctcctccaggggagccagccctgacccttgacctcatagcaccatgcgccccatcttccagcatttaccacattgccccaccttgtttagtgggttgaatggtgtcaccccaaaattcccatccacctggaacctcagaacatgaccttgtttggaataagggtctctcaactgccattaagttaaagatcaagctgagctcatgctggattcggttaggccctgaatccaatgacagtgtccatgtgacaggcaggacaggacacacagggatgggactgatgcatccacagaacgccaagaattttccgggggagaggcctgggacggcatctccctcacagcctcagaaggaaccaacgctgccagcatcttgatttcagacttctggtctccaaaactgtgagagttgttctgttgctttgggctgcccaaggagccatacacgccttgtctgttggatggtttgcctctctctaaccacctgccccccagacagtagtccctgagagacggccacacgtctgtgttcactgtcaaatccaagtgcaggcatagtacagggcatacagcaggcactcagcaagtgcagatgatggttggatggatgaatgaatgagtgaatgaatgcatgcgtgctctgaaccctgtctgtctgctttctgcatctttctacatctctgtagatgaatccaaatattcagtctttatgcaacatggccacataaattacagtacaaagtttgaggcaaaactgtgctactttgcattttgttattgtctttgtgatagctccctttttcctccattgaaacctaaaaccatttaaagtccattcaattagccaccatccacctcattttattctggcgaatgtataatttgttcctggccctcaataacttggtaacccagagagtttcctgcctctcccaagcttgggaaggtcgagcctcagatggcacaggtcttcattctgactccacacgccctaaattctggcgttctgtccccagtctgcggacacttctggcttccgccctgccctcagttgcaaggacatcaggggatactctgacacttatgcgtttccatagggactgaattgagactgggaggtggaggagggtagttccgagctatgggtcctggcctggcttcttcctgcacagactacattttggtgactttgatttaattttctcagttcctctttttccttttcctttgggaaaaggttcatgtgcttcagcatgtgaacactagatggtagcaaagaagaaagtctccttacctgggcttcccttgctgcaggagggaccctggcccaactgagtctccacccaaggcaggactgcaggtgtcttagttcatctgagtgacttataaaccacagaaatttattcgtcactcttctagaggctggaagtccaagatcagggtgccggcagatttggtgtctctgatgagggcttgcttcctggttcataggccaaattcctggactttcttgaaaagtcttcatctctgatcaccctctgagtcactacaggcccattaaggtgggcaggttctcctctgtgtgctgtggtccccaccctgcccccatggagaaattgcaggaggtcctttgcattcctgggtttcacctgcctggtccctggagatgcgtttacccctctcccttttacctctcctttacccctgctgtcacctggtccagttggtaacgctcaactctgcgggatgggagtcccacagcctctgccaagtgtaagtggagctgggtgcgatgtgctgttctcagcccccaccttttcctggcagcctgcccctgaggtggcttctgaacctcagcttcctcatctgtgaaatgggggtgacaagtggtcccctgcacaagctgggtggggcgagccaggcaaagctctatgggggccgtgggggcagtgctggttgtcacatctgtgattgacagtggggcagagacctgggtgggatcccagctccaccaagctgagcgagagcaggcaaaccacgctgcctcagtttccctatttgtacaagagggctagtgattccttcctcatggggctggggtgagaagtagaggcaatgatggttagagacagaggggctgggggatgctgcgtgtcacctgcgtgtgctcaggagtggggcactgtcctgagcaggagcagcctggggaggctgaggccagtggggagaggacagcgcagtgtgcagaagctggggatgggtctccctgcagcccctgccctgcctggccacttcttgcatggctggctccttgtcatttctcaggtctcagctcaaagtttccctctgcagagcagcctttcctgacctccctctcccaaaccagctaccacctccccccgaccagcccagtactctcagcccacctgcgtggtgccctctcgcccccctccctccaccactctctctcccagcccttttctctccctctccttctgtctccttctctattctacaatcatctgctctctttctgtctgcctggcctctgtctgtctccaccagctgacggcagggcctggcccgtttccctgtggcctggccttgtgtggccaagcaggtgcttgtagagaaagcgaaataactaaagtcctccacgaggtttacagtttccttttgggttttgaggaatactttttattgatgctgtccacatcccaggattgtattggaagtttgtttctggtttttagggaatggggtagtttagatctggttgttttgctggtgggattaaagggatctggtgtttgcaccagtcctgccaggacgcttttggaatgagagtttgtgctgaacacctaagagcttctgggcctgtgccagctgctaggctcctgaaaaggagctgatggtctcattttacaggcaagtaggctaagcctttgagagcttcagtgacttgcccagagtcttgcatactgggaaatggcagatcaagaccagaggccaaatctgcagaagacaaagcccatgctctctgctcttccgggcacctgacaccctgctggcccggagcacatgcaggagactgtcattgatggaaggagggggtgtcccactcatttagacttgaatgagcaaagcctgtttagaatcatcttcaaagtcatttcatgtacacaagtgtttattgcccgtgttttaagtgccaggcctggggaaactgtaggaaggaaggtggacacaggcctgcccaggagcaagaaacagactgggcagcgtgattcactccaagtaagaggaaaagtgtcagggcaggctcaggtcccaggggacaggagacgagggatctgatcatggcctctctaaggaaatggtattctagcagaggagcggggaagcatttcaggcagaaagaacagcccatgcaaagactcaggttggacggagtgtggtgccttcaaagacgggagagatcttcacatgctggagtgaagagagtgaggtggagatgcagctagggagccgagtggggccacccccaggggccttgagactgggccatgagttcgaatcatgtcctaaggaagatgggagagtgatccaattcaccttctggggtgatcctcctggcagagatacagggagagggttggagcccagaaatttattccttactgttctgggggctggaagtgcaagcccaaggtgctggaatagatgctgtggggagggcagagcggaccatggtgctcatccaggctgaagggtggctgcacagattcttccgggtttcccaagaacaagaagcagcttcaggaagctgaattcatagcagagaagcaggaaggaggcttttctaagcccagcgccctgcagggaggatgctggtgctggtgtctgcaaggcttggcccctaacagggtttgccctacagatggagcagaactggacagagatgcaccctggcctctagctttgggagcagggatcccggtccagcatcttggcattagttggggcccctcctggaggtgcaggggagcgtcctttccgctcatggtccccagtctcagcaaaacccttggtcccagctcctgaagacctatgttcttgctgcttcctcccacaccccaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacaggtgaggccctgccccatgagggagacctgtgctgccagaatccctgcctggccagcctcaggctgtgcagctcatgccacgcccagggccttggctgggtgtcccgttctacagtcactttctgaacaaggaagtcacattttcattttgcacctcgctctgcagattgcatagctgatcttggttcccacattctgggacggggtgcacagtgaatgtgcactatgggaacctggccacaaagtcctgtgcgtgagcccctcaggacccagggtggggtgggagctttgcaggagagactgacttagagaaaagtggccgttccactttgtcccaggacactgagggcttcatagttgtcactgggcaagagtgtaaggcagcctgtgcctgcagcttactcttattttggatcacatgtgtctcatggactgtgaaagattagaggtaaaataggtaataggagacagtatgggttggaggaatattagacaaacaaaatgtccttctcagtttttgtgaagtcctcgccctgaacattgattgcatgtattttggcaggttttattacttgcatgttctgtgcttttcaaaacagcatgttgtaaacagccatttgccttgaactcaaatcctcatgctccttctggtgtgtccaggataaaaaccaagaggtcacatgcattttggggctgcctctgtgatattcattataagctccaaagtcaatcgtgctgggtttctgggtgaagggggtgacctataacctgaaccatctttctggtttagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggtgaggaaaggatggcccattaagtgtggggatctcggccagaggtctagtgtcaccagggggtcgaggacagagctcgtgcctgggggaggaacaggtcgaggggctgcacctggggagaaacaagaggggggctgtgtcctctggaaatgagcttctcctgaaacaagctggggtgggggtgcacagccaggcttagagcaaggaactagaaaataccccggtgaaattgttttgagagttgcatattagttttcatgtgtatgtgaaaaaaaaaaacaacataaaagtggtgaagcaagtgacttagagaatgccacccctgaggatgctgtggcgaacagtatatagttggtgtacagatgctcagtgtacagaagttatagcaaaaacaaaaacaaaaaaaaactgtaacaagtaaagcaggacgagatggaagcagggggagagggaggaagagagattgctctattgatctcaaatggccgtctcagaagtgctgtggatgggacaggcagcatacgcttgtttgggagcagatgctcacagggtccttggaagccagctccgtatttgtcctcatggtgcgttctcccatgaggtaattgctccatcctacccttgaggactccggggctcgggacgatagaggcctgcagaccaccctgtgatgaagggagaaggaggctcaggccaggaggaggaagtgctgagggggtttccctcccagctggtactggctgtgcggggccctctgattagtcccaggaaggtccagggcggccgtggtgtttggcctgcaagggaaggatcaggaagcgtccgttgctgttcttcctggaagcatctcatggtgactgttgcgggcatgggcaaagctcaggccacgtctccctgggtgtctgtggggagcaggaaagggcatcagatgtcggtgctgaccctggctggtactgaaggcatgcggtgggtactgtgatgggtggatagaccggcagcccagggctccatagcctcccgcttcctgctgctttggagcctttccaccgggtccgaggaagcaattctgagtatgtggctgcacaacatgaaaggggtgggggtgctgtcacctgtgcgtttggaggaggctgactgccaccgcggaaccagtgtctttgtggcagaaactaggagctggtcactggcctgagggcaccaacctctctgaagaggctggagcctgtggtgttcccaaactcgttaggccctggaatccttgcccttaaacacctgtgagcctccagcaggagggtgctatgagggtgcacttctgagtagagctggtgttgggatggtcaagggctagagcacggtccctcagcctcagcgctggtggcaagaggccaggcgattctctgctggggagggggctgtcctggacacattaggatatcctgcagcatccctggcctctccacactggattcccccagtgaagacaatctaaaatgtctccagacttggccagatgcccctgaggggcagaatcacccccagctgagaatcactggcatagtctgtgcccttggtttgggggtgcccttccataagtcccttatccactccaggacacaatgctttcattggtgaagagggagatgggaactgcttcctcttgacattgacaatgtcagcagccagggccccttaccgggtgtttcttgtgtccgggatgctggtctaaggttgtgacaagaaaggttttatcctcacaggagccccatgaggctatgacatcatagtccttattttacagatgtgtaaactgaggcatagggaggccatgtaactggccatggtcatgcagctcgttggtgccaggctgggacttgaacccaggctgccagcgccagctttccgctctgtgctagaccctctctgaggatgagtggattaatccatgtcagcccttggcacagggcctggctcagggtgcacctcggagagcacttcttcctgtcctcaccagccacacggggaggatagcccctggggaggacagcccctggggaggagagcctctggcccagaagggtctcccggcttgactttcctttagggcattgttaggccatccagatgcagtgtcctcacgcctggcgttaaaggtataatgcagtcattttatttaaacacagaagaggatgggaatctgcatttcacctctcgggagcctcaggcctggcccggatatgacctcaaaaccctctgtggcagcgtggttgagccagcagcgtggttgagacacagagtttctgcactggagacggcatcaaagcacatctagcagcacccttggctcccacctctgtccctcccgcccagtgccttccttctctgattgagtgctctgcacagggacgcctcctgctcagccaggtggcctggtcacagccagctgtgttagcctcttgtggctgttgtaacaccttatcatctgctgggtgacttatgaccacagaatttactcttctgcagttctagaagctagaaatccaaaatcaaagtgtgggtagggtcgtgctccctgcgagtgctccaaggaggagccattctcttccagtttctggtggttcctgcattcttggcctgagaatcccagccctgcctccgtgggcacatagctgcctcctctccctccttcctctccccttcatatgaggatagtagtattgcaggcagggcccatctggataatcctggatgatctcctcatctagagattaacttaattacttctgcaaagatccgatttccaaataaggtcactttcacaggttctggggatttggacttggcacatcttttagagaaccccctttcaaccccctgattccactcctcttggttaactcgttcctcttctcattgagctaaagctaggctctgggatttgacccacaaagtcccctccatccctgagatctctgtggctgggccggtccatggcctccaacagaatgtgctgtgaagcttggacttggccctgggcaggtccctcccctgtccctgccccatttccttgttgtcagacgaaggccctcattgttggcttctatgacaacactgaaccttccttcctagctgggacacagttgcagattcacactaattcttgtcattctctattctctgtctctttgctacctatcaattacttattgttgactgtctaattttgtctgtatgagggatcatgctggtatctgtctgtgtcccgtggtgtgtccatcatcccagggtacctggttctaagagtcagtaagcacctgttggttgtgtggctttaaacacatctgtgaccctgatgaatctgatttgtccctccagccgatggcccctgagctccagggtgtctctgtggactctacgcatgcgtccacgtggggactggtgtgcattgcatagcttacatctccagatctcggttcccatctgcgccctgtgctgggactcttctccatttcaatcaatacatctaagcctcctgtgaagcttttggctttgtgctgatgtccggatgaccctgaagtcctctctgttccccttggagcagttcgcgggtccagccaactccctcttctctggcaatggtttgctgtgctctcctgcctggacttggcctccaggcggtctctctgtgccaccattgccccatttctagttcattctccacacaggtggccacaggaccagggtctcatagaagttggataatgtcacctcttgctcaaatccctccagtggctccctgaggcactgaatgccacatcctccctagtgcctgtggccccaccccatgtggcctgcctccctctcccggctcgcctctcccttggacccagcccatgggcctctttgatggtcctcacaccccaaccacagcccctgagactcttgctgtccctggaggtgtgcaaggctccaccgcgtttaaaacatcgctcagtgcaggaagccacctggccgctgtgtggcaacacttggccccttcttctcacccaaccttatttcccctacggcagcgtccctgacgccaataccattggctttgcccatgcagcctctctaccagcacatgggctccgcgagaccaagtcttcgcctctgtagttcttactgtgcgcacagctcacgagtgctaagtgcaaaataaatatcagttacatgaatgagccagaatgggccaatgggggattagagaagccagtgcctgtaaagtactaacaggtgccaggtccagggagccctcatccctggactgtttctcccatggcgtggctcagacctgagcctcttgttatttgttctcgaaacccagtgtctgtaagtgaacacggattttgagctggggtctgagagtgggggaaggtagcactcattgtagaaactcattctggaaactgctgtcgtgaacgtggcccaggcccaccgctgtctgcaccgtgcaatgtgttacatggggtgtcatctgcaagccctgggtgaggccccctttcctccatgggccttttgtgggccaaggtcaggattcctgtctgaccctgagaaactccttgttgagggctgggctcattgcacaaactggcaggtatgtctgaggtgcaacctccagccatttgcaaattgaggcttctgtgtgctggtcccagggtatagagtctagggtccctgaagccctgaaatcaagtgcagaaagcagtgctttgcttttgtcacattctcaactgtgtccccaatgctccagaagtgatagatctctgagataaaatgctgtgggaaaattcaatattggtcatacagaaagtatataaatgttgctttttggggggaaaattactcacagtaggaaaggcctgtaagagtattttgctttgcctggtgcagacaatggtgaataatggttgttatttgcttctctctgcagtgtgttgagttcaaaccccattcccactgtctcgcctgatacattgttttcacatctccatggggtgaaagcagaaagcaccaggcagcaaattaatcaattattaatcgcaacaactactattttattcatttattcatttattctccctctctccctctctttcccctgttgagggaggtttggcagacgttgtcttatcccatgtgaaaaagaaaatttttgttatcaaacgtttttgtgaacttcagttctctattagaatggagaatgcatctgcatgagaatttaatttttggaaatggtggaggccctatgcccacatgcacatgcgtgcccacacacacaggcttgcacatggggtgccttcgtgggtatgcctggtcagcggtgggtgagcagggccttgcgctcattctccagtcatcaaaagcgaattttatgagaaacagtctttgtgttgtcactgccccaagatttaagttttaaaacctgtcaagaaaaagatgtttgtgttttgtcttttctctgtgctgaacccaagagtcatgaccacacctgtctggtttttcacagtgtcccagctctgggcgcagtagaaacacgtgatgagggggagcgagggactgaggggctgctatgggaatccgggctgcaagggaagaacctactgatggaaggaagctgacttctccagagccccccagctgcctgtgctgctgctcctcctgcagacagcttctcccaggtgctcatgacagcaaggctgcaggctaggactcaccactgtgtctcacctgggcccatgtaaggacagcacaggccctccacttcatccatgctgtagtcttagtccctttgagctgtcataacaaaatccctagactgggtgtcttataaacaacagaaattcattcctcacagttccagagacagggaagtccaagatcaaggttctgacacgtggggtttggcaaggccccactttctcataggtggtgccttctatgtgtcctcacatggcagaaggggccacagagctctctaaggcccctttcctaagggtaccaatcccattggtgagggttccacctaatgatctaatcaccttccaagaccctaccccccgaataccatcacattggggttaggcttcaacataggaattttgggggacacaaacatctggcccctggcattgggaatgtcacagggagggctgtctgtgcagctgggtgggcctccgtctctggggcttactctgcgtagagagacttgctgcaggatttgaccaccccacgtgcctcgacatgtttctttctagctctgtgaccttggaaaagtttcttaacctctctgtgcttcagttctatcccttgtaaatgggggtgacaagaaagttcttatgaaggtcaacaggggtgctcaccgaagtatagctttgtctcattgtgctcagtgagcgttctggttgccgtggtaatcagcactgtcaccctcatcatcactgtggttaaggagcatataggaacaaggaagcactgggcatccaccgctcatcaaaatactgcctcacaggcatgaagcaaagtttagctcccagtttgtcaatgttccgtagctgatttgtgctattcctcattcctcggccaattcatcagtgagagtgttgatgtccctgccgctgcataggtacatctgttctccatccagacatgcagttacatgtgtttgtgtaactggctgtggttttgcttgcctgcttagcaagggacaagggcaaggggaattaatcaccggggtctatgtgccaggacaggctggcggggacctttgggttggtcaggagaaacaagcctcaagaaggcctctcgatggcacctgccatgagccacccgtcccagaccaggttgggtaacccacggcgcccagcctcagattactctgcccattgggatgaccctgggcaggtggtggcacatctgggccctggctgcctttcggtagctcacaggtgatgtcagtgacccccttgtcaggttgtcctgggggcggatgagacaacgctcatggagggcctggcctgtgtgggcacatggcgctcacgtggtagccctgctgccaaggttttctgagggtgtgtcccagcggcaaaagaaaaaaatctgatatttgtacattatttatttataaactatacattaggggtaccatgctaatatactgtgtactttataaaatatacatgcaagatagtaataaaaggtgacccgagagagtgactatgtacatattaatatgttctagcacagcctgccccactgtgtcctaggagtaaggccctaggaagtatatttcagcaagcacaggggggttctagtgctggtgcaggagtgaaagagtaaatcctagcccccacaatcccatgagtcaattccagtcagctaggcggtacaagagtaaagggacatacgggatttcccggctttatagattttttttaaagcttcttaagacacacccttgctatgtattcagcaagtactatatgtcccaatctaggcctcaaggattctaaggagaaactagacacagtctccaaccctctaggagctcatgactgaccttaaaagctgatgttcaccataaactcaacaacgcaaaagagggctgggtcgggagttgaaaggtgtattagtccgttttcacactgctgataaaaacatacctgagactgggtaatttataaggaaaaagaggtggttgtttttttcattttgttttgctttgttttttgttttgttttttctaagacagagtcttgctctgttgcccaggctggagtatcgtggcacgatcttggctcactgcaacctccacctccggagttcaaacaattctcctgccccagcctcccaagtagctgggattacaggtgcataccaccatgcctggctaatttttgtatttttagtagaggcagagtttcaccatgttggccaggctggtctggaactcctgacctcaggtgatccacccacctcggcctctcaaagtgctgggattacaggtgtgagccaccacacccagccagaaaaagaggtttaatggacttacagttgcacctgcctggggaggcctcacaatcatggtggcaggcaagagagaatgagaaccacgcaaaaggagttttccctcataaaaccaccagatctcatgagacttattcactaccacgagaaaagtatgggggaaaccacccccatgattcaattatctcccattgggtccctcccacaacacttgggaattatgggagctacaattcaagatgagatttgggtggggacacagccaaaccatatcaaaatcctaagacaaatgtgtgacgccaagaatgtggtgacacgggcatttgatgacatggagaacgttacacggagagaggcaacactcaggcagttcctggtactgtctaaatgtaaagaaagccttctttgcaggctccgggatcctttccccagtagacatacttgtaaaaagtgaatgctaacgtgttatttgaatgccattttaagtgtggggagggtgtactgaaaggcttcgtgcagtgtatgcttctgtaaagtgaagagccacctgcagcgagtgaggactcccccacagtcgtctccatggtgacttcacagaacagcaggcagcccctgccttttcttgaaagttggggctagagatttgaaaggctgtggaaacccagccactccctgcactgacaccagatggcgctggagatgctcgctgggatgcaggatgcttgtgagaacctggtctcaggacgacctggtgggcgtcttgcagcggaggcaggtctggcccagggtggttctggctgagcaccaagcagcagagctctcagagtgggaacgcacagccccagtgacaatcagctgaaacagggctgccccccgccccgccccaccccggcccttttttttgtttgagctattatttcccatcaagtaccttgataagcacttttcatgcattttattgcctaagtcccttgacaaggtgataagacagctgctattaccgctttttttgtttgtttgtttgttaacagtagaggaaaatgaggcaaagagaggggatgaaacttgcccattttgaatccagggctttccagctccacagcacatgactgtagcctactgttcgtccaatgcgtaagcacatcataggtgccaggcactgccctgggtgctgtggacacagtgatacaagccagggtcccagcccgcaggtgcctgcagcaagggggaggcaggagcccccaggaggtgatttcaagattggggcatgagcaccagatggacacaggcaaagagtactctgtgatttgtgcatctgaaagcagctgttctgggccagccgtgtgctcttaaaagcattggtaggaactgtatccgtctccctggggcctgggcctctgcactttgcaggctccgcaagggtgaaggtcaatcttgtgtgtcctcttggctgagctgttccacccagctattgaaatgctagtctgcatgttgctgtgaaggtattttgtagatgtggttgtcacctgcagtcggtgactttaaggggctttgagtggccctctccagtcagttaaaggtttgagaataaattggagtttcccagagaagaggaaatcttgcctcaagactgcggaatccactccagccgctggcctgccctccaaatccaggactgtacagcccccgcaatcgcatgagtcaattccttaaaataaatgtcttaaaacacacacatatgcacatatatgtgtgtgtgtggatgtatatatatatatatgtgtatatatagaatgtgtatgtacaaacatgtatgtgtatgcatatgtatatgtgtgtgtggtgtgtgtctatcccattgcttctgtgtctctggagagccctgacccaaacaccaggtgactctcaagagctgccagggtggagaaccaaagctttaaaatgaggagtcctggtcatcaaggtaaaggctttccacatagggacagcttgagcctgggcgtggagatgagacgcgtgaggtgcacagggtagcgtggttgttgcatagcccagtgtgagacctagggactggccagggagagagacctttattcaccctgtaaagaaagctggaattcaaaagacaccaaagtgtgaagcctctgagggttgtcccaagtcactcacctcctggctatgtggccttgggctacactgtgggacgttgtcatctgcaaaataggaaaactaaatcctagcacctgccttatagggctgcggggagatgacatgggaaacgcattcaaaggctgcctctgggcctggcataccgcaagggctcattcaatcttggctgctcttgctgccactggtgggaagcagtgtgggatctcctgcagctgaactgatctttctggagtgcagacctgatgccgtctgtcatgattcaagccttggaaagggccccaggactttccgagggtgggagggtgggctccagagaaaagacagggaggggccatgaggaggctcaggcaggaggggatggggtctgcagggagtgtcagagtcagctccagctgccgtaacaggataccacagagtggatgcctgaaacgacagacgtttgttttcttaccattctggaggctgaaagtccaagaacaaggtgatttccagtgaggcctctctctgtgtctttatagggccgttcccctgtgtgctggttggtgagagtgggtgatgagtactctggcctctgtttcctctacagggacaccagttccatcagatcagggccccgctcttgcaacctcctttaaccttagttacctccttacaggccctacccacaaatacagtcacattgtgggtcaaagcttcaacttgtgaattctggggcagagcggtggtacacaggtgaatcataatgtgggagactgaggcagagaggagaaactggcaggagctggggagtggggatggtgctgctggactccattcttgcagctgtgggcccctggctgcaagagaaagcgcagaggggaggaagcgggagatgattcgccagcgacctgagttgactagagaggggccctgcccagctccacgctgacagggaccatatagtcagtcaagagcgtttattgagcacctcctgcatgcactgtgaggaaagccaagtcacatccacagaggaaggccgtggtcagcagcaccagcatctgtccagtgggtgtgtccctggcatgttgcaccagcacagcgtgtgaggtccgatccttaaagctgcttcattttgttttccagcagccctctgcatcccctgcttctgcatcccctacttcattttgttttccaacggccctctgcatcccctgcttctggttttccaacggccctctgcctcccctgcatccccaggtagcactagacttttctgtttatttgcaggtagtgaactgccactgagtctgagtcgtaaacactgtttggattcagaggtcagaatatccttcccctgtgatgctcaaacttctgagtcagttcggtgttttgccagctccctcctcaactgagcccctctgtggcaggaggcctggggctgggatcctcccctttgccctgctcattccccagcttctgcgtgtgtgcccccagggagtgcaggctagcctggtgtctgggggccttggctgggctctgagctctgtgtggccattcagtttgcccacttgggtcccagtctgtggggctggcacctgctggaggttcaatttcccttcaaaaaaggtcatggtgatccctctgagaattactttgagaacctgacaactcaatgatgtgagattgcctactccaaggcccttctgtgggggacagcgagggctgctgtggcctcctgctcctctctctttaagatgagcaggtccatccacagcagcccagggagcagccctgggggcagagccatcaaggacctggtggagccatcctgaaacttcaacaggtcagggtggccattgtgcgcggcatggcacttagcacagctgagcagttaaaggggtatatggagggccctctgtgcagttgacaggtgtctgtggagcactctctgtgccattgacgggtgtccatggagcgctgtctgtgcagctgacaggtctccacagagcactctctgtgcagttgacgggtgtccatggagctctttctgtgcagttgacagatgtccgtggagctctctctgtgcagttgacaggtgtttacagaagtctttttctgtgcagttgacgggtgtccatggagcgctctctgtgtagttaacaggtatttacagaagtctctttctgtgctgcttgtagaagtcctcaacaatggtgatcttcactaatcactatttttttttcaggaagtatgcaggacttttgcaatccaacgtgcgtgtgttattttaaatttcatggctatggtggcagtggtgtcagagtaagggaaatcatgcagagtggaagcaagaggaaaccctgtcacttgtgccctattctgttgcaaaaccatgtcccagtgctggcctagacacacggggtaggaaaatagacaccacgtttttgtaggaagattggagaatagtggtctccttgcacttgacctgctgtgaagagttgatgttaacttcttggtgagtatgtaaattacatccatgggcacaggcgttctcgcagaggatgccccatccaggcctgtgatgcaactgcagtgccctggcaagtgcactggcttccggggctgggctggggagggcactgagctgagatccagaggaggagcagaggtgggagggtctcacaggctcagaagctccagggtggaaggaagcccagcctttgagggacgaaagggaagaagacaggcagagatcattctggagaagccagtaggggagtggccatgtgcagccttgtctactatgccagtgatctcactctttatataaagaaaatgcacaagagatatagggacatctttgtggctgttgttctgccaacaaccgtggcacacacaaaaaccctcacagcaggagcccaggaggagaagagagtccccattccactccttagacagcccctctggccaggagctggagaggagagtttccagtgccattccttagtcaggcgccctgggctagagctcaggctttcagacagagcctgacttttccacacccacttcctactggtttacagctactgtataaagcaaagcaccctcactttcctctttgtgacaggtagtgatgctttttacagaaactagactttatagaagcctggaggtgtggaatggtagagatccacaggactctgtagtgaacatgcaacaccagctcccatctgaaatacacacccacagatgcatttttccgttttattttatttcttccataagttattggggtacaggtggtatttgcttatgtgagtaagttatttgtgagatccttgtgcactcatcacccaagcagtaaacactgcaccatatttgtttgtcttttatcctttgcccccctcccactcttctccccaagaccccaatgtccattgtatcattcttatgcctttgcattctcatagcttagctcccacacataagtgagaacatacgatgtttggttttccattcctgagttacttcacttagaataatagcctccaatctcatccacgtcatcgtacagatgcgtttttctctagagaaagttcatcagcccagaaggcctgcctgggcgcttccctttcagactgagggatagtgacacttcccttaccctcaggcacccattgcagggtctggatgccccccacgcctggcagcccctcctcccccattgttggctccctcctctcattaacctccaaccctgctctctccctggctcccaggacaccatccctgcctttcttcctgccatcctggcccctcttccctgacccgcccctaaaggtgagcaggcccaagcttcctggctccttcctttgctggctctgtgctctctcttgaggctcaacctcacatctgtccccatatgtggatcgtcacaaatctccatccctggctccagctctttctgatgctaaaacctcacatgtccatttgtccactgtccctgcagaggccctgatgcaccctgagttcagcagagccaaagctaaccttgtcctctttcccgggaaacccgctcaacttcccagatcctcatactcagctaatgtcatctccatgtttccacatcaaagcccaggcagtcccctcctccaacatcacagccccactcattcagaaaagatgtgccatgatgtatgtgtcaggcatggcagggagagtttgccctcaagacccccagagtctggtgtcggcatctataacagtgtcactgttgtttcagaaaacgtcaggcacttctgcctctggccatgatgaagcgatggtagctgccctcccactaaaatcaaacgagagactggacaaaatgaatgagaggactgtttcgaggcattgaacagaaacagtacatgcctgttatccttgagagagtggagacccctgggttagcccataattgatctccctggtttctgggggaggcatcttcctgcagggtgcagggaggtggcctctgagcagagtggtgatctcaccgagatgaggaggcagagactggagtctgggctactgaaacagctggagtttgtaggacaggaaggagctatgtaacgggttctgtgcagatccagttggccatagcctgggctatgcctatatgcagaattctacagacttagcagagattgcctgtgagcatgacagctgaaggtcagggggtgctaggagatgttgggagttcagctcaaacagaatgaagagatcttgatgaatgcaacagacttgaaatcccacaaagaccaagacttaggagtaaggggcataccttaaggctttgttcaaaaccaaaatggacctgcagttattataaatatgttagaggtcttagagtgtcaacaaaatgatcacaatgaatgaccagatggagaatcttagcagagaaacagaaacaaaaagaaaaccaaatggaagttctagaattaaaaggtacaatatctgaaaatgtcactgcttgtgcaaaacagactccaggactgttctcacacaggggcttataaagccaggacataggccaggctgggaggagttggggaatccctgccaccctcctctttcctgggattcattactccctctacccaaatgccaaagcctcatgcacatcaattcatgcagcctgaacccagcaggatccacgactgccaatcctggcttgcagtttgtgctgggaaatggctgcattagcaacgtggagacatacttccttgtaactaagactttgtgcatctctgtaattatgtccttaggataaattccaacatgcaggctaattgagaaaaagatatctcatcatgagtttattttaactccaaagcctctttgccttatgttcttatttatatacatttcctttttttctcttttttaaaatttaactttaaagttcaggggtacatgtgcaggtttgttatatagataaacttgtgtcatgagggtttgttgtacagattatttcgtcacccaggtattaatcttagtacccattagttagttttcctgatcctctcccttctcccaccacattggcatcctttttcttctctagagagtatctgagactggttctaaaagcagtagccagcccggtgatacagggagaaatagccaaaagagctcctgccaaaacctacagtaatcagaaactttgactcaggaattctcccctttctagggatcaagctgatggaaatattcatatgcatgcagagaaatgcaggaatgaggacattttctgcggctttggttagaagtagaaaaacaaacactaacctaagtgtccattcatggtgagctggaccaataaatgatgggattatgtgatgttcacactgtggggttattaacagctattgaaagagctggattaaaacaccctgctttggaaccaggaccagctgtggtgtggaggaaacagcatattgcaaagtagtgtgtatggtatgatcctacttttgtaagacatcagaattaagtgggagtctgtaaattgttaattgtgtagaagtaggtctggaagtagatactgcaaaatgttagcagtcgctttttttagaggtgagatgtgggcagagaaaggaatactatctttccttaatactattaggcttaagttgtttgcaacgagcatacattatttttgtagctgaggaagagaacatagttctttgagctttgctgggaggcagtcagctctctggtctcagctatgacctgggacaactcatatctccatgaactttggtgttcttttcattaattcaccagggaggtgagggtagaaggagagcctggtgagcacctttcagctccaccatggtatgaatgtttgtctcctccaaaactcatgttgaaatttaattgccattataacagtattaagaggtgggacttctaaaaggtgattgggccatgagagctccgccatcatggatgggattaatgctggtataaaagagtctgtctggccctctctcagcctctctttgcccttctgttatgttatgacataacaagaaggccccttgttatgctggtaccttgctgttggacttcccagcctccaaaactgtgagccaataaatttctgttcaatgtaaattacccagtcttgggtattctgttatagcagcatgaaacaaactaagatgggctctaattctgatggtcagagcaagctccctggtaggttgaagggtggctctgactgggactccccattgggaagcaaatcaccctacagccttgtcctctgggaagtcctgacctcaaggagcactgcccagaggagtggctagagggtcactctggagaagcatgtgagcacttttcttttttctttttttttttttaactgaagttttagggtacatgtgcacagtgctggtttgttacatatgtgtacatgtgccatgttggtgtgctgcacccattaactcgtcatttacattaggcatatcttctaatgctatccctcccccaccccccaccccacaacaggccccggtgtgtgatggtcctgttcctgtgtccatgtgttctcattgtttcatactgattgtatttctatttatttttgcaaacaggtggtatactcagtatacattgctcaaaggagccccagtgctactggtttcttatctgtcccattggggctgttttatgcttatacaagcgaagatacattaatatatgttaagcttttccatcttggagattaggtatcagggagaagactgatgtgagatctgcctcctcttctttgtccctttcctgtctccccactcacctaggaatagaagggaggattctgacgactagtcttagagccaggcacctctcttcactctagagagggcagctcttcctgggatcaaagtgccatgtgtggtcttcttggagtggggctatcaggaacagctgggaacaaatgaggggccttggaagcatcaaccaggtctcatctgttgatggacatatgggttgtttttagttattacaaataaatctgtgatcagcatttgtgtacaagtctttgtgtggacatatgctttcacttatcttggataaatagctagaagtggaatggctgagtcatgtggtaggtttttaactttttaataaccggaaaaatgtgaagtgatcctgccatttagagtggtcctctgatatattctcaccatcaaggtattagagtttcagttcctccacatcctctccaatacttgatgtggtcagtctttttaatttcatgtaaagaactctgtgcagatccagttggccaagggctgggctatgcctatatgcagaattccacagacttagcagagagttagaatttaatttttaattctagtgggtgtgttgtggtgtcttattatggttttaatttgcattttttctaataattaatgatgttgagcattttttcatatacttatcaccatatctttgttgggaaaatatctattaaaatcttcccatttttcaaaattaggtcaattgatttttatgtttgagagtttcattggtctgtgtgtctgtttttatgctgctttagttattataccaaaatattgtttggtaccatgctgttttggttactatagctttgtagtatatctatttattttattttatttttttagagacagggtctcactctgttgtccaggctggagtgcagtggtataaccacagctcactgaagccttgacctcttgggctcaagtgatcctcaaacattggctttctgagtagccgagactatagacatgtaccaccacacccagttaatttttgtattttttttttgtagagacgaggtctcactatgttttccagggtgctcttgaactcttgagctcaagcatttctcccaccttggcctctcaaagtgttgggattacaggtgtgagcccctgcacccagcctatagtagtatatcttgaagtcaggtagtgttgtgcctccagcttcgttcttgctcaagattgctgtaaatattcagtgtcttttgtggctccataccaattttagattcattgttttcctatttttatgaataatgtcattggtattttgataaagattgcattgaatctgtgtatcactttggataatatgggcattttagcaatgtttattcttcccagccatggacaaaggatattttttcatttatttgtgtcatcttcaatttctttcaatgattcataattttcagaatacagatctttcatctccttggttatatttattcccattttacttttttgtagctattgtgaatgggattattttcttgatttctttttcagatagtttgctattgctgtacagaaacagtagggatttttgtatgttgatttttgtatcctgcaactttatggaatttgtttattttaacagttttttggtgaggtctttagggttttctatatagaagttcatgtcatctgcagacaggaacaatttagcttttcctttctaatttggatgccttttttttttctgtagcctaattgctctggctaggacttctagtattttgttgaatgaaagtagtaaaagtgggcatccttagctgggcatggtggctcatgcctgtaatcccagcactttgggagggtgagacaggtggattacttgaggataaagagttcaagaccagcctggccaacacaaagaaacctcatttctactaaaaatacaaaaaattagccaggtgtgctggtgcatacctgtaatcccagctactcgggaggctgaggcaggaggatcacttgaacctgggaggccgaggttgcagtgagccaagattgtgccactgcactccagcctgggcaacagaacaagactccatctcaaaaaaaaaaaaaaaaaaaagagtggtcatccttgtcttgtttcagatcctggaggaaagactttcaattttcctccttcaaaatgatgttaactatggatttgtcatatatggcctttattatattgagttacaattcttctaaactgacttcattaagaggttttattatgaagtgatgttgaattttgtcaaatgctttttctgcatctatgatttaacatattaatttttacatattgaaccatgcttgcatccctgggataaattccacctgatcatgttgaaggatctttttaaatgtgttgttgaatctagtttgctattattttgttgaggatttttatatctatgttcatcagggatgctggcctatagttttctttttttgtgtccttatctggtcttagtaacaggtaatgctggccttgtagaatagtttggaaatactccttccttttcaatattttagaatagtttaggaagaactgatattagttccttaaatgtttggtggaattcagaagtgaagcagtcaagtcctggactttcctttgatgggagattttttagtactgactcaatctccttactcattattggtctgttctgattttctatttcttcataagtaaatcttggtaggctgtacgtgtccaggaaatgatccatttcttctaggttatccaattgttcgtactgtgcattgtgcaggtaattgttcataatagtgtcttatgattccttctgtggtatctaatgttccatttttcatctctgattttccttcatttcttagtctaaagatttgtcagctttgtcttttcaaaaaaacctcatttgttaatcttttgtattttctagtctttattttatttctgctctaacctttatttttttttccttctactaattttgggttgagtttggtcttttcctggtttcttgaggtatagtgttaggttgtttatttcacatcttattttttgatgtaggcaattgttgttgcatgcttccttgttacaactgcttttgctgtatctcatagggtttggtatgtttttacttttgtttgtctaaagatactttctaatttcccttttaattttgttgttgactccttggttattcaggagcatgatgttttatttcctcatatttgaaaagtttctgaagttcctcctgttactaatttctggctttatacctttgtagtcaaagaagatacttgatatgatttttatcttcttaaatttgttaagatttgttttctggcctaatatattatctaggagaatgttccatgtgcaattgagaagaatgtgtattctgcagctgctggatagaatgttctgtaaatgtacattatgtctgttttgtctaaagtacactttaaatccaatatttctctgttcattttttgactggatgatctgtccattgctgaagtaaggtgttgatatcacctgctattattgtgttgcaatttatgtcttcatttagatctaataatatgtgctttatatatttaggtacaaatttgtatgcatatatatttacaatggtaacatcctcttgttgaattgatttcatcattgtataatgaccttttacagtttttgacttaaactctaatttatcagatataagcatagctactcctgcttttctttgggtttcaatttgcatggagtatttttgtccttcccttcactttcagtctgtgtgtgtccttagaggtgaagtgaatctcttataggcagcatacaattaggtcttgtttttaaaaatctatttagccactctctattttagctggagactttattcatttatattcaaagttagtattgatgggtaaatactcctgccattttgttagttgttttctggttattttatagatcttttgatcctcttttcctctgttgttgtttacctttgtggtttgatggttttctgtagtgcaaagctttgattctttccttgttctcatttgtgtatctgctgtaatttttttgttaccatggggcttatataaaaaattataaagttataatacactattttaagtagaaaacaatgtaactctggtcacatacaaatactctagacttttaccttaccccactcccacagtttttaattatgctgccttaatttacatctttttaattttgtatgtttcttaacaacttattgtagctatagttatttttgaccattttgattttttaatcttcatactagagatttgaaagatttacctacaccattatcataatgtagattctgaagttgattatgaatttgcgtctaccagtgagttttatactttcacatgttttcatgatagtaattattgtcctttcacttctggttgaagtactctcttgagcatttcttgtaaaggcaatctagtggtaatgaatttcctcagcttattcttgcctgggaaagattgtatttcctccatttctcaaggatagctttgctggatataatattcttggttagtagagatttttttccccctctcttatcatcccattctctccaggcctgacaggtttctgctgagaagtttgctcatagactaatggggattcccctatatgtgactttgttatttttatttccttctgcttttagaatcttttcttgttttcaccttttggtggtttgattatgatgtatctgagagaggacttctttgagttaaagttatttggggatgtttgagtttcatggatctggatgtccatctctctgccaacacatgggaatttttcacctgtagttttgttaaataagttttctgtgtttttatctgtcttctttgaaaatttcataatgcaaacatttgtttacttaatggtgtctcataagtcccataggttttcttcattttttaatcctttgctctctctcttttcccctctggatgggttattttgagttcagaagttcattttgcttgatctagtctgttgttgaagctctcaatttaaaaaaattatttattgaattcttcagctacaagatttctgtttgttcctttttaaatgatgactctttgttgactttcttattcagatcataaattgttttcctgatttcattgaattttctactgtattctcttgtatcttgctaaggtttcttaaggtcattattttgaatttcttctcatgcgattcataaagttttatttctttagggtcagttactggagaattattgtggttttttttttggcagcatcatgtttccttgctttcttgtttcttgtgtccatgcattggtatctgcacatattgtggtacaatcacctcttctaattttacagattggcatattttgggaaaaacttttacctatagatgggacctagggtgtcagtagggtagagtacattgccctttgttccaggtgggtgcagtaatatagtctctgtgcaggtttttcagctgtaatcaatgtcagcaatgcctgtgagtacctctgttgcctagtctgcagaagtctgtggcaatagtggtagcaagctatagtgttagtttcctcattggctgccaaatactttttctatgtacattgaggtaattgtgtgctttccttttttcagtttgtgaattttggtaaattacactgttgctttttgagcgataaactaatcttgccttcctgaaataaaaactccacttggtcatggtgtatcacaatttttataaattgttgggtttgatttgcttttttttttagagttttacatcagtgtttttcaggaatattggtctttcattttcttttcttggaatattttctagttttactttgtcagagtaaattctggcttcacagaattatttgtagtctctcctgtcttagtttattcatgctgctataacaaaataccacagacaaggtggtaataaataacacaaatttatttttcccagttctggaggctaggagttcaagaagctggcaagttcaatgtctggtgagaacccattcttcataggtggcaccatctaggtgtccttacatgacaagagatggaaggacaaaaagatgtgaactattgtgaagcccttttttaagggccttaaatccattcattatggaggagccctcaagccattcatgatggaggagacctcctgaccctaatcacttgcaaaagtccctgtctgttaacactattacattggagattaagtttcaacatgaattttggaagggacacaaacattcaaaccataaaaacttcctttcacttttttgaaataatttacataaaattagtattattctctaaatgttttgtagaactcatcagtgcatgtgtctgagactgcagtgtgtatgtgcatgaagatttttaattagaaattctatttttaataaatataggtccattctggttacatatttcttcttaagtgaggtttggtagtttgtgttttttcaaggaagttgttcattttatatcaattgtcaaatttattagcatgaagtgattcactatattttttatatcttcttaacatctgtagaattagatgatgtcagtgtcacctctccagtttctgatataggtaatttgtgtgttcccttaccatctctttttccttcttcttcctgatgaattattttctttattattttttaaatttcattggtttctgctttgatccttattatctttttcttctactcttgtggtttattttgttcttctttgtctaggttcctaagatggaacctgatatcatcgatttgagacctttcttcttttttaatattggcatttaatgttataaatttccctgttaccattattttgatatattgtattttcatttgtttcaaaacactttcaaatttcccttttgatttcttattggagccatgaattattcaggaatttaatttagtttccaaatatgtgggtttttttagaggtatttttttttgttattgattgccaatttatttccactctggtcagagaacatacttggtatgactgagtcctttggcatttattgaagcttatttctggtccaaatatgtccaatcttggtaaatgttttgtgtgtacttgaaaagaatgcgtgctcttctgttgtttggtatagtgctttataagtgttagatcaaattggtcgataatgtcattcatgtcttcagtagccttacaagttttctatttattctatgaattatttagagaggggttttgaaatctccaagaaatgatgtgtggatttctttatttctttcctcaattctgtcactttttgctttaggtattttaaagctcacataggtttgtcaatatttagtatcattgtgctctcctgatgaaggtatctctttaccattataagatgacccttttcaaagaacctgatgaggtttcttgctctgaattctaccttgcttgacattaatgtgcccatttcagctctgtttgattagtgtcagaatggtacatcttttttaagattttatttttaatctatttgtaactttatatatagttttgttgttctttataggttctttatatataagacttgttggcagcacatagttttgtctcatgttttaatccattctgaaaatttttgccattaattagggtattctgaccatttgcacttaatgattattttattaggtttaactctaccgtctggcaatttattttctatttgttccatctagttttttccatcttttctatctttctgctttcttttggattgagtgattcttttattccactttatctcctctgttggcttattagctatatacctctttgactatttccatagttataatggttgctttagtggttatagcatacctctcttatcttatcactgcctacctcaagcaatagtatgctaattcacttttagtctcatgacctcaccagagtatacttctgttctcctttcccaacatttgttctattgttgttgtccattccactcatgttataaacctcatactactttatttttagtatcaaagtcagttttcttttaaagataaataataagaaaacaattatatatttacacttgtggttaccatttctattactcttctttccttggtatagattcaggtttctattggctatcatcttccttttgcctaaaggatttcctttgtcatttcttataatgcaggtctgctggtgatgaaatcttccagcttttttatgtccaagaaggtacttattttgtctttattttgaaagatagtttttccaagtatggaattccgagttgtctggggttttttttctttcattactttgtaattgttgctccactgtcttgtcatccacattgtttctcttgagacatctgctgtcattctctttgttactctatacagtgaatacagataatgtctttttatttctgtacacttttaatattttctcatggttatagattttgattaccatggcccagacacagttttctttatgtttcatgcataaagttcactgagccttttcctgcttctttgcaggcatggtaattttttattggatgacacatgtgaattttaccttcttgggtgttggatgttttttgtattcctataaatactcttgagttttgttctgggaagcagttaagttacttgaaaatagtctaattcatgccaggttttgctttaacatttgttagatagaaccagagcagtgctcaattattgagttagctcaacagctaactcccattccagaggcagaaccccgtgtactctattcaatgtctgtacaccatgaagttttctgtctggctgatgggaaccggccctccgtctagtgccatgtgtgcaccgggcactgctatctcatcatttcagaggattctttcctcagagtcacatattaatccactgagggttcaagggaccctctgcagatctttggatcttcttactatgcaactctctcctctccaggtctctttcacgctaactctggctgccctgatccccttggcctctcaggttcatattctcaactctgggagttttccaggctcttcctggattccccctccctggattgtggcctggcaactctctagaggcagtagctggccagtcatgggcctactccatttgattctcatttttcaagaatcactgtcttctgttgctgatttctagcacgttgaaaactacggttttatacattttgactttgtgtttgaggtttgagtgaggaagacaattcagtccatgtttgtccaccttggtcagaagcagaagttaatgtcatagctttttactttgaagactcagacaagttttcacaacacattccttctagagaataaagttaggctctgctattgggtgtccccagatgggaaccccacttatttttaggcttcagctcagacgctacttccttcagaagtccctttctggcacactaccttcctcatgtggcttatttgttcctcttgcaccagatcactccgcagcttttgagtttgtatatggcaacaatgaacaaggtataatcctcgctgtagataaactcatcatatttgtttttctccatggagtgaaaatgttttaagctcatataatgactatggtcagggaaaaagccacacaaataattaggatatgttgtgacagtgcacaaatagaaacacacataatgtgcttgagaacatgataaatgccggttttacctttccttccctcacctgaccaagcttagcgagacgtgtggcatcttcctcatctttgctcttcagtgccaggtatggaataggtccattatggacaggtgccttattgaactgagcagagccacgaatgtcaggctgggagtgtggtcgctggagtcaggccttggtttacatcctggttctgcttcttaaccactctgtgcttcgacaggagagcaggaggtcctacttagttttggacgtgctaagtttgggatgcctgctagagatctgggggaagcatggtgaagaaagctgaatgtgcaagcctggagttcaggagggaggtggtgtctggagatggaaatctcgagccagtagcagttggttcttagtgtcatgggacacaggaggtcatataggaagcaaatgtggacagagagtgaaggggtttgaggattgggtcctgggcacatccacctctggaggtaggggagatgatgaagagccagcaaagtaaactgagacataatcattgaggcaggaggatagcaggctagggcagagacctgcaaggagagagaagagagcctttcacaaagaagggagtgaccgatggtgtccatgcttctgtgtgcttgagtacagagtctgggattctcctgagcatcctttgctccactgggatggaagatgggacctgatgagaccggggctaggggaatgtcctgagccccacacgtttgtgtctgtgtgcagggagcgtggaaggcagttcctgcttggtgaggtggagctgagagcggtgccacttagcagctatctgtgccactctggtatccggagagaaggagccggcatttgcccatccttcctcctaagccctgtcagttgtgattggaacgatgcccccgcccaccacatttgctggagttggactagagctggtaatatcagggttttactttttagtttaatttcttgcacaatgcatggatgtttattgagttttgccaataaagagttccatagggtattactgagcaggactggtctgaagataaatgaaagttgtgtacttggaaagacaatgctgtattattttcaaacccccttgagaaaaaggccttttgcactgggtgagctctggatcaggtccaatacagacagccttgcaaaagtggtgtttcagggaacacaagatgggtcaaatgatgacagtttggggggaatgagtctttgaagagctctagccctgttcttttccctcggtggctgccaggcagctggtcttcactacaaatgcagactgtcacatgtcaagactactgcagagttgaagaatggggcacaggactggaaaaggtgaaacattcttctcaaaattccaccaatttttctggaataaacattccttgttttgctgtaaacatgtggttaatttcaagaattgtgaaaaaattgactgcaatctttttttgccagttttctctttgcttttacaaaggagagattttttttttgtcattttctgtgatgttacctaacaatgttctttctaagcaatgacttctttttttataaggaaactatataaaaaataaaatacagtaaccaaaattaagtaaaatgatcaattcttggcttttatttgccaatttattttaatatatatttacaaaattggacacatacacatatatattttggcatataatatgcatactttctgtcatttgctttccttagcaatatatagtgactatcttttgtcattccgtaacatatacgccaccatttttaataggtacacaatattcagatggaacagatgcatcgtaatttaacaggcatcctctgactggatgtttacgttgtgttcaatttcttacttttatgaaaaagtccgggatgaacatcctttcatgtactttttatgtgtttgtcccaatcattttaggagacagactcctagaagtgggatttccagatcaaaggttaggatgagaaagtaagcgtgtttgggggcatttggggagggtgatgtctgtcacacaatctagactgaaagctctccgtccgtccctgcacctgtttctcagcttctacctcctgctcagtgctaggcagcctgctctgggaaggcatgctcatttagattaattcaatcagtgggtagaagggtcactcaaatccatgaaaagtcctcattttaagctatgtcttttggaaatttcctcttttggcttttaagtagcaaaacctggtaaccttctgataccttggtgaagatcagtcagatctgtaagtttttgttgtggtcctactgtgtatccttgctgtgttcatagaggccggattaataagtaaatgagaatgacttgctcctagcacagatttcacacagagtgagttttcatttatgtctagaaatctgcaaagaagggaactttttctcggttaagagcaaatacgattgaaagtatgtgatgataagcctgagacatttgcaatgggcttaaggacttggttcatcaaaagctgaaaagattaaaccacgttcagtatagttttatgtttaagcataccatagttctctgaaaatggcagttccttttcctgtattagtcccttagcattatgaaggaatctgtcccgagacctttgagacttcctgcattcatgaatgtcaccgtcgcattcagtctctctcataacatgcagtaaaggccaactgaaaaatgcctgcaactcctccaggctcctgaggagactataaatacaagactgcagtcatttataaagctattaaaacaaagtggggcctgagcccttgctgaaatgattttcagagttgttttctctctaaaacacatggcaaacaatcgcatgttagaaattcaagacttggctgagttccactttttgtatcttactttatcccaaacttctgtgaaacgaccatgttgttcaactgactttcttgctttctattcccgcctccacactaggagttgacttccttttaggtaccatgtttcttaagaaataaaacctgccttcatctatggaagtgatcatattggataacaacttgagcccccaggaattaaatcccggcccaaaaaaactgcaaaaccacagactgcaaaactgcaacctacatcgcatgtagatactctggagttacttgcaggcagcagcatctgcagtggcagggcaggtggggactgtgctgttcggaaagctgaattaactagcacccacatttcctagtgcactaaggaatgacactctgcctgcgaaagagctaaaccccatctctgctcctaagtaaatataaacattccattccctaataccttcctctcatgctgttaacttcactcagctgattccagacacacatagaacacaagggctggcctagcagacctggagtcagcccaccgttaagttcacgcaacagtattcaccaatgatctgccatctccacaccctgctaggacatgggcgggtgggggaaaggctgtcacttaaagtctctgcaggagacagatggtaaacaaactgaaaagatatcagttggttggggggaattaagataagtggagtggtggtgattgaaggctcagagggtttctgaggacctgggtccaaccctggatggtcctggcaaggctgtgcggtaggcagaggaaggagatgacatggagaccctagcgtgggatatctagaaactgaaggaagagccatgtggctggggggacagtgggcagggagaaagtgcagggaccatgtggagctgggtgggggcagtggccaccatggggaaagtcactgtgtcatttttggtccaaactcagacgtttttgaaagaaaaatgtaggtgctattagtaatcatctgggacagcaggtgtcagccgggactgtacctggaaacccatgagtagggggcttagcggacagagatggtgacatcaccttacccctgtgttgcccactgttccactggaaagtgccgcaagctggcgagcgtgtgtcctctcagttctagccaccatcaccctggtctggagtccttcctctggcaggtgggcggctccattgacaagccagccctccgctaagacctgtctcctttgttcccttctctcctcttgccctggatggggcttttaggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaagtaagtggcagcttgcgggcacagccgggcctgtgctctggccttgcaggcggagcccctctgagatcccacatcctgggtgtgccaggccgggacgcacaacccaccgtctgcagcaggtctcttgaccccgccaccgttgacgtttggggccgtgtggaggccctttcctgtgggggctgtcccgtgcatgctcagatgtttagcggcattctcggcctctacacactacacctcccgtgacaatcaaaactgtccctggacatcatcaaatgcctcctggagggtgaattgctccactggcctgtagcagccaggcaaggactgggccaaactgatgaggacatggcttgtcagtgttagagacaggggcagtctctgttcacctctatctgatcattttcctgcaagaaggtggatccagtgttgccagatcttctaaatttgtcaagtaaagctacccccccacccacatacacacagttatgcagtcacgtgtcacttaatgacaggatacattctgagaaatgcgtcattaggagattttgttgttgtgggaacatcacagagcgcactacacaaacccagagggcgcggtctgcagcacgcctggctccacgctgtagctgatggctccgaggctacaaacccgtacagcacatgactctaccatatactgtaggcaattctagcacgttatggtatagaaacatttctcaacatagaaaaggtacagtaaaaatatgacatacaaaatacaaaatgtcacctctgtatagagcacttaccatgaatggagcttgcaggcctggaagttgctctgggtgagtcccgagtgagcagtgagtgaacgggaaggctagcacgcgaccgtgcacctccgcagacttcagaatcactgcacacttaggctacgctaaatttacataaactttttttttctttaatagtaactttttactggataaactttaactttcggactcttataataacacttagcacaaaacacaaattatacagctgtataaaagtaatttctctttacccttattctacaagctttttatatttttcaattttttaactttttaaatgttttattaaaaattaaaacacaaatgccgcattagcctaggcctgcacagggtcagaaccatcaatcactgtcatcttcctcctccacagcttgtcccactggaagatcttcaggggcagtaacatgcgtagagctgtcatctcctatgagaacagtgccttctggattccttctgagggacctgctggaggctgctttacagttaacttttttttaataagtaggagtacactctaaaataatcattaaaattatagtgactacatacagcagtaacatagtcctttcatatcatgatcacgtgtgatgtactgcacggttacacgcactagactttgagaggccttggcagcacagtaggttttttcacaccagcatcgccacacacgttaggaacgccttacaccacgatgtcatatgacagcaacaatgtcacgaggcataaggaattttacagctccattttcatcttctgggacaactatcttatatgtgtcgtatatgtcgtgtatcattgaaatgtcatgaggtgcatgtctgtgcatatatacacatacaggtatatccacatacgcatcattttctggacaatatgtgcaccaagtccacccatctgccgtctggctgtgacccagagccacgggtgggcaccttctgtgttgcacccccataagtttccctgggtggtccctgctgtctgctgggctggagttggactgtctcatggggcaggacagagtggagctgctgcgtcttgctggttgaggtctgaagggatccagtcatgcccctgagacagaatgggggccttcttttggaaggcaaggctaccatgagccgggtggagctgacttgtgtggctttccaggatcgggcacctccctagttgctttccacattccagagccactggagttcagaacccctcggagcttgctgcgtaccccagtttgcgcccacggacactgcccaaaggtgccaagagccactgagcaggcatcggtgggctttcagaggaaagtcatgccattctggcagggtgggcctctgtttcccctttcaccaggccagatggcaggctaacgtgtctcgtgtgcggtaggagaggaaattctgataaagctcaggtgcaccgtcccaggagccacagtccacatctcctgcccaccctgtgaggtgtgagtcagtctgtgtagggctgggcttggtagacagtgccctggacagcccctagtccgctccttccctctttaaacctcaaaagccaacccttccctggagggagagacagtgccccaggggtgaggggaaccagctcccggagcgccagtgcctctgttggtttgctctgcacccttgctgtccccaggcccctgagtcactggagaccctgggaaaatgcaggttctgatgctgcaggtgcagggaggcctgagaatctgcatttctagcaagcttctagggctgccgacactgctcgctgctgggctgcaggccacactttgagaagcgagggtctacagcagggtccccagccagggaaccattgatgtttgggcccagatcgttctccgtggaggggccgtcccgtgtgtgtagtgtgttagcagcattcctcccgccttccactagatactagtagtacaccctccgcttctgaccaccaaacgtgtcccagacaccgcccaacgtcccctgaggtcagagacaacagaacgctccccgggtgagaatccatgatctgaatgttggactcccgctctgggcagattttcctctgagcagtggggcttttcatttcgaggaagggttgtttctggtctccgctggggagcttgagccccagtgttcccaactcccaccaaaatccttacttgagtgttttcacggtggagggccgtgaacgtaagcaggtgaggccggcccggggtggggctgtggatagagcacgaggtcctacccttccaggtgttacagagttgtgcttggggcgcaggtgcaggttgcatttctaccagcggttgggacagccctgccgctcggcctctgcatcgtggtgtcgtcatcccaggctttcatttctgcaagtctcagtgatgggacgtgtgttcctaaggcttggtttcctgtttctctgatttctggtgaggttgagcattattttcagcgtttatcagctttttggtttcttctttatgtactttgcctgaagttttctttatcttaatgatttttaggagtttacttttgaagatgtagcttctaatccttccccattttgagttacatgattcttctctctggggcttgtattttcagttttaaaatacttttctttgaggcacaaaagttttgatttttaaggctgtcagattgctgatcataaacttgaggagctcacagcctttttctgtgaggaccaagttgtcagtactttgaggtttgtgagccaggctgtccccgccacccctactcagttcaggcgctgtagtgatgaagtagctgtagacaatctgaggatgaaggggcatggctgtgtgtcaataaaactttatttacaaaaatagccagcggtccattgggtccagctggcactttgctgacccctgatgtgctttatggttcgcactatttgtaccgtgtttaaaaatcctccccagcctagaggtcatcagaattttattcacttctgttatttgcggttgcctttacctgtaccagttaataatggttttctatttgatagtcaaaccaagttctttcaaattaaaatactaagtgaattgatctaaacaacaaaaaaaaaggtaagtaatggaagatagtacatgtggttcaaaaaacaacaaaaattatggtggggcttggaatgagagatgcctggggtccccaccgccgactgtgaaggttgagaggaagttgggagaaggttgggctgccggggataccccaaacgcccccctatgtaagaagtaccaaaaacatgggccctgtggcttgtttttactccattacttactgaatctggaactaattttaaaccttggactggaatgtagtagctccctgctatttgtcaccatgtttaaaaacctggaattagacacagagaaaacagcagcggagtagcagcatcccaggaggtcagacatggcttcctggaggcgccatttgttttccctacagcagtggcttaattggtctccctttgtctctgctctgcctcctttcagagattcctccaccgtctcttgctaagtaattcagcctctggttgccatggcaacgtgccatctactgtatcccaaagaacatttgcgatttcctttttttaatttccagaaccttcatattttatcttctgagtgttcctgggccttttcctggtgaagcagtcactgctccccacggctaccccagaacacatccgtgtgcttggtctgggacccccaggaaagtcagggtcccatttgaaagagtgaagctctatgctgattttcacccctctctgtgtaggagctcagcttacctttaaaacctgtgtggatgcatcagcagagtatgagaggcccgcagctcctgcacggtaggtgtgcactggaaattatgcacagaggcacgggctgttttgcctccatcctgtctacagccaccatctaaggagagcagtgggaagcacctgctgccggctttcagcataggtgccggcgatgtgcttgacgtctgccttactttctttcatttatctagtcttcacagtaacccagtaaagcaggtggtactatcatctccattttacagatgagaaaattaagccttggtgagaaggtaactggcccagggccacgtagcttgcagaagctgccgtgcagtgagataggccatttgttagagccctagccctgggcctgggagaagcattctagacacgaaagcactgtggctccttgtttatcttaggcatggctttgaattttcttatattggtttggctttgatcagggtatcagctggcaactgggcaatgcaccaggtgtctcgggcaaaggacttcacacttgctctaaagcagtgcagaatgttggccgggtccggtggctcatgcctgtaatcccagcactttgggaggctgaggcaggcagatcacttgaggtcaggagttcgagaccagcctggccaatatggtgaaacctcgtctctactgaaaatacaaaaattagccaggcgtggtggcaggtgcctgtagtccaagctactcaggaggctgaggcaggagaatcgcttgaacctgggaggcagagtttgcagtgagccaagatcatgctattgtactccagcctgggcaacagggcaaagacaggggggttgggggtggtggcagtgcagactgtcaacacagcatggagcagtggggggttggacatcctcagggggaacatatagaaagagacactgcccagcaagggctctggaacagtgcagcaagcaggctagagccccagccgtctttgtctcagctgcgtgagataggccagcaccagtgtctcagaatctctctccttgtttgtgaaatggggatggtggcaatacctgcctcagggccctctggaagattccacattggtccctgaagaaagtcataaaagcacattctcagcagggggtgctggggccagagctgctgctgtcacagtcaaggctggatgcactcctgggcgagctgtcacctgcacggggcagaggccagcagcaggccttgtggcaggatgaaatgaatgctgctgcatgaacagcggtcacgatgctagtgggccagggagtgcaggagcattgctgttgatggggcttgagtgtcattcccattcgtgactgttgtgtaattttgcccgaagagagaggaatagggtaggcacctcctaagtcatgcacaaactgtcattccccttggggcgttctttgctcccaggaacgtgtgtgagaagctgattaatgctcagtagcatctttcaggagggggcacttagcatgttcatacagcagttagcggatctctgagtggcttctctgcacgttttgtcctgtggcctccagaacacgctgcaccctcaggtgtcctcccgggctgtggcctcccactcctgctctgtctgcaggagcaggacacagcgtgcagcgagtttagacgctccctcctctagatgtgctttaggcaaggcaggcctatttttggtcctggagacagaacgcacagaaatgtggagacagacagtgtccccgcagaggctgtggtttgggctgcaaggcggaaaccgtgcctggccagccaggggaccagcctgtctcaatggggccttcgttctgctgtgagcttttacctgaaactgcatggacggaaattttcacttccacagaaatggtgtttggtaaatttcagacacgtggaagcgggggaggaatcagcttccaatgccagccttcataatgacaccactaatagcatctgagagggtctgccgtgacgctgggcaggtgcagtgctgattgcctgtgatgccgagcagggaccatcatccctgctctgcagatgaggagactgggcagagaggctaagcagtgtccctgggtctcacagttcatgaatggccaggctgtgggctccagggccctcgctcccagccactgagccttgctgcctgaggccaagcatccggctcacaccttgtggacagggccgggaagctgatgatacactatagctaaaggccagtttccggtgaatgtttgtgttaatgaggtggttatggtccacgttcactgggctgagtcctttgcccgctgatgtctgcaaccctgaagttctgtgctcggtatggtgtgggtgctgcacacaggctccttcatggatcttactaccttccccaagaccctcactgaggagcgaacacacctgacatgggtcactcccggagcagggctgagctgccgcaagcgctgacggtttctcttgtcacagttatcattgccgccctgaaaaggctgcaaagtttgccttctgcctcagggttaatccatggctgctgggatggaaggtagcatttgaaattacctacagggggaggctgcacctgcagaacgggcccagttgatcctgtcacatccaatgtcattgcccatctcttggggtgcttaccccccaattacagagatttcgaattcatgtagcgtgcacgtgctaggcgctggggtgcagagatgaaaagatgcactcacaggtgataaattattgtgtctggtgaaagatgtacagagatagatgtgtggaccagcttcaggagggagggtgagggtgtcccaggcagaccagccagtgagagctcgaaggtgggaagcagcaccgccttcccaggactaccctgggggctgagaaggttcagggctgggtgagggtggcagggcagagggagaagactggaggggccatgggtccaggtggtggaggctcctgtgctgcccgctatgggttcccaatccacacagacctcctcttgtcattctgggctcagctcagatgtcaccttcctgaccatctcccagtggcacagcctcgccattaccctgtgtcacatcgtcccctgctgtgtttttagccacttccacagctgctgaaagtgccgtttactcatctgttctgttcgcctcttcagggtgtgcccactggcgtggcggggccctgctctgctcttctgtgagggccttgcccaccaaggaggcgctggctaagctggtgggaaatggcagatgaggaggcctggctctcccgagaagcagccagggctccctgggggtcaggagcgagggcatgtctgggaaacgcccctctgctgcagtgcagggctggtttgggagagcaaggctagagctgggtggggagacaagggtttctcacatgctacaggcccaggagccagcaccatcctggggacgcggggctgcagagaggacggcagagctggtgaggatgaacggcaggcctgtggctgagggaggagggcctgccagcctaggggtgggtggatctgcaatggtggagagggaatccaggaagaaggcaggcagacacaggggaaaggttatatgtccaaagggtccctatgccgtcaggtgcctggggtttttggcagtgcttccatccacttgtgcaggtgagactgcccaaggagcacagggactggaacgggagactgcccggtccatgctggacttgctgatctcagctgaggtcgagggtattcagagcccgtcgtggtgttttatacggtcctgtacttcctgttatccttggtccattttcttctacactatcttccctccagtttcacacacttggacagaagggagtggttgtttttcactgaccgccaggaaccacaacaggcttctgtgtgttccagtgaaataagccctatctgtctctcgggaatggagcagtgttaagctttttttaaaagcacaatctgaagacactggggtctggaaacccattttttcttgttctgaagcctgtggggcctccgcggttgggccttgctgaataatttggggttttaggttgggtacatcaagggtaaagggcttctgtttggatcaaacaggaggtggggggagggtgagattccctcatattgctgagaagggagttgggggctgagttccccgacttcagaggtgagacatctcacaagccagaccttgggactgtccctgtggacccaggctggactgggaagttcagggaaccctcgactcgaagagggttcttgttaatgaacagtcttcaaggagcaaagcccagactgttctcccagtgtggtgtacacatgaggagggacctcatcggggggaatttggcttcctgatattcaaaagcacatttgtctgctcagtctctgaaattgccagtgggacaatttccaaagggatcaccagaaagaaggtaaatgcagagacgaacaaggaactcatcatacccaggatcgttcttgatcaaaatgccaacagctgggcatcttcagccaaaagaaatgcagttgtggcaggaaagactcagctgtacttggggttctggtttttttttttttgtttttttttttgagatggactctcactctgtctccaggctggagtgcagtggcgtgatctcggctcactgtaacctctgccttctgggttcaagcgattctcctgcctcagcctcccaattagctgggattacaggtgtgcaccaccatgcccagctaacttttgtatttttagtagaaacagtgtttcaccatgttggccaggatggtcttgatctcttgacctcatgatccgcctgccttggcctcccaaagtgctgggattgcaggcgtaagccaccacgcctggcttgggtttcctgttttatagtgaaccccaaggttgcaaaacaggcgatgaggcttgtgatcatttatctttatggatcatgggtctgcgaactggatgagagttttaagcatgtcaggtgtgcaaacatctcctatggttgtgggaatttctccttgcatagccaccattgtctagagcagcagtccccatccatttttgtaccaggaaccagtttcatggaagacagtttttccatggaccagggaggaggatggttttgggatgattcaagcacattacctttattgtacagtttatctctattattattacattgtaatatataatgaagttattatacaactcactgtaatatagaatcagtgggagccctgagcttgttttcctgcaactagatggtcccatctggaggtgatgggaaacagggatggatcatcaggcattagattctcataagaagtgtgcaacccagatccctcatatgcgtagttcacaatctgctgagaatcgaatgctgctgctgatctgacaggaggtggagctaaggcagtaatgcttgctcgccactactcacctcctgctgtgtggccaggttcctaataggctaggttgccccagatgggtactggggttgggacccctgttctagagcagtctgcacgctggggactctgggtccatgacagtatttccttcctgtgtgataggcctcacagcctccactttgcatgtgaggaaatggaggctcagaattgttagtagccagtgagtagctgagtgaggacatgaacctgagtctttccagctcaaagtccttttccttagcctatttcacaactccctggaactcatccatggccatcctctggttcaaattatcctccacctaggcagtagactttcctttaaggaaggaagaaacttcttcaatgttttatcctcagtgcctggtacacagtaggctcccagctaattactgttgaatggatggttggttagatggatagatggatgattgtatgattggataggtgggtggttgggtagttagatggatggccatctggatggtgggatgattgaacaggttaatggctgctggggtaattgcattataagatgcatgagtataggtagatggagagacagctggatgaataggtagatgggtggataagtggtgggatgttgtgtagttagatggatgaggaggtgaatggagacattgttgaactaaatggcatcctattcactgtgcttgatgtaccctaatatctgtccatccatccatgcaactgtctcagcacgcacagtgggttagatggaatttcctaagagtttatttcaataaaataagagtttagttcagtacaataagtgtttattgaatgaatatctctctttgcatagtgggctctttggatacatttaagcaatgattccatttactacattgattataaccaacctattcagaagtgtatttgtgaatagtgtgagccctcaggacctcagtggccattgccaattttggagactggttctgtgctgtctccaggccagggtctgcatacgcttctggcgacaccactgccgtctggctgctgaccagcctgggctatttctgagctgcaggtccttaggccctcaggtgaggatactccagaagcctccacttcaccctcactggaaggaagtctctggtggaaacaagctactcctaaagctttctgagcacttgtcaggaggaataggagagaaagctttatcggaatgagtaagaccaatagtattaacccatgactcgccacaggaggcgggtgggggatggtgtcttcacagctcattcaacagagtagaagtcacagacccaaatgctccataagtgacctgggccaggcagggctgtggcatcctggggagtgtgcactcttgctcaagagggcagctgtcactcagatcctgtgggccatcacccctggccacatgtcaggccattgtggccagaatttccaagagaaaccgaagatttgatttttttggtgaaatagccttcatgtaaatgttgagagcctcttcctatttttaaaagcaatgtgtgcacccagaaaacatatttgtggaccagatttggcccgggaccacccactggccacctctgatgtgaagtcacttatgcacttgtattgggagaagtacatgtttctttacactgaggttaaggggattttcaactcttgagttagcagggaaaataaatgggtcatcctgtaaagtgactgtcagcagcggaagcctccagggctaccactgtcagtatcctagggagcctcagcgaacctgtctccttcctcgcatatgtgagggggcccttgtgtgcggccctctcagctccacccttgctctaaggaagccgcacagtgcaccgctgagaagtcaggatggacagaatgcctcggttcccagccagctctgcagttttccagcatgtgggcatggggaagtcacctcctgacatgcgccttactttcctcctctgtaaaagggatgtgactacaacagagcctgtcttttggggccacgggaaggatgcaatgagccgtcacacgtagaatgcctggaatcatgcctggcagagaggaagctctccaggaagaaaaggaagaaatctgagttccatgaggatagggaatttgtctctttcagttttaacagctttgttgagacataattcacacaccacatgcttcacgcactttaagtgtccaattcagggcttccaacatactcatagagttgtatttccatcagcacaatcgattttaagatattttcctcactccaaaaagaagcctctccctctcagctgtatctccagtccctagaatggtactgagtcctgtgggtactcggtgattttgcagctactgctgcagggacgaaggggaaactgcatgggaaggcatctcctaaacatgaccagttattggtgtcaccattccctttgcttcaccaacttgatcttcttcagatccttttcttctgcttcggcatcttttcattgtcatcattttatcttcatcactatcatcaccttcactgcttgtttatcatcatctttgtcattttcatctttttcttcctcattatctttccatcatctttagcaacaactttgtcaacatttttatcctcatcatcattttcatcatttccataatcacgaatttgccccatctttgctccctaggagacactcggggaacttgggctctcaatccccttgacgtctgggggcttggcctatgaagggaatgaagcccacatctaaagcaggttccggagcctctgctgagtctgatcgtgcctggagtgaagaggactcttgagaatggtgggggctgggcgcagtggctcattcccgcaatcccagaactttgggaagccgaggcaggagaatcgcttgagtccaggatcacttgctgtgttgcccaggctggtcaccagacctgggtgcccacaggcagataagaggaaggtgcctgagtcaccaactgcccacgggactgaggcacctccctcttatcttcctgctattttccagatcagcctgggcaacacagccagactccatctctacaaaaaatagaaatttaaaaacagctaggcatggtggtgcacacctgtgatctcagctacttgggaggctcaggagggagagaggatggcttgagcctaggagttagaggctgcagtgaactatgatggtgccattgcactccagcccgggcaacagattgagaccctgtcgttaaaaaaaaaaaaaaaaagaaaacaaaatggtgggaaggtgagtctgagccgggaccctgcagatcccacaggtccagctcaggttgccacccccgtgtgtggcctggttgggccggtgctgtcccagtactggccacccgtcaactgaggcacctggttgggccagtgctgtcccagtactggccacccgtcaactgaggcacctgattgggccggtgctgtcccggtactggccacccgtcagctgaggcacctggctgggccggtgctgtcccggtactggccacccatcaactgaggcacctggttgggccggtgctgtaccggtactggccacacgtcagctgaggcatgcagggctctgccatctatagccttctttggattccgagatcccaagaacagaagctgttggcatttagcaatttatgattttcttcctttttttgatgctgcagatttatccgactgactttcccagccctccagggggaccgttgctggggcttccggtctctctttgtttagaaatctcagggcaagtggagatcaggtctgttctgcacagatgcaccttcctgagctcttggcgtggcaccacctcctgcttcaccactgtggtgaggggtctgcctgtgaacactgcagagcctccaaggtcaagaagaccaccaagatttatgagggcactttcaaggatttgttgcaaaaatgcgaaggagctcacgaggcagtgctgtgagcaggctctgtgtggtattgtgggcagaaatcaacctcagccctaaagggaggggcctggtagtcctgcaaaggccggggcaggcaaggccagcacggatcaggcaaaatggtggctatcatgtatggatcttgtacgttctgcttttagatggaggtagctaagcaacagaacacacagcttccaaattgggacaagtttaaactggcaaatctcagccccagaggatataaatatgacgcttcatcgtcttgggtggaagtccccgtgtacagggagggaaagcccatctgtgtgtggcatgcagggtacagggagtgggtcccgagtcccatcctgtgcaggggagaggctcaggccccttctgtgcagtgtcaatatgaagtggccctgtccctgctgagggctccagggagggtcagctgctgtttgttttccttggttgcttgggaatctgtagaggatggtacagcatgttttgtaagaaaatgcaaaacaacatcaacccccattcagtgtcaataaaacatgattcccaaaccagggagcaggtggtttggtggacttggaggctgcctggctgagagccatgggctgagtgagcccagggaagtcacatggtgagtccaagccttgaaatgggtgtgtgatgtctgcctgctcagatgcttgcagggactaaataccacacagtcctgcttcacccaggatcggggcttagcgtgtgtgagtagtagtcatggtaataagagcacaaccatagctcactaacatgtatgaaacccatgttatgtatgaggggtggtgtttgcctgcattcatataaacataagacgtaaatgctattattggatgttcttagcagctaaggaaatggaggcccagagagattgggtaagatgctcaaagtcacacagctagtaagctagtggagctgagatgtgacccaggtgggccgactccagaccgcacgttagagccaccccactccctggaatagttgcacaggcggtcaggactggcatggttgttccaaaatcaacaaggacgcagactcctcttaccttcctgctatttacccttatgccggtgttgatcctccatggtccagggtggctgcaaaggcaccagacatcatattcaagtcccaaaggggcatacatctcagctgagtcagcttttccagagggctcctcccagaagctcctccacacacatctacctactgctccttggttggaccctcctcatgtggccgtggtcagctggaaaagagactgctctgaataggaccagcattcaggcataagaaggggagaagggagatggggtaggaaactcgcggcttctgctgctttaggtgttcaagttaattttgttacattaaaggaagaaaagaagcaacaaatgaagagatggatgagtgaatggaaagcattctgtctgttaggtagcaatgatttctaagtgatttctggagcagcctggtttgaggagtgcatgtggatccctatgggcttggagagcaccgccggggaatttaaaaatgccccattcctgaccctcccacactgggccagggaggtgagcagctggcaggaagttgaggaggaggagggaaagaggaaccctgagaggcgctgagagtgatgtggacaaacacagctaccccctccccagcaatcctaccctttctgcagcgatcccaccccttccccagcaatcccaccccttccccagcgatcccaccccttccccagcgatcccaccccttccccagcgatccgccccgcaacgatcccaccccttctccagcgatcccaccccctccgcagcgatcccaccccctccgcagcgatcccaccccctccgcagcgatcccaccccttccgcagcgatcccaccccctccgcagccatcccaccccctccgcagccatcccaccccctcccctgccatcccaccccctccccacagtgatcccaccccctccgcagtgatcccaccccctccccaatattttagttcagcaacagatgtttcctgaacagcctctgtgtgccactctccgcactgggcctaggatggggggaagaacaaagcagatgcgggggctgccttccgaagcttccattccaccagcaggcgtgggggaggggaggtcaggtgaacatgtgtgtggcacatgtggaatatgtggctatggctagacacgggaagggctgcagtgcagagtgaccgtgttccactcaggtggcttccagcatcccctcctgggctggtgggcgctggtgcacctcagtgccattgctgatgaaggtctgggtccggtggaaatggtgtggtctgcagatgaggtgcgcctgtcttttcttaaatcaaggacactttcagatggatttggtttctctctgactcggctcgttcagtcagcctgacgggcacctaccgtgtggctcgggccccgtgctgggcaagaccctgcctccagctcccagcctcactaggagtgggggatgggagtcacaggatgtgcccagtggaacagccgccagggcaggtgaatcctggagagcggcgggctgttcaggtctgggaccctgggaagccacagggaggagtgcatgggagtgaccctggaagcccagagatggagatggggaggggaagggctggcaggggccctgcccgagcaaaagatcagaggcagacaatgctcagcgtccaaggaggaaagcggaaggagctggagggcaaggcaggccctggtacctggcaggtgctccattggtgcctgtggaatggaccccaaaggatcttagccctgggagcaggcagtggggagcattacgtattctttccattttcaaaatttgaagaagggacttatatacatggtaaaaaataaaacggtacttctcactcccacctcatccatctgtccggagtcagccactgtccacggggccatttgtgatcattcagaagtgggtctttataggagtcctaacgcccagaacagtaatctgcagatattacctcccatgtgctgtgcccagctcggggtgagctggaacctgcggtagatccttcgctcggcatcagtctctggagggaggtaaagacctgtcctcagtgctcagccccaggtgactactcaaaaagccatttgaaagaagagatcataagcatgatttgttcatgctttaaacacaattttaaaccatacagatgtcacttgtttggccgtcactttgaggtagaatccaaggacatttctttgaggaaggatctaccaacttaagttatttttgctctaaacaaaggctggatgtgtctcctccaagttccactgacagtttctttggagaggagtgagtatttaaaggcacttggaagcaatctcagtgcagaatccttccagagttttaaggccccacctccccagatctcacttctctctcccacgcaaactgcacagtggtatttttagcaacttgcctctactgactccaaagcttagttttcatggaatttacattttcattttacacccatatgagatcatttaatcaatgtgcattaaaagcttaattacatttattacagagacaagtacacctggtacaaataggtttgggaacagaagcaaccagttcctgatccatgcacagctcagctggtgtggccaggcagttctgaaatcaacagggaggccacgaagtcagcacgggatgcccagcatggctggagccactgaaggatttctgcttcaagaagcctcaaccggtatctaaggccttcccactgatcagatcaggcccacccatttcagccaggacactctccttgacttaaagtcagctgatcacggcccttggtcacatctaccagacgccgtcacagcagcacctagaggagtgtttggttgagtaactggggactgggaccccaccccccataccattcaggttgacacatcaaattgaccctcacagattcaaggttggcagaaagctcatgagcagatgtaagattgcactcagtctctcactcacagcctctctcctcaggtgatttgtagagaagccactattcaagcaaagggcaagttcaaagcttagactcttaatgatgatgtggttttgcagtttctatattcacgtttattcccttttatcttccccagagtctggctgggagagccttccacataagggctaatggagcagcacccggttcctttctgtaatggcattgaattccactgcagggttgaacacaggtcctttaggcccaatgggcattaaggctctgccctgtgcttggctataatgaacatcctcatacgtgtgtctgtaagaggcccatgtggaaggatgttcacacacatcagaaatcttggaactggaactggcaggttagagaatatatgcatctgtcatttttgacctgagcattgaccaccagggaatgcccctgattgacagccccaccagtgggggggcggggggaggggctctgtctacactcctgtcaacattgtggattttccaactttctgccctctgctgatctggaggtggcacagtgacgtgctgtttggcacaaccacacactccatgtggttgttatttccatggaggtctgtgaatgacgatgaactttggacttgccccacaacagcagcccagttctactagtaaggcagagctgtgtcccacaagcccagaaccatgccccctgcagcggggcccctgtattgccagtggcttctctgttcattttgctgtgccagcttgagaggctgtgcaggggctggggattcagcagtgaccaggtagacaaagtctctgcccttggaggggtcctgagtccctaactggccagcttggtgccttgtcctgggttggcacacatactgccttttgtactctggtggcagctgtgcaagcgtgggactgtggtgtctctttcacaggcttggagggtggcttgcccaaggttgccttgttgctgtcaaaaccagcctttgggctcaagtttctcaatgtaaacctggcgttgccttgatgtcccattcatgtatccactcatgcattcagacactcattcattcattcagtcacttgttcattcattcactcgttcattcactcattcactcattcattcattcagtcactcattcattggtcacttatcacggaccaggcttggttccagggccctgagtacacagcattgggtactactgatgcagttcttaccattgaggtactcaaaacataaataatcaattctggccatgaaggccacaaaatacacaaatgcactggggagcaacctgtgcagaaaggagccagttacttcagctggaggagtcggggtgggctttctggaagaagaggtttaagctgaaccatggggagatctgggtaacaactttctcagcagagggaagggcccaggcagaggcgctgggtgggaatcagcttggcatgtgctgtggtctgaatgtttgtgtcctccccaaattcatgtgtcacccccagtatgatggtggttgtacatggggcctttgggaggtgattaggtcatgagggtgcagtgctcttgagcgggattagcgccctcaaaaaagggacccctgagggctgcattgctccctccaccatgtgaggacacagtgagaagatgctgtctctgggaaagtgggtcctccccggatgccgaatctgctggcacctcaaccttggacttcccagactccagaacagggagaaatggatttttgttgtttataagacactgagcttaggggactgtgttgtagcagccgcgctgggcaagggcagctcagcaggtcagcatgaccaaaggaggacaaggtatggggaggagggagatcagtggggtgggggaggggaggggtgctcaggggcttcgaggaggctggagctctgctcctcagcaggttgtctccctccaggaattccctgccacaggctcgggcctctgggtcctggtggctgagcacagatcttcgctgagtgtccctggtctgggccaatgtggggccagcatcttggttcttcccagctgactcaacctgggcttggctcacccttggctgggacccaaggaggccaggcagggtggtggggcccagtggggtgtggggcacattccttccagtgcgctcccctgccccagccttacacctggcattacagggcacatgctgtcctcaccctgcctctcacacctgctgtctctgcacacaccctcctggccctgcctctcacacctgctctctctgtacacactgtcctcactctgcctctcatacccactctcccacacactctgtccctgccctgtctctcatgcctgctctgcacacacagtcctggccctgcctgttacgcctgctgtctctgcttccctctctcacgtccttccctgcagggtgcgtctctccctcctctttgcacacatgttcttggcctttcttcctcactccactttcctcctttcaaaagtagcattggcagggctgggtgtcactgtgaatgacattctctgcgttaccttgactgtgagaacagaaagtgcctctctacaggtagatgcgagtttggtcctgaaagtcaagggcctggttttcctccggaggatttgaatccttccctctccctgctcccctcccttctctccttccctccctccttccctcccatagttctcaggcaccaggtgattcctcagtacctctgagagtccccagatggaaggtgacctggatgtcccttggtgtccatgttgctgtctttagcacctggaagaggaggtagaaggggcatgttcacggtggggttggggaagcctctcagggcagcccgggaaccatccggagagactggtgctggtgaccagctggccttcatgggcgggggtgcacgtgatcttggtgcctcacctgagcccttggaacacccggctccaggaggctgattggaggcgagacccctccccaccaccactggggctgttcctggtgcagagggtgaaggactcatctcatctgtatcccaggggcactaacccaaccctgggcagggcagtctagagtccctttttggcttagggtgggccacagagccaggctgacaaaacagaaatagcaacagtgatggagacagtgcggtgtgcagcttgcggagcccagggcacagcggcctggctagccccctcacatacggctctctcctttcagtctcaccaggtgagaccatggaggtgcagagaggagactggctgcacccaggaggtggaggacaagagacactggagagtctgggaggccaactccacgtacctggagttcttttctgtgctgccctgggagggagcccaggctccaggggacatatttctcctgcagggtggggttgggaggacagagtaggcaggagcctttggcctgaaggcttgtcactgtgggcacaagaggcatgggacaccttcccgacatcagaagccccccactgcaccaagcttggcggggcttcctggtggagttgaagttgccctgcctcctatgccctcaggacacaggaggcaggccagccgttctgttgccttttggaaactcagggcagctctgtggattgtcacagcaactggagctcctgctgtattttcaggatggtcccgggaggcaggtgttctgcagccatggggcactcccttagcaatgaagactggccccccattccacttgacttctgaatgtccctgggacactcatgagagtccgaagcctgtttatgatgacctgagcctcatcccaagtgcattgtggacacacacaggaggtattttggtggagctgtattacaggtggcgtctcctggaatgcaaaatgccagaaacctctcccacagattggggagggaaccttgctttgtccagagcttcaccaagaagcattcctccactagtgtctctcagggcatggagtgaccagtgtggcagctgtgggtctgtctgcattggtggctggcactgtgatggtgatttttctgtagcggcagcattggcattgtgtgctgtgtcacccaatccagccatgcctggcacttacttacctatcggaatatgtgttatttgattaaaacttaatttcctttttcctcctttatattgcagatagggtgttatgttgtttttttggttatgcgtgtcagggatttggaggaaaagggacaagacagaacaattgtaataatgggggtgtgtggggtacagtggggctgcggacccgtgtgaggagaaggacatctttgccggacagggacagtgtgaacagccacttattggtaaatgcagctcgacgtggggccatcacccggcatggagttttgggaggggtgggagtaggaggggctgctggaggggtcaccgtaaactgaaaggctttgctgagggccttggagtttgtcctgaggatggtgggaacccgggcttgagctcatcgtgggagtaggagttagagttatgctgctgtgggcagggaggtggacagtgtggaagtctccatcatccagggctgaggcttgtggcctggatcagggaagtggccttggggatggagagaggcagatggatggatggacggatggatggatgcaagcagaacccagcagacttggagcttcctggggtgttggacgtagggagtaagaggagccagttctcccaggggtctggtgtgtgcctgggtggtggctggagccagcccctgagcccaggatgctgggcacggagcaggtgtgaggaggtggggaacagggtgtgaaaaggtcggctttggactcagagtgcctggagtcacatcctccccggcatcccagaagtcaggactgctggctgctgagatggggcttgccccaggcatgtggaccagcagccagcacctctcagctgagccctcagtcggcagaacatccctgcttgctgtttcctagtgtggacacactccatcccctctgcctggatgcccatcccaggtctttccctgggcggtttctttcatcatccaggcctcatcttatggcctggagagtcctcttctcttcctgaacttctctccagacacacccacattgctctgacgctctgagacatagggtcaatgtgcctgtcatccgtgcacccagatggtgtgcgcctgggggcaagcagacgagacatctgccccattcaccatcagatgtctgaggatgcatcaatgcgtcgtgtgaatggtgtgtggagacgctgcctcgctggggaatcccatctccaggcgggggccgccagcttttctcagtgactcaaggcggctgtggggcaggattggcattcccagaaaggagcctcccaaaatagcccgggcgtcccctgtgggtgtcgagctgtctgttctctctaggaaggcattctgccttgtatggaaggaattgcttctcaatttctgctccacactgaggtgactttagatgttgattcaaaccttttctgtgacatctgtgctggggtgagatcaagatttgggggatgtgcgtttagtggggcagcctggctgggtggggcttcattggggaagcaaagcttggggagctggaactatgcttctcctgaccccgtgtccttccacttcctgaaattacctgcagcccctgctgctgtgctcatcatgcaggaaggcagtcagctgagcagtgtgtgcagaggacgattcagaaactggtacaaacttggcactgagacggcgtctgatgggagaagagggggtgtctgatgaaagaggctatgacagacaggagcatgtgcgtgtctggtggaagagggtgtgcgtgtctgatggaagagggtatgagtgtctgatagaagagggcgtgagtgtctgatggaagagggtatgagtgtctgatagaagagggtatgagtgtctgatggaagcaagtgagtgatggacagtgtgagtagatgatgaaagaaggtgtgagtatttgatggaggagggtgtgtctgatggagacggtgtgaatgtctgatggagagagcatgagtgatgaagagggtgtgagtgtctgatggaggaatgtgtgggcatctgatggaggaagatgtgaacatctgatggaggtgtgaatgagcagatgttgaaagagggtgtgagcatccgtctgatggaggaggctgtgagtgtctgaaggaggagtgattcttggggatccaggcctgcaaggaggcgctgggcaggatggagcctgcagctctgctggctgaaggtggaagagacctgggctcagcacgccaggtgaataatatcagtgctatagtagtaatgatgccacctatttgtgtgtcaacctcctcctgtatttagtgttctcgactctcccagcatccctgtgggttttgttggcaggtgttcacctggggaatcagaggctcaagtaagggagggcgtgacgccatcacccagctggcaggggtcagagctggaactggaatcctagctctgtgccagtgctggggcaccagtgctgactgtggaatagacagttgacagcctccacagacctggaaatgtgggtggcacagtggcatcatgactcctggagcctctccaggcgtcctgactgtccaggctgtcggcggtctcatcagctccacctctaggccccttcctccccattgtttgtcccctgctccctgtctcctctgtgctactcacagcacagggccaggtgtgtcgtaggtgactgctacagatctgtcgtgtgagaggcactcggaaccaggaagtgcctgtggggtcacctgtttggctggtgcccccttggcccccagaaatgactcacatccacacttgaacatacagacatccttttccagggtgtgttgtgctcgatacctttaattcctgtctgcattccagggcctgcccagcctcttcctggctccccagcccagcctggtccttccggcctccctgtcatccccacctctcgtgtgtgcacaagcagggaccaggtagggagaccggcagatgctgctctctgtccctggggtttcttttcttagtgttgctcccacacccacgcgatgctttaattaactgccacactcaggctttctcagtggggagagtcagaaatagactgtggcttccccagctccaggcggcaccaggacgtcaccagcagccccatttctgaatcaggagtctcaagcagctgcagagggtggggaggtttggggaatcccacaggggttctacacccccacctaccccgccccacccctctgcagggccttctgcagcttccaaagcccagctatgctccggccacgtctctagcggctcctcggagagcaacttgatactgaagctcaaagcccaggaagccctggcggcatccctgccccagccaggtccaagcaggctatgtagtgagggagaggaaccggcgcccattcctttgctcctcgacacaggctgctccccttgcctgcgccggctctgggggtctgctctcacagagcttcatgactcgttcaacctgactgcccttttcctggccatggttctgcctagaaaatttcctgggccaccctggcctgagtggcgactgtgtgtcagggcaggggtcagcacactgtggggcaggggtggtggcctgtgatgcatgcctctgcctgggcctgactctctgtgctgggagaatgcttcctgggcctcatcccagctgtgtccctgctggctagttcctgccagctggtgttgccggtgttcctccctgcctcagccctcccagcatctggaactggctgtgggttctgattccagctgtagtagctgctgatcacattcctctctctgagcctcaagggtctcgcctgtaatgttggcaaagtaattgtctgtccttggcatcaggctcgtcaccatttttccttttggaagccccaactctgcatgaagagttagcatagcttcaggtagcaggtggacaaaagggtatcttttatgtatacttagggtaacaagtattaatttggagtgtggggtgtttttgctctgtggccaacttcttccccaagtcttgaacacttcagggggccctcacaggcctgcagcacactttgtccttggtatctggtgggggtctgggcaggtccgtatctcttggtagtgggttcatctccatctctgttggacagaaatctggaagagtccggagagtgtttgcaaatgcaaatctagtcctggcacgcccacaccccatctcacccaggtctgctttaaatccttcagtgccgctctggggttccaggagtgaatccagactctctctccagcgatgccaggctgtgtgggtcctgcccctgctcagcctcggtgcacacacacctccatgcgatctaaacgaccccacctcaggacctttgcacatgtcctctcctcacctagcgatccccaatcatcctctggatcccaactaaagtgtcaccttctgggaagccattcatgtgcagattagagcctagtctgaacggtggcctggccttgttgggttggcagaaccaccctaagaccctgcttagcaccctcacctggcagtcaggggtcttcttgctcacctcaatcccctccactggtgagaaccacagggagggtcttggggcccacagcactgtctagggttctgcatccacccttccaggtgtggggtcctggcactctgtaagtagagaggcaggttggtgacaagccagtggggtcctggcctgagcacccttttgctctgtttacaaccctgtgcctccggggctgtgtctacccagaggactgcatattctagaccattcaggggtaccctgttgacattcagtgagaagcttggcagctagatgaagccctgcagtgagcgattggaccactaccagactgcctctgtgccttgggaccaattgcacagtttttgctggcttgatgtccacgctttcctgaggtgtaccagttggatgaaatgcttttctgggaacatggtccgcgatcagctggcaagtcacaggttgggttttcttgagaaattactatatcccaagcatgcattgtcacaaacatttttgtgcattatctcatttaatgctcattaagagggtctggtactaattctcattttggatgagaaagacaaggttccaacaaagggcggggggaagccttgttcgggggccatgccagtggacactagcctccagggacatttggggtacttctcagatttgaggaaatgcacagcctcactcctcaggtgtccctatgggtgttcctggctgggcagctggctcaagaattgtcttgagccacacacaaaatacaaatggctggggccagcatcgcggacagtgaaagagtttaccaaggcagttataggtaaagaaaggcaaatttattagagaaagtatgaagatccgttgcaagggtgcaatgggcagcacagtagagaaggggctgctggaaagaggcaggcgctggagggaagttttatagggttgtgccagaggggcttatgtgcagataagatagtactgctgggtcttcgagtggaacaaggtgtttggaaataggatgtcatgccagtgggttgtctgtgattagctggctctcagaacaattcttctcccccacctaggaccccttcctcattgttgcttacttattaggactccacgttttacttcccaagatcccattcctatacacagcctctccctcttagccagaggagctgtgcaaaggaagtaccttttcatgggtaaaagactcatggtgcgctcactcttgctgggcttcagggatttttcatttctattgctctaaaagtgcctgtgtgccttccccctccatcccatctccttcctgcttccgagcccttctgtgggcagcatgggggccaggaatctggcttgttcctgcttttcctatggtggtctgccccaccattattcacacacagaggctgttgggttctcttaccattccctgtttacagagactcagatacattcagaagcgagctaatgctgggtgcccagctctaaggggagaccccagacaactccaatttcctgatgatttctcttcctttacctaattccttctccaagacccttgcagacactgctgtaccaagtggattctgtgtaactctctcagaagtttcctcttccatgaagcctgccttgattacccacccccatcctcactccctcagtgtttaagcccagtgtgtgaacagttaagagacgctatggtcttcccacactggtttcttctcttcatttgggtctcagcgaaatgtatctctgccagattctgaatgtatctgcccctgcccaaccactcacccaccatatccgccatttcctccacggcattgaccactctctcagatgattttgttcatttgtctgcctttacctctagaccaggggcatccaatctttcagcttccctgggccacactggaagaattgtcttgagccgcatacataaaatacactaacgataggtgattagctaaaaataattgcaaaaaaaccctcataatttgtgttttcagaaagtttatgaatttgtgttgggcctccttcaaagctgtcctgagctgcatgcagcctgcaggccacgggttagacaagcttgctctagactatgagcttcccaagggcagggaagacttcccatactcagcactctgttctgggggcttggaacagtgcctggcacatagcaaatatgtcatagtcatctcctgagtgcttgaatgagtggcctttggggtgttttgactagactgcaaaagcaacacttaagtgagctaggctttgcatacattgtttgggactggggaggattccagccaggaattgtcagggggggaggttcaagtctcactgaacatcgagatatgatgtggaagcaaccacccacagagccagaagacaaagcccccaggggagcagaaccacaaagggttgtgttctagtggggagggaggagtggctgagccccgcaatgccctaggctttctgctgggacaaggattataaataggagataaataatttttaaatggaggcaacatcctcactggggcaaaatattatggccctaaattctaggcattcaaatactgggccctgttgtctccctgctgtggttagaggatctggaagtgggaaggtttctggctctggcccaaggacaatattattgtagtcataaaaataatcagagcttggcattaattttggatgatgatgcctccttctcctgacaagccctttatgttttttggtggtgactgttggctgcatcctccaacttcctcaatgagagaccacttgaaaaagaaataataatttgtcttcatatcgcacactccgtctgggctgatggtgggaggggaatgcgtgtgggtgggctcagctctgttagctgcgctggctggaagagattcccagtttttattcagcgctcgagctgggctgcatgcttgctgacaagaggcgggaggccccttagacgtctttagacactccccctgtgctgggctgggcacaggcggctctactcagcagttcagcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaggtttgggcgacagatcagaaaaatgaagacctgcacatgtggagctggagcaaggactagtctagtattagctctgtgacgggagagctttgactgtcacctggaagtctgacttgattttgccagcaagaggcaacaaccaaaggttcactttctctccttccaattttgggaggcgatctataggggtttgccagccacctctcatccttgcagaccccaggtggaatttgcaggcagccactatggtgcaaaatgtaattttagtgtttttccgcagacggctgagccaaagacctgccgtggaagagctggagagaagaaatatcttgaaacgtgagtagctggtgattcctctagaggttttccttcacgtgtggtgaggctgttgcacaaatcctgagttcccataacccagcccttctctgcaagcggaatgctccatgctcccagtaaacctgagctgctgctgaattctgaaagcaagccccaaaggaaagctgatatacctagaaacattttttttaatttaaaaaaactcctttcctcttagcataaagatgtttttattttcagggttagtcccatatgtctaagtgcgttaggtttcaagcaggtcttcctggcagtttgggtcggggttcttcatggctatagaaatcacaaagcatgaaccgcatgaacacactagagaaggacacgccccttgcctgttacacttgggaggaataaagcagtcagctcagggaaacggtgaagccatgagaagctttcctgtggctcaggactttgaggttccaggaccctctgttgctcccagccttgcaaccccttgcatttcccgttaggtggacaattatagcatatgctgagcataggtgttcatgagtaacctccatgctctagggcactatattccattaaatattccataaagtcagtgatttaggggtggccaaacctcttgaaaaagtgtttctccaatagttctttatctagtcattttcagtttttaaaacattttccacagaaagtgtcttctaatggcttggatttttaaaggactttttttctctttatgtgatgaatactgcagactttctctgagtttgttttcttatttgtgaacatctttttatgaagttataatggtaccaagctgactttctgtcagaaaataccgcagagccccttgttggtctgggtactgaacttgaattgattcctccctcctttctttgcctcagtgccttcattaactgcctaaaacaatcccctcctttatagattgttgaaaataaccctcagataaagacttcttcattttactttttaaacttaagatatagtgactactgttctatgttaactataccatctctgaggatttaaagaaaagctcttcattgataacatgcttaattaagtaggcagacagaaaagtcaagctgtttcagttgccaaatatttgaatttttaaaaattaagtcacttatttataaagcttgtaagttgcagatgctactaaaagtagcagtccagacttgaaccaggcaagttcaagacacaggaagcaccacattccaagtagcctgctgtcagcaacaggaagagagtactacagcccagacctttaacccaggaaccatgtcttctttcagtagcagcctcttccttcctatcgtgggcaaccaggtcttcccatcagcaagtacttctaattgtgttaatctttggaaataaatatcagagccttagaaatagaactatctttggtgaatagggagctagcaaatgcataactgaaactgactgcccttaccttcagtgcatgaaagggaaaatgggtttcctctgcggtggccatggcaatcccgccataaacactgtgccttcatcagtgaatgtaggtttgtccttagctcggaagccctctctagtgtcctgagtggaaggacctgagaattttactgctaggtttgtggtgggtgtttggttttacttttgttctgtggagatgagaatagggtaactatatatagcctagtatgaaacatcatactcataggctctagatacacaggacttcaagcactcatactgtattgtattttcttcttgtaaccaattcttagaatatcacttttgtatttgcttcaagggggaactcatgactaactgcagtcatatctgaggagcactcaaaactccgcccatataacactataacgtggatagaaaagcagaagagcaggggtccctttatatggtgatggtaattctttattaggcccaatctgtgccagggactatattcagtacttggtatatattccctcatttaatcattgcaacatatttgtgaggtttgcactttttaataaatgaatattgggaaaaggatagcactagagttcaaccccaggtctgcctaactccattgcccatcttcttaactactgcatcagaagcagtaatacatttctggatattcatggaagtctcaggtataactgtccaagctgctggagctatttccagaaaatatgagtatagcagtcctgattatgggtcccttgctttgtataatgcagagggtgttctgggtctggaaataagaaatccataaacatatcactaaggggagctcagaaggggaggtctgtgggcttaggctaacagggaggacttcttggaggaggtctccaacagagcgcctggcacaaagcagcactctgacaggaactttcaaagatcagttctccaaagaccctgctggtgaccttcgtagtaattatggcatttttcaggattaaaaaaaaaaaaaagatctgactttgtttcaatcttttcacatggaagctgcacttgggagctgcccatggcctattttaaagaaatctgaaacattttacgtcacgtaaatccctcatggcttgccttgtctggacactttcacaatgtctctctaattgtatcagctttctgatgataccttaaaagtatggtttcttctggtttctcacttgtataaagaattaagcagaaagaggatttcattaccttttctaaaacaccctaatccaagatgactcacttaaaaaaaattactggaaagcacaatatattaaactctcatataaccaatcccacaaatgtataaatatttgaaacgcatcttttacataaaggcagataatgtgaaattgtgttaattgcaagtggcaggatttcccttaccaaaacctaccagtgtttctaggagtgctgattgttgaaatctctttcctaggaatggagctatgttcaggtcagggacataaggctttatttagcaacagagaacaccagaaataggacagccattatcttgtatcccagggggaagcttacgttttatactatatctcagcactttcgtctatttttggcttccaagggtaggtgcgagcacagcttgaatgttaatagtcacaacttaccaagcaaagctaattttgctgagggacttgggctcctttaaaaggcactgtcatataacagtgttcacgcttcagcaatggagagtcagcgaggttcatagatgtgttaagatttgaaatatagtctgaacatataaattccaggcaagcatatgctgcccaggagctgaagaaggtgttccatgttttatgttggttaaaaagtctgtacgcttattaaggaaaaaaattagtggcagtgctatttatattgaaatgtacatatacatttatttacttagtctactacagctttttttatgtggcatctaagtgctagatgtaaatataaagatatttggggagaaagacagacacagaggtgtctacttccttaaacaaacagcagccatatctgtggttgtttctaatgcacagaagggctgaggagaccaggttgggatgacagcaaagctttgcttagtacaagtatttctgtgtaatgagaccatgatctcctgagcagtgactgacaaagtgggaagaaaacaccatgagtgatgtggaattaacttcagctcccagaaatatggatatcttgggaacacttccctgctgaagagaagaacgtttcaacctgtttctctttgttattttttttttcctattttaatctttcacagaaaggaatgatcagacagagcaggaagaaagaagagaaatcaagcaaagattgacaagaaaggtagtataagcattttattgcctgaataataaaaggtggtctagagaacagctgcttcggtagcaggtgggatgggtaatgctaggtatcactctgtgatcatgaataatgttctcctggacatcatggcatcagttaaatcaggatatttgctcagcaacaatgaattaactccctctgacgttccctatggacgaagtccttccctagcacggtagcacttggagaggtgcacaatgcacatgacattttttacttatgttcaggtggaagccagaagttgattggcattttcttaatttacagtgtctaggaaaagcatacctgggtatcagtgttttagtcacattttacactcatcgcttttgttcacctccaatatgtctagaagttcctcagttgcagaaagctttattagactcaaaggtttgttctctgtgactcaaacagttaacatttactatggccaatacaggtagcaactctataaatcttaatctacttttaaagccttgaccatttctaaattcaagtgttctggattccccttcttcgttgtgctgctccataataattctcttgaaattaacagaatatccttcctaagctggacatataataactttattagtacttttaaaaagcttatctaattgtatctgaagccagtgatgccataaaatctaagttaattcactaaccattccttgagctggtgctatgtactactgggggtgtgactccttctgataaaatatgttggaggaagggggattgtgatttaagagtacagtatataatttcagcccttcacattagagattgcttgtatttgggttatattttccagtttcaggttttttttgttttgttttgttttttaagagaagtgctgtttgttcagagtacttcaaaaaagctagtttggcatgtgatacttaactatgatgatctttaattttagcttaatcagagacccactgttgatgaattaagagacagaaaaattctgatacgattcagtgattacgtggaagtagcaaaagcgcaggactatgacaggagggcagacaaaccctggacgagactgtcagcagcagataaggtacctaactgcctgtgctggtggggggtgttggatgatataataaaggcaaaatatgtcatgccagggagtttattcatagacaatgggagccctcaactatttaagggtatactgcagtaaatattggtttctcaaagataattcagggtcagattgagaagtggttctcagctaggtgacagttttgccccgagggacatttggcaatgtctagagacatttttgattgtcacaactcgggatgctactggcatctcctggtagaggccagggacactgctcagcatctcacaatgcacataacagcccccacaacaaaggattatctagtaccaaatgtcaagactgtggaaattgagaaaccttggtataagggataaatcaaaggtgggcaaggctgccataagagatcaactgacaagtttaaacaaaaagagctacagtggggacaaagaggcattcaagaaagcctctacagtatagaaaaggttctagattctccccctggacttgtgcagtttgaggtatctctgagaacctcctaagaagtctgaactgaacagctagagaggcaggaagaacacaaggaggtagtaggtcatagagtctctgcatgacatttggtgagcacagagagggtcagttcttgtctgtgatcaaacacttgactggcaagatttaagcccaagagtgtccatagagttttgtcaccttcttgcttctattaattttcagaagacttaaagcctttaggaagagaaaaattatacattcaggcaaggaatttgctaattgttcttcattcttcatatgctgagtatgagtatgtacacagatattgcatcaacttggagaaatgtgaacgtgttggactaacttgcctggttctttgtgactgatgtgcccagaggatcacagtgatgcgaggagaagtatctttggtggtctgcagatgtgtttgagtatgagaataatatacccctaaagttcttaaagactttccttgtcccagaggctgtgtttgatgttttcagtctcatcaggtccctcgagtgtttatctgagaaagaagtacatgatgcaagtgggcctggggaagccaaaatattaatgtatgctgaagttagaaaggcttatttctagattatctctgattataaaattccaagttcaccaaaagctgaagtttactcattatcttggtgttcctgtttcattagtgccctaagcatgtgcttggtccgtttaggtatggagtgaacggagtttggggaagggttgtcttcccactacagttcagcaaattaatgaatggaacacttacataatactagtcctagccagagcaatcgagcaacagaaagaaagggcatccaaactggaaaagagaaagtcaagttatccctctttacagacaatatgatcttatacctagagaaacctaaagactccaccaaaaacttagatctgataaattcactaaagccataggatacacaaaatcacacaaaaattagtagcatttctataaactaataatggactagctaagaaagaaatcaagaaggcaatcttatttaaaataggtaccaaaaatacctgaaaatgaattgaaccaaggaggtgaaagacctctacaaggaaaactacaaaacaatgatgaaagaaattgaagaggccacacacaaatggaaagatatctcatgctcatggatagaaaggactaatactgctaaaatgaccataaaatgaccaatgcaatccctatcaaaataccaatgtcatttttcacaaaaatagtaaaagccatcctaaaattcatgtgaaacccaaaaagaacctgaatagccaaagtaatccttagcaaaaagaacaaagctggaggcatcacactaacttcaaaatgtattataaggttatactaccagcataatattggtataaaagacacatagaccaatggaaaagaatagaaaacccagaaaaaattcacttatttacagccaactgatttttgacaaaggtgccaagaacataaactggggaaaggacactcttcaataaatggtgctgggaaaattggatatccatatggcaaaagaatgaaactgtacccctatttcttactatatacaaaaatcaacttgaagaataaagacttaaatgtaagaccccaaactataaaaccactaaaagaaaacacagaagaaacagtccaggacattggtctaggcaaacattttatggctaagacctcaaaagcacagatagcaaccaaaataaacaaatgagactatattaaactacaaagcttctacacaacaaatcaacagagtaaagagacaacagggaatatgagaaaatattaatatctgcaaactattcatccaaaaagggactaatatccagaatatacaaggaactcaacagtcaaaaaacaaaacaaataatcccattagaaagtagacaaaagacatgagtagacatttctcaaaagatgacatacaaatcgccaacaggtatatggaaaaaatgctcaacatcattaatcaacagggaaatgcaaatcaaaaccacgatgagatatcatcttattccagttagaatagttattaaaaaaataaaaacatgctggaaaggattaggagaaaagtgaacttttatatactgttgatgggaatgtaaattaatgcagccattatggaaaacagtatggagactcctcaaaatattgtttaaaaactatatgatccagaaatgccacttctaggtatacacgcaaaggaaatcaaatcagtacattgaagagatatctgtactcccctgttcactgcagcattattaacaatagccaagatacaaaatcatccaagtgtccatcaatagattaatggataaagaaaatgtagtgcgtgtatatatgtatatgtgaatacagtgtgtatacacagccacacaaaatggaatattccaccttaagaaaatccagtcatttttgacaacatgtatggaactggatgttattatgttaaataagccaggcacagaaaaacaaatatcgcatgttctcactcatgtgggatcaaaaaagttgatgtcatggaggtagacagtagaatgatagataccaaaggctgggaagggtggcagggtttggggagagaaagagaggttggttaaccagtagtaacatacaattagaaggaataagttctaatgttctatagcagagtagggtcactacagttaacaactatgttgtgtatatttcaaaacagctagaagagaggacttaaaatgttcccaacacatagaaatgataaatactggaggtagacatcctaaatacttgatcatcacacagtctatgcatataacaaaatatcacatgtaccctgtatatatgtacaaatattatgtatcaataaaatttttacaaagacttccagaatattagctacatactagcttggtaggactataataatgagtatggcagttttaatgatgaaccaaaaaattgtttgtttttttctgtatattacataatagagtcaacaaggattaggaatggttaatttataaacacgatgctaatttcctgatttttttaatatcctgtaaaacaatgtcttgtttttaaatttcaggcagcaattcgtaaagaattaaatgagtacaaaagtaatgaaatggaggtacatgcatcaagcaagcacttgacaaggtcagatttgtttctgtgaatttcatggtacttatttttgaaacacacaccgccttcccccgtcccccgccacaaaccatgtatccagctatacaaattcagcatttttccagagaactctattgaacaaatagaatgtacctcaagtaagaatgctgcctgctcccattatttcctttaggacttggtgaaaggtgatatgtatggtaacaatatcggtttatttaagtagttaatgcatatttaacaaaaataagcctcaaggcaatgaaagtaatttttctgtgtatttaattcccctctaatattcagaattcctccaatttatagaactcacctgtttatacttacagatttttgtgaaattagtcactccccaccttcacatttactttttcctatcgtaaattattagtcacatctttaacacagccagcgttctcctaaagctgagtatttgtttcctcagtaaatatttgagtaagtgctgagaatgcaatagtgaatatgataaaggaggctcccatcttcatggagtttatgtcccattgggaatatattggctgattctcccataatcaagacttttcccattaagatgaatatattctctgtctatgctatgatatgcaagggatgacactgggcttcttagtgatgacgaagttgggaaaagatttaactctctttacttattgaactgcatattttttcagtatttccccccacttcttttccatggccatgaccggtagtaattatgtgaagttctcaaacatctctgattctaaagcagatgactgtgatgcaacaagccttcaactgtatcagttgctttgtcttctcctttatctgaagatgctcaaggcccacatacaaagagaaaggaaatcctgcatatagatactgccttaaactaaaataatagctttagttttctgtttgttccaaagtggccactgcaattgttatctgaaagatttactctgtaagattaatgtggctatagaacagaaactaagtacaatggaattccaccttaaccaatggttttagggtgaatatatcaaggggaagggaaagttggatgaataggaaaaaattatgcaaagagtttgttttttaaggttccctcccatgactaacatacttttggggaggaataggtcatatggaggaataggtcatatgaatgtttaggaaaaacagtttcagtaaatcatgcacaattacatttaatgttcattctgtcttaaatagaatgaatacatattctatatattgcaatctcaattttgtacattttccgattatacattattaaatgtttagtaaagatgtttattgtcctaagttgatagctttctaaaataatgactctaatacttaaaatgtggtataaagaccctaaaattatttcaacaattcaagagtcagaacggtatttttggttatgagattttaagagttttaaaattactatgaacatattactctacaaaaagtcataactctactataattttcaataatttattaacaaattcatcatttctactgatttagcaaagccctggcctttctgtgtacttcaagggcttttaactcacaggtttaaaactaagttctagatagtcctaagaattcagcatataacaggggcctgagagtggggagccctctgagactctaccctattttaaccagagtagctccatcctcatgttttacatatgggacttctgagaatctttttaatagcagcaaatttatttgtataaggtttttggctattttaactgctagaaatgaataaccttaaattctttgtcttttttataatctctagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 780 - DNA, 126502 bp, Homo sapiens
cattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctgggtgagacatgatgatggggcgatggtgggggatgtggcagcacaaagcaactttgtccactgatgtcgggaacgccttttgaaggaagaaaagtgtaagttgttacccagagtagaagatggccaggccaggagttgggaagggggttctagaaggcaaagtgcgtgtaaagttcttgaaactagagatacctaaggaatctagatgaggccagtctggttggagcaaagggtgatgagtcgggaggctggagagtgacaaggaccagattgcgtggggaggatactgctgcctgggggcttcccatcctgagggcggaggaacttgaacacagtagttatttgctatcaactgaaatgtattgagcccctgctgctctgtgggcatacaatggttggacaaacagacaaagtccccgttctcaaggaacttgtattccaacagaaaagaaaagaaatacacaagacgacgtcaaagagtgacaagtggcccaaagaaagtaaaacaagggcccagtcagggtgactcacgcctgtaatcccagcactttgggaggccgatgcaggcagatcacaaggtcaggagatcgagaccatcctggctaacacagtgaaaccccatatctactaaaaaatacagaaaaattagccgggtgtggtggcgggcacctgtggtcccagctactcgggaggctgaggcaggagaatggtgtgaacctgggaggcggagcttgcagtgagccaagaacatgccactgcactccagcctgggcagcagagtgagactctgtctcaaaaaaaaaagtaaaacaaggtggcacctcagattgaactgaggaaggtacaggaagccactacagtgggtgggcagggtgggcacctctgtgcagtgggcattcaggggtgaggagtcagcactgtggcagtgttgggagaaggtattcctggcagagagggtggctgattggaaggccctgaggcagcaacaaacagggcacgatcagggacttccctgtgcagtcagcgtggctggaatggagggagcatgatggagaaggcaccaagtgaggccagaggctcctcagggggtttggattggatccttaatggaggggtgggaggatgccctggagggtttcagcacaggacggcaaggcctgctgtgcattgctggggatctctttgcttccataaggtcagtggaccgggaagtggccagaatggcagctgggatgggcaggggatgagggggacactcttgccatcatgcatgccacacatgatggggagtgggcttgaggggcagccatggcggaagaggagccctcaggggtttgggagaggttagcaaatactcatgcttgttttgggaggagcctctgctcacggtgggggcatgggggtggtggtgagcaccgcagcttgtaagaggcaagcttgtgtggctgctgggtcccacgtgctatcagatggactcctatatggtgtgctgggaaagacgccctgtggctctcaaccagctcagcctatggccctgagagaggatgtgggcaggccctgaccatcttggttttcttccctttttttcttttttatttatttctctttttctttctttctttctctttctttctttctttctttctttctttctttctttctttctttctttctttctttcttcagctttattgaactataattcacatattatacaattcacccttatacagttcacagttctgtggtttttgctacactcacgggtttgtgcaactgcaccacagtctaattttaaaacactttcatcatcccaagaggaaaccccatgtccattaagtgctccctccccacttcccctttccctacccctggcaaccgtgaatctactttctgtctctctggacacttcatacaaataggatcgtacagtgtggggtgtgctgtggcagggttgtttcacctaacaccgtgttttcaagttcacctgcattgcggcattgccagtttagggctgatagtattccatgatacatagaccatactctctttatccattcatccgttgatgggcatttgggtttctttcccactttgtgtctattatgagtagagctgctgtgcatattcacgtgcacatttttgtgtggacacctgttttcagttctacgggatctactcaggagtcagatggttatatggtgacccagtcttcggggcaagctcaggagcagaatcatcgtacggtgactcggtcattggggtctactgaggagtcgaatggtcatatggcgactcggtctttgggcaatggtaaggagtgagaatggtcatatggtgactcggtctctggggtgtggtcaggagtagaatgttcatggtgactcggtcctcaaggtctgctcaggagtagaatggttacatggcgactaggtctttgtggtctgctcaggagtagaatcactgtatggtgactcgatgttgaattatttgaggagttgccagactccttccatgttggctgcctggtctgcatcctccccactgtgtgtgaaggctctgatttctcacctccttgcccacaccttttattgagcctgaacacctttcacatggtcacacctgacctgagcagctgcccggccatagtgccaacacatccctggccacgagaggtggcgcctgggctggccaacgtgcaccctcagggtcgggatgtgatctagagcagggcttctctcattctgttcctgcccatgttcatttcaacccccaaaaggacttgagctctcaggcttaatttcatttacttaatgcatgaaggaggaaatgatttctgaggccaagaccggagtggtccccagggactccatttcaacagtgtatttaaaccaccacgtggaggttgcttgctaggctgggaactgtgatcaaagaacttccaatattttatgttcataaaggcagtttgagagtaatgttttttaaaaaggcatctgaatggggaggaataggatcattgtgaggtccacagtctctttgcctttgaagtttgcaagaagctactgaatgagttccatgctttgtaatactctggtctgggcaccctcaggcgtgcgtggccggcagggacctgtaggaatcctcttcacctggggagatttgaagcctagtgcatataaccagggccgtcacccaatgctgtgtgatcctgggccagtcagttagccttttgcagttagctgatcgttttcacctcagcttgaggcatctctttcaggaagtttctccagttccagtacacgctctcaagcgactctccccctctcctcaaaatgcttacctgcattttcatgatgcagctatgatgtgcaacattcactaattgatgtctgtgaaccctggtggctgtgtgccaggtaggtatgtgctcaggtgtgctgtgtgctcagtgaggctgtgaacccacgtgggtgtgagcccaggtaagctgtgtgctcaggaagctgtgagcctaggtgtgctctgtgcttagtgaggctgtgagcccaggtgggtttgagctcaggtatgttgagaggagggtggatgtgagcccaggtgtgctgtgtgctcagtgaggctgtgaacccaggtgtgctgtgtgctcagtaaggctgtgagcccaggtggatgtgagttcagtgaggctatgcactcaggtggctgcaagcccaggtgtgctgcgtgctcagtaaggctgtgaacccaggtgtgctgtgtgctcagtgaggttgtgagcccaggtgtcctgtgtgctcagtgaggttgtgagcccaggtgtcctgtgtgctcaggcagctgtgagtccaggtggatgtgagttcagtgaggctatgagctcaggtgggtgtgagcccaggtgtgccgtgagctcagtgagtccaggtgggctgtgtgcccaccgaggctgtgagcccagatcggtatgagcttaggtgggtgtgagctcaggtgggctgtgtgccttattgaggctgtgaacccaggtgggctgtgagctcagtgaggacagacaccacacctggttttgctcatgggtatcaccccagtacctggcccagagcagatgattgtcttgatttgggttttggggaggtgaccctggaatgaggatttgagagcaagtaatttataagaaagctgtcccaggagaagctggcaccagtgctgggaaagtggcacagggaggccaaggaggggtagtatcaggcacagctgtgcaggggcagttgcagcctgaccctgagggtactctgagcatgagtgtgtcagagtttgtctctgctgaggccaggggctaggctacattcttgccaccaccagtcattggctctcggctctgtgcaggaggacagagaggctgagaggctgggagttggcctgtaggggtgcccttaggggcaaaagcacatgggagctgggaggctccacagccttggactggaggggtgggcagagcactgacagtatccgcttggggtcaggccatgtggatccagtgttctactccgatcctctccgacaggccttccagaacagggtgtaccatgtgctccagcacgagggagacgtgcttctgatgtcagctatagcagtgcctccagggtcgatggcacgagcccagttgacaatccccacagccagatgctttgaaatatgtgatccttgataaatttttaatttagggtaattttaagtttgcatattgcatgagactttactgctctttgaaatctgcataaatcacagtcatgctgcatgtttgggttgtcacttggcatactggccagctttttgttggccccccaatcctacttctgctaagggctggcctggtgtgtgtgaccagaatgccaggcccagaagccaccagcactaagtcaatgggaagtgctttgctcagtgcagagctgctgctgctggaatcactgcaccacttattccccatgacactgggcctcctcgccaccaggtcaagccagactcaagacgcaggcaaacggaaaaatgcagaactgtttgctccttctccctccctggaaacccctgctcttataggttggctttgttggtccagccccagcttcttgacttggtagggagttccacaggatgaggacatgctttttgtgtttttctttgcactaaactatgtgtaacatcaaatttaccatttcaacccttttaaagggtacgattcatgtgtgccaatcatgctagatataatttgcattttcctgaatattaattagggggaacatcttttttatatgctgttgacggtttggatacctccttttggaaggtgttcccggactttgcatattttccacagggttatttgactttgttcatttgtgggagttcttttgatattctagaaactggactatgtccagttaaatatgttacaaacatcttttcctgcactgtgttttgtcttttcattttacagtgtttttgattaaattcttaatttaaataaccaaagagtacagttcagtgctctgtgcagtgagtgcagtcacattgttgcaaaaccatcactgctgtctaattccagaacctttcatcacctacaaggaaattgtgtgatactcctcattctcccctcctccaagcccctgataactacgcatctactttctgtctgtatgaattggtctgtgctgaacatttcatgtaaatggaatcatacgctgtacggacgctatatggacttttgtggccggctgtccccatgcagcatcatgttatcagggtccctccacactgtagcaggtgtccaggcctcattcccttttatggctggggaatgttccatggtctggatagactatacttgatgtgtccatttgtccgctgatggacatttgggctgtttttgctttaggtcatactttctgcctgatgtaaaagtgccagtcgtgtataaggactgtagtcagcgccaccatgccacagcttagagaagggatgggggaactactgggttgtcagaggcgccgttcttgaccctcagagactttctgtctcctggaggagaagtggctgtgttgggcaggtttgaatcttgagaattcacggtccctgggtttgaggcctcgctgtgccacttgatgccatgtgaccttgggcaagtcacctctccctctgagcctcacttttctcacctgttaaatgaggtacttataaagccgaatagcctaattcaaacattttaagtctgaaatgctctgaaattcgaaacttttttagtgttgacatgatgctcaaagaaaatattcatcagaacattttggatttcaaagttttggatgctcaactggtaatgcaaatattccaaaatcagaagaaatctgaaatccgaaacacttctggtcccaagtgtttcggatcaagaatactgcacctgtaacacctgcctccttagtggtgtgatgattgcgtggaatgagacatgaaaagggctcagcccaaaatcgtctggcaccaaatacccaatggataggggattttgtttattttgttgttactgttgttgaggtaaaattcatatagcacaaaattaactattttaaagtgtacaattcagtggcatttagtacattcatgatattggcatctgccacatgtgtctagttcccgaacattgtcacatcacatccaaaggagatcccatgcccattctcccctcccacatcccgcggcagccaccactctgccttgttgagtggtcttctgtgactggctcctttcgtttagcaccatgatcttgggggtcatctgtgctgcagtgggtgtcagtgctttcttcctggtaagagcgtaacatggtgcagtcattgtggaaaacaattgggtggttcttggaaatgtgaaatataggattactgtatgagctagcagctccacttccgggtatctaactaaaacaactgaaaacaggtattagggggaaaaaaacctgcacacgaatgtccaatagcagcactgttgttcacaatagccagtatgtggagacaacctaaatgcccatcgacagatcgatggattaacaatttccatacaatggactattaccttttgttattattattattattatagctttcttaactcctattgattttttcaaaagtgacctcagctgtcatctcttttccacaaagagtcttacctgagtctggagaccattcctttttctgaccacagaaccccgtcttaatctctgtcctgcctcttccactcattaattcattccctgattccttccaaagtatttgttgggtgcctgctatagacaaggtcactccagtggggagggaccgacaacaccaagtcagctgaaataacagcaccgtggagggagtgtgtgccatgcggagaattttgggttgggtgggagggtgcttggatgtctcactgttgctctgatggaccaggaggagatgtttgcaatgaaacccaagtgataagaaggaggcagctttgcaaaggtggaggagagcctcccttgaggggctgcttactaggatccggaggtggggatgagcctggggaggctgcagagaactgtgaggttggagctgctcacagggagaggtcacagggctttgagggccaaagggaggcctaactcctgtggaagccactggagggtttgaggcagggtaaggcggggtcaggggtgtatgccatgtgacccgaagggagggcattgcgggaacctgggagcgatgagggagacctgggccgggggagtcagggcagggcggatgtagcaaagtcacattgtcctgagtgaccattcacttggctgtccccgctcccaggcctcaggactgtgagggcaggcactgggtctcaggcccagagaagatgctcagaaaaggaaaaggagaccggggcacgagtgagccagtgcagtgtgcagagtgagggggcagtgggcaaagaaattgcatggcccagatcactcactggagaccagagacaccttagtgtcccaggatgatgaagagcgaggggccagagctaggggagttagtgatgcatctgctagccgggctggccctccctgtgggcacagagaaagtggttcctcaacagccatgggtgacctttaaggatgcccacagatggtgccatctcaggagaagggtcccagagggactggctctgtcacctgctgtcagctgctcccggaaagcccgcactgcatgacttgctggtttgttggaatggttccatcttgctgtgtcacttccatgacaatcaccagaggaaccaggcccaggcaaggggcctgtgatgaagcgagcagccctgatgacatcagaaatgcagacagttccagacattcaagcatgatgtccttggctcttgggtgaaaatcctcctcggtgtgtcagggaaagtcattgaattcacgttggacccggacttggtaaatcttcagaagcacgctctattctgcaggatttaagcttcagatgggcctagactggtatgcacaggtagggactgtgcacttgagcacagatggaccttcagcccatctccttttggttctcatatacttgttgagccctggctaggccctcctgagctctgtttcagggcctgcagaggctgctgtacaggtcacacttggtctctgctctcacggtcaagtagccaggatggacataaaactaatgaacacatacatcaagagctaattaaaaattgtgctgaaggccatggtggaaaaataacaggaaacctaacaggtgggtaggaagggtgagaccatgagggatgaataggagttcatcagagaaaagtgttgcctccagagggaatggcacagaaggcagccctattgtgggaaagcacttaatgagcgaggagggccatggtggtagagaagcttaagaaatggaggccagggctctggggttacagtgggggttttatatttcatcctaagagccactgtgatgtcatgtggggagcaatataaggccctgtttgcttgcttgcttgcggggtaggcaggagtggaagcgggaaaccagggcagaggctgcagaactgtacaggtgaaagtgatgctggactgcccccaggggttagaagtgaaatgaagataagagatcaggatccaaaaccatttattctctccctttttcttcttggggcacccagtagtattttttcccagaagacatttcttaaaggatcacttaagccaggaactgtcaaatgcacaaaccaaatgcactttctactagtttttgcaaataaagttttattgcaacatagccatgcccattaatttatgtcccatctgtggctgcttcacactacagcagcagagctgagtggcggcagcagagactgtgtggcccgcaaagcctcagagttttattatttggccccttacagaagacatttgccaattcctgacctaagcaaagtgagtgagggacgcattttcaaaacacaaatctgttggcttaaagtcttcctagcacttaaatgcatttaatccctctgaaaaatgctagagtagacacagtttttaaattgacttttgtttttctttaaccttttgctgatattatatataagaaactcaccttatgctttaggtttagaaagtcagggttggaactcagactttgaagatgttgtgtgatattatttctctaaatttctactacaatactaaagtctcctgatgtgttatttcactttttgtcctttctctgaaatgctcattttcctccttttctgtaaaatataatctcagggaagaagtttgtaaaagcagcttttagcctttgcaaagatataggtgggcctcttgtacaataatttttataagagtttgttctttgcaaatgcagatgcatcctactaagccacatacaaaaaaatcatcacaatgatgacaacaacaaagccaattttccagattccacctttctccttcctcatcctcttcatgtttgaatttgtgctgccaaattctatagagcattttcagatccacttgatttacagatttgagctgaatttcacttggaaaactgaccatatgtctggcaggcaccagcgaccattggcagtactatagggttgatactaaacagatgggctttctagttagatgtgctgttttttccacaatacatatgagaaagaaaagaagccactttaataatgtcttgatttttccactggtgtcagagtcatcaatgatgcccatttatgtagtcttaatttcagcatcattgcgtgcagggtgccttagacagctagaagaagcttaatgacttgggaaattttgaggcccaacttctgcctagatcttagagaatcttgttatctttggaatacagatagtggataaaagacttttatagtccaaaaataaattattaacactatttgtcaggaatacattcaaagttcttagtcctgggtttattgctcaaactatttgacagcttttgtggggttattgcagtctaggcagcaaggtgtaaatagcggttgtctgataggtctgtttaggaaaatctagctaaacaactgaatacgatttcttcctgcagaacttctcagagcctatactatgctaatatgcactggggctctcatgaagagggttttagtacagacagcattttctaactactttaatcctctcagcatctccctatgctagagttccatggaaaacactttgggaaacaccggtgtcatgcctagatggtaaactgaagagcagagaggctgcggcagacctgccatttaccagctgtgtgaccttgaacgagtgctttcgtgctctgagcctctactttttaaatgtaaaatggagctgaaaatataggccctgcctgttagggttgtttgcctggaatgaacatgcagaaggttttggtggcctccctttgggcattaaaatataagttctcctaaaattaagtatttattcaattcacaattttccaggggccaattattcactctgaagcttagccaggcttttgtcttttcttctctgtgcttcttagcacctccactaaccagtaaaggagagaaaggagatgccctttgagttaagggctgctgagggggcagccagaagaagccatggccaacatgaggtctagaggtggctcgggaattgcagttaccttccactgtcgggagtcagtgggacagctccaggccattgttaaaaaccattgccctgcatttgattctgcttccatttttgtatcatgggatcaatccactcattcatttattcactcgctcactcatttattcaacccacctgccaggcactgtgctaggtgccggaggaggaagcggaccctaagtctaggaattgcattgtgcagttgttgaggtctctgtttcccctatactggaaaagtcagcagttagtccatcaaacaagggctataatcagattacagattttgatgaatgaacttgcagggctgtagaaaaaagcctataagcttttaggaatagagccataggcatttagcagtattttcttcccttttttgaataaattcactcctttttttttttttttttgcatccctccctgccctccacccaacaccagcaagcagtttattcctccattataagcagtgtgactataagacacttgtcaaatggtctcactttgtccttggatggtatgacccttgttttgtttttattgatcagcacacccaaaatatcatgctcttcagtcattacttaggaattttctaggggtggaggaggtcaaaccaagaacttttacatttgggagattgaaatctatttctaaaacttgattttggaggttcagctccattctggtggtcactctctgaaaatgcccagcactttttctgtagatggctgtcaagccacatctcttgcagcctggccacaggcaattggattttcagtgctcagtgcttccgtgtgaggttattgtatgttgctttaaaggttaacttcttcctcctcccagccctatttctccttcctcctcccagatcttagacagcagtgttatcatctgctctgtgtcatctagcacaggactgggagaggggcggagttgtcaaagaggctgtggggttaagatcagggcttttacagcagatgacctgagttctaagctccactctgtcgctaactagcatgtgccctggggtaattatttcacatctgtgtgcctccattgtcctcatctgtaatgtaggtgatgaaaatagttcttcgcttgctagggtcttgatggaatacaatgagcaaattcatgccaggtgctcagcactgagcctgttgcacagcaaatgctcagtagatgcttccgttgctgatgacagtgatgacaaaaacaaaccttcgtattccttggctcttccatatgtgtgagtgcccccatcctctgccttcctgccttcagccttgttccccctacagtctgccatcctcaccgagattccacgtggtcttctcacaaggctgaacttgctccaggtccctcaatgactccacattgtccccaggactcttatcacagccacacagctcttcttggtcaggtccccacacgccttcctaagctcacctatgtcaactctgttccatagaccataagctccagcctaagggtcctcaagttccagtgcacagacccacaccagcaaattaagaacactaagagcaatgcagttgggttttcatttacgaatgtagaatcaattaatttttttaagagacagggtcttgctctgttgcccaggctggagcacagtggtgcaattcactgtaacctggaattcctgagctcaagcaatcctcctgcctcagcctcctgagttgctgggactacaggtgtgcataaccacaccgagctaatttttttttccttcgtttttgtagagacagggtctcactacgttgcccaggctgggcttgaactcatgccctcaagcagccctcctgcattggcttcccaagccactgagcccaggcctaaaaattctgtttgtttgtttttttctgagactatattttttctattatgtgtactaagttgtgatgaacatagatgattgctttgtgtagtgtgtgtgtgtgttggccattactgccataatgaacattagcatatctgtgtggatcccaattttatatgtggaaattttactgggtttctgagccttagagactggggacctcagacctagcttccccaaatgactccccattccccaaacaccatgtactgccatgcatttatgaatttgcacgttttactaaaatcctactcaacctctaatacccaactcaattatcactacctactacctcccctagcttctagtagccttcttagagttatcccaccctcaagcaggaaaagttgcttcctctgctattataatcctctttcttgattcttcctggtggttccaggtaccttagttttctcagtggtcactgagtcccccgggagagagggtacctagcaccactttgtccctcaggcctaacactgtgctttgttcaaagacaatggtctccacgtattggtgttacaggtaaggactcaaagaagaaatagaggtcatatctcagcttcttatttgcttctattgtggctcatgtcacattatgaggttgccttacactttctgtgttccttcttttctcctccataaatacatgagcttcatgcagcgggaaactgcaggcatgttgatggaatttactgctctgtcaaaactcagagcagtcctgacacacagcaggccctcagccgatatgatgaatgggtttgtgagtgaatgaataaaacaaacaaggaaaaaattattttgcaatattatctgatagagatggcacctttcttctctaagaaatcagccatgtagcacatggcactgagtacctgacctcactcccccagagatatggggctttccttccaatatgtttttggggaatttcgtgaagtggaaggataagataagatatcttagtggatgaaagatgaggatgaaaaaatacctgatgtcactaaagggtggacatcaaagtcagatggacgaggaacagaccctggctccagcgtttggcagccctgcactccggattcacagggtcgagcaggtgtttatttgggcagcccctgggtgccaggaaccagcaaagatgcgagacccagcaacaagcacgagagtgacggttctcattgtcatggagcttatgtttgttctcatgggaaatgcagatgacagtcaataaatagtgaatcccagggcacaatctgagagtaatcagagctaggatggaaggaaatgtgaataaagggattggccctgcaccaggcatggaaattagcctgtaagctccatgaggtcagtgttccgtcagtcctagaacagttcttgcctcatagctctgtgtggctgttgatgggggaaagggatggagttagttacccagggacaagtataccagctactgtgagcctgagagaggcctgggagagggctggctggagttgccaaagaggctggagcttgtcccttgagttgcaagcatgtgacatcagcaggggagggccagctgccccatccatcatctgaggactgaggctgtgtgtagcacttcctcacacagatgccaggtgtgacagacatttcccattaattaacctctaatgcctcagaggtggcagaggtgcagtggaacctggcactactgttattcagaggctggggggtggctgctaatgtgtttgcaccttccagagtctctccagtgtgagaaggcagttcctcaggaactgcagggagagacggggagagaattcctggagtggggggaggtgctcccatctgtcccttccctctgtggacaggtgtgcatgggccacatgcacccgcccacagatggcatcccacccatgcaggtgcacacccacccacgcccatgcacactggctccgcaggtgctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacacctgccccgctgtacacctgcagtgatgggctcatgtcctctgcccttggaggggtttgtaagtagttttctctgagcagcactattttgaagtttctcttcttgggcggagagtcatagctctcacaagccctcccctggcacagtcctgggcttgagccaccccagggaaggcagaggggagagggaatttcctcccaagggggatgcagagcagcacagcctggggcccctgggcatggggtcttcactcctctgatgacagttgagccccttgaggagctgcttagactaaggcatctgtcctggtcaatgcattggatttttggtttaggagcaaagggtcttttgagctgaagaccctctagtggctccctgctgaattctgaatcaggttcaagtccctgactacgaccctgcctgcctccccagcacatccacgcctctcaaccactgtttcctcctgtcttggacagcctgcccctttcccatcatagcccctgtcctgttccccactggggcggccctctggagcacccagtgctgaccctgtcacagtcggtcagtcgacacctgccctcgaggctccctgaggaggccctgggtcctgtccttcctcgcgtctgtggggatcctggttcagggctctctatgtccccctggcacgtgcctgagctgttgctggcactggagatacagctgcaaacatccatcaagggcctgcagtcaggagcttcagctcggggcatgggcaggaggagtggagacaactacaaacaggtaaacaaatgagtgtgtgcgtgcatgtgcgtgtgtgtgtgtctgtgtgcgtgcatgtgtgcgtgtatgtgtgtgcgtgcatgtgcatgtgtgtgtctctgtgtgcatgtgtgtgtgcgtgtgtgtgcatgcacaccagctgatacctgtgatgagaaaaataaagaggaaggcaagaaatagtgaggagtgccatcccacatggggtgagccaggactgtctaaattcatacctttattcattgttcatctcctgcaggtgagtacagccccacaaaggcaggcatcgtctcttttgttcacctctgcacaccctgtgcctattaggatacatggcacatggttggtgtcagtacgtatttgttgaaaggtggagtgagtgagtgagtgagtgagtgaattcttaaagggagagaggagtgcagtctcctcagtggccaaagtgctccctcgccagccctcagctctgctgtgaggaccactgtgtgtcagagacggggtgggaaccccagaacctgctccagccactagggcagaagtggggggaggcagctgattaaaatagtgcaggtagtgacggtggtcctggcagtgatggtggtagggagggggaggcgccactgcccctcctgcccaccttccaccagtggaagcagtcacatagccacagcaagaaggagacaccataccccccagcaaggccctggcaaaggggatgcagggagtcaatgcttcaacctcctgttagtaagtggcagggccaggaggggagcctggggtgcctggtcccagcccccatgttcttcacagctacgtcacactggcttccatggcacatggcaagcactaatgcacaataaggatgataataagggggagggagcagcagagcacagagagctgcacaagtttagtgattaacttggattttgtcctaaatgagaagggaagcgagcaggaagtgatagggttagagctctatttctaagacatcggatcacaggaagaccagttgctggggcagggatgctggtactggaccagggttgttatgatgcaggtggcaaagaaagttgggttcagggtctgatctgtagtttattctgtgtgctactccgttttgccttggctgctaggaagctcagggcacacaaataccctcctctggagcccgtgtggtgtctgtcgtggggacccacctaactccttgatgctgtggccctcagcagaccctgattcctccagatccttcctgacactcccttcatccttcagctgtgtatgtgtgtttctggtgattgctgccgatcctttgtgaaggaggtgagatataaataaagcaatgattatgctccatcctcgtctcctctgctcatccctggagatcttcgtcttcatcttcagctgagcttggaggcttggggagacctagcccatccttcccctcgtgcaaagcatgctcaggacagcaggctttcccagggccatgtggagtcacagtcttgctcccatctggtgtctgtaggtggaggaaggaaaggagaggatgagaacatggaatgcattgtctctgagaagagaaggatccctgtacatccctctgcctcccgtggccttggggagagggtggccgggaggatctgtggttaattggtgttctgcagctgccctggttccacacatttcctgggctcccactgggtaccaggcactaggtgctggggtcgcctcaaaaacacagtggaggatgccattgctgtagctcccttaatggtttgcagagcccagaatgtcaaacaagacattcctgggcttgtctttccccatggggctgctttgtggagcatctgtggacacagcacctagcacagttaacacttgtattagtccgttttcatactgctacaaagtgcccccgataaaacaaaaaagaactgcccaagactgcatgatttataaaagaaagaagtttaattggctcaaagtttagcatggttggggaagcctcagaaaacttacaatcatggcagaaggtgaaggggaagcaaggcaccttcttcacaaggcagcaggaaggagaagtgcagggcgaagggggaggagcctcccttataaaaccaacagatctcaagagaactcactcaatatcatgcggacagcatgggggaaaccacctccctgatccaatcacctccacctggtctttctcttgacacatggagattatggggattataattcaagatgagatttgggtggggacacaaagcctaaccatatcagcactctattagtaatgcctggagagaatgacctcatgccccaacccacctagggtgggcctggtttatcctcttgtcttggtgtcccatccttctgtgttctgctttgggtcccctcgatgcagctttggaaggtgagaggggcctctggagtcagggtgctcaaggtcctgccctgccacagcatttcccagctctgagaccaacaaaaaaatggctcagggctctgatcttcagtttgttcatctgtaaaatggatataaaatggaatgatctctagctcatagatttattgtgaaggtaaaataggacaatgccttaggatagtcctggccctgcacaggcagtgaccagcgtttactccatcatcattattctattgctcatatcatagaaattattataatataaattttgaccaaaagttacctgcactggcatggtatgttaatcagagtgatgataaagtctagacatatagataatattattttacatggatgataacatgaactattaataaactgtgtattgtggatgtttatctttgttttcagattgtttttcattttaatttttttttagagacagggtctctctctctgtagcccaggctggagtacaggtgcaaatcatagctcactgcagtcttgacctcctaggctcaagtgatcctcctgtctccgactcttaagtagcatgcaccaccatgcctggggaatttccaaaaatttttttgtagaggtggagtctctgtgttacccaggctggtctcaaactcttgggatcaagggatcctctagccttggcatcccaaagcattacgattacaggcatgagccactgtactggccttcccagaatttatgaccacactgagtcctcccctcaaccttacctatcagggatgattatcatggcatcttttttttttatcaacagatgtggaaaccgaggctccaaggggccgggtggcttactcaaaggccctgggttagagacaggtgcagccctttggaagccagaccccgtggaagctctagaggctgccaggcaggccgcctgtcactgggggcacagaggtcactgccatgtggggccttgggccctcgggtgctgcctcatatggctcttctcaggctgagctctgcagagcccagattcagagcaggccgtcctgggcctccttggggcagccagtggcatgcatgggtgccttaggtgggaaatgcgggagtgtgaccccttccctgggtctgaggggcctggcccatcataatccccggccccttggacactggtaatgccccttcccctcgaacactggtggtctccttccctgtcctctctgacaaaggtgacctccttcctcaggtgagcccttgtgttagccacaccgtccagcccttctccctgcatgtccatgcttcctggggctctgaggtctgcatcagcttagggctcccagccccttccacaggtaacaaggcaaattcacctgctggctgtggaactgaccacgcgctgaccatgggaggctgagccagctgtcggggagtgtgtatgttcgcagggcgaggggtcctggcagaggtctgggctcctgtggtagcagccgtgctggggagcaccccacgggtctgcgatcttcctcccccagcgacactgggaggttaaatcggagcctggttgggactcaggtccttgttgctgccagaagaaacgtcccttccctgtcccaggaggcatctggggcaatgtgctcatctattctcagtcctgcctgggtgacggcctgaactctgctctacactgtgaccctaggatggaggtgacgctggcttactttgtgagcttctctaactttaccattttgttagttgcattttgtttcattctaactaatctttcctactaagggacacacggcttgtgctacaaaaacagcctgtgaagcacatctccctctctcccccgcctgccaacagccagggctccccatttctttctttctttttttttttttttcttctttttttgagacagagtctcaccctgtcacccaggctggagtacaatggtgtgatcttggctcactgcaacctttgcctcccgggttgaaacaattatcctgtctcagcctcctgagtagctgggattacaggtacccgccaccacactcagctaatttttgtatttttagtagagacgggatttcaccatgtcggtcaggctggtctcgaactcctgaccttgtgatctgcctgcctgggcctcccaaagtgctgggattataggcgtaagccactgtgcccagccccggggttccccatttctttggagggcccacagacattttctctccacacaccagtgtgtgcctgtataccacccctgttcgcacactggtggcgtgtgcgtgtgaatttgtgcgctggggttttctttggcctgattatctcagatcagtttcctgtccgtgcttggagatccactttctttctttctgcatctgcacacaggtggttgacaggacagacgatgacttacccagtccccctgtggacgggtatgtaggtcggtatgagtctcttttacaacaaacagcactgccatgagcttcctaggacgttcatcttcacgtgtcccagagtctacaaacatggccgtttcatggacaaggaaggggtccaggagcactgcttcctctgcctgctcacagacgtgctcacagacgtgctcactctgcagccgtttgctcagaattctcaccggcctggctctgcgttgggttccaaggctgccccaggcctgggctctaccctagaagaggtggcagcctggtgggagggcaggcaggcagaggtctttgcggctcattggtgcctgcataggtagcttcatgggcgtaagacaagggagtgaccctgtctgggacaagaggaaggtaaagactctggacaaagtcctattcaatggaggagctgaagtttatgaggcagagaagcggctgggagggagagcagcgtgggtggagggcagagcacgagcaagggtcctgggcaggcagcgtttcatgctggaattaggaacatcttcacacgtggcgcgtcatatggcggaaggcgaaggcttctggtggccgtgagtgggtcgcaggagggagggtctcacagagggaaattcagcgcacgctgctgagctgctgcggccactgtgggtgcactgctggacaaccatcctggggtccaggctttggggggatcactggtgaccccttagggtgagaggtcatcaccttgggcccccaggagtcacataggtttggtggccacttgaggacccccttggttttcgtcttccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcaggtaaaggcctggtgacaggcgcgggcaggctgtggctgggaccagcgtccttggcatggtgctgcggcccctgctgatctgtgacttcctggcccctacacaggaggggcagatgtgcttcatggcctgtgatggccaggagccatgcaagttaccccgctggcccctccagggcccacctggcctccctgaagccctggggtggagttggcaccaggcaccccatgtgggacgctctgcccagaccctaaggtgcccacaagtccactgggaccttgttaaaaacgaagcctctgatttacttagggctgggttgggccgagacactggctttggagcaaggtctcacttgctggcttcacctgggtggtgagcccccagcccacgcgactcccgcaccacctcacctcccacacctgcaatctcacttggaggatgctggggcctgggtcgtacccccacagatgcaggtttagttggccaagagcctcctgggtgactcagggttgaggccgtcggtttggctttgacacctctgggcctctcttcttcctgaaagacagaggctgctcccctgctcctaagctgtctcagtgtgccttccctacaccctcccaccaaagcatccagaaggttcctccactcacctcctgctgccccctcacaccctgccagccctggctctgtgggaagcgggattgcgatggctggtcccgttgcccccgcctcctcggaatccagcttgggaactgcagccatgaggctgaaccacagacagggtggacacaggcagtgatgacgggacaagcagccgtaaggcacataacggcagaacacggccccccagcatttggcatggaggagccaactcaaccctcagaacctcctgctaggccagcactcccgcaggatcctgccccatcggaagggatggggaacaggcccagaaagggaaatcactcacccagggtcacacagccagcaggtggcggggctgaggcttggaccctggcagccgggtgtggtggctcgtcagcctgggctctgcagatggcagtgttctgagaagagagcccggaggaggccgcatctccaccccagggccccgcctccagccacatgcctgtgagccacacctaaaaacaattagtgagggagctgctgctgtggaatcagtcccaggcctcaggaaccagccctggcgagtgcccgtctcaggctgttgcctcggggggtccctggggtcccatttcctttccagctctgaagaggcgcaggctccagggctttgaggatggtggagacgaaggccaggtgttacagcgcccaggcccacagcaggggaggcggccaacaccgacagcaggccctccactcatgcttttctgtgtgctttacaaaattattattattatttttaccaaccaagaagttgatagatgaattcttgttgaagtggaaacagaacaagcatcatcattcggcagatcttgagcacctcctgtgtgcccagtaccaacaggaggggcccaggccctgcccacccagagctttccgcagagtagggagtcgagtgacaaagtgtggaagccaccaagtgaaccagcacgtgagtcgattgcagactccggcgaggctgcaaggcagcctccctcactggatgctaggctcagctaggtgggcgggttccatttgttcccctgcatctggcagggccccttgcacacacacggcactaatgggctcttagtgatccaggcttaatggcaggatcacggagcaggccctggggggtggaaatgagcagggcgggcactgctttgggcccagtggtccgagaagacccaggtgaggaggctgcattgagctgagatgtaattggttcattgagaaaggcagggaagagcatggcagcagtgggaacagccctcgaaaaggcagcgagctggggaaggcacgtctgtgcagcagtgaaaggccgggggactagagcagagtgacctccgtgacctcaggggggtctctgacattctccaggcctgctgaccccagcagtggaactggaaggctgaggtttgtcttctgaggactctgggctctttggcctactccaagctgtgccgtgtgagttcaccagcaagatgctctggggaccctgcaagggcattggaggtctcgaggtttttacctgcagcatccccaccttcaggaccgccattcgggcatctggaaattcgaggaacagtgctgcattttgtttacttattccaaaccactattttcctttaaagcagggggtgttatttgtttcagcatatcaaattcctgatttcacgggcatcacgggttaggatgagttgaagtgaatgcaaagatgattgaaagagaaatatgtagcaaacagtggttttggtaggcgaggctgggggaaccggctgaagatggctctcaggggctgcagggtggaccagcatctcagtccatgcctgccctggcaggtggctcagatccactcagccatttacacactgtaccaccttcacaagctgcaccaccactgacgtccccatccccgagagggggagggtagagcctcgcagctgcatctttgggtcatcgggaagtccttgagtcagtgcaggcaaagacctgtgatgtctgaggctagccaccatgagcaccgcctggtgccggcctggggacggggtccacacagagctcgaggcctccacccctgttcttcttatctgctttgtgagcctggctgcagcctctttgctgacacctcccaaggtcagcattcactttgtcaattttatccacaattctggcacctggaaattggcttggaaattgggaccacagaaaggaaattctgttttctctgcccaaaaatgtccccaccctgctgtgtttgggtttcccttttcatcctttggctttagggtaaatatcctcagggaagccacccgggaggtcaaggatgggatgggtttccccagacaactgccccccagtcagtcccccgccccaggcctgacttattcctcctcgcccacttctagacacttgccatctgtcctcccacctgtgctggcatcaggcagaggctgtgcctgtcttgctcatggcagaatctcctgtgcctgacatggtgcctggcacacagtaggtgctcagtaaatgtgtaaggggtttccatagattgaacacctgatcaccatggcctgttcccccagtggagccccacctgtgaaggctgcagggcttctgccctccgtgactccccagcacccagctcagcacttggcacatagcaggtgctcaggaaatgcttttgagtaagtgaaataattccattgccagtgcctgtttgtcatctgcctccccaactagacattaagctaagccaggtgggctgactctgtctgttccccggcagctggcagggccccctgcacacacagaacactgatggactctctgtgatccagggttaatggcaggatcacggagcaggccctggggtggaaatgagcagggcgggcactgctttgggcccagtggtcggagaagacccaggtgaggaggctgcattgagctgagatgtaattggttcattgggaaaggcggggaaatcatcacagcagtggaaacagcccttgcaaagctgcatctttcaaagaaagggttgaggtggttatgtagtcttgtatttggaaattggggctcacctgtaggcaaacagttttcctgacggaaggaagaagatgattgtggagcagcccgaggcctgcctgtgaaagaagggagaatgggacaaggtggtggccgtcgctcaagagtgttttgctccgggaaggggaggcagaaagggctattctgaaggcggaattgacaaagatttggcaaattaggcttggtggaaggggactgggggctggcctcctcccttcctgtccatctggtagactggaagcttttaacctgggtttattggaagaagctctagtgggagagccgcacaggagaatctcatctgtgagtggatgttaagagcggccaggaggcacttcgcaaaggcgaacaggaaccacggaaaggagcccggggtgttggcggcagagggagggcactttccttggttggtaatttagggaacatttggtgaagggcaggaatggctggtgagagctagcttagagaggggcgttatatgtgcaggggctttccagataaatcacagaaatgatcgctgtagaatatctactgcgtgcactgctctttagctgtggtttatgcacattgcttagcagcactcttggtaagaaagttgggcctcgccagtggactaggccccctaaccccgaggcgcctgctagctcagtgtttttggtctgtaaacttgagcctggcattggctgtggcttggacagggcccagtgacacctttgcctgagactcacctgtgtgtttgtgtgttgggcagcgctggagaagaagatggccggcaggcaaggccgagaggagctcatcaagaaggggctgctggagatgatggagcagggtaagtgggacccgtccctggcttggaagggcacggtgctgggaatgcagaatggaaagtctcacatgagcccaggaagcccatcagaaacagtgtagaatccaaggagggccgtgttcagatgaagcctgcaaggttggagagacaccccatgtcaggagccattccattggtccagcccccaggggcacgggagaccccattactgagctgaagagctccccctcatggcaccactcctctctggggaatgtctaacagagctgggtgtgcatgaatctggtggtttatcccaattcctttaaagtggtagcagtggttttttcagcattaatttttttttcatattcacatttcagtcctccatttgggcaaattatttttaattccactattacctactccccctaccaccatgtaggaagcattcaggacatgctggggcggggtgggatattgtgcacgccctgtctcattggtcttcccagcatccctggggagagaggcagcggctatcccacttgcagacgaggcgtgggagggtctgggtggtgactgccccaagtcattgcagcctgagagcagagacacagaacaaatcctgatctcttggtctctggtctagagagcttaatctcagtggggtctacataatcatctttgtttccatctttcagaaaggccagttattatcactcatgcaattaactgaacagagttctttaattcccaagtctttctctttgtgatggattcctggaggtgtgaggcccaggacttagatgctgacactagcccttggtgccttccggttccctgagaggctaaatcttggttaggaggtttcacaacacctcactgcctctggaagactctctggagctggaccaagctctggcctgctgatttgaggaatctggccatgcatagccagtttcctgaggcttgcatggatatattgaattcctctctccccacttcagccttaaaatattactagtgtctttgtaatttggcccaaatatcaggaattaggaaggaagctcatgaaataaacgaatccagattttatgcagccgggcctgtcagcacacaaacccgattgtgggcccaggcttttgtcattgtttcctctctttagactcgaagagtgaagtattttgatgatgctatttttaggggaaatctacatgggaaattgcttcatagtgataataaaaccttacatgtgcgaggaaagcttggtgtcaagtcccgtggcactcagatggttaacgccgtcgtgacgctcggatttggcggaatgcggttgctgagctagaaatctggaggattttcactgggatgggacaaaaaagtgtcaaactccggcattttgaatatgttgccaacaagcatacctttggatcttagggaaggagaaaggaagatgaaaacaatgctaaggccttttctcatctattctaaaaaaaacactacttttgttgagtaaagagtaagtatatagatttggttcctctcaaaaatgaagctatagtttgactaattaaaggggaaaacttctaggagcgttggcttttttccactctgaatttttgcaagatgactttgtctgatgaagtcatagcagaggctggagacgaatgcttggccgcggccaggctgacagtgtggctctcaccctgctgccgtgggagcctggtctctggcttccgtgcctctgacggcgacatcacacacccgcaggcttacagaatcactttagatcagggtcggcaaaccttttctggagagggtcagatagtgcatatttcagggggacgtgcagtctctgttgcaactacttgtctctgcttttgtagcgcaaaggcagccggagacaaaacatgcatgagagggcatggctgtgtcccaagaaaactttatttatggccactggcctttgaattttatataattttcatgtgccacaaactattatttttcttttgatttttttttcttttgtcaaccatttaaagatgtcaaatccaggtgggggagctggattggtccccacattgtggtttgctcatctctaccttccatactctctctcttgctaaatgattgtggaccagggactagagtggcctgaaacacagtctctttccttgagagggaaaatgcactcctaaattgatgccatgacattttattgagggcccactctgtgtcagggtctgtgctagctgctgaggacacaggtgagcaaaatactgttctgaacgcacatccagtggggccattaggtaatcccacaaaaagccggcaactcacgaccacagtgagtgcagtgaaggatgcagcaccctaagatcatgagacaggacctgacctggttctcggggggccgggagatgtttgagtcaggtccaaaggtgggcaggaggacctaggctggttctcagagtctgttgcatattaggatcacctggagagatttaataaccctccaccgctcaggcagcagttaaattagatgcgctgggcgtgggacccaggcagcagtgcttcctcatcctccacagctgattccgactttgatgcaggaaggttgaaaagccaagagacagaaggaagcggggagtgacttccagcccacaggagcagcaagcacaagtccccgcggtggaagggaccttgagatggtgggttgggttggaggaaaggaggaaggaggaagcaggaaagggagaggggcttgggtcaagacgcctcccgtcttccctgcccacacaccggctggggtggcagaggcatgaccacgctgctgcgggagcctggggcggccacagtgcgagtgggtgggatctgcgaggagcccgagtgtctctgcagggaaatatcagggaccgggcagcaggggttgctctgggaggggacttggacttgcttttcgcagtcgactcttctgtgctgcttgaatcctttactgtgtgccacctgtaatcaacctgtaatcaacgtgctgtaataacgggatccacgcagatgcttggccacaggctcccggctaaatccttccctgcaccgcagtttccgtcctgcactagcttcaaaaatgtcttttctcactgggtcgacctgaggtcagaccctgtctgtccctaatcctcctggtgctgggtcaccgggtcctcttgcaggatgactggaattgttggcggtggctgtgcacctgccctctccggctcaggggaggatcaggcttgagggctgttgctctggggtaggcacgcagtgccgccgcctctgctgtggatgtgaggactctccagggtgaggagcagaggcgctttcctggctttggggttaaggaaccggcttcagggttaaggaaccggcttcagccaccgccttccactgctggcagggacgaatctgcagccgggggcgccctcctgtggccggccaggctcatgagcctccctgcaaggtggacgggacttcatgcaggacaggccctgtgaggctgtgggagtggattgtcagggactccagagcctcatttgagccccctcgaaactcacatttgaacttccttggccaggacaaaccccaggattgccctctgccctgcacacgcgcatgtatgcacacacacatgtacatacacattggacaccctggagcttgccctgaagcaggtgggcagcctggtggagtgagccggactctgggcagggccagcagaagagagcccgccagctcccgggggtgaggcagcatccagggcatgagtttgctccctctggggtgttactttatgatcgatggtctgttttatgaaccactgtgaccccctcccctctcgttcctgtgactctagtcgccagcttggacctaggaaggaccctgctggtggcgttattacatgactagatgtgtgcagtggagcccgttgtgccctggggagggcagaggggacccctctgatctcttcagtgctccttccaccctcgtctcggatatccgtgactaagtgaggccagaccaaatctctggtacaaggggtccccttccccagcccccttgccctggtccccagcccacgtttctctgtgctagacactgtttatgttctgaatgactttcctccatctccctgtatgcgttgacttggcattttcttaaataatttaaggaatttcctaccccgtcattgggtataaaagaagagagtttattactctgtgctgtgttcagtgacttgagattgactaggcattctttcctcagggaattggacagtgacaaatcaagtctatctggtttccatgtggtaggaacgccgggggacacatgtctgcacgtgtgcacacacatgcacgtgcacctgtgtgcacccacctgtgcttgcactgtgcacatgtgccacgacacacgtgtgtgcctgcgtgtgcatctgtgagtgtgtgtgcatgtctgcaacacgttccctctcactgtggctgctcaggtgcactgccccgcgctcccctctgcagccctcagaaggagagtggccgggcggaggctggccttccagcgagaggagcagggcctgggctcccaccgctcccccaacccctccccaaccagcgtttcttagcaacggccctgccaccagggctattttgggaactgaaacttttcactgaacatgattatgagctggagctctgaccgcagcccagagaagtcctgcaagaagtccttgcagaaaacctgcaagaaagcaggggaaggttcaaagactgtggaggggcatggtgcttttctgagtctggagacctctgggccttccaggttctatgttctgacctttttatagtggcagttgtgatgattttgatgatgacgatggaggcatccttattattaacagcagtgacagtcatggcagcaaaagacctgtgcattctaaggtttggtgtccataactgcaagtggtgggtggcagccttgcctgtcacatagggtaggtgtgaagctcaagctggcagagccctgtgctcccctacgccagctctcacattccctgtgtgttgccaggggctgggtaagctgtgctgtcacggttgcacgtcaaatgcgagtaagtcggtcacgagaaggggctggtttcagttttcagctttgtgacctctaattttgtctactcggtgagctctcttggcttgtatctgggttggtgggctgttatagccaagggtcaaatgtggctcaggacctgtttttatgtggtctttgagctaagaatgctttttaaatagaaaagactttcataaaaattaaaaaaaaaaaatcaagggttgcagcacgggggatacagcacgtggcccacagagcccgtcacaatggccatctgcgccttatgggaagagcctgccagcctcgcctggacctctgggcaactgacgcggctgcatggatgagatcgtccagccctaaatctccagacttctggcatggctgaccttttcattctccccggaggagacgtgtgcggcagagggaatatgatcagcagcgatgacaagctcaaatctcttccagggtcccaggcaggaaatgggtctggcatgagtcctgggtgtggtgaggactctggagggagaaacggttctgtcctaagcctgctgttagcagatgggcccaaaggtgcagaccaaggggccagatcactcttgtcaccctcctcttctcgttgtcagaaaccatcaccaacaacaatgacagaaagcacatgtaaagtgcctaccttatgccagacacattccataccctagctccgttaattctcactatgttgccatgaagcaagcagaaatattatccccattttatagataaggaaattgagatccagaggaatttgctatttgggcacaaaacaccgtttgcaggtggtgggacgcatgatggggtgactgtatactgtttgtccaaacaggacacttttaggagtgaaagggacactgttgaaggacacagggatggcaggtaggaatcgggactgaccaggtcctatggaccctgaccctgaagtaaatgttgcctcctccttccactgccaggatgggacgtgtgtggaaggaggtcagcgtaggctagcatccccaaacggccacctcgtggctgtgtcgacatgtgcaggtcacactgccctctgcaccgggcctccaggaactgctgtagagattgagaggagtcctgcagggctatgtggaggctttgtgcatggggctgtaacgtgcatctcagtgacgtgactgtgacttgctggccgagggccctgccatcctgcagttgggtaactgagccatttattttgctctccaagtgctgagcccctcagcattaaggtgcaaacccagggatggcaagtgaagggccagaccctcagaggctgcagcagccgagcttcaagagacggaaagcaccaggtccttccttatgccctgctagtgcctcctcttctgggaaggctgcctgtcagacctagggacccccggctctgtggcccctccatccatgggtgtgccccgttcctgggctcacggtgccatgtgtggtcatctgcgtggcttcctcagagtgtgagacccctgggggcaaggactgtatcttactaacctccaccttgccagggtttattacagtgccagacacgtagccggtgatcagtaaacacctgtttaatgcctggctgagggtcaaacggtgggtgcagaggtgagttggttctctgcagccatgacaacccctgcatctcagagacctacagcaatcaccgtttgttgtcccctgtctgggttggcctgtgatctgccccgtgggtctgctgactccagccagctgctgggcatgtcttcaggacaaaggtccagggaaacaggagggacgagcagggatgtgcaagcacttctcatgccagtgctgcatcatacccactgtgtcccatcgaccaaagcaagctccagggcagaggccggggtcagagtggggctactgcaaaggtgcacggcagtgggtgtggacgtggctcaggggcactgcagtctcccacaggtgtcggaggaagagtgcacacagggagtggagtgtaagagcagaaaccaggctagggtgtgctgaggtgcccagggctcccctggaaagtccagacttggagagggactcctagggtgtgtggtgagggggagaggggtgggggaccacccagagcctagaatggatacttctcagaaagactcttgggacgacggaagggatgaaggaagggaggtgcaggcccagctgacagctacatttccttgtagatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcaggtactggctggagaccacgcgaagttgagctgctcctagaatggccatacgtccccactgttgtccttggctatagcttaggcaacagccctcgtagaacattgttctccagagagctgggcccgtgctctaagcgctgccatgctgtgctgcctggctgggttgaagtgtttgctggggcacttttctctactgtctctttccaagtctggcacggctgataagtgaaggtacttaacgatgttcatctccctggcacacctaccccccctcccagggcgtctttgtgtttccctgggaacttctaggcaggaaagtgctctctggaggggcaagtgcccagtggggggattttagtgaccctaaaagggtaggaggtagggttgagggacttttctgtggccgaaatcctgccacagggggcctcttggcctaagagatgctgaagtccctgcatgtgtgcatgcctgggagctggtcggtgctgatgcagtctcagcatgctgcagcctatgtggggctcttccgctgcttcttgaggggaggtgggcttggtgccttgctccaagcctcagtttccctctgttaaatgggaaaagtaatggacctacatcagggttgtttggagggtgggaggaacttagcagtgtctgacgtgtagagtgactattatcaaaggcagtaggggctttgcgtagtggtggtggtttttattttaattgaatagaccagggcgcttcccaaggataggggagaagggaggaaggatagaggggaggaaagcaggaactggccacagacacctgcagatgcttcaccagctcctcctcctcctgcccacctggcagagtgattcttacggagcttcactgttgacttggaatcctgatgtctcgtaaaatttcaagctataagcgagtctcacacggtttgggggtgggaaggtgaacgcgtctctccgtgagtgtgggaggttggaaatccaggccccaggacagcctgctgggcttctgcttcagagcgggtggacacctggtcctccgtgcccgggacttccttctgccacacaagggtggcaccacacactcgcaggccgcccgtccacaacgcccctgcagcgctagcggcacctgcccagaggcatgctcagccctcttcgggggtggccgtgtctctccagtttcacttggcttggaatttggggtctgagagttgtgacttctggagggtcccagctctcacgcagaggccccctccacacacacaggtctctgtgtgccccaggcatctgactttggggctggcgtggttctttttttttttaatactttaagttctagggtacatgtgcacaacgtgcaggtttgttacatatgtatacatgtgccacgttggtgtgctgcacccattaactcgtcatttacattaggtatatctcctaatgctttccctccccctccccccaccaagcaatggcaacaaaagccaaaattgacaaatgggatctaaactaaagagcttctttgcagcaaaagaaactcccattggagtgaacagacaacctacagaatgggggaacatttttgcaatctactcatctgacaaagggctaatatccagaatctacgaagaattcaaacaaattgataagaaaaaaaccccaccacaaagtgggtgaaggatatgaacagacacttctcaaaagaagatatttatgcaacccgctggcatggttcttaaggctgagcagagcctggccttcctgccgtggtgtggtccccacagcccagcccttgtgtgtggcctgtgagcctccccaagggaggcagggctgctgctcccagcccttgatgggggtcacgcttctccttggcagtgatttctgtagctcagctcagggcctgtgcctgctcccctcagtgccctcttctgacctcagacacgctcccgctctctctccagatgctgggtgtgcggatgggttcctgagagcagagtgggtctgttgagattacacatttgtatcagggaccctctcctgagtgaggcctgagggaggagtgggaatcagctgggcagagagcgaggtgcagagcatcccagaaaggggaatgacatgcaaagacaggggacaggaacacacacgttttctgtaaagggccagagaggaaagagcatgagctctgcaggctggaggtgtctgacacagccactcgcctctgccccctggtagcacaaaagcagcgtcggtggtgaaagggtggggctcttgtcggtggaactttagtgattaaaaacaatccagggcccggtgaggtgggtcacacctatcattccagcactttgggaagccaagacaggagaatcacttgaacctaggagttcaaagtcatcctggacagcatagcatgacgccatctctacaaaaaagttttgttttttgtttttggttttaattagctgagtgtgtgggcacacacctgtagtcctagctactcacgaagctgaggcgggaggatagcctgagcccgggaggtcaaggctgcagtgagctgtgatcacaccactgcactccagtctgggcgacagagccagaccctgcttcaaaaaaaattcaaaataaacagcccacagaatggagagagagaagagacctggcaggttatccctgagggcagctggaaccccccagggatggagagtcgatgggatttgccttgtaggaagcgctctgctggtgacccagcaagacctgggggagactggagccgtgcatggttccctggggacttgtctcattcccagcttccccagtgtgggtcttgtgctcctgggatttgtgagatgacttcttgtgaatggcatgtggacagacaatgagaaaacattattaatgttcaattaataatgaaaaagtttaaacattaataatgaaaatacttttcagtaattagggcaagtagtattggcttctcattttgggcaatgatagagatttgctttttcttataaacagagataaaaatataaattcacttaaagtaaaatatagcaaacaaaagtatagaaagtacagaggaatgtccaaaatgtctaaagcaggagccacaagtctgatttaagaaagaccattccattccctagggatgcagctggcttattagcagttagtgacatttgtcatcatgctggggataacaagaggtgacacaagtggctgcctgcatgcagggttggggagcgtgctctactaatgactgcacattcatttagcttacttagccctggaagcagcccccggagatctcacgcccatgatgaaatgctggcacaaaagtcgaataactggtccaaatgactggaaacagagggcaatgtctttgacatcaggccgacctgggtttgagacacacggctgaactccttactgagctgtgggaccatgggcaagtgacttaacctttctgattatgtttgatcaactgtaaaatgaggatagtagtcacactgacctcccagggtcgctaaaattaaattaagtgatccccaggaaagacttatctccctcctaacccacaccgagcacttggaaagtgtctgctgctgctactgtagcatcactgttactctcaccatcatcgttgtcatcgtcattgtcatctgttgtcttcattgtcaaaaacaacccttggaaagggacgcactaacacgcattatttagctgcctacagatgctcccagagaggccatctctctggtagcatgtgtgttttgggatgtggggccacctgcagtttgctatggctgggacaaccccgaggcctcatccagccctgcaggcctgggatcctgcgccagggaccctgcgccagggacatcggtcacctccacaacaccaggtcaatgttcagaagcttggccatgagcaacatccctataaacggggtataacttaacacagggacattaaatgcactggttaaaaatttgcaagccaatgtttaaaaatcaggagtgttcacagaaatccagatgtgcagtttcttttcagtcatcaaagttcaggcctccggatccctgttcccacacagccagggtcgctggagctgaacagagtctgtccctgtagatgggtgttggagtttgcaaccctttccatgaaggttaagagcctagtctttggagccaatccctgtgttactgacttaatcttctgctttgggccccagtattttgtgatagaaggagttaaagcttgaggccactgtgaggcaacgtggtcctaggtctccggtttctactgcagagctcagggggaccagctgttagatgctgtgtgtctgatgctgtctgttctcttcccacattctgcacctcagcacccaagggaactgcccacatctgggcccagtcgctctgtgttgtgggtaattccatgacagacagatgtcatctaatggcagacaaagccagatcctcaagtggcaaatgtgtcacgtgagtgctggaacctgggacctgcttctctccttgaccttggacaagttcagggaaacctcatgggggcccagaacatggtgccccgtgggtgatggtctacacctgcaggagcccctggggtgtctgcagtggtgctcattgctgtcctgaaaggtcagctgctttctcttaaaaagcaaacctcccatgagctttgctgggggtcggggagaggggtcatcaaaaagcacaaggggctgtcctgggtcactcctggcatccaggtggcaacatccaggactggagttgcagcttccccgtgccccaaccatgatgagtgtgggtgtcaggggatacatctgaatattgcaaatctctcaggaggaggacactgtcaatgattttgaccattattttccttgagcctttggtttggtgatttgggttgactttgggcttttgtgtttggggcgactttgcttttcctggttttgtttggatggtgcccgatatggtttggctgtgtccgcacccaaatctcatcttgaattgtagctcccataattcccacgtgtggtgggagggacctggtgggagatcattgaatcatgggggtggtttccccagtactgttctcatggtagtgaataagcctcatgagatctgatggttttataagggaaaaccccttttgcttcgttctcattctcttttgtctgccaccatgtaagatgtgcgtttcgccttccgccatgattgtgaggcctccccagctatatggaactatgagtccattaaacttctttttctttataaattactcagtctcaggtatgtctttatcagcagcatgaaaacggactaataagtgccacaccagcaacagagcattccctacaaagcccagaaggatccggtgttttgacacaaatgggaacagggtcctcttcagtgtttctactatgggacaggggctgagttctggccttcccacaagtgcactaattaaaaaggagagtgacactcagggagcgtgttctgtgtgcactctattatcttataacagcctcatatttttggatgagaaaacagagcccagagaggttaagtcactttcccaggccatagagcataaaaacagatcaaacccagtggcaggactgggtttgatcttcaccataacagtctacagcctaaactctagagccaaacaggagacaaacatttcttctgcttctggaatgttctggaatgtgagtctagaacaaggactgtcaaattgcaggcttcaggtcagatactgcccatgtctgtgtctgcatggctgtggagcactgctctagtgggccggtcctgggagccagggagggaggggtgcctccctccctgtgccctgctcctgtcttcctagctggtggctgcccttaaccactgcctggggcctatgctggtcccagctacccctggggcctgggctctgggcaactgctgggcaccgagtggaggaacctcatctgggagttggtgagccacctggcccacagccagctgcccaagctgagaccaaggttgtgctgggtgtacgggggtggagtacaagtgaccatggctcaccacatccatccttgggctggccacccttgaactccagaatgtcttcagtgggtggtaactggctgcaaagtgtgtcccctgccctggtagccctcttgaggcaagtggcagggcagagtttttcctcttgtttaagttcctacataatattcttgattttgcctcttagcctggaaagacaaaaatgtttactatctgcatctgaacagaaaaggtttatcagcccctgctctggaaaataagtggggattacacagaagggtgtcagtggaacatgctcagcaaagaggtaccagtaagtcatgaacttgtggcgctgtggttgagcttcaggtatttccattcctagccctgacccctgcattggggtttgtacagtgtagaagcttctggttgagactgcatttggtaagagggagcctctgctggtccagccccaagggagcggtcccccaaatgcagggaaccagtgtcttcttccactttttaaaaaattgattcagcacttgagatgttaacagatgttgcaatttcagttttgacaagattccaaaatacaacggtggctgcacactcacgtgagatgcagagggcggtgtcagagaggagagggaagatggggaggagggagggagagaggagatgctgaaaaccgtctcctgtccttagagccatcaggcaggctaaggatgtgagggttcagtgtgtggtgaggatggatgttttgggggagactttggaggagggttttggtcagcgtagctggtgtggtgagtctcatggccatcagggtgaagggtggggaacccatagtcccaccttgggcaggtggaatgaggggacctcagagacttaccctttaccctgtgccttaaggcagtggcactatgaccattgactcagtcctgggaaatccagagctcccctgtccagtgcagtagccactagccatgtgactgtttgaaataattaaaatttaagcttgtttttcactccagccgcttgtccagtgttcagtggtcatgagggtctagtggccaccatatggacaaggaagaaatgtgtccatcatctcagaaagtgctactgggtagtaccgagggtcagggtggctgcacatctactttgctgtgaaacaagggcagatgtagtttggattggctagccttccagagttctccatactaacagagactgtaatagcaacagaggccacatggcccaagctggaaatattttctacctggccctctgcagaaaaggcctgccaaaccctggtttggagaatgggtttccactggggtgggaagcattgccaggagctgggaggctggtgaggaggcccaggcagaagttctgacagctcacactgggaaacacgtgggtatttctgagaaatattttcgaagtagagttcgtgagacttgcctgtgaattagatacaaggggtgggtacagggtggagaggacaagagaaggatggcgtggggcatctggtctggctggacagctggtgggtcatggaacactgaacctggtgaaagtaggtgatatggtttcgctgtgtccccacccaaaatctcatcttgaattataatccccacaatccccataatctccacgtgtcaagggagaggccaggtggaggcaattgaatcacaggggggcagtttcctccatgctattctcacaatagtgagttctcacaagatctgatggttttataagagactcttcccccttcacttggtacatgtccttcctgccgccttgtgaagaaggtgcttacttctcctttgccttctgccatgattgtaagtttcctgaggcctccccagccatgctgaactgtgagccaattaaacctcttttctttataagttactcagtcttgggcagttatttttagcagtgtaagaagagactaatacagtagggatctgtctggattagtgccatgtccacagcttctagaatagtgcctggaacccatggttgttcaataacatttgcaagatgggttgatggttgaatgagcaagagggaagggaaggctcaggagaattttttgtggggaccaagattcaagtttggatgtgattggcctccagatggagatgccagtgtggccaactggtaacatatgagtctggagctcagagaaatggtccagggttaacagagaaatggaatcagttctgaagccaaaggagtggatgagaatgacctgtgagaaggttagacagggaagaggacctaggccttcatcctggggcagcccaggtggacattcagatgcaggaggtgggacctgccagagaggctgagcagaggtggccagagctccaggggagaaccaggagagtatgtgtcgggaagccagaggggaaagtgttaaagatggtggatggctgagtggggtggccctggctcagtgagggggccaggccttgctgggtggagatgcagtgttaaaggtcatctttcataagtttatttttcaaaggagcagataattgtaactaagctgggagtatacatgaggtcaagactgtttggtttggttttgggtagaatattttagatcttgttgggatcctgaaaagaaggataagtcagtgatgcaggccaagcgggacaacctgtcaatagctcagagggatgtggaactggcccaagtcagtgcttatctagtgaagtcttatgtggagatcagacatagaagatagatccagatgattggctggggctgacccagaagtgaggacactgaccccaggctgcccttcctccctggtatgaggacactgaccccaggctgcccttcctccctggtatgaggacactgaccccaggctgcccttcctccctggtaatgcttcctttggtggcacctctgagcagacccttggagcctggttcagacgctggccacattgtcctggaggagatgagtcagaggagtgctgagtagctctagacaaaccttccccaccatggtttcatgttggcctttccatacttgtagtgggcaggttcgggtattttatacagattattgtacagatgaggagactgagactcactaagcaaggtggaggccaaagtcactcgtctgtaaataggtcaaacgtatggaggaagggggcggatgctggatactggtgtaattgaggccgggtgagccagttccgtgacatctctgtctcccaaaagcaggactttggaaatgtgctgggtgaccagtaccctgagagcgtaacccattcacaaagaagcgttcaggaacaagaagtcctgtaaacccaaacaatcaaagcagggtgtggatgcaaggaccatattaaaggacttcagaataatagatgtgtgaatatctgaaaaggggtgggacccccccaggaagaaacttcctagaagaaaactaggcctgggctggctactgagagctcaccccatgcctggtggtcttggccaggaacttggctgccgaggaaatgggctgtgaagtgtggtgtcccaagaatgagggtgtccacttgcctgtgctgatttacacaagacagaaaactccacaaagttataactggaacctacatagagaaaatgggcatttctgtgcttacctgtggcttaacaaggacacctcacaactatttttacctagaaagcataaaatatttactttgatgttgttatcagggcaaaacttactaagtgaaacaactaatcagagttgtagactcttagacattataggttacaagtcagatgacataatgacagtctcaaagcataggagtcttaaaccctttttaacaagtaacacttttgaggacagtttaatgtaacaagaaaaataaaatgaaaacagcattttcatgtgggtatccatgcagaacaagagtatagagccagttgtaatggttgttctcagttcaggccaacttcataacacagagctgagtctgccgtctgcagctggagtatgtgttgttgagggagaacaacacatactccatctctgctttcagagattttgttctccaggcattaggagggctggcctttctgagataaggactccattgtcatgaacttaacataagaaagggctgggaatgagagtttaaaacttccaacatagccaataaaggaacggaaactaatgatagctaatgggatacaaggagcgtgcaatatttgcatctggtgtttagctggaggctctctgcaggcaggaattaggcctgttgtaacaccccctccctgaccactgtgttttcagcaccatggacagcacccaacagctcttgggtacctccagaaacagcagctgatagatgaatgaaccccataggagctaacacagtgacccaaggacaagccccagctccactaggcttttcccttagacatacagtggggagagtgttcgtgtgttcttcattgggtagttgtaaaaactgaataagatgatgtatgccaggtgccttccacaggccttagcactcaagagtgtgctgagagggcaggaagtgagggagtgctggtcccagggagaccatctctcttggatcagagggaaggaagaatagagatgctggggacagcagtttgcatttgagtcagaaatccaagaggagccccggtctgatgacctcagtttcccctgtaaagctggaggtgaagctgtgtggtgggagcaggcaaaggtgggaagctggaggtggggaagggacagaaagggcttgagcagtcatgcagagcacctgcaggaggaagctcctggccacgggtcctgcagagtgacagttcttcctgaagtggactccgtaggctcttcctcctgcaatagtaggcaagggcaggagcagacaagtggcagcttaatccccagatgaaacttttccagagagttaaatggaaaggaatccaggcaaaggacttagggactgttggtccgattgttgttgaaataatggatgatggaacccaagccaggcaaaaagagaaataagaaagggaaggattgataggttgagggaaagctggggatgggcaggctgaggggtggttgtgaaggaggtggatggagcctgaatcagcagctagaaagggagggatgagggttctgggtggcctgacccttcctccaagtcgatccttcctatcctcactcccactctaggctggcatgccagatgttagggctgctgcaaacagacaaataagaatgagagctgctggactggagggttacactgtgtcatggccacttcttgcttaaactgagaaacaatcctgtgagggactattgttaacacaatgccatgcatgagtaaatggagttttggagagatttagtaacttaaggtccaagagtaaattcagagaccacttgagcctgggtgtgtctgactccaaaacctggcatggtgaacactgctcctaggtgaggtgggagctgtggcatggacctctcatgtggaaaaaagaatggaatccctcatactattgaaatgacttccctctctccatattcctctctctgcttccgatggttctattgagagttgaacttgcaggaagtcaagtgcctgtgtgaggtcactgctctgtatgctcttcacgatcccatcccaccaaaccctcttgctttgctctcttacttccactgctgtcagaggaaacatgtttttaactctctgctttgcctttgaaccagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggtgggtccacatgcatcctgcccattctatttcctttctctgccccatccatccatctatcctacattcatccacccatccatcatctatctatttattcacccattcactcatccatccatccataccttcaaccagtcttgattgggcaccaactgtgggctggttctcatcattagcttctgtgactggggctcagggcaggcccagaggagtagatcttaccaaggaaactgtggttggcaggagtagactgcctaggctccctcaagcaaacaggggagtctctttgcaggagtcaaaggggggatcttccaggacctgaatgcaagaggtgcagccagttcccaggatggggcttggctttagcttggcttggcttttctttttcttttttcttttcctttccattctgttcctttccattccattccattcctttcctttccattcctttctgttccattccattctgttctgttccattccattctttctggatgctcatgtgtctgtctttctctttgtgcttctctctgagtctcagtctctttcagtcagtctctctcccttcctccctccctctctctgctggtctctgttttgctgtttcactttccagtgagttctgtccagcaaggcagagccaggagtaaacagcagacattggtggtcagataggggtgcacagctggacagaggcccccacagtcatacacttatgtagcttttgtcacactggcagaataatcctagcaagtagagataattactttgcaagcttaggtattttttatctggaattgactgctacaaacaggacacattgatggtctcagggaaaaagtaggctgttgatcaagagataatgacttttcagagtaaagccttgcgtgctgtctttgaaggctgtgggcgtgaaacatgatgcatagcagggtttgacagttttgttacaatcacctaaccagtgattaaccaccatcaataattgccatttgctgggtaggcacgaggtgccccatttatggttgagaaaacaggctcaggaaactccagtaacttgtcccaggtcctggaaatgattgagacttttgaacccagtttttgggcccaaagcttgttgctaccacacgtgtggccaggggctggtgccctcccctctgcgatctcacctaatcctcattgtgcttcttcccagttttcatgaaagagggaactgccaccttttggaagaggtgtcagctgctgagacaaggagagcccgggcatgagctcgggagggctgggtcccagcccttggctcttttctggggaccttactgccccttatggggtgaatgttcaatctggaggggactcttgggtggaaaatgctttcagtggggcattttccttgtacacctaacacgaattaagtattccagtctaactgatgattctcagccagataccacagaaacggaggaggtgagatgcaccccacagggggcctctttagctgggactgcagatgtcctggatgggttagatgtggggctgtggtgccctgtggttccccaagtagtattggtttgtgggagaatgtgctgctgggtgggtggagggatgagtgagggggcgcccccgccaccccaccaccctgagacttggccccagctgttctccctgacagaacattctcccttcctgctttgcctggtcagtacctttgcatgcttgggaccacagctcaagctgtttctcctccaggggagccagccctgacccttgacctcatagcaccatgcgccccatcttccagcatttaccacattgccccaccttgtttagtgggttgaatggtgtcaccccaaaattcccatccacctggaacctcagaacatgaccttgtttggaataagggtctctcaactgccattaagttaaagatcaagctgagctcatgctggattcggttaggccctgaatccaatgacagtgtccatgtgacaggcaggacaggacacacagggatgggactgatgcatccacagaacgccaagaattttccgggggagaggcctgggacggcatctccctcacagcctcagaaggaaccaacgctgccagcatcttgatttcagacttctggtctccaaaactgtgagagttgttctgttgctttgggctgcccaaggagccatacacgccttgtctgttggatggtttgcctctctctaaccacctgccccccagacagtagtccctgagagacggccacacgtctgtgttcactgtcaaatccaagtgcaggcatagtacagggcatacagcaggcactcagcaagtgcagatgatggttggatggatgaatgaatgagtgaatgaatgcatgcgtgctctgaaccctgtctgtctgctttctgcatctttctacatctctgtagatgaatccaaatattcagtctttatgcaacatggccacataaattacagtacaaagtttgaggcaaaactgtgctactttgcattttgttattgtctttgtgatagctccctttttcctccattgaaacctaaaaccatttaaagtccattcaattagccaccatccacctcattttattctggcgaatgtataatttgttcctggccctcaataacttggtaacccagagagtttcctgcctctcccaagcttgggaaggtcgagcctcagatggcacaggtcttcattctgactccacacgccctaaattctggcgttctgtccccagtctgcggacacttctggcttccgccctgccctcagttgcaaggacatcaggggatactctgacacttatgcgtttccatagggactgaattgagactgggaggtggaggagggtagttccgagctatgggtcctggcctggcttcttcctgcacagactacattttggtgactttgatttaattttctcagttcctctttttccttttcctttgggaaaaggttcatgtgcttcagcatgtgaacactagatggtagcaaagaagaaagtctccttacctgggcttcccttgctgcaggagggaccctggcccaactgagtctccacccaaggcaggactgcaggtgtcttagttcatctgagtgacttataaaccacagaaatttattcgtcactcttctagaggctggaagtccaagatcagggtgccggcagatttggtgtctctgatgagggcttgcttcctggttcataggccaaattcctggactttcttgaaaagtcttcatctctgatcaccctctgagtcactacaggcccattaaggtgggcaggttctcctctgtgtgctgtggtccccaccctgcccccatggagaaattgcaggaggtcctttgcattcctgggtttcacctgcctggtccctggagatgcgtttacccctctcccttttacctctcctttacccctgctgtcacctggtccagttggtaacgctcaactctgcgggatgggagtcccacagcctctgccaagtgtaagtggagctgggtgcgatgtgctgttctcagcccccaccttttcctggcagcctgcccctgaggtggcttctgaacctcagcttcctcatctgtgaaatgggggtgacaagtggtcccctgcacaagctgggtggggcgagccaggcaaagctctatgggggccgtgggggcagtgctggttgtcacatctgtgattgacagtggggcagagacctgggtgggatcccagctccaccaagctgagcgagagcaggcaaaccacgctgcctcagtttccctatttgtacaagagggctagtgattccttcctcatggggctggggtgagaagtagaggcaatgatggttagagacagaggggctgggggatgctgcgtgtcacctgcgtgtgctcaggagtggggcactgtcctgagcaggagcagcctggggaggctgaggccagtggggagaggacagcgcagtgtgcagaagctggggatgggtctccctgcagcccctgccctgcctggccacttcttgcatggctggctccttgtcatttctcaggtctcagctcaaagtttccctctgcagagcagcctttcctgacctccctctcccaaaccagctaccacctccccccgaccagcccagtactctcagcccacctgcgtggtgccctctcgcccccctccctccaccactctctctcccagcccttttctctccctctccttctgtctccttctctattctacaatcatctgctctctttctgtctgcctggcctctgtctgtctccaccagctgacggcagggcctggcccgtttccctgtggcctggccttgtgtggccaagcaggtgcttgtagagaaagcgaaataactaaagtcctccacgaggtttacagtttccttttgggttttgaggaatactttttattgatgctgtccacatcccaggattgtattggaagtttgtttctggtttttagggaatggggtagtttagatctggttgttttgctggtgggattaaagggatctggtgtttgcaccagtcctgccaggacgcttttggaatgagagtttgtgctgaacacctaagagcttctgggcctgtgccagctgctaggctcctgaaaaggagctgatggtctcattttacaggcaagtaggctaagcctttgagagcttcagtgacttgcccagagtcttgcatactgggaaatggcagatcaagaccagaggccaaatctgcagaagacaaagcccatgctctctgctcttccgggcacctgacaccctgctggcccggagcacatgcaggagactgtcattgatggaaggagggggtgtcccactcatttagacttgaatgagcaaagcctgtttagaatcatcttcaaagtcatttcatgtacacaagtgtttattgcccgtgttttaagtgccaggcctggggaaactgtaggaaggaaggtggacacaggcctgcccaggagcaagaaacagactgggcagcgtgattcactccaagtaagaggaaaagtgtcagggcaggctcaggtcccaggggacaggagacgagggatctgatcatggcctctctaaggaaatggtattctagcagaggagcggggaagcatttcaggcagaaagaacagcccatgcaaagactcaggttggacggagtgtggtgccttcaaagacgggagagatcttcacatgctggagtgaagagagtgaggtggagatgcagctagggagccgagtggggccacccccaggggccttgagactgggccatgagttcgaatcatgtcctaaggaagatgggagagtgatccaattcaccttctggggtgatcctcctggcagagatacagggagagggttggagcccagaaatttattccttactgttctgggggctggaagtgcaagcccaaggtgctggaatagatgctgtggggagggcagagcggaccatggtgctcatccaggctgaagggtggctgcacagattcttccgggtttcccaagaacaagaagcagcttcaggaagctgaattcatagcagagaagcaggaaggaggcttttctaagcccagcgccctgcagggaggatgctggtgctggtgtctgcaaggcttggcccctaacagggtttgccctacagatggagcagaactggacagagatgcaccctggcctctagctttgggagcagggatcccggtccagcatcttggcattagttggggcccctcctggaggtgcaggggagcgtcctttccgctcatggtccccagtctcagcaaaacccttggtcccagctcctgaagacctatgttcttgctgcttcctcccacaccccaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacaggtgaggccctgccccatgagggagacctgtgctgccagaatccctgcctggccagcctcaggctgtgcagctcatgccacgcccagggccttggctgggtgtcccgttctacagtcactttctgaacaaggaagtcacattttcattttgcacctcgctctgcagattgcatagctgatcttggttcccacattctgggacggggtgcacagtgaatgtgcactatgggaacctggccacaaagtcctgtgcgtgagcccctcaggacccagggtggggtgggagctttgcaggagagactgacttagagaaaagtggccgttccactttgtcccaggacactgagggcttcatagttgtcactgggcaagagtgtaaggcagcctgtgcctgcagcttactcttattttggatcacatgtgtctcatggactgtgaaagattagaggtaaaataggtaataggagacagtatgggttggaggaatattagacaaacaaaatgtccttctcagtttttgtgaagtcctcgccctgaacattgattgcatgtattttggcaggttttattacttgcatgttctgtgcttttcaaaacagcatgttgtaaacagccatttgccttgaactcaaatcctcatgctccttctggtgtgtccaggataaaaaccaagaggtcacatgcattttggggctgcctctgtgatattcattataagctccaaagtcaatcgtgctgggtttctgggtgaagggggtgacctataacctgaaccatctttctggtttagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggtgaggaaaggatggcccattaagtgtggggatctcggccagaggtctagtgtcaccagggggtcgaggacagagctcgtgcctgggggaggaacaggtcgaggggctgcacctggggagaaacaagaggggggctgtgtcctctggaaatgagcttctcctgaaacaagctggggtgggggtgcacagccaggcttagagcaaggaactagaaaataccccggtgaaattgttttgagagttgcatattagttttcatgtgtatgtgaaaaaaaaaaacaacataaaagtggtgaagcaagtgacttagagaatgccacccctgaggatgctgtggcgaacagtatatagttggtgtacagatgctcagtgtacagaagttatagcaaaaacaaaaacaaaaaaaaactgtaacaagtaaagcaggacgagatggaagcagggggagagggaggaagagagattgctctattgatctcaaatggccgtctcagaagtgctgtggatgggacaggcagcatacgcttgtttgggagcagatgctcacagggtccttggaagccagctccgtatttgtcctcatggtgcgttctcccatgaggtaattgctccatcctacccttgaggactccggggctcgggacgatagaggcctgcagaccaccctgtgatgaagggagaaggaggctcaggccaggaggaggaagtgctgagggggtttccctcccagctggtactggctgtgcggggccctctgattagtcccaggaaggtccagggcggccgtggtgtttggcctgcaagggaaggatcaggaagcgtccgttgctgttcttcctggaagcatctcatggtgactgttgcgggcatgggcaaagctcaggccacgtctccctgggtgtctgtggggagcaggaaagggcatcagatgtcggtgctgaccctggctggtactgaaggcatgcggtgggtactgtgatgggtggatagaccggcagcccagggctccatagcctcccgcttcctgctgctttggagcctttccaccgggtccgaggaagcaattctgagtatgtggctgcacaacatgaaaggggtgggggtgctgtcacctgtgcgtttggaggaggctgactgccaccgcggaaccagtgtctttgtggcagaaactaggagctggtcactggcctgagggcaccaacctctctgaagaggctggagcctgtggtgttcccaaactcgttaggccctggaatccttgcccttaaacacctgtgagcctccagcaggagggtgctatgagggtgcacttctgagtagagctggtgttgggatggtcaagggctagagcacggtccctcagcctcagcgctggtggcaagaggccaggcgattctctgctggggagggggctgtcctggacacattaggatatcctgcagcatccctggcctctccacactggattcccccagtgaagacaatctaaaatgtctccagacttggccagatgcccctgaggggcagaatcacccccagctgagaatcactggcatagtctgtgcccttggtttgggggtgcccttccataagtcccttatccactccaggacacaatgctttcattggtgaagagggagatgggaactgcttcctcttgacattgacaatgtcagcagccagggccccttaccgggtgtttcttgtgtccgggatgctggtctaaggttgtgacaagaaaggttttatcctcacaggagccccatgaggctatgacatcatagtccttattttacagatgtgtaaactgaggcatagggaggccatgtaactggccatggtcatgcagctcgttggtgccaggctgggacttgaacccaggctgccagcgccagctttccgctctgtgctagaccctctctgaggatgagtggattaatccatgtcagcccttggcacagggcctggctcagggtgcacctcggagagcacttcttcctgtcctcaccagccacacggggaggatagcccctggggaggacagcccctggggaggagagcctctggcccagaagggtctcccggcttgactttcctttagggcattgttaggccatccagatgcagtgtcctcacgcctggcgttaaaggtataatgcagtcattttatttaaacacagaagaggatgggaatctgcatttcacctctcgggagcctcaggcctggcccggatatgacctcaaaaccctctgtggcagcgtggttgagccagcagcgtggttgagacacagagtttctgcactggagacggcatcaaagcacatctagcagcacccttggctcccacctctgtccctcccgcccagtgccttccttctctgattgagtgctctgcacagggacgcctcctgctcagccaggtggcctggtcacagccagctgtgttagcctcttgtggctgttgtaacaccttatcatctgctgggtgacttatgaccacagaatttactcttctgcagttctagaagctagaaatccaaaatcaaagtgtgggtagggtcgtgctccctgcgagtgctccaaggaggagccattctcttccagtttctggtggttcctgcattcttggcctgagaatcccagccctgcctccgtgggcacatagctgcctcctctccctccttcctctccccttcatatgaggatagtagtattgcaggcagggcccatctggataatcctggatgatctcctcatctagagattaacttaattacttctgcaaagatccgatttccaaataaggtcactttcacaggttctggggatttggacttggcacatcttttagagaaccccctttcaaccccctgattccactcctcttggttaactcgttcctcttctcattgagctaaagctaggctctgggatttgacccacaaagtcccctccatccctgagatctctgtggctgggccggtccatggcctccaacagaatgtgctgtgaagcttggacttggccctgggcaggtccctcccctgtccctgccccatttccttgttgtcagacgaaggccctcattgttggcttctatgacaacactgaaccttccttcctagctgggacacagttgcagattcacactaattcttgtcattctctattctctgtctctttgctacctatcaattacttattgttgactgtctaattttgtctgtatgagggatcatgctggtatctgtctgtgtcccgtggtgtgtccatcatcccagggtacctggttctaagagtcagtaagcacctgttggttgtgtggctttaaacacatctgtgaccctgatgaatctgatttgtccctccagccgatggcccctgagctccagggtgtctctgtggactctacgcatgcgtccacgtggggactggtgtgcattgcatagcttacatctccagatctcggttcccatctgcgccctgtgctgggactcttctccatttcaatcaatacatctaagcctcctgtgaagcttttggctttgtgctgatgtccggatgaccctgaagtcctctctgttccccttggagcagttcgcgggtccagccaactccctcttctctggcaatggtttgctgtgctctcctgcctggacttggcctccaggcggtctctctgtgccaccattgccccatttctagttcattctccacacaggtggccacaggaccagggtctcatagaagttggataatgtcacctcttgctcaaatccctccagtggctccctgaggcactgaatgccacatcctccctagtgcctgtggccccaccccatgtggcctgcctccctctcccggctcgcctctcccttggacccagcccatgggcctctttgatggtcctcacaccccaaccacagcccctgagactcttgctgtccctggaggtgtgcaaggctccaccgcgtttaaaacatcgctcagtgcaggaagccacctggccgctgtgtggcaacacttggccccttcttctcacccaaccttatttcccctacggcagcgtccctgacgccaataccattggctttgcccatgcagcctctctaccagcacatgggctccgcgagaccaagtcttcgcctctgtagttcttactgtgcgcacagctcacgagtgctaagtgcaaaataaatatcagttacatgaatgagccagaatgggccaatgggggattagagaagccagtgcctgtaaagtactaacaggtgccaggtccagggagccctcatccctggactgtttctcccatggcgtggctcagacctgagcctcttgttatttgttctcgaaacccagtgtctgtaagtgaacacggattttgagctggggtctgagagtgggggaaggtagcactcattgtagaaactcattctggaaactgctgtcgtgaacgtggcccaggcccaccgctgtctgcaccgtgcaatgtgttacatggggtgtcatctgcaagccctgggtgaggccccctttcctccatgggccttttgtgggccaaggtcaggattcctgtctgaccctgagaaactccttgttgagggctgggctcattgcacaaactggcaggtatgtctgaggtgcaacctccagccatttgcaaattgaggcttctgtgtgctggtcccagggtatagagtctagggtccctgaagccctgaaatcaagtgcagaaagcagtgctttgcttttgtcacattctcaactgtgtccccaatgctccagaagtgatagatctctgagataaaatgctgtgggaaaattcaatattggtcatacagaaagtatataaatgttgctttttggggggaaaattactcacagtaggaaaggcctgtaagagtattttgctttgcctggtgcagacaatggtgaataatggttgttatttgcttctctctgcagtgtgttgagttcaaaccccattcccactgtctcgcctgatacattgttttcacatctccatggggtgaaagcagaaagcaccaggcagcaaattaatcaattattaatcgcaacaactactattttattcatttattcatttattctccctctctccctctctttcccctgttgagggaggtttggcagacgttgtcttatcccatgtgaaaaagaaaatttttgttatcaaacgtttttgtgaacttcagttctctattagaatggagaatgcatctgcatgagaatttaatttttggaaatggtggaggccctatgcccacatgcacatgcgtgcccacacacacaggcttgcacatggggtgccttcgtgggtatgcctggtcagcggtgggtgagcagggccttgcgctcattctccagtcatcaaaagcgaattttatgagaaacagtctttgtgttgtcactgccccaagatttaagttttaaaacctgtcaagaaaaagatgtttgtgttttgtcttttctctgtgctgaacccaagagtcatgaccacacctgtctggtttttcacagtgtcccagctctgggcgcagtagaaacacgtgatgagggggagcgagggactgaggggctgctatgggaatccgggctgcaagggaagaacctactgatggaaggaagctgacttctccagagccccccagctgcctgtgctgctgctcctcctgcagacagcttctcccaggtgctcatgacagcaaggctgcaggctaggactcaccactgtgtctcacctgggcccatgtaaggacagcacaggccctccacttcatccatgctgtagtcttagtccctttgagctgtcataacaaaatccctagactgggtgtcttataaacaacagaaattcattcctcacagttccagagacagggaagtccaagatcaaggttctgacacgtggggtttggcaaggccccactttctcataggtggtgccttctatgtgtcctcacatggcagaaggggccacagagctctctaaggcccctttcctaagggtaccaatcccattggtgagggttccacctaatgatctaatcaccttccaagaccctaccccccgaataccatcacattggggttaggcttcaacataggaattttgggggacacaaacatctggcccctggcattgggaatgtcacagggagggctgtctgtgcagctgggtgggcctccgtctctggggcttactctgcgtagagagacttgctgcaggatttgaccaccccacgtgcctcgacatgtttctttctagctctgtgaccttggaaaagtttcttaacctctctgtgcttcagttctatcccttgtaaatgggggtgacaagaaagttcttatgaaggtcaacaggggtgctcaccgaagtatagctttgtctcattgtgctcagtgagcgttctggttgccgtggtaatcagcactgtcaccctcatcatcactgtggttaaggagcatataggaacaaggaagcactgggcatccaccgctcatcaaaatactgcctcacaggcatgaagcaaagtttagctcccagtttgtcaatgttccgtagctgatttgtgctattcctcattcctcggccaattcatcagtgagagtgttgatgtccctgccgctgcataggtacatctgttctccatccagacatgcagttacatgtgtttgtgtaactggctgtggttttgcttgcctgcttagcaagggacaagggcaaggggaattaatcaccggggtctatgtgccaggacaggctggcggggacctttgggttggtcaggagaaacaagcctcaagaaggcctctcgatggcacctgccatgagccacccgtcccagaccaggttgggtaacccacggcgcccagcctcagattactctgcccattgggatgaccctgggcaggtggtggcacatctgggccctggctgcctttcggtagctcacaggtgatgtcagtgacccccttgtcaggttgtcctgggggcggatgagacaacgctcatggagggcctggcctgtgtgggcacatggcgctcacgtggtagccctgctgccaaggttttctgagggtgtgtcccagcggcaaaagaaaaaaatctgatatttgtacattatttatttataaactatacattaggggtaccatgctaatatactgtgtactttataaaatatacatgcaagatagtaataaaaggtgacccgagagagtgactatgtacatattaatatgttctagcacagcctgccccactgtgtcctaggagtaaggccctaggaagtatatttcagcaagcacaggggggttctagtgctggtgcaggagtgaaagagtaaatcctagcccccacaatcccatgagtcaattccagtcagctaggcggtacaagagtaaagggacatacgggatttcccggctttatagattttttttaaagcttcttaagacacacccttgctatgtattcagcaagtactatatgtcccaatctaggcctcaaggattctaaggagaaactagacacagtctccaaccctctaggagctcatgactgaccttaaaagctgatgttcaccataaactcaacaacgcaaaagagggctgggtcgggagttgaaaggtgtattagtccgttttcacactgctgataaaaacatacctgagactgggtaatttataaggaaaaagaggtggttgtttttttcattttgttttgctttgttttttgttttgttttttctaagacagagtcttgctctgttgcccaggctggagtatcgtggcacgatcttggctcactgcaacctccacctccggagttcaaacaattctcctgccccagcctcccaagtagctgggattacaggtgcataccaccatgcctggctaatttttgtatttttagtagaggcagagtttcaccatgttggccaggctggtctggaactcctgacctcaggtgatccacccacctcggcctctcaaagtgctgggattacaggtgtgagccaccacacccagccagaaaaagaggtttaatggacttacagttgcacctgcctggggaggcctcacaatcatggtggcaggcaagagagaatgagaaccacgcaaaaggagttttccctcataaaaccaccagatctcatgagacttattcactaccacgagaaaagtatgggggaaaccacccccatgattcaattatctcccattgggtccctcccacaacacttgggaattatgggagctacaattcaagatgagatttgggtggggacacagccaaaccatatcaaaatcctaagacaaatgtgtgacgccaagaatgtggtgacacgggcatttgatgacatggagaacgttacacggagagaggcaacactcaggcagttcctggtactgtctaaatgtaaagaaagccttctttgcaggctccgggatcctttccccagtagacatacttgtaaaaagtgaatgctaacgtgttatttgaatgccattttaagtgtggggagggtgtactgaaaggcttcgtgcagtgtatgcttctgtaaagtgaagagccacctgcagcgagtgaggactcccccacagtcgtctccatggtgacttcacagaacagcaggcagcccctgccttttcttgaaagttggggctagagatttgaaaggctgtggaaacccagccactccctgcactgacaccagatggcgctggagatgctcgctgggatgcaggatgcttgtgagaacctggtctcaggacgacctggtgggcgtcttgcagcggaggcaggtctggcccagggtggttctggctgagcaccaagcagcagagctctcagagtgggaacgcacagccccagtgacaatcagctgaaacagggctgccccccgccccgccccaccccggcccttttttttgtttgagctattatttcccatcaagtaccttgataagcacttttcatgcattttattgcctaagtcccttgacaaggtgataagacagctgctattaccgctttttttgtttgtttgtttgttaacagtagaggaaaatgaggcaaagagaggggatgaaacttgcccattttgaatccagggctttccagctccacagcacatgactgtagcctactgttcgtccaatgcgtaagcacatcataggtgccaggcactgccctgggtgctgtggacacagtgatacaagccagggtcccagcccgcaggtgcctgcagcaagggggaggcaggagcccccaggaggtgatttcaagattggggcatgagcaccagatggacacaggcaaagagtactctgtgatttgtgcatctgaaagcagctgttctgggccagccgtgtgctcttaaaagcattggtaggaactgtatccgtctccctggggcctgggcctctgcactttgcaggctccgcaagggtgaaggtcaatcttgtgtgtcctcttggctgagctgttccacccagctattgaaatgctagtctgcatgttgctgtgaaggtattttgtagatgtggttgtcacctgcagtcggtgactttaaggggctttgagtggccctctccagtcagttaaaggtttgagaataaattggagtttcccagagaagaggaaatcttgcctcaagactgcggaatccactccagccgctggcctgccctccaaatccaggactgtacagcccccgcaatcgcatgagtcaattccttaaaataaatgtcttaaaacacacacatatgcacatatatgtgtgtgtgtggatgtatatatatatatatgtgtatatatagaatgtgtatgtacaaacatgtatgtgtatgcatatgtatatgtgtgtgtggtgtgtgtctatcccattgcttctgtgtctctggagagccctgacccaaacaccaggtgactctcaagagctgccagggtggagaaccaaagctttaaaatgaggagtcctggtcatcaaggtaaaggctttccacatagggacagcttgagcctgggcgtggagatgagacgcgtgaggtgcacagggtagcgtggttgttgcatagcccagtgtgagacctagggactggccagggagagagacctttattcaccctgtaaagaaagctggaattcaaaagacaccaaagtgtgaagcctctgagggttgtcccaagtcactcacctcctggctatgtggccttgggctacactgtgggacgttgtcatctgcaaaataggaaaactaaatcctagcacctgccttatagggctgcggggagatgacatgggaaacgcattcaaaggctgcctctgggcctggcataccgcaagggctcattcaatcttggctgctcttgctgccactggtgggaagcagtgtgggatctcctgcagctgaactgatctttctggagtgcagacctgatgccgtctgtcatgattcaagccttggaaagggccccaggactttccgagggtgggagggtgggctccagagaaaagacagggaggggccatgaggaggctcaggcaggaggggatggggtctgcagggagtgtcagagtcagctccagctgccgtaacaggataccacagagtggatgcctgaaacgacagacgtttgttttcttaccattctggaggctgaaagtccaagaacaaggtgatttccagtgaggcctctctctgtgtctttatagggccgttcccctgtgtgctggttggtgagagtgggtgatgagtactctggcctctgtttcctctacagggacaccagttccatcagatcagggccccgctcttgcaacctcctttaaccttagttacctccttacaggccctacccacaaatacagtcacattgtgggtcaaagcttcaacttgtgaattctggggcagagcggtggtacacaggtgaatcataatgtgggagactgaggcagagaggagaaactggcaggagctggggagtggggatggtgctgctggactccattcttgcagctgtgggcccctggctgcaagagaaagcgcagaggggaggaagcgggagatgattcgccagcgacctgagttgactagagaggggccctgcccagctccacgctgacagggaccatatagtcagtcaagagcgtttattgagcacctcctgcatgcactgtgaggaaagccaagtcacatccacagaggaaggccgtggtcagcagcaccagcatctgtccagtgggtgtgtccctggcatgttgcaccagcacagcgtgtgaggtccgatccttaaagctgcttcattttgttttccagcagccctctgcatcccctgcttctgcatcccctacttcattttgttttccaacggccctctgcatcccctgcttctggttttccaacggccctctgcctcccctgcatccccaggtagcactagacttttctgtttatttgcaggtagtgaactgccactgagtctgagtcgtaaacactgtttggattcagaggtcagaatatccttcccctgtgatgctcaaacttctgagtcagttcggtgttttgccagctccctcctcaactgagcccctctgtggcaggaggcctggggctgggatcctcccctttgccctgctcattccccagcttctgcgtgtgtgcccccagggagtgcaggctagcctggtgtctgggggccttggctgggctctgagctctgtgtggccattcagtttgcccacttgggtcccagtctgtggggctggcacctgctggaggttcaatttcccttcaaaaaaggtcatggtgatccctctgagaattactttgagaacctgacaactcaatgatgtgagattgcctactccaaggcccttctgtgggggacagcgagggctgctgtggcctcctgctcctctctctttaagatgagcaggtccatccacagcagcccagggagcagccctgggggcagagccatcaaggacctggtggagccatcctgaaacttcaacaggtcagggtggccattgtgcgcggcatggcacttagcacagctgagcagttaaaggggtatatggagggccctctgtgcagttgacaggtgtctgtggagcactctctgtgccattgacgggtgtccatggagcgctgtctgtgcagctgacaggtctccacagagcactctctgtgcagttgacgggtgtccatggagctctttctgtgcagttgacagatgtccgtggagctctctctgtgcagttgacaggtgtttacagaagtctttttctgtgcagttgacgggtgtccatggagcgctctctgtgtagttaacaggtatttacagaagtctctttctgtgctgcttgtagaagtcctcaacaatggtgatcttcactaatcactatttttttttcaggaagtatgcaggacttttgcaatccaacgtgcgtgtgttattttaaatttcatggctatggtggcagtggtgtcagagtaagggaaatcatgcagagtggaagcaagaggaaaccctgtcacttgtgccctattctgttgcaaaaccatgtcccagtgctggcctagacacacggggtaggaaaatagacaccacgtttttgtaggaagattggagaatagtggtctccttgcacttgacctgctgtgaagagttgatgttaacttcttggtgagtatgtaaattacatccatgggcacaggcgttctcgcagaggatgccccatccaggcctgtgatgcaactgcagtgccctggcaagtgcactggcttccggggctgggctggggagggcactgagctgagatccagaggaggagcagaggtgggagggtctcacaggctcagaagctccagggtggaaggaagcccagcctttgagggacgaaagggaagaagacaggcagagatcattctggagaagccagtaggggagtggccatgtgcagccttgtctactatgccagtgatctcactctttatataaagaaaatgcacaagagatatagggacatctttgtggctgttgttctgccaacaaccgtggcacacacaaaaaccctcacagcaggagcccaggaggagaagagagtccccattccactccttagacagcccctctggccaggagctggagaggagagtttccagtgccattccttagtcaggcgccctgggctagagctcaggctttcagacagagcctgacttttccacacccacttcctactggtttacagctactgtataaagcaaagcaccctcactttcctctttgtgacaggtagtgatgctttttacagaaactagactttatagaagcctggaggtgtggaatggtagagatccacaggactctgtagtgaacatgcaacaccagctcccatctgaaatacacacccacagatgcatttttccgttttattttatttcttccataagttattggggtacaggtggtatttgcttatgtgagtaagttatttgtgagatccttgtgcactcatcacccaagcagtaaacactgcaccatatttgtttgtcttttatcctttgcccccctcccactcttctccccaagaccccaatgtccattgtatcattcttatgcctttgcattctcatagcttagctcccacacataagtgagaacatacgatgtttggttttccattcctgagttacttcacttagaataatagcctccaatctcatccacgtcatcgtacagatgcgtttttctctagagaaagttcatcagcccagaaggcctgcctgggcgcttccctttcagactgagggatagtgacacttcccttaccctcaggcacccattgcagggtctggatgccccccacgcctggcagcccctcctcccccattgttggctccctcctctcattaacctccaaccctgctctctccctggctcccaggacaccatccctgcctttcttcctgccatcctggcccctcttccctgacccgcccctaaaggtgagcaggcccaagcttcctggctccttcctttgctggctctgtgctctctcttgaggctcaacctcacatctgtccccatatgtggatcgtcacaaatctccatccctggctccagctctttctgatgctaaaacctcacatgtccatttgtccactgtccctgcagaggccctgatgcaccctgagttcagcagagccaaagctaaccttgtcctctttcccgggaaacccgctcaacttcccagatcctcatactcagctaatgtcatctccatgtttccacatcaaagcccaggcagtcccctcctccaacatcacagccccactcattcagaaaagatgtgccatgatgtatgtgtcaggcatggcagggagagtttgccctcaagacccccagagtctggtgtcggcatctataacagtgtcactgttgtttcagaaaacgtcaggcacttctgcctctggccatgatgaagcgatggtagctgccctcccactaaaatcaaacgagagactggacaaaatgaatgagaggactgtttcgaggcattgaacagaaacagtacatgcctgttatccttgagagagtggagacccctgggttagcccataattgatctccctggtttctgggggaggcatcttcctgcagggtgcagggaggtggcctctgagcagagtggtgatctcaccgagatgaggaggcagagactggagtctgggctactgaaacagctggagtttgtaggacaggaaggagctatgtaacgggttctgtgcagatccagttggccatagcctgggctatgcctatatgcagaattctacagacttagcagagattgcctgtgagcatgacagctgaaggtcagggggtgctaggagatgttgggagttcagctcaaacagaatgaagagatcttgatgaatgcaacagacttgaaatcccacaaagaccaagacttaggagtaaggggcataccttaaggctttgttcaaaaccaaaatggacctgcagttattataaatatgttagaggtcttagagtgtcaacaaaatgatcacaatgaatgaccagatggagaatcttagcagagaaacagaaacaaaaagaaaaccaaatggaagttctagaattaaaaggtacaatatctgaaaatgtcactgcttgtgcaaaacagactccaggactgttctcacacaggggcttataaagccaggacataggccaggctgggaggagttggggaatccctgccaccctcctctttcctgggattcattactccctctacccaaatgccaaagcctcatgcacatcaattcatgcagcctgaacccagcaggatccacgactgccaatcctggcttgcagtttgtgctgggaaatggctgcattagcaacgtggagacatacttccttgtaactaagactttgtgcatctctgtaattatgtccttaggataaattccaacatgcaggctaattgagaaaaagatatctcatcatgagtttattttaactccaaagcctctttgccttatgttcttatttatatacatttcctttttttctcttttttaaaatttaactttaaagttcaggggtacatgtgcaggtttgttatatagataaacttgtgtcatgagggtttgttgtacagattatttcgtcacccaggtattaatcttagtacccattagttagttttcctgatcctctcccttctcccaccacattggcatcctttttcttctctagagagtatctgagactggttctaaaagcagtagccagcccggtgatacagggagaaatagccaaaagagctcctgccaaaacctacagtaatcagaaactttgactcaggaattctcccctttctagggatcaagctgatggaaatattcatatgcatgcagagaaatgcaggaatgaggacattttctgcggctttggttagaagtagaaaaacaaacactaacctaagtgtccattcatggtgagctggaccaataaatgatgggattatgtgatgttcacactgtggggttattaacagctattgaaagagctggattaaaacaccctgctttggaaccaggaccagctgtggtgtggaggaaacagcatattgcaaagtagtgtgtatggtatgatcctacttttgtaagacatcagaattaagtgggagtctgtaaattgttaattgtgtagaagtaggtctggaagtagatactgcaaaatgttagcagtcgctttttttagaggtgagatgtgggcagagaaaggaatactatctttccttaatactattaggcttaagttgtttgcaacgagcatacattatttttgtagctgaggaagagaacatagttctttgagctttgctgggaggcagtcagctctctggtctcagctatgacctgggacaactcatatctccatgaactttggtgttcttttcattaattcaccagggaggtgagggtagaaggagagcctggtgagcacctttcagctccaccatggtatgaatgtttgtctcctccaaaactcatgttgaaatttaattgccattataacagtattaagaggtgggacttctaaaaggtgattgggccatgagagctccgccatcatggatgggattaatgctggtataaaagagtctgtctggccctctctcagcctctctttgcccttctgttatgttatgacataacaagaaggccccttgttatgctggtaccttgctgttggacttcccagcctccaaaactgtgagccaataaatttctgttcaatgtaaattacccagtcttgggtattctgttatagcagcatgaaacaaactaagatgggctctaattctgatggtcagagcaagctccctggtaggttgaagggtggctctgactgggactccccattgggaagcaaatcaccctacagccttgtcctctgggaagtcctgacctcaaggagcactgcccagaggagtggctagagggtcactctggagaagcatgtgagcacttttcttttttctttttttttttttaactgaagttttagggtacatgtgcacagtgctggtttgttacatatgtgtacatgtgccatgttggtgtgctgcacccattaactcgtcatttacattaggcatatcttctaatgctatccctcccccaccccccaccccacaacaggccccggtgtgtgatggtcctgttcctgtgtccatgtgttctcattgtttcatactgattgtatttctatttatttttgcaaacaggtggtatactcagtatacattgctcaaaggagccccagtgctactggtttcttatctgtcccattggggctgttttatgcttatacaagcgaagatacattaatatatgttaagcttttccatcttggagattaggtatcagggagaagactgatgtgagatctgcctcctcttctttgtccctttcctgtctccccactcacctaggaatagaagggaggattctgacgactagtcttagagccaggcacctctcttcactctagagagggcagctcttcctgggatcaaagtgccatgtgtggtcttcttggagtggggctatcaggaacagctgggaacaaatgaggggccttggaagcatcaaccaggtctcatctgttgatggacatatgggttgtttttagttattacaaataaatctgtgatcagcatttgtgtacaagtctttgtgtggacatatgctttcacttatcttggataaatagctagaagtggaatggctgagtcatgtggtaggtttttaactttttaataaccggaaaaatgtgaagtgatcctgccatttagagtggtcctctgatatattctcaccatcaaggtattagagtttcagttcctccacatcctctccaatacttgatgtggtcagtctttttaatttcatgtaaagaactctgtgcagatccagttggccaagggctgggctatgcctatatgcagaattccacagacttagcagagagttagaatttaatttttaattctagtgggtgtgttgtggtgtcttattatggttttaatttgcattttttctaataattaatgatgttgagcattttttcatatacttatcaccatatctttgttgggaaaatatctattaaaatcttcccatttttcaaaattaggtcaattgatttttatgtttgagagtttcattggtctgtgtgtctgtttttatgctgctttagttattataccaaaatattgtttggtaccatgctgttttggttactatagctttgtagtatatctatttattttattttatttttttagagacagggtctcactctgttgtccaggctggagtgcagtggtataaccacagctcactgaagccttgacctcttgggctcaagtgatcctcaaacattggctttctgagtagccgagactatagacatgtaccaccacacccagttaatttttgtattttttttttgtagagacgaggtctcactatgttttccagggtgctcttgaactcttgagctcaagcatttctcccaccttggcctctcaaagtgttgggattacaggtgtgagcccctgcacccagcctatagtagtatatcttgaagtcaggtagtgttgtgcctccagcttcgttcttgctcaagattgctgtaaatattcagtgtcttttgtggctccataccaattttagattcattgttttcctatttttatgaataatgtcattggtattttgataaagattgcattgaatctgtgtatcactttggataatatgggcattttagcaatgtttattcttcccagccatggacaaaggatattttttcatttatttgtgtcatcttcaatttctttcaatgattcataattttcagaatacagatctttcatctccttggttatatttattcccattttacttttttgtagctattgtgaatgggattattttcttgatttctttttcagatagtttgctattgctgtacagaaacagtagggatttttgtatgttgatttttgtatcctgcaactttatggaatttgtttattttaacagttttttggtgaggtctttagggttttctatatagaagttcatgtcatctgcagacaggaacaatttagcttttcctttctaatttggatgccttttttttttctgtagcctaattgctctggctaggacttctagtattttgttgaatgaaagtagtaaaagtgggcatccttagctgggcatggtggctcatgcctgtaatcccagcactttgggagggtgagacaggtggattacttgaggataaagagttcaagaccagcctggccaacacaaagaaacctcatttctactaaaaatacaaaaaattagccaggtgtgctggtgcatacctgtaatcccagctactcgggaggctgaggcaggaggatcacttgaacctgggaggccgaggttgcagtgagccaagattgtgccactgcactccagcctgggcaacagaacaagactccatctcaaaaaaaaaaaaaaaaaaaagagtggtcatccttgtcttgtttcagatcctggaggaaagactttcaattttcctccttcaaaatgatgttaactatggatttgtcatatatggcctttattatattgagttacaattcttctaaactgacttcattaagaggttttattatgaagtgatgttgaattttgtcaaatgctttttctgcatctatgatttaacatattaatttttacatattgaaccatgcttgcatccctgggataaattccacctgatcatgttgaaggatctttttaaatgtgttgttgaatctagtttgctattattttgttgaggatttttatatctatgttcatcagggatgctggcctatagttttctttttttgtgtccttatctggtcttagtaacaggtaatgctggccttgtagaatagtttggaaatactccttccttttcaatattttagaatagtttaggaagaactgatattagttccttaaatgtttggtggaattcagaagtgaagcagtcaagtcctggactttcctttgatgggagattttttagtactgactcaatctccttactcattattggtctgttctgattttctatttcttcataagtaaatcttggtaggctgtacgtgtccaggaaatgatccatttcttctaggttatccaattgttcgtactgtgcattgtgcaggtaattgttcataatagtgtcttatgattccttctgtggtatctaatgttccatttttcatctctgattttccttcatttcttagtctaaagatttgtcagctttgtcttttcaaaaaaacctcatttgttaatcttttgtattttctagtctttattttatttctgctctaacctttatttttttttccttctactaattttgggttgagtttggtcttttcctggtttcttgaggtatagtgttaggttgtttatttcacatcttattttttgatgtaggcaattgttgttgcatgcttccttgttacaactgcttttgctgtatctcatagggtttggtatgtttttacttttgtttgtctaaagatactttctaatttcccttttaattttgttgttgactccttggttattcaggagcatgatgttttatttcctcatatttgaaaagtttctgaagttcctcctgttactaatttctggctttatacctttgtagtcaaagaagatacttgatatgatttttatcttcttaaatttgttaagatttgttttctggcctaatatattatctaggagaatgttccatgtgcaattgagaagaatgtgtattctgcagctgctggatagaatgttctgtaaatgtacattatgtctgttttgtctaaagtacactttaaatccaatatttctctgttcattttttgactggatgatctgtccattgctgaagtaaggtgttgatatcacctgctattattgtgttgcaatttatgtcttcatttagatctaataatatgtgctttatatatttaggtacaaatttgtatgcatatatatttacaatggtaacatcctcttgttgaattgatttcatcattgtataatgaccttttacagtttttgacttaaactctaatttatcagatataagcatagctactcctgcttttctttgggtttcaatttgcatggagtatttttgtccttcccttcactttcagtctgtgtgtgtccttagaggtgaagtgaatctcttataggcagcatacaattaggtcttgtttttaaaaatctatttagccactctctattttagctggagactttattcatttatattcaaagttagtattgatgggtaaatactcctgccattttgttagttgttttctggttattttatagatcttttgatcctcttttcctctgttgttgtttacctttgtggtttgatggttttctgtagtgcaaagctttgattctttccttgttctcatttgtgtatctgctgtaatttttttgttaccatggggcttatataaaaaattataaagttataatacactattttaagtagaaaacaatgtaactctggtcacatacaaatactctagacttttaccttaccccactcccacagtttttaattatgctgccttaatttacatctttttaattttgtatgtttcttaacaacttattgtagctatagttatttttgaccattttgattttttaatcttcatactagagatttgaaagatttacctacaccattatcataatgtagattctgaagttgattatgaatttgcgtctaccagtgagttttatactttcacatgttttcatgatagtaattattgtcctttcacttctggttgaagtactctcttgagcatttcttgtaaaggcaatctagtggtaatgaatttcctcagcttattcttgcctgggaaagattgtatttcctccatttctcaaggatagctttgctggatataatattcttggttagtagagatttttttccccctctcttatcatcccattctctccaggcctgacaggtttctgctgagaagtttgctcatagactaatggggattcccctatatgtgactttgttatttttatttccttctgcttttagaatcttttcttgttttcaccttttggtggtttgattatgatgtatctgagagaggacttctttgagttaaagttatttggggatgtttgagtttcatggatctggatgtccatctctctgccaacacatgggaatttttcacctgtagttttgttaaataagttttctgtgtttttatctgtcttctttgaaaatttcataatgcaaacatttgtttacttaatggtgtctcataagtcccataggttttcttcattttttaatcctttgctctctctcttttcccctctggatgggttattttgagttcagaagttcattttgcttgatctagtctgttgttgaagctctcaatttaaaaaaattatttattgaattcttcagctacaagatttctgtttgttcctttttaaatgatgactctttgttgactttcttattcagatcataaattgttttcctgatttcattgaattttctactgtattctcttgtatcttgctaaggtttcttaaggtcattattttgaatttcttctcatgcgattcataaagttttatttctttagggtcagttactggagaattattgtggttttttttttggcagcatcatgtttccttgctttcttgtttcttgtgtccatgcattggtatctgcacatattgtggtacaatcacctcttctaattttacagattggcatattttgggaaaaacttttacctatagatgggacctagggtgtcagtagggtagagtacattgccctttgttccaggtgggtgcagtaatatagtctctgtgcaggtttttcagctgtaatcaatgtcagcaatgcctgtgagtacctctgttgcctagtctgcagaagtctgtggcaatagtggtagcaagctatagtgttagtttcctcattggctgccaaatactttttctatgtacattgaggtaattgtgtgctttccttttttcagtttgtgaattttggtaaattacactgttgctttttgagcgataaactaatcttgccttcctgaaataaaaactccacttggtcatggtgtatcacaatttttataaattgttgggtttgatttgcttttttttttagagttttacatcagtgtttttcaggaatattggtctttcattttcttttcttggaatattttctagttttactttgtcagagtaaattctggcttcacagaattatttgtagtctctcctgtcttagtttattcatgctgctataacaaaataccacagacaaggtggtaataaataacacaaatttatttttcccagttctggaggctaggagttcaagaagctggcaagttcaatgtctggtgagaacccattcttcataggtggcaccatctaggtgtccttacatgacaagagatggaaggacaaaaagatgtgaactattgtgaagcccttttttaagggccttaaatccattcattatggaggagccctcaagccattcatgatggaggagacctcctgaccctaatcacttgcaaaagtccctgtctgttaacactattacattggagattaagtttcaacatgaattttggaagggacacaaacattcaaaccataaaaacttcctttcacttttttgaaataatttacataaaattagtattattctctaaatgttttgtagaactcatcagtgcatgtgtctgagactgcagtgtgtatgtgcatgaagatttttaattagaaattctatttttaataaatataggtccattctggttacatatttcttcttaagtgaggtttggtagtttgtgttttttcaaggaagttgttcattttatatcaattgtcaaatttattagcatgaagtgattcactatattttttatatcttcttaacatctgtagaattagatgatgtcagtgtcacctctccagtttctgatataggtaatttgtgtgttcccttaccatctctttttccttcttcttcctgatgaattattttctttattattttttaaatttcattggtttctgctttgatccttattatctttttcttctactcttgtggtttattttgttcttctttgtctaggttcctaagatggaacctgatatcatcgatttgagacctttcttcttttttaatattggcatttaatgttataaatttccctgttaccattattttgatatattgtattttcatttgtttcaaaacactttcaaatttcccttttgatttcttattggagccatgaattattcaggaatttaatttagtttccaaatatgtgggtttttttagaggtatttttttttgttattgattgccaatttatttccactctggtcagagaacatacttggtatgactgagtcctttggcatttattgaagcttatttctggtccaaatatgtccaatcttggtaaatgttttgtgtgtacttgaaaagaatgcgtgctcttctgttgtttggtatagtgctttataagtgttagatcaaattggtcgataatgtcattcatgtcttcagtagccttacaagttttctatttattctatgaattatttagagaggggttttgaaatctccaagaaatgatgtgtggatttctttatttctttcctcaattctgtcactttttgctttaggtattttaaagctcacataggtttgtcaatatttagtatcattgtgctctcctgatgaaggtatctctttaccattataagatgacccttttcaaagaacctgatgaggtttcttgctctgaattctaccttgcttgacattaatgtgcccatttcagctctgtttgattagtgtcagaatggtacatcttttttaagattttatttttaatctatttgtaactttatatatagttttgttgttctttataggttctttatatataagacttgttggcagcacatagttttgtctcatgttttaatccattctgaaaatttttgccattaattagggtattctgaccatttgcacttaatgattattttattaggtttaactctaccgtctggcaatttattttctatttgttccatctagttttttccatcttttctatctttctgctttcttttggattgagtgattcttttattccactttatctcctctgttggcttattagctatatacctctttgactatttccatagttataatggttgctttagtggttatagcatacctctcttatcttatcactgcctacctcaagcaatagtatgctaattcacttttagtctcatgacctcaccagagtatacttctgttctcctttcccaacatttgttctattgttgttgtccattccactcatgttataaacctcatactactttatttttagtatcaaagtcagttttcttttaaagataaataataagaaaacaattatatatttacacttgtggttaccatttctattactcttctttccttggtatagattcaggtttctattggctatcatcttccttttgcctaaaggatttcctttgtcatttcttataatgcaggtctgctggtgatgaaatcttccagcttttttatgtccaagaaggtacttattttgtctttattttgaaagatagtttttccaagtatggaattccgagttgtctggggttttttttctttcattactttgtaattgttgctccactgtcttgtcatccacattgtttctcttgagacatctgctgtcattctctttgttactctatacagtgaatacagataatgtctttttatttctgtacacttttaatattttctcatggttatagattttgattaccatggcccagacacagttttctttatgtttcatgcataaagttcactgagccttttcctgcttctttgcaggcatggtaattttttattggatgacacatgtgaattttaccttcttgggtgttggatgttttttgtattcctataaatactcttgagttttgttctgggaagcagttaagttacttgaaaatagtctaattcatgccaggttttgctttaacatttgttagatagaaccagagcagtgctcaattattgagttagctcaacagctaactcccattccagaggcagaaccccgtgtactctattcaatgtctgtacaccatgaagttttctgtctggctgatgggaaccggccctccgtctagtgccatgtgtgcaccgggcactgctatctcatcatttcagaggattctttcctcagagtcacatattaatccactgagggttcaagggaccctctgcagatctttggatcttcttactatgcaactctctcctctccaggtctctttcacgctaactctggctgccctgatccccttggcctctcaggttcatattctcaactctgggagttttccaggctcttcctggattccccctccctggattgtggcctggcaactctctagaggcagtagctggccagtcatgggcctactccatttgattctcatttttcaagaatcactgtcttctgttgctgatttctagcacgttgaaaactacggttttatacattttgactttgtgtttgaggtttgagtgaggaagacaattcagtccatgtttgtccaccttggtcagaagcagaagttaatgtcatagctttttactttgaagactcagacaagttttcacaacacattccttctagagaataaagttaggctctgctattgggtgtccccagatgggaaccccacttatttttaggcttcagctcagacgctacttccttcagaagtccctttctggcacactaccttcctcatgtggcttatttgttcctcttgcaccagatcactccgcagcttttgagtttgtatatggcaacaatgaacaaggtataatcctcgctgtagataaactcatcatatttgtttttctccatggagtgaaaatgttttaagctcatataatgactatggtcagggaaaaagccacacaaataattaggatatgttgtgacagtgcacaaatagaaacacacataatgtgcttgagaacatgataaatgccggttttacctttccttccctcacctgaccaagcttagcgagacgtgtggcatcttcctcatctttgctcttcagtgccaggtatggaataggtccattatggacaggtgccttattgaactgagcagagccacgaatgtcaggctgggagtgtggtcgctggagtcaggccttggtttacatcctggttctgcttcttaaccactctgtgcttcgacaggagagcaggaggtcctacttagttttggacgtgctaagtttgggatgcctgctagagatctgggggaagcatggtgaagaaagctgaatgtgcaagcctggagttcaggagggaggtggtgtctggagatggaaatctcgagccagtagcagttggttcttagtgtcatgggacacaggaggtcatataggaagcaaatgtggacagagagtgaaggggtttgaggattgggtcctgggcacatccacctctggaggtaggggagatgatgaagagccagcaaagtaaactgagacataatcattgaggcaggaggatagcaggctagggcagagacctgcaaggagagagaagagagcctttcacaaagaagggagtgaccgatggtgtccatgcttctgtgtgcttgagtacagagtctgggattctcctgagcatcctttgctccactgggatggaagatgggacctgatgagaccggggctaggggaatgtcctgagccccacacgtttgtgtctgtgtgcagggagcgtggaaggcagttcctgcttggtgaggtggagctgagagcggtgccacttagcagctatctgtgccactctggtatccggagagaaggagccggcatttgcccatccttcctcctaagccctgtcagttgtgattggaacgatgcccccgcccaccacatttgctggagttggactagagctggtaatatcagggttttactttttagtttaatttcttgcacaatgcatggatgtttattgagttttgccaataaagagttccatagggtattactgagcaggactggtctgaagataaatgaaagttgtgtacttggaaagacaatgctgtattattttcaaacccccttgagaaaaaggccttttgcactgggtgagctctggatcaggtccaatacagacagccttgcaaaagtggtgtttcagggaacacaagatgggtcaaatgatgacagtttggggggaatgagtctttgaagagctctagccctgttcttttccctcggtggctgccaggcagctggtcttcactacaaatgcagactgtcacatgtcaagactactgcagagttgaagaatggggcacaggactggaaaaggtgaaacattcttctcaaaattccaccaatttttctggaataaacattccttgttttgctgtaaacatgtggttaatttcaagaattgtgaaaaaattgactgcaatctttttttgccagttttctctttgcttttacaaaggagagattttttttttgtcattttctgtgatgttacctaacaatgttctttctaagcaatgacttctttttttataaggaaactatataaaaaataaaatacagtaaccaaaattaagtaaaatgatcaattcttggcttttatttgccaatttattttaatatatatttacaaaattggacacatacacatatatattttggcatataatatgcatactttctgtcatttgctttccttagcaatatatagtgactatcttttgtcattccgtaacatatacgccaccatttttaataggtacacaatattcagatggaacagatgcatcgtaatttaacaggcatcctctgactggatgtttacgttgtgttcaatttcttacttttatgaaaaagtccgggatgaacatcctttcatgtactttttatgtgtttgtcccaatcattttaggagacagactcctagaagtgggatttccagatcaaaggttaggatgagaaagtaagcgtgtttgggggcatttggggagggtgatgtctgtcacacaatctagactgaaagctctccgtccgtccctgcacctgtttctcagcttctacctcctgctcagtgctaggcagcctgctctgggaaggcatgctcatttagattaattcaatcagtgggtagaagggtcactcaaatccatgaaaagtcctcattttaagctatgtcttttggaaatttcctcttttggcttttaagtagcaaaacctggtaaccttctgataccttggtgaagatcagtcagatctgtaagtttttgttgtggtcctactgtgtatccttgctgtgttcatagaggccggattaataagtaaatgagaatgacttgctcctagcacagatttcacacagagtgagttttcatttatgtctagaaatctgcaaagaagggaactttttctcggttaagagcaaatacgattgaaagtatgtgatgataagcctgagacatttgcaatgggcttaaggacttggttcatcaaaagctgaaaagattaaaccacgttcagtatagttttatgtttaagcataccatagttctctgaaaatggcagttccttttcctgtattagtcccttagcattatgaaggaatctgtcccgagacctttgagacttcctgcattcatgaatgtcaccgtcgcattcagtctctctcataacatgcagtaaaggccaactgaaaaatgcctgcaactcctccaggctcctgaggagactataaatacaagactgcagtcatttataaagctattaaaacaaagtggggcctgagcccttgctgaaatgattttcagagttgttttctctctaaaacacatggcaaacaatcgcatgttagaaattcaagacttggctgagttccactttttgtatcttactttatcccaaacttctgtgaaacgaccatgttgttcaactgactttcttgctttctattcccgcctccacactaggagttgacttccttttaggtaccatgtttcttaagaaataaaacctgccttcatctatggaagtgatcatattggataacaacttgagcccccaggaattaaatcccggcccaaaaaaactgcaaaaccacagactgcaaaactgcaacctacatcgcatgtagatactctggagttacttgcaggcagcagcatctgcagtggcagggcaggtggggactgtgctgttcggaaagctgaattaactagcacccacatttcctagtgcactaaggaatgacactctgcctgcgaaagagctaaaccccatctctgctcctaagtaaatataaacattccattccctaataccttcctctcatgctgttaacttcactcagctgattccagacacacatagaacacaagggctggcctagcagacctggagtcagcccaccgttaagttcacgcaacagtattcaccaatgatctgccatctccacaccctgctaggacatgggcgggtgggggaaaggctgtcacttaaagtctctgcaggagacagatggtaaacaaactgaaaagatatcagttggttggggggaattaagataagtggagtggtggtgattgaaggctcagagggtttctgaggacctgggtccaaccctggatggtcctggcaaggctgtgcggtaggcagaggaaggagatgacatggagaccctagcgtgggatatctagaaactgaaggaagagccatgtggctggggggacagtgggcagggagaaagtgcagggaccatgtggagctgggtgggggcagtggccaccatggggaaagtcactgtgtcatttttggtccaaactcagacgtttttgaaagaaaaatgtaggtgctattagtaatcatctgggacagcaggtgtcagccgggactgtacctggaaacccatgagtagggggcttagcggacagagatggtgacatcaccttacccctgtgttgcccactgttccactggaaagtgccgcaagctggcgagcgtgtgtcctctcagttctagccaccatcaccctggtctggagtccttcctctggcaggtgggcggctccattgacaagccagccctccgctaagacctgtctcctttgttcccttctctcctcttgccctggatggggcttttaggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaagtaagtggcagcttgcgggcacagccgggcctgtgctctggccttgcaggcggagcccctctgagatcccacatcctgggtgtgccaggccgggacgcacaacccaccgtctgcagcaggtctcttgaccccgccaccgttgacgtttggggccgtgtggaggccctttcctgtgggggctgtcccgtgcatgctcagatgtttagcggcattctcggcctctacacactacacctcccgtgacaatcaaaactgtccctggacatcatcaaatgcctcctggagggtgaattgctccactggcctgtagcagccaggcaaggactgggccaaactgatgaggacatggcttgtcagtgttagagacaggggcagtctctgttcacctctatctgatcattttcctgcaagaaggtggatccagtgttgccagatcttctaaatttgtcaagtaaagctacccccccacccacatacacacagttatgcagtcacgtgtcacttaatgacaggatacattctgagaaatgcgtcattaggagattttgttgttgtgggaacatcacagagcgcactacacaaacccagagggcgcggtctgcagcacgcctggctccacgctgtagctgatggctccgaggctacaaacccgtacagcacatgactctaccatatactgtaggcaattctagcacgttatggtatagaaacatttctcaacatagaaaaggtacagtaaaaatatgacatacaaaatacaaaatgtcacctctgtatagagcacttaccatgaatggagcttgcaggcctggaagttgctctgggtgagtcccgagtgagcagtgagtgaacgggaaggctagcacgcgaccgtgcacctccgcagacttcagaatcactgcacacttaggctacgctaaatttacataaactttttttttctttaatagtaactttttactggataaactttaactttcggactcttataataacacttagcacaaaacacaaattatacagctgtataaaagtaatttctctttacccttattctacaagctttttatatttttcaattttttaactttttaaatgttttattaaaaattaaaacacaaatgccgcattagcctaggcctgcacagggtcagaaccatcaatcactgtcatcttcctcctccacagcttgtcccactggaagatcttcaggggcagtaacatgcgtagagctgtcatctcctatgagaacagtgccttctggattccttctgagggacctgctggaggctgctttacagttaacttttttttaataagtaggagtacactctaaaataatcattaaaattatagtgactacatacagcagtaacatagtcctttcatatcatgatcacgtgtgatgtactgcacggttacacgcactagactttgagaggccttggcagcacagtaggttttttcacaccagcatcgccacacacgttaggaacgccttacaccacgatgtcatatgacagcaacaatgtcacgaggcataaggaattttacagctccattttcatcttctgggacaactatcttatatgtgtcgtatatgtcgtgtatcattgaaatgtcatgaggtgcatgtctgtgcatatatacacatacaggtatatccacatacgcatcattttctggacaatatgtgcaccaagtccacccatctgccgtctggctgtgacccagagccacgggtgggcaccttctgtgttgcacccccataagtttccctgggtggtccctgctgtctgctgggctggagttggactgtctcatggggcaggacagagtggagctgctgcgtcttgctggttgaggtctgaagggatccagtcatgcccctgagacagaatgggggccttcttttggaaggcaaggctaccatgagccgggtggagctgacttgtgtggctttccaggatcgggcacctccctagttgctttccacattccagagccactggagttcagaacccctcggagcttgctgcgtaccccagtttgcgcccacggacactgcccaaaggtgccaagagccactgagcaggcatcggtgggctttcagaggaaagtcatgccattctggcagggtgggcctctgtttcccctttcaccaggccagatggcaggctaacgtgtctcgtgtgcggtaggagaggaaattctgataaagctcaggtgcaccgtcccaggagccacagtccacatctcctgcccaccctgtgaggtgtgagtcagtctgtgtagggctgggcttggtagacagtgccctggacagcccctagtccgctccttccctctttaaacctcaaaagccaacccttccctggagggagagacagtgccccaggggtgaggggaaccagctcccggagcgccagtgcctctgttggtttgctctgcacccttgctgtccccaggcccctgagtcactggagaccctgggaaaatgcaggttctgatgctgcaggtgcagggaggcctgagaatctgcatttctagcaagcttctagggctgccgacactgctcgctgctgggctgcaggccacactttgagaagcgagggtctacagcagggtccccagccagggaaccattgatgtttgggcccagatcgttctccgtggaggggccgtcccgtgtgtgtagtgtgttagcagcattcctcccgccttccactagatactagtagtacaccctccgcttctgaccaccaaacgtgtcccagacaccgcccaacgtcccctgaggtcagagacaacagaacgctccccgggtgagaatccatgatctgaatgttggactcccgctctgggcagattttcctctgagcagtggggcttttcatttcgaggaagggttgtttctggtctccgctggggagcttgagccccagtgttcccaactcccaccaaaatccttacttgagtgttttcacggtggagggccgtgaacgtaagcaggtgaggccggcccggggtggggctgtggatagagcacgaggtcctacccttccaggtgttacagagttgtgcttggggcgcaggtgcaggttgcatttctaccagcggttgggacagccctgccgctcggcctctgcatcgtggtgtcgtcatcccaggctttcatttctgcaagtctcagtgatgggacgtgtgttcctaaggcttggtttcctgtttctctgatttctggtgaggttgagcattattttcagcgtttatcagctttttggtttcttctttatgtactttgcctgaagttttctttatcttaatgatttttaggagtttacttttgaagatgtagcttctaatccttccccattttgagttacatgattcttctctctggggcttgtattttcagttttaaaatacttttctttgaggcacaaaagttttgatttttaaggctgtcagattgctgatcataaacttgaggagctcacagcctttttctgtgaggaccaagttgtcagtactttgaggtttgtgagccaggctgtccccgccacccctactcagttcaggcgctgtagtgatgaagtagctgtagacaatctgaggatgaaggggcatggctgtgtgtcaataaaactttatttacaaaaatagccagcggtccattgggtccagctggcactttgctgacccctgatgtgctttatggttcgcactatttgtaccgtgtttaaaaatcctccccagcctagaggtcatcagaattttattcacttctgttatttgcggttgcctttacctgtaccagttaataatggttttctatttgatagtcaaaccaagttctttcaaattaaaatactaagtgaattgatctaaacaacaaaaaaaaaggtaagtaatggaagatagtacatgtggttcaaaaaacaacaaaaattatggtggggcttggaatgagagatgcctggggtccccaccgccgactgtgaaggttgagaggaagttgggagaaggttgggctgccggggataccccaaacgcccccctatgtaagaagtaccaaaaacatgggccctgtggcttgtttttactccattacttactgaatctggaactaattttaaaccttggactggaatgtagtagctccctgctatttgtcaccatgtttaaaaacctggaattagacacagagaaaacagcagcggagtagcagcatcccaggaggtcagacatggcttcctggaggcgccatttgttttccctacagcagtggcttaattggtctccctttgtctctgctctgcctcctttcagagattcctccaccgtctcttgctaagtaattcagcctctggttgccatggcaacgtgccatctactgtatcccaaagaacatttgcgatttcctttttttaatttccagaaccttcatattttatcttctgagtgttcctgggccttttcctggtgaagcagtcactgctccccacggctaccccagaacacatccgtgtgcttggtctgggacccccaggaaagtcagggtcccatttgaaagagtgaagctctatgctgattttcacccctctctgtgtaggagctcagcttacctttaaaacctgtgtggatgcatcagcagagtatgagaggcccgcagctcctgcacggtaggtgtgcactggaaattatgcacagaggcacgggctgttttgcctccatcctgtctacagccaccatctaaggagagcagtgggaagcacctgctgccggctttcagcataggtgccggcgatgtgcttgacgtctgccttactttctttcatttatctagtcttcacagtaacccagtaaagcaggtggtactatcatctccattttacagatgagaaaattaagccttggtgagaaggtaactggcccagggccacgtagcttgcagaagctgccgtgcagtgagataggccatttgttagagccctagccctgggcctgggagaagcattctagacacgaaagcactgtggctccttgtttatcttaggcatggctttgaattttcttatattggtttggctttgatcagggtatcagctggcaactgggcaatgcaccaggtgtctcgggcaaaggacttcacacttgctctaaagcagtgcagaatgttggccgggtccggtggctcatgcctgtaatcccagcactttgggaggctgaggcaggcagatcacttgaggtcaggagttcgagaccagcctggccaatatggtgaaacctcgtctctactgaaaatacaaaaattagccaggcgtggtggcaggtgcctgtagtccaagctactcaggaggctgaggcaggagaatcgcttgaacctgggaggcagagtttgcagtgagccaagatcatgctattgtactccagcctgggcaacagggcaaagacaggggggttgggggtggtggcagtgcagactgtcaacacagcatggagcagtggggggttggacatcctcagggggaacatatagaaagagacactgcccagcaagggctctggaacagtgcagcaagcaggctagagccccagccgtctttgtctcagctgcgtgagataggccagcaccagtgtctcagaatctctctccttgtttgtgaaatggggatggtggcaatacctgcctcagggccctctggaagattccacattggtccctgaagaaagtcataaaagcacattctcagcagggggtgctggggccagagctgctgctgtcacagtcaaggctggatgcactcctgggcgagctgtcacctgcacggggcagaggccagcagcaggccttgtggcaggatgaaatgaatgctgctgcatgaacagcggtcacgatgctagtgggccagggagtgcaggagcattgctgttgatggggcttgagtgtcattcccattcgtgactgttgtgtaattttgcccgaagagagaggaatagggtaggcacctcctaagtcatgcacaaactgtcattccccttggggcgttctttgctcccaggaacgtgtgtgagaagctgattaatgctcagtagcatctttcaggagggggcacttagcatgttcatacagcagttagcggatctctgagtggcttctctgcacgttttgtcctgtggcctccagaacacgctgcaccctcaggtgtcctcccgggctgtggcctcccactcctgctctgtctgcaggagcaggacacagcgtgcagcgagtttagacgctccctcctctagatgtgctttaggcaaggcaggcctatttttggtcctggagacagaacgcacagaaatgtggagacagacagtgtccccgcagaggctgtggtttgggctgcaaggcggaaaccgtgcctggccagccaggggaccagcctgtctcaatggggccttcgttctgctgtgagcttttacctgaaactgcatggacggaaattttcacttccacagaaatggtgtttggtaaatttcagacacgtggaagcgggggaggaatcagcttccaatgccagccttcataatgacaccactaatagcatctgagagggtctgccgtgacgctgggcaggtgcagtgctgattgcctgtgatgccgagcagggaccatcatccctgctctgcagatgaggagactgggcagagaggctaagcagtgtccctgggtctcacagttcatgaatggccaggctgtgggctccagggccctcgctcccagccactgagccttgctgcctgaggccaagcatccggctcacaccttgtggacagggccgggaagctgatgatacactatagctaaaggccagtttccggtgaatgtttgtgttaatgaggtggttatggtccacgttcactgggctgagtcctttgcccgctgatgtctgcaaccctgaagttctgtgctcggtatggtgtgggtgctgcacacaggctccttcatggatcttactaccttccccaagaccctcactgaggagcgaacacacctgacatgggtcactcccggagcagggctgagctgccgcaagcgctgacggtttctcttgtcacagttatcattgccgccctgaaaaggctgcaaagtttgccttctgcctcagggttaatccatggctgctgggatggaaggtagcatttgaaattacctacagggggaggctgcacctgcagaacgggcccagttgatcctgtcacatccaatgtcattgcccatctcttggggtgcttaccccccaattacagagatttcgaattcatgtagcgtgcacgtgctaggcgctggggtgcagagatgaaaagatgcactcacaggtgataaattattgtgtctggtgaaagatgtacagagatagatgtgtggaccagcttcaggagggagggtgagggtgtcccaggcagaccagccagtgagagctcgaaggtgggaagcagcaccgccttcccaggactaccctgggggctgagaaggttcagggctgggtgagggtggcagggcagagggagaagactggaggggccatgggtccaggtggtggaggctcctgtgctgcccgctatgggttcccaatccacacagacctcctcttgtcattctgggctcagctcagatgtcaccttcctgaccatctcccagtggcacagcctcgccattaccctgtgtcacatcgtcccctgctgtgtttttagccacttccacagctgctgaaagtgccgtttactcatctgttctgttcgcctcttcagggtgtgcccactggcgtggcggggccctgctctgctcttctgtgagggccttgcccaccaaggaggcgctggctaagctggtgggaaatggcagatgaggaggcctggctctcccgagaagcagccagggctccctgggggtcaggagcgagggcatgtctgggaaacgcccctctgctgcagtgcagggctggtttgggagagcaaggctagagctgggtggggagacaagggtttctcacatgctacaggcccaggagccagcaccatcctggggacgcggggctgcagagaggacggcagagctggtgaggatgaacggcaggcctgtggctgagggaggagggcctgccagcctaggggtgggtggatctgcaatggtggagagggaatccaggaagaaggcaggcagacacaggggaaaggttatatgtccaaagggtccctatgccgtcaggtgcctggggtttttggcagtgcttccatccacttgtgcaggtgagactgcccaaggagcacagggactggaacgggagactgcccggtccatgctggacttgctgatctcagctgaggtcgagggtattcagagcccgtcgtggtgttttatacggtcctgtacttcctgttatccttggtccattttcttctacactatcttccctccagtttcacacacttggacagaagggagtggttgtttttcactgaccgccaggaaccacaacaggcttctgtgtgttccagtgaaataagccctatctgtctctcgggaatggagcagtgttaagctttttttaaaagcacaatctgaagacactggggtctggaaacccattttttcttgttctgaagcctgtggggcctccgcggttgggccttgctgaataatttggggttttaggttgggtacatcaagggtaaagggcttctgtttggatcaaacaggaggtggggggagggtgagattccctcatattgctgagaagggagttgggggctgagttccccgacttcagaggtgagacatctcacaagccagaccttgggactgtccctgtggacccaggctggactgggaagttcagggaaccctcgactcgaagagggttcttgttaatgaacagtcttcaaggagcaaagcccagactgttctcccagtgtggtgtacacatgaggagggacctcatcggggggaatttggcttcctgatattcaaaagcacatttgtctgctcagtctctgaaattgccagtgggacaatttccaaagggatcaccagaaagaaggtaaatgcagagacgaacaaggaactcatcatacccaggatcgttcttgatcaaaatgccaacagctgggcatcttcagccaaaagaaatgcagttgtggcaggaaagactcagctgtacttggggttctggtttttttttttttgtttttttttttgagatggactctcactctgtctccaggctggagtgcagtggcgtgatctcggctcactgtaacctctgccttctgggttcaagcgattctcctgcctcagcctcccaattagctgggattacaggtgtgcaccaccatgcccagctaacttttgtatttttagtagaaacagtgtttcaccatgttggccaggatggtcttgatctcttgacctcatgatccgcctgccttggcctcccaaagtgctgggattgcaggcgtaagccaccacgcctggcttgggtttcctgttttatagtgaaccccaaggttgcaaaacaggcgatgaggcttgtgatcatttatctttatggatcatgggtctgcgaactggatgagagttttaagcatgtcaggtgtgcaaacatctcctatggttgtgggaatttctccttgcatagccaccattgtctagagcagcagtccccatccatttttgtaccaggaaccagtttcatggaagacagtttttccatggaccagggaggaggatggttttgggatgattcaagcacattacctttattgtacagtttatctctattattattacattgtaatatataatgaagttattatacaactcactgtaatatagaatcagtgggagccctgagcttgttttcctgcaactagatggtcccatctggaggtgatgggaaacagggatggatcatcaggcattagattctcataagaagtgtgcaacccagatccctcatatgcgtagttcacaatctgctgagaatcgaatgctgctgctgatctgacaggaggtggagctaaggcagtaatgcttgctcgccactactcacctcctgctgtgtggccaggttcctaataggctaggttgccccagatgggtactggggttgggacccctgttctagagcagtctgcacgctggggactctgggtccatgacagtatttccttcctgtgtgataggcctcacagcctccactttgcatgtgaggaaatggaggctcagaattgttagtagccagtgagtagctgagtgaggacatgaacctgagtctttccagctcaaagtccttttccttagcctatttcacaactccctggaactcatccatggccatcctctggttcaaattatcctccacctaggcagtagactttcctttaaggaaggaagaaacttcttcaatgttttatcctcagtgcctggtacacagtaggctcccagctaattactgttgaatggatggttggttagatggatagatggatgattgtatgattggataggtgggtggttgggtagttagatggatggccatctggatggtgggatgattgaacaggttaatggctgctggggtaattgcattataagatgcatgagtataggtagatggagagacagctggatgaataggtagatgggtggataagtggtgggatgttgtgtagttagatggatgaggaggtgaatggagacattgttgaactaaatggcatcctattcactgtgcttgatgtaccctaatatctgtccatccatccatgcaactgtctcagcacgcacagtgggttagatggaatttcctaagagtttatttcaataaaataagagtttagttcagtacaataagtgtttattgaatgaatatctctctttgcatagtgggctctttggatacatttaagcaatgattccatttactacattgattataaccaacctattcagaagtgtatttgtgaatagtgtgagccctcaggacctcagtggccattgccaattttggagactggttctgtgctgtctccaggccagggtctgcatacgcttctggcgacaccactgccgtctggctgctgaccagcctgggctatttctgagctgcaggtccttaggccctcaggtgaggatactccagaagcctccacttcaccctcactggaaggaagtctctggtggaaacaagctactcctaaagctttctgagcacttgtcaggaggaataggagagaaagctttatcggaatgagtaagaccaatagtattaacccatgactcgccacaggaggcgggtgggggatggtgtcttcacagctcattcaacagagtagaagtcacagacccaaatgctccataagtgacctgggccaggcagggctgtggcatcctggggagtgtgcactcttgctcaagagggcagctgtcactcagatcctgtgggccatcacccctggccacatgtcaggccattgtggccagaatttccaagagaaaccgaagatttgatttttttggtgaaatagccttcatgtaaatgttgagagcctcttcctatttttaaaagcaatgtgtgcacccagaaaacatatttgtggaccagatttggcccgggaccacccactggccacctctgatgtgaagtcacttatgcacttgtattgggagaagtacatgtttctttacactgaggttaaggggattttcaactcttgagttagcagggaaaataaatgggtcatcctgtaaagtgactgtcagcagcggaagcctccagggctaccactgtcagtatcctagggagcctcagcgaacctgtctccttcctcgcatatgtgagggggcccttgtgtgcggccctctcagctccacccttgctctaaggaagccgcacagtgcaccgctgagaagtcaggatggacagaatgcctcggttcccagccagctctgcagttttccagcatgtgggcatggggaagtcacctcctgacatgcgccttactttcctcctctgtaaaagggatgtgactacaacagagcctgtcttttggggccacgggaaggatgcaatgagccgtcacacgtagaatgcctggaatcatgcctggcagagaggaagctctccaggaagaaaaggaagaaatctgagttccatgaggatagggaatttgtctctttcagttttaacagctttgttgagacataattcacacaccacatgcttcacgcactttaagtgtccaattcagggcttccaacatactcatagagttgtatttccatcagcacaatcgattttaagatattttcctcactccaaaaagaagcctctccctctcagctgtatctccagtccctagaatggtactgagtcctgtgggtactcggtgattttgcagctactgctgcagggacgaaggggaaactgcatgggaaggcatctcctaaacatgaccagttattggtgtcaccattccctttgcttcaccaacttgatcttcttcagatccttttcttctgcttcggcatcttttcattgtcatcattttatcttcatcactatcatcaccttcactgcttgtttatcatcatctttgtcattttcatctttttcttcctcattatctttccatcatctttagcaacaactttgtcaacatttttatcctcatcatcattttcatcatttccataatcacgaatttgccccatctttgctccctaggagacactcggggaacttgggctctcaatccccttgacgtctgggggcttggcctatgaagggaatgaagcccacatctaaagcaggttccggagcctctgctgagtctgatcgtgcctggagtgaagaggactcttgagaatggtgggggctgggcgcagtggctcattcccgcaatcccagaactttgggaagccgaggcaggagaatcgcttgagtccaggatcacttgctgtgttgcccaggctggtcaccagacctgggtgcccacaggcagataagaggaaggtgcctgagtcaccaactgcccacgggactgaggcacctccctcttatcttcctgctattttccagatcagcctgggcaacacagccagactccatctctacaaaaaatagaaatttaaaaacagctaggcatggtggtgcacacctgtgatctcagctacttgggaggctcaggagggagagaggatggcttgagcctaggagttagaggctgcagtgaactatgatggtgccattgcactccagcccgggcaacagattgagaccctgtcgttaaaaaaaaaaaaaaaaagaaaacaaaatggtgggaaggtgagtctgagccgggaccctgcagatcccacaggtccagctcaggttgccacccccgtgtgtggcctggttgggccggtgctgtcccagtactggccacccgtcaactgaggcacctggttgggccagtgctgtcccagtactggccacccgtcaactgaggcacctgattgggccggtgctgtcccggtactggccacccgtcagctgaggcacctggctgggccggtgctgtcccggtactggccacccatcaactgaggcacctggttgggccggtgctgtaccggtactggccacacgtcagctgaggcatgcagggctctgccatctatagccttctttggattccgagatcccaagaacagaagctgttggcatttagcaatttatgattttcttcctttttttgatgctgcagatttatccgactgactttcccagccctccagggggaccgttgctggggcttccggtctctctttgtttagaaatctcagggcaagtggagatcaggtctgttctgcacagatgcaccttcctgagctcttggcgtggcaccacctcctgcttcaccactgtggtgaggggtctgcctgtgaacactgcagagcctccaaggtcaagaagaccaccaagatttatgagggcactttcaaggatttgttgcaaaaatgcgaaggagctcacgaggcagtgctgtgagcaggctctgtgtggtattgtgggcagaaatcaacctcagccctaaagggaggggcctggtagtcctgcaaaggccggggcaggcaaggccagcacggatcaggcaaaatggtggctatcatgtatggatcttgtacgttctgcttttagatggaggtagctaagcaacagaacacacagcttccaaattgggacaagtttaaactggcaaatctcagccccagaggatataaatatgacgcttcatcgtcttgggtggaagtccccgtgtacagggagggaaagcccatctgtgtgtggcatgcagggtacagggagtgggtcccgagtcccatcctgtgcaggggagaggctcaggccccttctgtgcagtgtcaatatgaagtggccctgtccctgctgagggctccagggagggtcagctgctgtttgttttccttggttgcttgggaatctgtagaggatggtacagcatgttttgtaagaaaatgcaaaacaacatcaacccccattcagtgtcaataaaacatgattcccaaaccagggagcaggtggtttggtggacttggaggctgcctggctgagagccatgggctgagtgagcccagggaagtcacatggtgagtccaagccttgaaatgggtgtgtgatgtctgcctgctcagatgcttgcagggactaaataccacacagtcctgcttcacccaggatcggggcttagcgtgtgtgagtagtagtcatggtaataagagcacaaccatagctcactaacatgtatgaaacccatgttatgtatgaggggtggtgtttgcctgcattcatataaacataagacgtaaatgctattattggatgttcttagcagctaaggaaatggaggcccagagagattgggtaagatgctcaaagtcacacagctagtaagctagtggagctgagatgtgacccaggtgggccgactccagaccgcacgttagagccaccccactccctggaatagttgcacaggcggtcaggactggcatggttgttccaaaatcaacaaggacgcagactcctcttaccttcctgctatttacccttatgccggtgttgatcctccatggtccagggtggctgcaaaggcaccagacatcatattcaagtcccaaaggggcatacatctcagctgagtcagcttttccagagggctcctcccagaagctcctccacacacatctacctactgctccttggttggaccctcctcatgtggccgtggtcagctggaaaagagactgctctgaataggaccagcattcaggcataagaaggggagaagggagatggggtaggaaactcgcggcttctgctgctttaggtgttcaagttaattttgttacattaaaggaagaaaagaagcaacaaatgaagagatggatgagtgaatggaaagcattctgtctgttaggtagcaatgatttctaagtgatttctggagcagcctggtttgaggagtgcatgtggatccctatgggcttggagagcaccgccggggaatttaaaaatgccccattcctgaccctcccacactgggccagggaggtgagcagctggcaggaagttgaggaggaggagggaaagaggaaccctgagaggcgctgagagtgatgtggacaaacacagctaccccctccccagcaatcctaccctttctgcagcgatcccaccccttccccagcaatcccaccccttccccagcgatcccaccccttccccagcgatcccaccccttccccagcgatccgccccgcaacgatcccaccccttctccagcgatcccaccccctccgcagcgatcccaccccctccgcagcgatcccaccccctccgcagcgatcccaccccttccgcagcgatcccaccccctccgcagccatcccaccccctccgcagccatcccaccccctcccctgccatcccaccccctccccacagtgatcccaccccctccgcagtgatcccaccccctccccaatattttagttcagcaacagatgtttcctgaacagcctctgtgtgccactctccgcactgggcctaggatggggggaagaacaaagcagatgcgggggctgccttccgaagcttccattccaccagcaggcgtgggggaggggaggtcaggtgaacatgtgtgtggcacatgtggaatatgtggctatggctagacacgggaagggctgcagtgcagagtgaccgtgttccactcaggtggcttccagcatcccctcctgggctggtgggcgctggtgcacctcagtgccattgctgatgaaggtctgggtccggtggaaatggtgtggtctgcagatgaggtgcgcctgtcttttcttaaatcaaggacactttcagatggatttggtttctctctgactcggctcgttcagtcagcctgacgggcacctaccgtgtggctcgggccccgtgctgggcaagaccctgcctccagctcccagcctcactaggagtgggggatgggagtcacaggatgtgcccagtggaacagccgccagggcaggtgaatcctggagagcggcgggctgttcaggtctgggaccctgggaagccacagggaggagtgcatgggagtgaccctggaagcccagagatggagatggggaggggaagggctggcaggggccctgcccgagcaaaagatcagaggcagacaatgctcagcgtccaaggaggaaagcggaaggagctggagggcaaggcaggccctggtacctggcaggtgctccattggtgcctgtggaatggaccccaaaggatcttagccctgggagcaggcagtggggagcattacgtattctttccattttcaaaatttgaagaagggacttatatacatggtaaaaaataaaacggtacttctcactcccacctcatccatctgtccggagtcagccactgtccacggggccatttgtgatcattcagaagtgggtctttataggagtcctaacgcccagaacagtaatctgcagatattacctcccatgtgctgtgcccagctcggggtgagctggaacctgcggtagatccttcgctcggcatcagtctctggagggaggtaaagacctgtcctcagtgctcagccccaggtgactactcaaaaagccatttgaaagaagagatcataagcatgatttgttcatgctttaaacacaattttaaaccatacagatgtcacttgtttggccgtcactttgaggtagaatccaaggacatttctttgaggaaggatctaccaacttaagttatttttgctctaaacaaaggctggatgtgtctcctccaagttccactgacagtttctttggagaggagtgagtatttaaaggcacttggaagcaatctcagtgcagaatccttccagagttttaaggccccacctccccagatctcacttctctctcccacgcaaactgcacagtggtatttttagcaacttgcctctactgactccaaagcttagttttcatggaatttacattttcattttacacccatatgagatcatttaatcaatgtgcattaaaagcttaattacatttattacagagacaagtacacctggtacaaataggtttgggaacagaagcaaccagttcctgatccatgcacagctcagctggtgtggccaggcagttctgaaatcaacagggaggccacgaagtcagcacgggatgcccagcatggctggagccactgaaggatttctgcttcaagaagcctcaaccggtatctaaggccttcccactgatcagatcaggcccacccatttcagccaggacactctccttgacttaaagtcagctgatcacggcccttggtcacatctaccagacgccgtcacagcagcacctagaggagtgtttggttgagtaactggggactgggaccccaccccccataccattcaggttgacacatcaaattgaccctcacagattcaaggttggcagaaagctcatgagcagatgtaagattgcactcagtctctcactcacagcctctctcctcaggtgatttgtagagaagccactattcaagcaaagggcaagttcaaagcttagactcttaatgatgatgtggttttgcagtttctatattcacgtttattcccttttatcttccccagagtctggctgggagagccttccacataagggctaatggagcagcacccggttcctttctgtaatggcattgaattccactgcagggttgaacacaggtcctttaggcccaatgggcattaaggctctgccctgtgcttggctataatgaacatcctcatacgtgtgtctgtaagaggcccatgtggaaggatgttcacacacatcagaaatcttggaactggaactggcaggttagagaatatatgcatctgtcatttttgacctgagcattgaccaccagggaatgcccctgattgacagccccaccagtgggggggcggggggaggggctctgtctacactcctgtcaacattgtggattttccaactttctgccctctgctgatctggaggtggcacagtgacgtgctgtttggcacaaccacacactccatgtggttgttatttccatggaggtctgtgaatgacgatgaactttggacttgccccacaacagcagcccagttctactagtaaggcagagctgtgtcccacaagcccagaaccatgccccctgcagcggggcccctgtattgccagtggcttctctgttcattttgctgtgccagcttgagaggctgtgcaggggctggggattcagcagtgaccaggtagacaaagtctctgcccttggaggggtcctgagtccctaactggccagcttggtgccttgtcctgggttggcacacatactgccttttgtactctggtggcagctgtgcaagcgtgggactgtggtgtctctttcacaggcttggagggtggcttgcccaaggttgccttgttgctgtcaaaaccagcctttgggctcaagtttctcaatgtaaacctggcgttgccttgatgtcccattcatgtatccactcatgcattcagacactcattcattcattcagtcacttgttcattcattcactcgttcattcactcattcactcattcattcattcagtcactcattcattggtcacttatcacggaccaggcttggttccagggccctgagtacacagcattgggtactactgatgcagttcttaccattgaggtactcaaaacataaataatcaattctggccatgaaggccacaaaatacacaaatgcactggggagcaacctgtgcagaaaggagccagttacttcagctggaggagtcggggtgggctttctggaagaagaggtttaagctgaaccatggggagatctgggtaacaactttctcagcagagggaagggcccaggcagaggcgctgggtgggaatcagcttggcatgtgctgtggtctgaatgtttgtgtcctccccaaattcatgtgtcacccccagtatgatggtggttgtacatggggcctttgggaggtgattaggtcatgagggtgcagtgctcttgagcgggattagcgccctcaaaaaagggacccctgagggctgcattgctccctccaccatgtgaggacacagtgagaagatgctgtctctgggaaagtgggtcctccccggatgccgaatctgctggcacctcaaccttggacttcccagactccagaacagggagaaatggatttttgttgtttataagacactgagcttaggggactgtgttgtagcagccgcgctgggcaagggcagctcagcaggtcagcatgaccaaaggaggacaaggtatggggaggagggagatcagtggggtgggggaggggaggggtgctcaggggcttcgaggaggctggagctctgctcctcagcaggttgtctccctccaggaattccctgccacaggctcgggcctctgggtcctggtggctgagcacagatcttcgctgagtgtccctggtctgggccaatgtggggccagcatcttggttcttcccagctgactcaacctgggcttggctcacccttggctgggacccaaggaggccaggcagggtggtggggcccagtggggtgtggggcacattccttccagtgcgctcccctgccccagccttacacctggcattacagggcacatgctgtcctcaccctgcctctcacacctgctgtctctgcacacaccctcctggccctgcctctcacacctgctctctctgtacacactgtcctcactctgcctctcatacccactctcccacacactctgtccctgccctgtctctcatgcctgctctgcacacacagtcctggccctgcctgttacgcctgctgtctctgcttccctctctcacgtccttccctgcagggtgcgtctctccctcctctttgcacacatgttcttggcctttcttcctcactccactttcctcctttcaaaagtagcattggcagggctgggtgtcactgtgaatgacattctctgcgttaccttgactgtgagaacagaaagtgcctctctacaggtagatgcgagtttggtcctgaaagtcaagggcctggttttcctccggaggatttgaatccttccctctccctgctcccctcccttctctccttccctccctccttccctcccatagttctcaggcaccaggtgattcctcagtacctctgagagtccccagatggaaggtgacctggatgtcccttggtgtccatgttgctgtctttagcacctggaagaggaggtagaaggggcatgttcacggtggggttggggaagcctctcagggcagcccgggaaccatccggagagactggtgctggtgaccagctggccttcatgggcgggggtgcacgtgatcttggtgcctcacctgagcccttggaacacccggctccaggaggctgattggaggcgagacccctccccaccaccactggggctgttcctggtgcagagggtgaaggactcatctcatctgtatcccaggggcactaacccaaccctgggcagggcagtctagagtccctttttggcttagggtgggccacagagccaggctgacaaaacagaaatagcaacagtgatggagacagtgcggtgtgcagcttgcggagcccagggcacagcggcctggctagccccctcacatacggctctctcctttcagtctcaccaggtgagaccatggaggtgcagagaggagactggctgcacccaggaggtggaggacaagagacactggagagtctgggaggccaactccacgtacctggagttcttttctgtgctgccctgggagggagcccaggctccaggggacatatttctcctgcagggtggggttgggaggacagagtaggcaggagcctttggcctgaaggcttgtcactgtgggcacaagaggcatgggacaccttcccgacatcagaagccccccactgcaccaagcttggcggggcttcctggtggagttgaagttgccctgcctcctatgccctcaggacacaggaggcaggccagccgttctgttgccttttggaaactcagggcagctctgtggattgtcacagcaactggagctcctgctgtattttcaggatggtcccgggaggcaggtgttctgcagccatggggcactcccttagcaatgaagactggccccccattccacttgacttctgaatgtccctgggacactcatgagagtccgaagcctgtttatgatgacctgagcctcatcccaagtgcattgtggacacacacaggaggtattttggtggagctgtattacaggtggcgtctcctggaatgcaaaatgccagaaacctctcccacagattggggagggaaccttgctttgtccagagcttcaccaagaagcattcctccactagtgtctctcagggcatggagtgaccagtgtggcagctgtgggtctgtctgcattggtggctggcactgtgatggtgatttttctgtagcggcagcattggcattgtgtgctgtgtcacccaatccagccatgcctggcacttacttacctatcggaatatgtgttatttgattaaaacttaatttcctttttcctcctttatattgcagatagggtgttatgttgtttttttggttatgcgtgtcagggatttggaggaaaagggacaagacagaacaattgtaataatgggggtgtgtggggtacagtggggctgcggacccgtgtgaggagaaggacatctttgccggacagggacagtgtgaacagccacttattggtaaatgcagctcgacgtggggccatcacccggcatggagttttgggaggggtgggagtaggaggggctgctggaggggtcaccgtaaactgaaaggctttgctgagggccttggagtttgtcctgaggatggtgggaacccgggcttgagctcatcgtgggagtaggagttagagttatgctgctgtgggcagggaggtggacagtgtggaagtctccatcatccagggctgaggcttgtggcctggatcagggaagtggccttggggatggagagaggcagatggatggatggacggatggatggatgcaagcagaacccagcagacttggagcttcctggggtgttggacgtagggagtaagaggagccagttctcccaggggtctggtgtgtgcctgggtggtggctggagccagcccctgagcccaggatgctgggcacggagcaggtgtgaggaggtggggaacagggtgtgaaaaggtcggctttggactcagagtgcctggagtcacatcctccccggcatcccagaagtcaggactgctggctgctgagatggggcttgccccaggcatgtggaccagcagccagcacctctcagctgagccctcagtcggcagaacatccctgcttgctgtttcctagtgtggacacactccatcccctctgcctggatgcccatcccaggtctttccctgggcggtttctttcatcatccaggcctcatcttatggcctggagagtcctcttctcttcctgaacttctctccagacacacccacattgctctgacgctctgagacatagggtcaatgtgcctgtcatccgtgcacccagatggtgtgcgcctgggggcaagcagacgagacatctgccccattcaccatcagatgtctgaggatgcatcaatgcgtcgtgtgaatggtgtgtggagacgctgcctcgctggggaatcccatctccaggcgggggccgccagcttttctcagtgactcaaggcggctgtggggcaggattggcattcccagaaaggagcctcccaaaatagcccgggcgtcccctgtgggtgtcgagctgtctgttctctctaggaaggcattctgccttgtatggaaggaattgcttctcaatttctgctccacactgaggtgactttagatgttgattcaaaccttttctgtgacatctgtgctggggtgagatcaagatttgggggatgtgcgtttagtggggcagcctggctgggtggggcttcattggggaagcaaagcttggggagctggaactatgcttctcctgaccccgtgtccttccacttcctgaaattacctgcagcccctgctgctgtgctcatcatgcaggaaggcagtcagctgagcagtgtgtgcagaggacgattcagaaactggtacaaacttggcactgagacggcgtctgatgggagaagagggggtgtctgatgaaagaggctatgacagacaggagcatgtgcgtgtctggtggaagagggtgtgcgtgtctgatggaagagggtatgagtgtctgatagaagagggcgtgagtgtctgatggaagagggtatgagtgtctgatagaagagggtatgagtgtctgatggaagcaagtgagtgatggacagtgtgagtagatgatgaaagaaggtgtgagtatttgatggaggagggtgtgtctgatggagacggtgtgaatgtctgatggagagagcatgagtgatgaagagggtgtgagtgtctgatggaggaatgtgtgggcatctgatggaggaagatgtgaacatctgatggaggtgtgaatgagcagatgttgaaagagggtgtgagcatccgtctgatggaggaggctgtgagtgtctgaaggaggagtgattcttggggatccaggcctgcaaggaggcgctgggcaggatggagcctgcagctctgctggctgaaggtggaagagacctgggctcagcacgccaggtgaataatatcagtgctatagtagtaatgatgccacctatttgtgtgtcaacctcctcctgtatttagtgttctcgactctcccagcatccctgtgggttttgttggcaggtgttcacctggggaatcagaggctcaagtaagggagggcgtgacgccatcacccagctggcaggggtcagagctggaactggaatcctagctctgtgccagtgctggggcaccagtgctgactgtggaatagacagttgacagcctccacagacctggaaatgtgggtggcacagtggcatcatgactcctggagcctctccaggcgtcctgactgtccaggctgtcggcggtctcatcagctccacctctaggccccttcctccccattgtttgtcccctgctccctgtctcctctgtgctactcacagcacagggccaggtgtgtcgtaggtgactgctacagatctgtcgtgtgagaggcactcggaaccaggaagtgcctgtggggtcacctgtttggctggtgcccccttggcccccagaaatgactcacatccacacttgaacatacagacatccttttccagggtgtgttgtgctcgatacctttaattcctgtctgcattccagggcctgcccagcctcttcctggctccccagcccagcctggtccttccggcctccctgtcatccccacctctcgtgtgtgcacaagcagggaccaggtagggagaccggcagatgctgctctctgtccctggggtttcttttcttagtgttgctcccacacccacgcgatgctttaattaactgccacactcaggctttctcagtggggagagtcagaaatagactgtggcttccccagctccaggcggcaccaggacgtcaccagcagccccatttctgaatcaggagtctcaagcagctgcagagggtggggaggtttggggaatcccacaggggttctacacccccacctaccccgccccacccctctgcagggccttctgcagcttccaaagcccagctatgctccggccacgtctctagcggctcctcggagagcaacttgatactgaagctcaaagcccaggaagccctggcggcatccctgccccagccaggtccaagcaggctatgtagtgagggagaggaaccggcgcccattcctttgctcctcgacacaggctgctccccttgcctgcgccggctctgggggtctgctctcacagagcttcatgactcgttcaacctgactgcccttttcctggccatggttctgcctagaaaatttcctgggccaccctggcctgagtggcgactgtgtgtcagggcaggggtcagcacactgtggggcaggggtggtggcctgtgatgcatgcctctgcctgggcctgactctctgtgctgggagaatgcttcctgggcctcatcccagctgtgtccctgctggctagttcctgccagctggtgttgccggtgttcctccctgcctcagccctcccagcatctggaactggctgtgggttctgattccagctgtagtagctgctgatcacattcctctctctgagcctcaagggtctcgcctgtaatgttggcaaagtaattgtctgtccttggcatcaggctcgtcaccatttttccttttggaagccccaactctgcatgaagagttagcatagcttcaggtagcaggtggacaaaagggtatcttttatgtatacttagggtaacaagtattaatttggagtgtggggtgtttttgctctgtggccaacttcttccccaagtcttgaacacttcagggggccctcacaggcctgcagcacactttgtccttggtatctggtgggggtctgggcaggtccgtatctcttggtagtgggttcatctccatctctgttggacagaaatctggaagagtccggagagtgtttgcaaatgcaaatctagtcctggcacgcccacaccccatctcacccaggtctgctttaaatccttcagtgccgctctggggttccaggagtgaatccagactctctctccagcgatgccaggctgtgtgggtcctgcccctgctcagcctcggtgcacacacacctccatgcgatctaaacgaccccacctcaggacctttgcacatgtcctctcctcacctagcgatccccaatcatcctctggatcccaactaaagtgtcaccttctgggaagccattcatgtgcagattagagcctagtctgaacggtggcctggccttgttgggttggcagaaccaccctaagaccctgcttagcaccctcacctggcagtcaggggtcttcttgctcacctcaatcccctccactggtgagaaccacagggagggtcttggggcccacagcactgtctagggttctgcatccacccttccaggtgtggggtcctggcactctgtaagtagagaggcaggttggtgacaagccagtggggtcctggcctgagcacccttttgctctgtttacaaccctgtgcctccggggctgtgtctacccagaggactgcatattctagaccattcaggggtaccctgttgacattcagtgagaagcttggcagctagatgaagccctgcagtgagcgattggaccactaccagactgcctctgtgccttgggaccaattgcacagtttttgctggcttgatgtccacgctttcctgaggtgtaccagttggatgaaatgcttttctgggaacatggtccgcgatcagctggcaagtcacaggttgggttttcttgagaaattactatatcccaagcatgcattgtcacaaacatttttgtgcattatctcatttaatgctcattaagagggtctggtactaattctcattttggatgagaaagacaaggttccaacaaagggcggggggaagccttgttcgggggccatgccagtggacactagcctccagggacatttggggtacttctcagatttgaggaaatgcacagcctcactcctcaggtgtccctatgggtgttcctggctgggcagctggctcaagaattgtcttgagccacacacaaaatacaaatggctggggccagcatcgcggacagtgaaagagtttaccaaggcagttataggtaaagaaaggcaaatttattagagaaagtatgaagatccgttgcaagggtgcaatgggcagcacagtagagaaggggctgctggaaagaggcaggcgctggagggaagttttatagggttgtgccagaggggcttatgtgcagataagatagtactgctgggtcttcgagtggaacaaggtgtttggaaataggatgtcatgccagtgggttgtctgtgattagctggctctcagaacaattcttctcccccacctaggaccccttcctcattgttgcttacttattaggactccacgttttacttcccaagatcccattcctatacacagcctctccctcttagccagaggagctgtgcaaaggaagtaccttttcatgggtaaaagactcatggtgcgctcactcttgctgggcttcagggatttttcatttctattgctctaaaagtgcctgtgtgccttccccctccatcccatctccttcctgcttccgagcccttctgtgggcagcatgggggccaggaatctggcttgttcctgcttttcctatggtggtctgccccaccattattcacacacagaggctgttgggttctcttaccattccctgtttacagagactcagatacattcagaagcgagctaatgctgggtgcccagctctaaggggagaccccagacaactccaatttcctgatgatttctcttcctttacctaattccttctccaagacccttgcagacactgctgtaccaagtggattctgtgtaactctctcagaagtttcctcttccatgaagcctgccttgattacccacccccatcctcactccctcagtgtttaagcccagtgtgtgaacagttaagagacgctatggtcttcccacactggtttcttctcttcatttgggtctcagcgaaatgtatctctgccagattctgaatgtatctgcccctgcccaaccactcacccaccatatccgccatttcctccacggcattgaccactctctcagatgattttgttcatttgtctgcctttacctctagaccaggggcatccaatctttcagcttccctgggccacactggaagaattgtcttgagccgcatacataaaatacactaacgataggtgattagctaaaaataattgcaaaaaaaccctcataatttgtgttttcagaaagtttatgaatttgtgttgggcctccttcaaagctgtcctgagctgcatgcagcctgcaggccacgggttagacaagcttgctctagactatgagcttcccaagggcagggaagacttcccatactcagcactctgttctgggggcttggaacagtgcctggcacatagcaaatatgtcatagtcatctcctgagtgcttgaatgagtggcctttggggtgttttgactagactgcaaaagcaacacttaagtgagctaggctttgcatacattgtttgggactggggaggattccagccaggaattgtcagggggggaggttcaagtctcactgaacatcgagatatgatgtggaagcaaccacccacagagccagaagacaaagcccccaggggagcagaaccacaaagggttgtgttctagtggggagggaggagtggctgagccccgcaatgccctaggctttctgctgggacaaggattataaataggagataaataatttttaaatggaggcaacatcctcactggggcaaaatattatggccctaaattctaggcattcaaatactgggccctgttgtctccctgctgtggttagaggatctggaagtgggaaggtttctggctctggcccaaggacaatattattgtagtcataaaaataatcagagcttggcattaattttggatgatgatgcctccttctcctgacaagccctttatgttttttggtggtgactgttggctgcatcctccaacttcctcaatgagagaccacttgaaaaagaaataataatttgtcttcatatcgcacactccgtctgggctgatggtgggaggggaatgcgtgtgggtgggctcagctctgttagctgcgctggctggaagagattcccagtttttattcagcgctcgagctgggctgcatgcttgctgacaagaggcgggaggccccttagacgtctttagacactccccctgtgctgggctgggcacaggcggctctactcagcagttcagcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaggtttgggcgacagatcagaaaaatgaagacctgcacatgtggagctggagcaaggactagtctagtattagctctgtgacgggagagctttgactgtcacctggaagtctgacttgattttgccagcaagaggcaacaaccaaaggttcactttctctccttccaattttgggaggcgatctataggggtttgccagccacctctcatccttgcagaccccaggtggaatttgcaggcagccactatggtgcaaaatgtaattttagtgtttttccgcagacggctgagccaaagacctgccgtggaagagctggagagaagaaatatcttgaaacgtgagtagctggtgattcctctagaggttttccttcacgtgtggtgaggctgttgcacaaatcctgagttcccataacccagcccttctctgcaagcggaatgctccatgctcccagtaaacctgagctgctgctgaattctgaaagcaagccccaaaggaaagctgatatacctagaaacattttttttaatttaaaaaaactcctttcctcttagcataaagatgtttttattttcagggttagtcccatatgtctaagtgcgttaggtttcaagcaggtcttcctggcagtttgggtcggggttcttcatggctatagaaatcacaaagcatgaaccgcatgaacacactagagaaggacacgccccttgcctgttacacttgggaggaataaagcagtcagctcagggaaacggtgaagccatgagaagctttcctgtggctcaggactttgaggttccaggaccctctgttgctcccagccttgcaaccccttgcatttcccgttaggtggacaattatagcatatgctgagcataggtgttcatgagtaacctccatgctctagggcactatattccattaaatattccataaagtcagtgatttaggggtggccaaacctcttgaaaaagtgtttctccaatagttctttatctagtcattttcagtttttaaaacattttccacagaaagtgtcttctaatggcttggatttttaaaggactttttttctctttatgtgatgaatactgcagactttctctgagtttgttttcttatttgtgaacatctttttatgaagttataatggtaccaagctgactttctgtcagaaaataccgcagagccccttgttggtctgggtactgaacttgaattgattcctccctcctttctttgcctcagtgccttcattaactgcctaaaacaatcccctcctttatagattgttgaaaataaccctcagataaagacttcttcattttactttttaaacttaagatatagtgactactgttctatgttaactataccatctctgaggatttaaagaaaagctcttcattgataacatgcttaattaagtaggcagacagaaaagtcaagctgtttcagttgccaaatatttgaatttttaaaaattaagtcacttatttataaagcttgtaagttgcagatgctactaaaagtagcagtccagacttgaaccaggcaagttcaagacacaggaagcaccacattccaagtagcctgctgtcagcaacaggaagagagtactacagcccagacctttaacccaggaaccatgtcttctttcagtagcagcctcttccttcctatcgtgggcaaccaggtcttcccatcagcaagtacttctaattgtgttaatctttggaaataaatatcagagccttagaaatagaactatctttggtgaatagggagctagcaaatgcataactgaaactgactgcccttaccttcagtgcatgaaagggaaaatgggtttcctctgcggtggccatggcaatcccgccataaacactgtgccttcatcagtgaatgtaggtttgtccttagctcggaagccctctctagtgtcctgagtggaaggacctgagaattttactgctaggtttgtggtgggtgtttggttttacttttgttctgtggagatgagaatagggtaactatatatagcctagtatgaaacatcatactcataggctctagatacacaggacttcaagcactcatactgtattgtattttcttcttgtaaccaattcttagaatatcacttttgtatttgcttcaagggggaactcatgactaactgcagtcatatctgaggagcactcaaaactccgcccatataacactataacgtggatagaaaagcagaagagcaggggtccctttatatggtgatggtaattctttattaggcccaatctgtgccagggactatattcagtacttggtatatattccctcatttaatcattgcaacatatttgtgaggtttgcactttttaataaatgaatattgggaaaaggatagcactagagttcaaccccaggtctgcctaactccattgcccatcttcttaactactgcatcagaagcagtaatacatttctggatattcatggaagtctcaggtataactgtccaagctgctggagctatttccagaaaatatgagtatagcagtcctgattatgggtcccttgctttgtataatgcagagggtgttctgggtctggaaataagaaatccataaacatatcactaaggggagctcagaaggggaggtctgtgggcttaggctaacagggaggacttcttggaggaggtctccaacagagcgcctggcacaaagcagcactctgacaggaactttcaaagatcagttctccaaagaccctgctggtgaccttcgtagtaattatggcatttttcaggattaaaaaaaaaaaaaagatctgactttgtttcaatcttttcacatggaagctgcacttgggagctgcccatggcctattttaaagaaatctgaaacattttacgtcacgtaaatccctcatggcttgccttgtctggacactttcacaatgtctctctaattgtatcagctttctgatgataccttaaaagtatggtttcttctggtttctcacttgtataaagaattaagcagaaagaggatttcattaccttttctaaaacaccctaatccaagatgactcacttaaaaaaaattactggaaagcacaatatattaaactctcatataaccaatcccacaaatgtataaatatttgaaacgcatcttttacataaaggcagataatgtgaaattgtgttaattgcaagtggcaggatttcccttaccaaaacctaccagtgtttctaggagtgctgattgttgaaatctctttcctaggaatggagctatgttcaggtcagggacataaggctttatttagcaacagagaacaccagaaataggacagccattatcttgtatcccagggggaagcttacgttttatactatatctcagcactttcgtctatttttggcttccaagggtaggtgcgagcacagcttgaatgttaatagtcacaacttaccaagcaaagctaattttgctgagggacttgggctcctttaaaaggcactgtcatataacagtgttcacgcttcagcaatggagagtcagcgaggttcatagatgtgttaagatttgaaatatagtctgaacatataaattccaggcaagcatatgctgcccaggagctgaagaaggtgttccatgttttatgttggttaaaaagtctgtacgcttattaaggaaaaaaattagtggcagtgctatttatattgaaatgtacatatacatttatttacttagtctactacagctttttttatgtggcatctaagtgctagatgtaaatataaagatatttggggagaaagacagacacagaggtgtctacttccttaaacaaacagcagccatatctgtggttgtttctaatgcacagaagggctgaggagaccaggttgggatgacagcaaagctttgcttagtacaagtatttctgtgtaatgagaccatgatctcctgagcagtgactgacaaagtgggaagaaaacaccatgagtgatgtggaattaacttcagctcccagaaatatggatatcttgggaacacttccctgctgaagagaagaacgtttcaacctgtttctctttgttattttttttttcctattttaatctttcacagaaaggaatgatcagacagagcaggaagaaagaagagaaatcaagcaaagattgacaagaaaggtagtataagcattttattgcctgaataataaaaggtggtctagagaacagctgcttcggtagcaggtgggatgggtaatgctaggtatcactctgtgatcatgaataatgttctcctggacatcatggcatcagttaaatcaggatatttgctcagcaacaatgaattaactccctctgacgttccctatggacgaagtccttccctagcacggtagcacttggagaggtgcacaatgcacatgacattttttacttatgttcaggtggaagccagaagttgattggcattttcttaatttacagtgtctaggaaaagcatacctgggtatcagtgttttagtcacattttacactcatcgcttttgttcacctccaatatgtctagaagttcctcagttgcagaaagctttattagactcaaaggtttgttctctgtgactcaaacagttaacatttactatggccaatacaggtagcaactctataaatcttaatctacttttaaagccttgaccatttctaaattcaagtgttctggattccccttcttcgttgtgctgctccataataattctcttgaaattaacagaatatccttcctaagctggacatataataactttattagtacttttaaaaagcttatctaattgtatctgaagccagtgatgccataaaatctaagttaattcactaaccattccttgagctggtgctatgtactactgggggtgtgactccttctgataaaatatgttggaggaagggggattgtgatttaagagtacagtatataatttcagcccttcacattagagattgcttgtatttgggttatattttccagtttcaggttttttttgttttgttttgttttttaagagaagtgctgtttgttcagagtacttcaaaaaagctagtttggcatgtgatacttaactatgatgatctttaattttagcttaatcagagacccactgttgatgaattaagagacagaaaaattctgatacgattcagtgattacgtggaagtagcaaaagcgcaggactatgacaggagggcagacaaaccctggacgagactgtcagcagcagataaggtacctaactgcctgtgctggtggggggtgttggatgatataataaaggcaaaatatgtcatgccagggagtttattcatagacaatgggagccctcaactatttaagggtatactgcagtaaatattggtttctcaaagataattcagggtcagattgagaagtggttctcagctaggtgacagttttgccccgagggacatttggcaatgtctagagacatttttgattgtcacaactcgggatgctactggcatctcctggtagaggccagggacactgctcagcatctcacaatgcacataacagcccccacaacaaaggattatctagtaccaaatgtcaagactgtggaaattgagaaaccttggtataagggataaatcaaaggtgggcaaggctgccataagagatcaactgacaagtttaaacaaaaagagctacagtggggacaaagaggcattcaagaaagcctctacagtatagaaaaggttctagattctccccctggacttgtgcagtttgaggtatctctgagaacctcctaagaagtctgaactgaacagctagagaggcaggaagaacacaaggaggtagtaggtcatagagtctctgcatgacatttggtgagcacagagagggtcagttcttgtctgtgatcaaacacttgactggcaagatttaagcccaagagtgtccatagagttttgtcaccttcttgcttctattaattttcagaagacttaaagcctttaggaagagaaaaattatacattcaggcaaggaatttgctaattgttcttcattcttcatatgctgagtatgagtatgtacacagatattgcatcaacttggagaaatgtgaacgtgttggactaacttgcctggttctttgtgactgatgtgcccagaggatcacagtgatgcgaggagaagtatctttggtggtctgcagatgtgtttgagtatgagaataatatacccctaaagttcttaaagactttccttgtcccagaggctgtgtttgatgttttcagtctcatcaggtccctcgagtgtttatctgagaaagaagtacatgatgcaagtgggcctggggaagccaaaatattaatgtatgctgaagttagaaaggcttatttctagattatctctgattataaaattccaagttcaccaaaagctgaagtttactcattatcttggtgttcctgtttcattagtgccctaagcatgtgcttggtccgtttaggtatggagtgaacggagtttggggaagggttgtcttcccactacagttcagcaaattaatgaatggaacacttacataatactagtcctagccagagcaatcgagcaacagaaagaaagggcatccaaactggaaaagagaaagtcaagttatccctctttacagacaatatgatcttatacctagagaaacctaaagactccaccaaaaacttagatctgataaattcactaaagccataggatacacaaaatcacacaaaaattagtagcatttctataaactaataatggactagctaagaaagaaatcaagaaggcaatcttatttaaaataggtaccaaaaatacctgaaaatgaattgaaccaaggaggtgaaagacctctacaaggaaaactacaaaacaatgatgaaagaaattgaagaggccacacacaaatggaaagatatctcatgctcatggatagaaaggactaatactgctaaaatgaccataaaatgaccaatgcaatccctatcaaaataccaatgtcatttttcacaaaaatagtaaaagccatcctaaaattcatgtgaaacccaaaaagaacctgaatagccaaagtaatccttagcaaaaagaacaaagctggaggcatcacactaacttcaaaatgtattataaggttatactaccagcataatattggtataaaagacacatagaccaatggaaaagaatagaaaacccagaaaaaattcacttatttacagccaactgatttttgacaaaggtgccaagaacataaactggggaaaggacactcttcaataaatggtgctgggaaaattggatatccatatggcaaaagaatgaaactgtacccctatttcttactatatacaaaaatcaacttgaagaataaagacttaaatgtaagaccccaaactataaaaccactaaaagaaaacacagaagaaacagtccaggacattggtctaggcaaacattttatggctaagacctcaaaagcacagatagcaaccaaaataaacaaatgagactatattaaactacaaagcttctacacaacaaatcaacagagtaaagagacaacagggaatatgagaaaatattaatatctgcaaactattcatccaaaaagggactaatatccagaatatacaaggaactcaacagtcaaaaaacaaaacaaataatcccattagaaagtagacaaaagacatgagtagacatttctcaaaagatgacatacaaatcgccaacaggtatatggaaaaaatgctcaacatcattaatcaacagggaaatgcaaatcaaaaccacgatgagatatcatcttattccagttagaatagttattaaaaaaataaaaacatgctggaaaggattaggagaaaagtgaacttttatatactgttgatgggaatgtaaattaatgcagccattatggaaaacagtatggagactcctcaaaatattgtttaaaaactatatgatccagaaatgccacttctaggtatacacgcaaaggaaatcaaatcagtacattgaagagatatctgtactcccctgttcactgcagcattattaacaatagccaagatacaaaatcatccaagtgtccatcaatagattaatggataaagaaaatgtagtgcgtgtatatatgtatatgtgaatacagtgtgtatacacagccacacaaaatggaatattccaccttaagaaaatccagtcatttttgacaacatgtatggaactggatgttattatgttaaataagccaggcacagaaaaacaaatatcgcatgttctcactcatgtgggatcaaaaaagttgatgtcatggaggtagacagtagaatgatagataccaaaggctgggaagggtggcagggtttggggagagaaagagaggttggttaaccagtagtaacatacaattagaaggaataagttctaatgttctatagcagagtagggtcactacagttaacaactatgttgtgtatatttcaaaacagctagaagagaggacttaaaatgttcccaacacatagaaatgataaatactggaggtagacatcctaaatacttgatcatcacacagtctatgcatataacaaaatatcacatgtaccctgtatatatgtacaaatattatgtatcaataaaatttttacaaagacttccagaatattagctacatactagcttggtaggactataataatgagtatggcagttttaatgatgaaccaaaaaattgtttgtttttttctgtatattacataatagagtcaacaaggattaggaatggttaatttataaacacgatgctaatttcctgatttttttaatatcctgtaaaacaatgtcttgtttttaaatttcaggcagcaattcgtaaagaattaaatgagtacaaaagtaatgaaatggaggtacatgcatcaagcaagcacttgacaaggtcagatttgtttctgtgaatttcatggtacttatttttgaaacacacaccgccttcccccgtcccccgccacaaaccatgtatccagctatacaaattcagcatttttccagagaactctattgaacaaatagaatgtacctcaagtaagaatgctgcctgctcccattatttcctttaggacttggtgaaaggtgatatgtatggtaacaatatcggtttatttaagtagttaatgcatatttaacaaaaataagcctcaaggcaatgaaagtaatttttctgtgtatttaattcccctctaatattcagaattcctccaatttatagaactcacctgtttatacttacagatttttgtgaaattagtcactccccaccttcacatttactttttcctatcgtaaattattagtcacatctttaacacagccagcgttctcctaaagctgagtatttgtttcctcagtaaatatttgagtaagtgctgagaatgcaatagtgaatatgataaaggaggctcccatcttcatggagtttatgtcccattgggaatatattggctgattctcccataatcaagacttttcccattaagatgaatatattctctgtctatgctatgatatgcaagggatgacactgggcttcttagtgatgacgaagttgggaaaagatttaactctctttacttattgaactgcatattttttcagtatttccccccacttcttttccatggccatgaccggtagtaattatgtgaagttctcaaacatctctgattctaaagcagatgactgtgatgcaacaagccttcaactgtatcagttgctttgtcttctcctttatctgaagatgctcaaggcccacatacaaagagaaaggaaatcctgcatatagatactgccttaaactaaaataatagctttagttttctgtttgttccaaagtggccactgcaattgttatctgaaagatttactctgtaagattaatgtggctatagaacagaaactaagtacaatggaattccaccttaaccaatggttttagggtgaatatatcaaggggaagggaaagttggatgaataggaaaaaattatgcaaagagtttgttttttaaggttccctcccatgactaacatacttttggggaggaataggtcatatggaggaataggtcatatgaatgtttaggaaaaacagtttcagtaaatcatgcacaattacatttaatgttcattctgtcttaaatagaatgaatacatattctatatattgcaatctcaattttgtacattttccgattatacattattaaatgtttagtaaagatgtttattgtcctaagttgatagctttctaaaataatgactctaatacttaaaatgtggtataaagaccctaaaattatttcaacaattcaagagtcagaacggtatttttggttatgagattttaagagttttaaaattactatgaacatattactctacaaaaagtcataactctactataattttcaataatttattaacaaattcatcatttctactgatttagcaaagccctggcctttctgtgtacttcaagggcttttaactcacaggtttaaaactaagttctagatagtcctaagaattcagcatataacaggggcctgagagtggggagccctctgagactctaccctattttaaccagagtagctccatcctcatgttttacatatgggacttctgagaatctttttaatagcagcaaatttatttgtataaggtttttggctattttaactgctagaaatgaataaccttaaattctttgtcttttttataatctctagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 781 - DNA, 126502 bp, Homo sapiens; identical to SEQ ID NO: 780

SEQ ID NO: 782 - DNA, 10695 bp, Homo sapiens
tcctgtaaggaacattaattctttaatgaatacactcagtcggtatttctctttcgagtattctgatggatcaggagattcacggatggaaaggcactgtcttggccctgaagctgctcacagtcccgcagcaggcaaacacagaagagaaaagccgaatccctgtgacactggcttacgggacctatgaagggccacgggccattgtgaaggagcaccacaggcttccaggagagccaggagtcaggggagcttccccaggatggcgtcactgtcagctgagatgatgcctggaggttgcggagatactagcaggtgtgtgtgagaggcaaggtcccccattctgcccggcaccagcaagtacactgaagtcttgtccgggggcctgaaggggaggggacagcaggaacaaggtagccaggctggagcagacctgatgggaagggcttccctgccccacagagaagtgcagaggggactgtgagggcacgcagagcctgaggtggtctgaagcagacagatggcaccagcctcacctctacgaagctccctgcagaggccatgaaacagcctgggggtgggcaggaagcccggggggcagactcaggaggaagacagtgtcagattcggccctgaagggccacgcagacctcggccaaggatgggaaggagtccaggtgccaggcagcccagggcgagtggtgcccacaggcttgggctgtgctgtgcataagggccacacctgaagctcggccacacctgaggctcggccaccacataggccccgtttctttaccaagataggttcctgcagaggtcgtgaagctgctgtggtcatttgctggcagcgacgtgaagatagaattctttcctgactcaaccaggggcactctcgtctcctccccgtgagacccgcaatgcaggaagcacccacagctgcatggacagaactggggcctgggaaagaggccaggaaggtgccagatgagagggcgctccatcagggtggcagcaatgccatgggctggcaaatggagaaaggggaacaaagcacccaagtgcatctagccccagccacacgccttctgctgggagtgtgctcagagggaagtgaccgctaggattcggaatctccagtcacggcccctggagaccggcatgtgggctgtgtgtggggtggagggctgggggtgttggcaagtctcacaggtgaggacccaacgagggaatcagacaaaaagtggccacaaattaggcagctccaggaaggacatgtccttgccatagtaagatgttctgctcacgcgtatccacgagaaagccccgcatttcacggggagcatagaaacaggagtccccaactctgctcaccagctcctccggctgctgccatctgctcctgcagcatggcggcctgggaagcctgcactggtgattttctgccactcaagttttgcagacttcgggaagatggatgcatagcctggggcaatgacagtcacaggcccgccttgtcacaaggtccctggagcgggcaatgccttgagcccaaaggctgggagcacaaagccatcttcagccatcctcgatttccagcaagaccccagggctcacccaacagcccgacactccatactacaaggtgggttaatttttttaaagactctgcagaaatataccaactacagagctcaggaaagcaactgatttataaaacccaatccaagttgtttgcttttatagcattagagacatgtctgaagaacttcaagtttttatctatagaaacataattagtttaataaattactaggtctattttgaataacaaattgagtacttttattagacctaagtggaactttatctgaatctgaattttccaaggggccagtgtagagtgacacaggtgtccgaggccacctttccatcttcagacacccccccgtctctctgcacagggagttggccttccagtaggtgttgctcttctgtcttgacgtctcctggaaagatttttatctctattttcctgtggtggtgttttccacgagctaattctttctatctttaaactcattggctgaaaacaaatgtgggaatatttttgcattagtaacaattatattatttttaaatgttaagcaacacatcataccagctatcacagaatgtagatgattctactcccccttcctacagaaggacacatgaggtatccacacttagtgtctctcattccccattttacagcccacgctcttgtgaaatttgggattccaatacatggctgatattgtaaagtcaacagtgaaataaagtgcttgaaactcaattcaaaaatgcataataaaaataattttctacattttgcactatttaacaattgatggtttcaaggcgtggataagccacccattcagttatctatttactcgtacattgccccgcatgcctgtgattaactcaggtcaatgatggagcatgagagaagtccgcgtctcacaggaggctgggcctgtgcagtccaccctgggacttacgatgttttgtactcataggatctgaaaaggctcttttcctacttgtgacaaatgcttggagtagatttctgatcttccttcagggaataaagtgttatctgctcagcagttgctttgggaaagaatgcgaggggataaatcatcttcaggagttgggggcgccttctccatccacatcaacccagtatcagttgctggctgtggactcacgagatttgcttcctgagtatgagggtgacacaaagctgggacaggaagagacacactggctgggagaatgttctaaagaggagctaattttaacaaagaaaaatgtgatagagactgccgagaccagctcggtcaggaagaccctaacccagcagtgctagaggaattaaagacatacgcacggaagtatagcatgtggagtgggaaatcagggcactcacagccttcagagctgagagccgtgaacagagatttacccacatatttattgacagcaagccagtgataaattgtttctatagattatagattaactaaaagtattccttatgggaaacaaagggatgggccaaaacaaagggatgggctctggctagatatccacagcagaaacatgtccttaaggcacagatcgctcatgctactgtttgtggtttaagaacgcctttaagcggttttccaccctgggtgggccaggtgttccttgccatcattctggtaaacccacaaccttcagcgtgggcatcatggccatcacgaacatgtcacagtgctgcagagattttgtttgtggccagttttggggccagtttatggccagatctgggggcctattcccaacaagagacaaaatagcatcctgtactgtggctcccaagctaacagcgccacccctgttcagaggagtccacgccgacaagcagcaggtgcaagaccgcagtgcagaagcagggagcacgggaggctgcgagccctcagactcacgggtggagacagtgccacacacatcacctccgcagcctgcacccacggaaacaaagcccccaagtcccctcggccccagccagacgcttgctgctgtgagtgtactcagagggaagcagccgggaggacttggaatctgctccacagcaagaagtgctaagggttaggatcttgtttgaaaggcatgtacccgtgtccttggaagaacacaggactccagggagcaccatgctcacccagggaggtgaaattgtgtggtgaggagctgatgggatgtgtgtgtttgggtacagaacctctgcttctctttacagatgataagcacaaagggtcacctttggaggagctgaattgttagatgacgatctttgtcccaggagagtggcactctgattcttgtggccagcgtatttgggtattgtctcttcatcagctgacagaggtgaaatttttccaaaagcaggttccaatgcctaaaagacaaaatgcagggaaattcttcacattttcgaaggtaaaataaattcaaattttaatacaatgaagaataattggaatgtcctagaaaaaaatagggtacaaggtagggggacttggactgggttttccccctaatatgttgataagaacagaaaccctcaccaagcgtttgtgaaggaacctttgtggagccgatgtttgctttgtgtttcttattgtggttccttgtttcaaaatgatcacaggatcccaaaggctacagaacaaacaatccccaacatatcttcctttaggctcctgtgtcttcaaccgggagtgtgttaacggaggaagaaaatgtgatactacttctagtgttgtctctacaacttgtctaagatccaaaatgcaaattcccaactttccctgttatcagcagactgacctggaacagggtgatccttcaggtgggatgaggtatattaggtctggaatgctaaattattcaccgttctgccctctgaggaggagaagggaatgagaaggggagagggttgctatgaacgaacccttaatatcagatccagagtggctcacccacacagccatgcccgcgttctgtgggtgctcgagtctcagccttttagatattcagtccctaaaacggcgactacacacagatacaccttcgcatatttaaagtgtgggattcacatatcccatcctgtttcttcaaatcaggtatgctcttgtgagcgtacatcctgttcttataaatagccccacggtgaccagtgcaatgcacagaatggaaaaatatttggaaattcaccaagctctaatctcaaaataagagaatgatcaaaactgcagggcatgtgaagactgaataagacttcattgactcttagggtaattgttatacaatgacccaaatggggcagtagatactattttttaggaactggcatacaatatatgtagggaaaaaaatccctgtgagtcttcttgggttctccccacagaaggtggacaatcccggccagtatttgtggcaatttcccccactcttcctctgacagaggaacagcctgcccagcttctgctcttccttccgcagaaggactcggcgctttgctgtgctgagaggctaaactcactttctttctgaggcagcagaagccatctccatggaaacaaagctctcgcagagctcccgaagagtgggaataacttccaagatttcccgtaatttcttgtagaggaacttgtggcagttttttttgtttgtttgttttgtttttttcagacggagtcttgctctgtcccccaggctggagtgcagtggcgcgatctcggctcactgcaagctccacctccctgattcaggccattctccagcctcagcctcccgagtagctgggactataggcacccgccaccacacctggctaatgtttttgtatttttagtagagacggggtttcaccgtgttagccaggatggtctcaatctcctgacctcacgatccacctgcctcggcctcccaaagtgctgggattacaggtgtgagccaccgcgcccagctgtggctgtttttgctgtgcttggagaacaaaccacagagcagtctcctctggaatgtattcggtgggtgcctgtgtgtgtgtgtgtgtgtgtgtgtgtgtgtgtgtgtgtgttgtaatcactgtgctgtatcggaaatattctaagtcctggaagtaccgatttaaaagttcacacaataaatgcagctaggaaatgttagtacttttcttaatccactaagaaatatccccacttacgtttggagggtgttcatgtggtttcatgtgttgttacctgtatgtataattttaatgattcaagttatttagatccatatgcaggaaacagaacccagacaaggcagtgataacactggccacattcacactctcttaggctggttctttgagcggtgtgatcaaacgtgaaagctcagtgttctgtagaggcaggctggtgctgggaggcacccactacttcagcatgagaatgctggttcttcgttcgggatagagcaggttagtgatacaggatgggggcaggaaagtcctgggtggagaagaacggggtccctggctagggctcgacccctgggcctgtgcccatggacctacgcatttctgcttttgtgcccaaatgttgcatttcccaagaccaccgtggcctgccacactcccatcctatgcctataaaaaccccaagaccctagcgggcagagaccaagcggctggatgtcgagaagaacacaccggcagaagagcacaccagcagacacagcagacgccagcaggccatcgactggcggaatgacacggagtttgcttggggtggtcaggggagagcccggtcactgggcagcccaactcccaaggggaaaactgccttcccactccatctcccttctggctcccccatctgctgacaggtatcaccactcaataaaaaaccttgcacccatcctccaagcccatgtgtgatctgatttttcaggtacaccaaggcaagaacccaggatacagaaagccctctgtccttgtgataaggcagagggtctaattgagctgataaacacaagctgcctacggaggggtaaactgaaagagctcccgcactgtaacacacaccctctggggcttcagctggaaacattcacccccagacactgccgtggggtcagagccccatagcctgccggtctgtacactcccctagaggtttgagcagtggggaaccaaagaagcgagccacacccccatcgcacaccctgcgagggggacaagggaacttttcccgtttcaacaggtctctattgcattctacacagctgtcctagaggatgaacagaaggacaccaggctactgagctggctctggagtcaccctgggttcaaatcccagctctacgttctccagcccgtggccacgatggggttagtaataggatccatttcatagggtcgtcatagagagtaagaccgtaaagctccgtacctagcccatgtaaagtccacagtaagggtttgctgctgttgtcctgagacatcatgagatgtcttagaattctggacttgagacacacggcctgggggcggcaatgcttctgtctgctggagtgccaggtgagaggcctgatgtatccagttcttattaatcattacttacgggaaatggagttgatggaaagatagcaacccctcccaccacccggagcgtgagtgataccgcgtcattcagcaataaagcccacatctttatggggacgctatttttacataacgcaaacggtacaaaaacataaatgcgcttttggtaccagagtgtgcgattcttgccccgcgtgtggggacgctgcagatttcttcctggctttccaccgctgcagctgcagagctctcagcttttctcggagctccatgttctgctccctcaaagcatctatatgactccggagttttccatgaacatcagcccacagagacttctgtctcccaagctcttggtggagtctgatgatctgctgctgtaatggctgttattgggaagagaacaccagaaaaacctctcagatgtcacaatgggcacatttatctgcaaaatactcaagccctctctgatgtaagaccaacactatttctggaataaaagacacccgatgagataaacaggactaccacagcctttttctttcttctttctttcctttctttctttcttttcttttcttttttcagggtctcactcagtcactcaggctggagtgcagtggcatgatctcagctcactgaagcttcaacttgatgagctcaagcgatcctcctgtctcgacctcccaaatagctgggactacaggcatgtgccaccatacttcgctaatttttgtatttttactcgggatgggggttcaccatgttgcccagactggtctcaaactcctgggctcaagcaatccacctgcctcggcctcccaaagtgctgggattacaggaataagctaccatgcctggccatagctttattcttattaagtagtgtttattatgagttagtccacataatataaccagataaagatggttagtgaattatgatttttttgttaaaacactactacagcaaaaagaggctggcattcttttccttttttttttttttttttttttttttttgagacagtgtctttctctgtcacccaggctggagtgcagtggcgcagtctcagctcactgcaacctccacttcccagattcaagcaactctggtgcctcagcatccagagtagttgggattacaggcacatgccaccacacctggctaatttttctattgttagtagagacagggttttaccatgttggccagactggtctcaaaggctgtactggcatggatatatggtcaatagtttaaaaattatggaagccggccgggcgcggtggctcacgcctgtaatcccagcactttgggaggccgaggcgggcggatcacgaggtcaggagatcgagaccatcccggctaacacggtgaaaccccgtctctactaaaaatacaaaaaattagccgggcgtagtggcgggcgcctgtagtcccagctacgtgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaattatggaagccactgcattttcaacctaacatgttagccttcccctgggatccttcactggatcgtagagcctccagccttgctctgagaataagtgggatcgtgataaaggtacagtcctgcactgggtggccctggccacagggacccgtgggactttaatgacagcaagcactgtccaacagggtccaatgaggaagatggtaaaaatcaggaaacttgctgggatgatgtgaggcatgtcaactttctgattttctttaatgaagtttttaaagtctggtgccttctcctggattagaggagaaaagctggaatgttaatattttctttaactccctgccctgcctcccatccaccaagagatacggttgcagagggggaaagagccacatgccccttggagaggaagtacagaatcagtgtcccggggtggtgcattcctacaggggtccagcaagggaaagtccaatgacgggcctcagggacaggaatcagggtcccgcctggtgggactaactctgtccccacagagctcaactcactggcatctccccagtgttgcagtcctccgtgagaacctcggctgccacagctgtcttctccatgacagccccagctcctgggcacgggtcctctgggtgggtgccctctttggggtccctggcctcgagttgacctgccagcatcctggttgggaagggaagggctatggggacacttgaatgcagccctcctaccccgtcagtgtgggctgaaggccccagccccaaactaagggtgagcaggacccgcagccgctccttctccccctgggtcatgtgcacattcccaggcccgaagctgaccaggtgaaaggacaccacagacagagggactgagctgtccacacctggctctccaccatcctccgtggaaaatgctttagatcctagaagatcagcctgacacctaacacactccagtcatccaaagaggggtgtgagtggggtgtgagccggtgtgagtgggatgtgagtgggttgtgagcaggatatgagcggaatgtgaatggatgtgagcggatgtgagcacgatggtcttggggtatgagcaggtgtgagtggaatggtctcagggtgtgagcaggtgtgagtggagggtcgcatgagacaccgagggaattctcagccctttaatcagcacccacctggaggggcacaggcagaccctccaccgtgttgagtatgtgtcttgaaccatcagggtgacatttgtgaattcatggtgaagatgtggaaaggaaacacctttttataggtacagcatttatgccagttctaggaagttcacagcaattagagaacaaaaacgaaagagaaaaacgcaaagctttcctgcaagcctgcagggtcgtctctgaaagctgcctccacccctgccttgccctgtccgttttaggaagccagtggcccccaacgaaaccccgactgtttaattcataaacttctaactgtgtgagaaggaacagtttaaccacagtgatcggagaaatgctatttaaaagagagtctcctgatggaagcgaatcgaaggtctagagcaagacctaccagtaaccagatcactgccattccttccccgcggagactgggaatgtttctgcggaagtgggctggggtcacggtcctcacagccctgagaaagctccttctttcctgctcctctgaggggacaccccagtgtcctcggccccaaactcatgaccccctcagtccagggaagaccctttccttcagccccaccaccagacctcgtcacctcacctggtccccaacagtcactactgccaggatcagatcatctgggccatgtccccacagttgtccccaagccctcctgcctcatatccagagaccagagagcagcggacagttccaa

SEQ ID NO: 783 - DNA, 10930 bp, Homo sapiens
ctgactaggtatttattaagttctaaaaccttgaataactgctattttaaaaattcacactaaaagaaaactagaaatgttaacatcttttacagagggcagtaagtggccttttttttttttttaaattataattgcctaggagaaaggtgagctaatctctttggaagtgtcatcagctggtgaacttcatcttggtctccactttatgtctttcactccatgaaaatgtcttttcaaagcagtgttatccgcccatggtgagtttaaataggcatcatcatcattttcttccaatctctggaaataagtatgttttattcaggcaggcatttcaggaaagtgttttgcacataaagagactgaagaaagagtccatgactgacctccccctctccctgccctctaggagcaggatactgccatgtctaacaccaggggacacctggcaggaccccgacagacctgcagacagaagctctagaaagacccctccccggcattctgcagagctcactgctccccagcagccccaggtaaggcacacaggctatgtgtgggcgccagcactgcagaaagcccatctgtcccctgctaccttgagctcctcttgtcttctgtgatagtacagcatcagctgcttctgctcctcactgctaataataggctctcgggctggagctccctgtcccctctgcaaagaggagagcagagcaaattgtggattaaggtgttcttagagtgacaatcctgaagttacaacaaatgttttacgattgcctttgccggctactaaagataaacaggtcccccatgtctgatcacccgaagtgaagcatcaagggaagccttggtcttgagcagccctgagccctggactctcactgtgtggagaccagaggctgcacgataccatctctgtcttgaccattcccaaggcagacactgcaggcaggtccagtgggaaagggaggatgctcagagccacggactctggatctacataaggtggagggccccatttccccaaaatcacagcctagtgacgtaggagcacccacaaaaccaaggcggcccctcaggttacagcgctacacgatgtccttcaaaggtctcgaacctttcctcctccccctcctgtacacagcatcagcagtttgaaaaagcctgaaatcagtgacgggcgaaattttacatttcaaggaacatatctgtttacttgcagccctatttttacgcttgaaattaacatagtatatttcctctcccccacatattaaaacaaactctagatattggtactcaatccatattttcttccagtttttgttggtgtgcaggaagaggatatttttagtttaaacccgagccaataagattaaaatatttgtaccagtagtttaaatctttcggattcactgtacatttttatcagtttgaagggaaataacaaaaactactgacacattaaagcaaaaagtacttacttgctgaatcttggcgataattttggttttttcattcttccccacgtagtctgaaagcttcttcgttcttctcagctccttggctgcccaccacagctgcgcctctgcctctttaatgacgttgagccctgcctggggccagtcgtaagaatggcttgactgtgtgttcccacccagggggcagagcccagctgagcccctcccagcagggggcaggggacagatttctccccgtgctcaccatgggaggcctgactcccgcacctcactctaagtccttgctgactttagtaccttccctgttaagtttccactcatgccctgactcagttaacttcctcctctggacaacagggagatcctatctcatttgcaccttgatccatatagttcgtcttagacagatctgtaggccactgccagggaagggcactggcatcgtgctgggtgtttaaatcgaggtataaaggggctgcctgtttacttctgcatatttcatttatttaacatggcttagacaaagaatattgtccaataggataagaagtgagaaaacccaaggaaaatggaacatgagggtcagaaaataacatgaagcaacaggtaagactagaaacacaaatttccatgcaaagggactgacgcatttgggtagaaataggaagaaattaggtagctggcttcctagcagccaaagacagtggaaatgtttgcagtcactcctgatgagcggcctcacaaactgcgtccactgcctcctgtgtgtggggccaaacccctcactcatgagtacccactctcaggggctgctcctgaattcagaactctgctctgaagcagggcatagcaaacctgaaagctgtgtagggagcaaaacactacatccagaagaggggcatcaaatcttaagggctttgggggccaggaactcaacctccagagtacccactcacaaactacgtacctgtgttcccgacaagtcttccttattttcaaactccatgcggatgggatcatacggtggcaaccccatggggtaaacaatcatcaccgcgcctcgaagctggtccaaggcatctttcaccatctccatggtaacacagacaccggcttccacttgtttctgcaagcagaaagccatcgttatctacagtgtggctaatcacttccataaattcgatcaagatcttgtacaagacccttgccagatactgccagagcaacaaaaagaaatcaaacagttcttgctcccagagtgactaccatctatttcaggggctgagcgaagcacaccgtggcctgtattataaagcagacggtgagcagcactgagcatggagtacaatgaagtgcaaagaattctcaaaggagaaagagcccaatgctggcagcacagatggcagtgaggatcgggagatacggcaggcggagcaggcaccgcaggtgggcctcgaaatgcagatgggctgaaaaggtacagatggcagcaggtgcttcaggacaagctgaaacaaagaaaagcaggcgccagccccctcagcatggggcaggaaggagagaagatgaggccagctctagctggatcagctgaagtttgtttttgaatggccacaaaagccaggctgaagagttcacctttcctctgttaggccacgggaagcgactgccttttctgggaaggagtggtaatgttgagagatttatcttgtagctgatatagaacagacctagttggccagatgtggtggctcacaccttatgtaatcccagcactttgggaggccgaggtgggcaaatcacctgaggtcagcagttcgagaccagcctggccaacatggcaaagccctgtctctactaaaaatacaaaaattagctgggcgtggtggcaggtgcctgtagtcccagctactcagcaggctgaggcaggacaattgcttgagcctgggaggcagaggttggagtaagccaaaatcgtgccactgcactccagcttgggcaacagaataagactctgcctcaaaaaaaagaacagacctagttggagggagaccaggtagcaggctctgaagagtacagaggaaggtgtgatgaaataacaaatatatctggtctttgctactcagttccaggcacagagctccaaaactcttggaatttcctgagtgacaggagtgtcttgttatttataacgagccccttctcaccatacctgagcttgtgctaatacagtaacctgtagtccgcgctgggtttcaaggaaggggctggccgtgcctgggagaccaagcacataattagagggttggagctttcggcctcactcccttcctccacctccaggcgctagaggttgggatcaaacacgtggccagtggtttaagccatcatgcctactgaacaaaaacgctataaaaatcccagacatcatggctcagtgaagcttcctgattggtgaagacgttgatgtgccgggtgacacacatcagtgggggcgttgtgggaagctccaaatttgtagtcaagctggacacaagtatgggtggcctggggacctcacgtgcagctggtgtctgaaataagaggagtcttgttggtgatctcaccctttaacttttaggtctgatgctaactccaggcagttagtgtcagaattgaaggatctgcccttgacctgtggggtctgtgctgtctctgagtagttagtgtcagaacggaattgaattgactggcaggacccccagtgggcatcagaatgcaaaaggctacaggagagccttaaagaaagccacagctgtggaagtgaaaggaagaggtggacttaagaggcatcatgggagcagacggtacagaaccccacttcaaacctagaggtgacagaagggagaagtgttgaagatgacactgaggatttgccctataaaaccaagacactgtggttctgttactggaaacagagaagctcataggaggtgctgattctcagggacagaacagagagggagaggagtgaggaagcaaagagctcatttctagaaaactggacttcaaagtgctgactgggtgttcagatagaaccatctcacaaccagctggaaattcaggttggaagtgaagcaagatgtcagggggaaaggatggaagcttcagagttatctgcagagggtggaatttgcatttggcagagtagataagatactgagagaggaagaagaccaaggataaaaagtactttcagaagtacacaggcaaaggggagaagtgaggcgaccgagagaggagttccacagcaaagtgtggggagaagggtgcagaacaacagccagaccactgttttcttgccatggcctgagacgtgctcacatgcctagatgccatcaccacgcaaacgacgggctcaaccagggcctctcctgtagagcttcataaagcctttcctatattaacaggcacagagcttcagggcagcctttgctgaggctcttcaaagattagtcaaaagcttggtaagtttgagaaatattggtttaaaaataacagttctgctgagcaaaccaggagaagcagaagaaaaagtggtgatcagtcaagagacttgcagttgagagcggtagcaactaatatcaccaacacacaaatacaagcaacagatacagataccacttctttcaatagccttaaattctcttcctccagatacacattatctgtatatcaatggtataaatttacgctcctccctctataaactagcctttgtataaaatgctgaagacaattacaaaaaaccatttatatcaaatacatattaagtcaatcaagtgtctggagagctactcgatggccacaatattcaaatctcccctacttaactttgttaagttcttcaaaaaggtaaaagaaatgaaatcaacatttgtattatacatatttgtattatacgtgaacctatatttacataagccaacaaaaatttgtgtctgcctggaggaacggagaggcctctgggcaaccgtcaggattatgaaaggaaaagctacagcctaccccaaatacgcttgtttcctttgcctccggaaggctgaaagagaaggctggctgagaggcaactctggaagccagagttggagttttatctcaaaagacaagttttaggccgggcgcggtggctcatgcctgtaatcccagcactttgggaggccaagacaggcggatcacctgaggtcaggagttcgagaccagcctgaccaacatggagaaaccccgtctctactaaaaatacaaaattagctcggcatggtggtgcatgcctgtaatcccagctactcgggaggctgaggcaggagaattgcttgaacccaggaggtggaggttgtggtgagccgagatcgcaccattgcactccagcctgggcaacaaaagcaaaattccatctccaaaaaaaaaaaaaaaaacccaacaagttttagtgcatcatttaaaaaagccaaccttagatattattgctttggcttcttctatagtcttctttaacacttgcttcatcttctcatttggagctataaaaataaaaaggagagagggagaaagagctgtcaaatacaaagcctcttctgaaatacctcaatcccctctgtctgagtcagggggtaaatgaactgagagagagtgcgagtgtggaatttagggaagagaagcaagaaacctggctgccggaagttaggtgaagacctcttcccaacagcagagacctggagtgtgctttacgcaaagtggcaaaggctacaaaaaacagaaatgcatgtcgttgggtaaacagggccggtgaactttttctggaaagggccagagagtaaaatttgaggctttgcaggccacacagtcttgttgggtgggataactcagctctgccacgtagcacaagagcagacaatacttaaataactggggtagctgcgtctccttacaattttatttacaataggcagctggctaaatttgacctgtagcccataatttggtgacccctagatcaggaaaaaataataacttgaaagcttagaagccaaaaaaaaaaaaaaaaaaaagaagaagatggaatgcccaaacctagggaaaatggggcaagttgaaaccatacattcctagtaaataacagtattaattagacattgaaaatattagaaacacaagattgtattataatagaagtggttaggctgggcgtagtggctcacgcctgtaatcccagcacttcggaaggccaagatgggtggatcacctgaggtcaggagttcgagaccagcctgggcaacatgctgaaaccctgtctctatgaaaaatacaaaaattagccgggcatggtagcaggcatgtgtaatcccagctactctggaggctgaggcaggagaatcactggaatccgggaggcagaggttgcagtgagccgagattgtgccactgcactccaacctgggtgacagagtaagactctgtctcaaaaaaaaaaaaaaaaaaaaaaaaggtggttaatttaagaacatattacatattggtttaatgatgaataatgaactgttaactggttctcatattttttttcctcatcttaccacatcttcttacgtaagaaagctgtggaagacaaccatttttcaggttaacattgaaaggaaaaaatactaggaattcttactatccctgatatttaaaaaaatgtatttttgagctgctaaaggccttgcaggaatactgttcttttactcctaacagtgttttagggctgttcaattacagtgttttaaatggcgcttttaatgcaggttaaaaagaataagctatcaaaaaggattatcatcaattccacatgatcagccaaacactgaaaggagaggaatttcctcagtgttttgccgtgtactgaagtgctctgccccagagagaagcatgtccttgatcagggaagtccatgtgctgacatgctttccctttcctctttcacacagtccatctcgaaagatcccccaacatttgcgaacagtaacaaaacacaactctgaatacattgcggtgaggacctgccaacaattattaggtggaaacacatgaaattgccaatactcaaccatttttgagctacagaagggaaagggtcatttcatctggttcgtcgaatacatataaaagcaagctgcaacttattaaagagcaagacaaaagcttcctttatctacctaattcatcctagattagagttttaccaaaggagctacagagtacagtattttgtaagtctgtagagaaatgacgaggtcaatttttaaacgtaaagaactgctttctcacacctgtaatcccagcactttgggaggccgagaccggcagatcatctgaggtcacgagttcgagaccagcctggccaacatggcaaaaccccgtctctactaaaaatacaaaaattagtcaggtgtggtggcacatgcctgtagtcccagctactcaagaggcggaggcaggagaatcgcttgaacctggaagacagaggtggcagtgagctgagattgtgccactgcactccagcctgggctagagcaagaatccgtctcaaaaaaaaaaaaaggaactgttttcatacttatgcctgtatcaagcatgcacatagaagagaaatcctcacttaccttgcccattccttcgtccaatatcatcctttttaaacactgcacctccgctgggtacgcatttttcaccccattcatccttcaatttcaattcttcaatctgatcatcggtcagtccttgcatattaggagggagaaatatgccatgttcggctaattcttccatttcttaaaaataagtgaaagacagtatcacaatcataacacctcataccccattggaatgtaagctccaaagagtcaggggtcttgcccatctggctcactattttatggaacaaacatttatatgccacttgctatgtgccagacctggcctgggcctttgacacgggggcatggtactggtcttattcatccttgtcttttttttctttgagacagggtctccctctgtcacccaggcaggagtgcagtggcgcgatctcagctcactgcagcgatctcagctcactgcagcattgcctcccgggttcaagcgattctcacgcctcagcctcccgagtagctgggacaacaggcatgtgtcaccacgttttgtatttttagtagagactgggtttcaccatgttgcccaggctagtctagaactcctaggctcaagtgatccgcccgcctcagcctctcaaagtgtcaggattacccgtgtgagccaccacgcccggccccatccttgtcttctgaaggctgagcactggtgcagaataaatacatgaattttcagttcactaatgtgactcttagcattcagcacatttccaatttataacgttataggaaaagaagatgaattccttttctcctcaaatgctttaacttaaaaataacatttaatattgagtttgtgttggaacctcaattaagaaactacacataagtttcatgaaaagaaccatgaccctcaggaatttctccacggtgcaaaactcacatattcatataatgtaatcaatacatttcataataaatcacatattcatgcaatttaataaatcacataaatgaatatactatttattgcaaatagttacgtttgtatattctatatatacacgatagttatataaacagtaatatcctagaccacatcaggaagtatcatcccgtcaagttcaaaaactatgctgtctaatgcggcagctactcgctccacttggcgatttaaatttatttaaattaaaatgacccagacgcgatggatcacacttgtaatcctagcactttgggaggcggaggcaggcggatcacctgaggtcaggcgttcgagaccagcctggccaacatgatgaaaccccgtgtccactaaagatacaaatattagctgggcgtggtggtgggcgcctgtaatctcagatacttgggaggctgaggcaggagaatagcttgaacccgggaggcgaaggttgcagtgagcagagatcgcgccactgcactccagcctgggcaacagtaagaccctgtctctcacacacacacataccatatatatatatatatatataatttatttatatttatatatacatatatataatttatttatattcatatatactatatatatggtatttatttatatttatatatatttaattaattaaaatgcaaatgtaaaattcggttgcctggccgcactagccacattccaaatgctctacggccacaagtggccggcagctgcccaatggacagcacagatgggggcccttccaccgccggaaagttctgcggcaaagcgggtgccctggaacctgcgcggggtagggagacggcgccgcaacgcaacaggccgtttccagggcggggaaagatcaccaaggcttcctcaactgtaaggggccgtcccaaagccaggtggctcgctgctttacattgggcgactaaaaatagtaaattcagcttttaaaagcccacctagttctcatctcacccctcacacgtgattaattgcactaagtctgctgttcagcccggcctttcggctccctcctccctccccagcccatttccacttattcgcagcaccccaaatcctggctccgagaggcacctgggcccacctcccagcccggggtgtcagacaggccggatcttctccggttccttattcatctccggttaaccctagtgtcccgtttcaaccccggctgctgcaaatctcttcaataatcttcacaaacctgacccctcggcccaccctgcccctctttctccatcccacgccggtctctcgatctgtccgggatgggcccacccgcgagccgcacctgagcagaggcgctgcaccttgagccgcccattatagacccgggccacctgcaccgtgagctcctccagctcggtactcccaggcgcctgcagcaggaactggctctcgtcgccccgcttcacgtgcagcagaaccatggcggtcccgccgaggtactgaggcgttgagaaggccccggctgcgtggcccgcgggtcctgccggccgagggtcgccggatcgccagcagctgcgacgcactaacagccgctcacagtccggaatcccacgctccctagcccgcggtgagcgggggaaacggcactcgctcccggaagtggatgttgccaagagcaacagtgaagcagagttaaagagccgccagctcaagctcagaacccgagtgggggaggctggggtgcaccgaggcccagcaatccaagcccgtacggagctgcggccggggaaaccacccacacagtctgagaggacagctgattctgagcggaccgacggaag

SEQ ID NO: 784 - DNA, 10935 bp, Homo sapiens
ctgactaggtatttattaagttctaaaaccttgaataactgctattttaaaaattcacactaaaagaaaactagaaatgttaacatcttttacagagggcagtaagtggccttttttttttttttaaattataattgcctaggagaaaggtgagctaatctctttggaagtgtcatcagctggtgaacttcatcttggtctccactttatgtctttcactccatgaaaatgtcttttcaaagcagtgttatccgcccatggtgagtttaaataggcatcatcatcattttcttccaatctctggaaataagtatgttttattcaggcaggcatttcaggaaagtgttttgcacataaagagactgaagaaagagtccatgactgacctccccctctccctgccctctaggagcaggatactgccatgtctaacaccaggggacacctggcaggaccccgacagacctgcagacagaagctctagaaagacccctccccggcattctgcagagctcactgctccccagcagccccaggtaaggcacacaggctatgtgtgggcgccagcactgcagaaagcccatctgtcccctgctaccttgagctcctcttgtcttctgtgatagtacagcatcagctgcttctgctcctcactgctaataataggctctcgggctggagctccctgtcccctctgcaaagaggagagcagagcaaattgtggattaaggtgttcttagagtgacaatcctgaagttacaacaaatgttttacgattgcctttgccggctactaaagataaacaggtcccccatgtctgatcacccgaagtgaagcatcaagggaagccttggtcttgagcagccctgagccctggactctcactgtgtggagaccagaggctgcacgataccatctctgtcttgaccattcccaaggcagacactgcaggcaggtccagtgggaaagggaggatgctcagagccacggactctggatctacataaggtggagggccccatttccccaaaatcacagcctagtgacgtaggagcacccacaaaaccaaggcggcccctcaggttacagcgctacacgatgtccttcaaaggtctcgaacctttcctcctccccctcctgtacacagcatcagcagtttgaaaaagcctgaaatcagtgacgggcgaaattttacatttcaaggaacatatctgtttacttgcagccctatttttacgcttgaaattaacatagtatatttcctctcccccacatattaaaacaaactctagatattggtactcaatccatattttcttccagtttttgttggtgtgcaggaagaggatatttttagtttaaacccgagccaataagattaaaatatttgtaccagtagtttaaatctttcggattcactgtacatttttatcagtttgaagggaaataacaaaaactactgacacattaaagcaaaaagtacttacttgctgaatcttggcgataattttggttttttcattcttccccacgtagtctgaaagcttcttcgttcttctcagctccttggctgcccaccacagctgcgcctctgcctctttaatgacgttgagccctgcctggggccagtcgtaagaatggcttgactgtgtgttcccacccagggggcagagcccagctgagcccctcccagcagggggcaggggacagatttctccccgtgctcaccatgggaggcctgactcccgcacctcactctaagtccttgctgactttagtaccttccctgttaagtttccactcatgccctgactcagttaacttcctcctctggacaacagggagatcctatctcatttgcaccttgatccatatagttcgtcttagacagatctgtaggccactgccagggaagggcactggcatcgtgctgggtgtttaaatcgaggtataaaggggctgcctgtttacttctgcatatttcatttatttaacatggcttagacaaagaatattgtccaataggataagaagtgagaaaacccaaggaaaatggaacatgagggtcagaaaataacatgaagcaacaggtaagactagaaacacaaatttccatgcaaagggactgacgcatttgggtagaaataggaagaaattaggtagctggcttcctagcagccaaagacagtggaaatgtttgcagtcactcctgatgagcggcctcacaaactgcgtccactgcctcctgtgtgtggggccaaacccctcactcatgagtacccactctcaggggctgctcctgaattcagaactctgctctgaagcagggcatagcaaacctgaaagctgtgtagggagcaaaacactacatccagaagaggggcatcaaatcttaagggctttgggggccaggaactcaacctccagagtacccactcacaaactacgtacctgtgttcccgacaagtcttccttattttcaaactccatgcggatgggatcatacggtggcaaccccatggggtaaacaatcatcaccgcgcctcgaagctggtccaaggcatctttcaccatctccatggtaacacagacaccggcttccacttgtttctgcaagcagaaagccatcgttatctacagtgtggctaatcacttccataaattcgatcaagatcttgtacaagacccttgccagatactgccagagcaacaaaaagaaatcaaacagttcttgctcccagagtgactaccatctatttcaggggctgagcgaagcacaccgtggcctgtattataaagcagacggtgagcagcactgagcatggagtacaatgaagtgcaaagaattctcaaaggagaaagagcccaatgctggcagcacagatggcagtgaggatcgggagatacggcaggcggagcaggcaccgcaggtgggcctcgaaatgcagatgggctgaaaaggtacagatggcagcaggtgcttcaggacaagctgaaacaaagaaaagcaggcgccagccccctcagcatggggcaggaaggagagaagatgaggccagctctagctggatcagctgaagtttgtttttgaatggccacaaaagccaggctgaagagttcacctttcctctgttaggccacgggaagcgactgccttttctgggaaggagtggtaatgttgagagatttatcttgtagctgatatagaacagacctagttggccagatgtggtggctcacaccttatgtaatcccagcactttgggaggccgaggtgggcaaatcacctgaggtcagcagttcgagaccagcctggccaacatggcaaagccctgtctctactaaaaatacaaaaattagctgggcgtggtggcaggtgcctgtagtcccagctactcagcaggctgaggcaggacaattgcttgagcctgggaggcagaggttggagtaagccaaaatcgtgccactgcactccagcttgggcaacagaataagactctgcctcaaaaaaaagaacagacctagttggagggagaccaggtagcaggctctgaagagtacagaggaaggtgtgatgaaataacaaatatatctggtctttgctactcagttccaggcacagagctccaaaactcttggaatttcctgagtgacaggagtgtcttgttatttataacgagccccttctcaccatacctgagcttgtgctaatacagtaacctgtagtccgcgctgggtttcaaggaaggggctggccgtgcctgggagaccaagcacataattagagggttggagctttcggcctcactcccttcctccacctccaggcgctagaggttgggatcaaacacgtggccagtggtttaagccatcatgcctactgaacaaaaacgctataaaaatcccagacatcatggctcagtgaagcttcctgattggtgaagacgttgatgtgccgggtgacacacatcagtgggggcgttgtgggaagctccaaatttgtagtcaagctggacacaagtatgggtggcctggggacctcacgtgcagctggtgtctgaaataagaggagtcttgttggtgatctcaccctttaacttttaggtctgatgctaactccaggcagttagtgtcagaattgaaggatctgcccttgacctgtggggtctgtgctgtctctgagtagttagtgtcagaacggaattgaattgactggcaggacccccagtgggcatcagaatgcaaaaggctacaggagagccttaaagaaagccacagctgtggaagtgaaaggaagaggtggacttaagaggcatcatgggagcagacggtacagaaccccacttcaaacctagaggtgacagaagggagaagtgttgaagatgacactgaggatttgccctataaaaccaagacactgtggttctgttactggaaacagagaagctcataggaggtgctgattctcagggacagaacagagagggagaggagtgaggaagcaaagagctcatttctagaaaactggacttcaaagtgctgactgggtgttcagatagaaccatctcacaaccagctggaaattcaggttggaagtgaagcaagatgtcagggggaaaggatggaagcttcagagttatctgcagagggtggaatttgcatttggcagagtagataagatactgagagaggaagaagaccaaggataaaaagtactttcagaagtacacaggcaaaggggagaagtgaggcgaccgagagaggagttccacagcaaagtgtggggagaagggtgcagaacaacagccagaccactgttttcttgccatggcctgagacgtgctcacatgcctagatgccatcaccacgcaaacgacgggctcaaccagggcctctcctgtagagcttcataaagcctttcctatattaacaggcacagagcttcagggcagcctttgctgaggctcttcaaagattagtcaaaagcttggtaagtttgagaaatattggtttaaaaataacagttctgctgagcaaaccaggagaagcagaagaaaaagtggtgatcagtcaagagacttgcagttgagagcggtagcaactaatatcaccaacacacaaatacaagcaacagatacagataccacttctttcaatagccttaaattctcttcctccagatacacattatctgtatatcaatggtataaatttacgctcctccctctataaactagcctttgtataaaatgctgaagacaattacaaaaaaccatttatatcaaatacatattaagtcaatcaagtgtctggagagctactcgatggccacaatattcaaatctcccctacttaactttgttaagttcttcaaaaaggtaaaagaaatgaaatcaacatttgtattatacatatttgtattatacgtgaacctatatttacataagccaacaaaaatttgtgtctgcctggaggaacggagaggcctctgggcaaccgtcaggattatgaaaggaaaagctacagcctaccccaaatacgcttgtttcctttgcctccggaaggctgaaagagaaggctggctgagaggcaactctggaagccagagttggagttttatctcaaaagacaagttttaggccgggcgcggtggctcatgcctgtaatcccagcactttgggaggccaagacaggcggatcacctgaggtcaggagttcgagaccagcctgaccaacatggagaaaccccgtctctactaaaaatacaaaattagctcggcatggtggtgcatgcctgtaatcccagctactcgggaggctgaggcaggagaattgcttgaacccaggaggtggaggttgtggtgagccgagatcgcaccattgcactccagcctgggcaacaaaagcaaaattccatctccaaaaaaaaaaaaaaaaacccaacaagttttagtgcatcatttaaaaaagccaaccttagatattattgctttggcttcttctatagtcttctttaacacttgcttcatcttctcatttggagctataaaaataaaaaggagagagggagaaagagctgtcaaatacaaagcctcttctgaaatacctcaatcccctctgtctgagtcagggggtaaatgaactgagagagagtgcgagtgtggaatttagggaagagaagcaagaaacctggctgccggaagttaggtgaagacctcttcccaacagcagagacctggagtgtgctttacgcaaagtggcaaaggctacaaaaaacagaaatgcatgtcgttgggtaaacagggccggtgaactttttctggaaagggccagagagtaaaatttgaggctttgcaggccacacagtcttgttgggtgggataactcagctctgccacgtagcacaagagcagacaatacttaaataactggggtagctgcgtctccttacaattttatttacaataggcagctggctaaatttgacctgtagcccataatttggtgacccctagatcaggaaaaaataataacttgaaagcttagaagccaaaaaaaaaaaaaaaaaaaagaagaagatggaatgcccaaacctagggaaaatggggcaagttgaaaccatacattcctagtaaataacagtattaattagacattgaaaatattagaaacacaagattgtattataatagaagtggttaggctgggcgtagtggctcacgcctgtaatcccagcacttcggaaggccaagatgggtggatcacctgaggtcaggagttcgagaccagcctgggcaacatgctgaaaccctgtctctatgaaaaatacaaaaattagccgggcatggtagcaggcatgtgtaatcccagctactctggaggctgaggcaggagaatcactggaatccgggaggcagaggttgcagtgagccgagattgtgccactgcactccaacctgggtgacagagtaagactctgtctcaaaaaaaaaaaaaaaaaaaaaaaaggtggttaatttaagaacatattacatattggtttaatgatgaataatgaactgttaactggttctcatattttttttcctcatcttaccacatcttcttacgtaagaaagctgtggaagacaaccatttttcaggttaacattgaaaggaaaaaatactaggaattcttactatccctgatatttaaaaaaatgtatttttgagctgctaaaggccttgcaggaatactgttcttttactcctaacagtgttttagggctgttcaattacagtgttttaaatggcgcttttaatgcaggttaaaaagaataagctatcaaaaaggattatcatcaattccacatgatcagccaaacactgaaaggagaggaatttcctcagtgttttgccgtgtactgaagtgctctgccccagagagaagcatgtccttgatcagggaagtccatgtgctgacatgctttccctttcctctttcacacagtccatctcgaaagatcccccaacatttgcgaacagtaacaaaacacaactctgaatacattgcggtgaggacctgccaacaattattaggtggaaacacatgaaattgccaatactcaaccatttttgagctacagaagggaaagggtcatttcatctggttcgtcgaatacatataaaagcaagctgcaacttattaaagagcaagacaaaagcttcctttatctacctaattcatcctagattagagttttaccaaaggagctacagagtacagtattttgtaagtctgtagagaaatgacgaggtcaatttttaaacgtaaagaactgctttctcacacctgtaatcccagcactttgggaggccgagaccggcagatcatctgaggtcacgagttcgagaccagcctggccaacatggcaaaaccccgtctctactaaaaatacaaaaattagtcaggtgtggtggcacatgcctgtagtcccagctactcaagaggcggaggcaggagaatcgcttgaacctggaagacagaggtggcagtgagctgagattgtgccactgcactccagcctgggctagagcaagaatccgtctcaaaaaaaaaaaaaggaactgttttcatacttatgcctgtatcaagcatgcacatagaagagaaatcctcacttaccttgcccattccttcgtccaatatcatcctttttaaacactgcacctccgctgggtacgcatttttcaccccattcatccttcaatttcaattcttcaatctgatcatcggtcagtccttgcatattaggagggagaaatatgccatgttcggctaattcttccatttcttaaaaataagtgaaagacagtatcacaatcataacacctcataccccattggaatgtaagctccaaagagtcaggggtcttgcccatctggctcactattttatggaacaaacatttatatgccacttgctatgtgccagacctggcctgggcctttgacacgggggcatggtactggtcttattcatccttgtcttttttttctttgagacagggtctccctctgtcacccaggcaggagtgcagtggcgcgatctcagctcactgcagcgatctcagctcactgcagcattgcctcccgggttcaagcgattctcacgcctcagcctcccgagtagctgggacaacaggcatgtgtcaccacgttttgtatttttagtagagactgggtttcaccatgttgcccaggctagtctagaactcctaggctcaagtgatccgcccgcctcagcctctcaaagtgtcaggattacccgtgtgagccaccacgcccggccccatccttgtcttctgaaggctgagcactggtgcagaataaatacatgaattttcagttcactaatgtgactcttagcattcagcacatttccaatttataacgttataggaaaagaagatgaattccttttctcctcaaatgctttaacttaaaaataacatttaatattgagtttgtgttggaacctcaattaagaaactacacataagtttcatgaaaagaaccatgaccctcaggaatttctccacggtgcaaaactcacatattcatataatgtaatcaatacatttcataataaatcacatattcatgcaatttaataaatcacataaatgaatatactatttattgcaaatagttacgtttgtatattctatatatacacgatagttatataaacagtaatatcctagaccacatcaggaagtatcatcccgtcaagttcaaaaactatgctgtctaatgcggcagctactcgctccacttggcgatttaaatttatttaaattaaaatgacccagacgcgatggatcacacttgtaatcctagcactttgggaggcggaggcaggcggatcacctgaggtcaggcgttcgagaccagcctggccaacatgatgaaaccccgtgtccactaaagatacaaatattagctgggcgtggtggtgggcgcctgtaatctcagatacttgggaggctgaggcaggagaatagcttgaacccgggaggcgaaggttgcagtgagcagagatcgcgccactgcactccagcctgggcaacagtaagaccctgtctctcacacacacacataccatatatatatatatatatataatttatttatatttatatatacatatatataatttatttatattcatatatactatatatatggtatttatttatatttatatatatttaattaattaaaatgcaaatgtaaaattcggttgcctggccgcactagccacattccaaatgctctacggccacaagtggccggcagctgcccaatggacagcacagatgggggcccttccaccgccggaaagttctgcggcaaagcgggtgccctggaacctgcgcggggtagggagacggcgccgcaacgcaacaggccgtttccagggcggggaaagatcaccaaggcttcctcaactgtaaggggccgtcccaaagccaggtggctcgctgctttacattgggcgactaaaaatagtaaattcagcttttaaaagcccacctagttctcatctcacccctcacacgtgattaattgcactaagtctgctgttcagcccggcctttcggctccctcctccctccccagcccatttccacttattcgcagcaccccaaatcctggctccgagaggcacctgggcccacctcccagcccggggtgtcagacaggccggatcttctccggttccttattcatctccggttaaccctagtgtcccgtttcaaccccggctgctgcaaatctcttcaataatcttcacaaacctgacccctcggcccaccctgcccctctttctccatcccacgccggtctctcgatctgtccgggatgggcccacccgcgagccgcacctgagcagaggcgctgcaccttgagccgcccattatagacccgggccacctgcaccgtgagctcctccagctcggtactcccaggcgcctgcagcaggaactggctctcgtcgccccgcttcacgtgcagcagaaccatggcggtcccgccgaggtactgaggcgttgagaaggccccggctgcgtggcccgcgggtcctgccggccgagggtcgccggatcgccagcagctgcgacgcactaacagccgctcacagtccggaatcccacgctccctagcccgcggtgagcgggggaaacggcactcgctcccggaagtggatgttgccaagagcaacagtgaagcagagttaaagagccgccagctcaagctcagaacccgagtgggggaggctggggtgcaccgaggcccagcaatccaagcccgtacggagctgcggccggggaaaccacccacacagtctgagaggacagctgattctgagcggaccgacggaaggagat

SEQ ID NO: 785 - DNA, 99182 bp, Homo sapiens
catggtaaagacagatatatttatttcatatgacagcacgtttcacaggatatgtacagaatgtctgtgtaccactgactttaatactgtacttctataaagtttatagttataaatattgtatgccacataagcaataaaattcttacatataaacagcaatctaatatagagaacacagagttcacaaagagatccttagtgtctaacttctgctctgcttttaacagaactagtaaatatttaataatacatagaataatggctagttatttgcagcatacctttaactttcataactttgtgcattttcagcaacttgccaagtataattttcctgataaaggctgggctgctgatatgtatattttagacagtagtttatattcaataggaaacattgctcacagatctgcaatttgcactagtgaagtttacctaacaatgaattattttgctaatggagagcaaataccatatacactagtcacatggatgttaaagccacagtttcaacaagttaattcacattttgaagcaactgcttatagtaatactgctgtttaagacgctactgctgaaatgattagaacctccaaaaagcacaatataaaactcacaagagttatttctaacagcaaatcttggctgttaacagagaagattacttctataaatatagtattttgataacatttgagcatttagaaaaatgctttttttctaatagatttgctttataagtgcagtgcagtttgctgtgcttttaacattctacatattcgtagccatgaacgctattttttgatattccctcaatgtacatctttaaaggttaagtgtggacataggaatttaggtggacatatacaactctttatataaaaggaatgttaatgtaagtcttaatgggtaaagatgattgtaactgaaactgacaaagaaacaactattgctcaaggagttttctgattggtttacttaatgatatcaaaatactacattctgtaaaaattctgtgtacttcttcaaaaaattaataaaagcgggatcagttgcatattggcagtgcaggagacaaaatccgcagctactttgaggtatagcctctaaaaacttaaagcagcatcatagatgtgttatgtagcctcgtaagaggggggagaacacacactgggtatattcccaattcaaagcactcaggggacagctgctttccctgctaaaagcaaagttccagagcaaaagcagcaaaaagaaaatatgggagggatatgggcaacgtatactcgaacgtacgcagagaagagagtacggttagctctaatatttctcattgaacttggtggtatgtgccttccctgcatataaggccatagtgcttttttgggagcgctagaatatccatccacttgacagtgaccacaaaataggctgtttccagctgcaagaacctcctcctggagaaaagcgtatgaaggtgctggagtgaaaagtaacaaggttgtgtgtatttgaaggggttgggtgtggaacggtagaaaattctgattctgtggtgagattattctagttttgaaaacaaaattaatgaaaggtccaaattacatttgcagccatctttttggtaatgtgatattgaaaaagggactttgttggaacttttaggtataatttggtctgagttatagcctagaaattaaagtatgaattgtaaaaatatgtaaatgtatacagaagtacatgtgtttgtatgtattatatatgtacacatacctatacttttttcctttaaagcaatgcctttcaaaactctgttcactgtaaccttggcagctctttggtaaatactcaaagataccaattgttaacaagtatgagagggctggtggaaatgtcagctgaaagttgggtgggctttttgagattcttcagaagactgaccgaaaagtttctgaataaggactgttttctaaagtataagtactttttatggctactactgtctcctattcatccaaagagaaatacatcaaaactccagttaacaatgagaagggtttttccttatttccaatatacacatagtccaactctgtacacatcaaatagtggtgttttgtgaagatatcagtgcacttacaatgacttattgcacataatgaaatactaatgcccaattctcttagctctatcctgccaaaagcaagtacccactgttttctattgcatggcgttatctttctgtaaagtccagtgtgggtgaagccttagaggccaaggtcgtgaaaggatctactggagggctggtgccgggcgggagcagagggacaggaggtggaggaggtcttcttgacggcaacacacagaaggagacatttgtacctttattccagtcatcattcaatgtcaggttggagccagaaaatgaacttggctgattacccagtaagtctgaacaagctgactttgacttccctttcacaccaaaatcctcttcttcctcgaaggttacccatcctttcgggttgctaatttttaatgtagactggccctgtagatcaaaactgtccttaaagccatcaagtgaagatgaagccctgcttttgttatgaccaagaggctgcagagaagggaaaggactgatagtaacgggctcttctttggagaaccatgaagttgcctctgattcttcagacttggctctaaatgggtttccaggagcagcagtcctgtcactgaaaggatttgtcctggtcaagccagtaataaatgggtttggagaacttcgcatattttcctgggattgactccgagctggaattggaggcattgttggcatgcaacttacagaactcaaaacattactttgcgttgcagaaggcaactgaatcaacctctttgggtctggggtgggaacaggtgacgtttgaacagatagctgagcctttgatacagcaagcagattaaatgacagatcttcaaatgggtcaatctttaatggtgattctcttttgccatcagagattccatttgtttttacctgcaaaagaaagggagcactgaaaaatcagtttatatttactcttaataccccctattcttcctgtctcaattattcttcccttttaggggcaagcatgtaaatttagaaactaaaaagtagctttgtgtagtttgttactccggtggtttaaataacatgaaacacctacagtctttaaaaacttctttctaaataaatcctttctaattaaatccatttttaaatccctcaaaatcaaagagcttatttcattcatgcaagttttgaaatggtaagaaggagaattgtacagaattaacaaatttgttcatgcccagttctatcacatttcagcatgaacttaagaaatccatacttataacttatgctaaatctatataaataaaattctaacacccatctatgatgatgatgtggtttcattgttcttttaagtgtgttttctaaaattaatgttactatggaaattcaattttatagataaaattaattctattagcatattttattcctaagacgaagactccatctttctgtcttctacttggaaaaataaattttgagagttctttgcccaccccctcttttttttttttttggagaccaagtcttgtgctgtcacccaggctggagtgcaatggcacgattttggctcactgcaacctccacctcccgggttcaagtgattcttgtgcctcagcctcttgagtagctgggactacaggcgtgtgccaccaggtctagctaattttttgtattttagtacagatggggtttcactatgttgcccaggctggtcacaaactcctgagtgcaggcaatctgcccaccttagcctcccaaagtgtcaggattacaggcgtgagccaccatgcccggcacagctgacttttaatgtaagctctcctttgttgaataaactgagtaatgtgaggctgggcgcggtggctcaagcctataatccctgcactttgtaaggctgaggcaggtggatcacctgaggtcaggagttccagaccagcctggccaacataatgaaacctgtctctactaaaaatacaaaaaattagctgggcatggtggtgcgcgcctataatcccagctactcaggaggctgaggaaggagaattgcttgaacctgggaggcagaggttgcagtgagctgagatcgcaccaccgcactccagcttgggcaagagcaaaactccgcctcaaaaaacaaaaaacaaaaactgagtaatgtgacaactttccataaaaaaattgaccctcctgtcttgtaaaaatattccaaaacagatacactattagtaaccaaatgcaaccattgcttaaaaccagaggaaaaaaagttccattttctatttggtttatgaagtctacaaccacaatgatgtgcctagagtggtgcctggtcccttctatgtgacagagttggctgtgaactgttatcagtaggaagagtgcttggaattccttcactcctgccctaaatcccttggtccctactccataaagaaggtggttggagtggagcacagccaagggactgagcaaagacaaatgatcggatgaaggaaaagaactatgattcttgcctcataagcaaattagcttatcaggcatacattattaattttgaaaaaaatgtatataattcttaaaactagggtagatgacttggacacttatgctaacttaagaaaacttcagggttggatacgatagggcaaaaaaaaattcagttcaagactggcaatgtaataaaatgagcactgcccaaaaggaatttggatagttgttaaagcaacataactatactttcatgaaatatattggaaaaaaacagcagcagtctcaataaaatgtaactgcatactatgaaacacttagttactgcttaagaatatggaaggatgttcacttgtaaaaggaaatggatgacttaagtgaataactttcaagtatctgttttattcaactatcctagaatatgctttataattggttgaaacagtatatttttcttcaaacttagtgtgataaatttgtacaaaactaaagagaaaacatgtcacagactttaaactgtactctaaatgtcttaggtaagtagacctatatgtggaaatgtacttaaaaggaaatttatatagatattataaaattaactctatattaccaaaaatctctggactatttatagttaatacaaaatgaaatacttctgtctgagacaaaattctcctatggcagatagaatcgtctgcaacacagacattataggaaaggagaattttgtgctctgccagcttagaacagaagtcacctgctgcatcagtgctatacatttaaacacctttatttgcatatataagaaaatttttatttcaaaataagttaatttgatagaatcaggatcatttttcccagacttgaaattacaatgacaaccacatcaccattcatcacattagaattaatttgtaatctaagcaggatttgtgatgacaatattaaaattggtgctatttttacagagaaaggtgttggaaggacctttagataatcttgttatactggtaactttcatctttctaaaccatcaattcttccttaccaataacaatcttgctactaaaaccatttgaaaaaatatttcccccaaatattttttcctaaaaaacatactgaattttgtgtttatgtaattacataaatgccattgttaaaaccaagaaccgatctggttttgccaaaaaggccttcatatacctaaatcttactttcttgaagttacactttttagttttgttaattttcataaaaaaatgaagcaaaaagtggtaaagcattagcaagaacaactacatggttcctaaaatccaaaatactaagaaaaagaaaaagcaggttttatggtatgatagaatttattaatggagacaggtggttttaaaaatgggtgaaactttagatgtatgaagcagagattcatacatctaatgtgttgagacggatgaaaacacatgtaagattgataaattgtcagatacctgttaccctgatggttgctcctgctttgagaaaggaaacagacatcaaaggaaagagttaggaggacaatccgagatcaaccagcaaccctaacaattcagtcaacaaaatgctttctaagttacagacagaacccaagagcagcaatatttgcaggttgtaacataaattcaaaagacaattccaattccttttataattttgttgaattagggtccagactttagttttgtctgaggttgattactaaccagttcagttttgttattccaaaaataatactccaaatgatttcagagttctaaaatattttaagcaacctgttatggactgaatatttgtgtgctctcccctcccaaattcatatgttgattccataagcccctgtgtgatggtatttggaggtggggccactaggaggtaattagagttagatgaggtcatgaaggtgggaccccatgatggaatcagtgtccttatgagaagagacaccagagagcgtgtgcaagggtgtgtgcatgctctcattccaggcaccacatgcaatgaggctgtgtgaacacacagtgagaaggtggctgtcagcacaccacaaagagtgccctcaccagaactcaaccatgctggcaccctgatctcagacttccagcctccaaaactgtgagaaaataaatttctgttgtgtaagccacccagtctatggtatttcatatgtcaacccaagcagactaagacacagccttaggatagcctagggatgtcattattagagaaaatggcaatgtaatggtacaaaatggtaccatttttggtacatactattttgcaaaaagactaccctactgaaaattagtactcatccagcttgttttatcttactcaaattttctgaaggatgatactcttaatatcattaatttacttcataatgtattagttggaaggtacaagaaacttgtaccttacaagaaatttggaatttacctttgtttaaaaatgaaatcataatccctctataatataccattattttttaaaatctagtatcctcaagcaagttttgaggtaaatcttctccaatatctaaacctattactaaatagcaaaactaattttgacaattcagagacatcacccagaaatatattaagtactttagaatttcctgcctagtaaacatgagactcttatttaacactcagagttttatgtatcagctctggcagtggacaggagatcaggaataggtttatactgagaggtacaaggttgctgtatcctccattaaatgggtctagaatgctgtgatttttctaccaggtctcacagtaacagtatagcagtgagttcggttcctttacttccagttgcatttccttatttctggctctcagctgataaagatgactaagatgctagaagtcagatagataagtgaggattttttatactttgtaaaggacgtataacatgttatataatcactcgaattaaatgaatctcttctatacaaaattataaagtcaaaggataaataataaaaagtaaaactgggtcatatacattatgttttaaataccttgtagatttggaataggataagtaaagacttgtaaaaattacaaatgttcaattctaaaactatttcatgtcattacaaaatatcaaacttgtcatatttaaaaatctcaccatcaggtttgaaaatcttgtaaattgttcaacttaacagctacttccaataatttaaaattttttttattatttttaaaataggcattattttacggttcaaaattcaaaaggtacaaaaagatagaaagactcctcctcacctgcctcctggcccccagcattgggcattccctggaggaaactgtaaccactttgtgatccctcacaatgacactctgcatgtaaacaagaccccaccctccaagaaagaaaagtgtgtctgtgtatctaatattaaggagtttgatatcaatgactgaggcaaaaagatacttcaggatttgaaacaaatatctttgtctttttgatgaactgacaaccatgagattcaagaacacaatctaagggggcacacacaaagcatgtgcccgtcggccaccaaatcgctatactcacttcaatgaaaaacataaaacaatggaaagttttctgagaaaatgatatgtgtcttagaatgattttataatgataactacaatctcagctaacagtttgcacctccggaagtttttcagagtactttatctacttttgtattggtctaaggacacttaaaccatcagagttttagtaattatggcacgcaactacaatgagatggatgccctaaaacagtcctagaaagctcagagtggctagttgaaaaagttttttgcccttcaattacattttaaaaactacaaaagagtatacaagaaaataagaaaaattcacgattcactaaaaatggattagcagaaaaaaaaaatcattatttgaaagagttctaccattattatatattttcaccatcctcaatttttcttttttcttttttttttttttttttttgagatggagtctcgctctgtcacccaggctggagtgcagtggtgcgatctcagctcactgcaacctccacctcgcaggttcaaccaattctcctgtctcagcctcctgagtagctgggactacaggcgcacaccaccatgcctgggtaatttttgtatttttacaaaacaaaagagacagggtttcaccatattggtcaggctggtcttgaattcctgacctcaggcgatcgacccgccatggcctcccaaagtgctgggattacaggcatgagccaccgctcccagacttcatcctcaattttctaaactaaaaaaatatagaattctttttggtattaaccagcttaagggaacatttatttttctgtattatatatccttcaacttttacaaatgtgacttaataaatgctaactgctaactttattcatattgtattgaatcatatttactttaatatctgttttcaccctgtagacacttaagaaactgctcacttctgccaactagctggacatacctatatatctgtaaaaataaatgtaaactattacttataaatgtgttaaagggacattgccaatacgtattatttctgtatttcagatctttccaaagtgtaaaagaagactttttatttatttattattatttttggaggtacagggtctcactgtgtcaccaggctggaatgcagtggagcgatcatggctcactgcagccttgatgtcctgggctcaagtaatcctcccacctcagactcccaagtagccaggaccacaggtgcatggcacaacacctggatagttctttaatttgtagagacaaggtttctctatgttgcccaggctggtcttgaacttgcaggctcaagggatctgcccacctcagccttccaaagtgttagggttcactcatctcacagttttttcaaaagagtttaatgagatacttttaaggaaagatcactttgaaaattcagagtaggctgggcatggtggctcacgcctgtaatcccagcactttgggagactgaggtgggcagattgcctgaggtcaggagttcaagaccagcctggctaacatggtgaaaccctgtctctaccaaaaatataaaaattagccgggcatggtggcaggcacctgtaatcccagctactcaggaggctgaggcaggagaatcgcttgaacccgggaggcggaggttgcagtgagcggagatcatgccacttcactccagcctgggagacagagcaagacttcgtcttaaaaaggaaaaaacaaacacacaaacaacaacaaaaaacccaaacatatatatatatatacacatatatatgtataataacaaatataaaaagaaaattaaaactcgtatttatttttacttcttataacaggcaataattaaaataggtatgttcaaagactaaatcatatgcatcaaagataatattttgtgtaacaaatgagacttacttgcggttgtgaggaagcttctgaaggcaagctatgggatgacctgcttcgaggtggtggttgtggtggggtttccaaatttggctgggggccagactgaggcataggtgctgccacagggacaagaggctcttgcaacctttgagcaggcgggggcaaagaagactgcggaggaaaagcagcctgaggcttcagtggttcaggaaggaaagttgaacctaaaaaaccagtggttgtcagatgttaggtatattctagaaaaccatgtttttttccttctttagtgaaatgttaggagaacattctagttatttcttcccccaataagtagcctcatttcttgtggtataatgaaggaaggatatagctatctgaatatatgttgtagaaggtgggagatgacagaaggaaaaagagaaaaatatacaacaaaaccagtacagtatttctaatatagtatctacctttcttttctctcaatttttaaaaatttttgatttttgagacagggtcttgttcttttgcccaggctggagtgcagtggtgtgatcacggcttaccacagtctcaacctcccaggctcaagtgatcctcccaccttagccgcccgagtagctgggaccacaggcatgtgccatcacccctggctaattttaagagtttttaatttttttacaggcgggtctcactatgttgcccaagctggtctcaaatttctgggctcaagtgatcctcctgcctcagcctcccaaagaggacctacctttcgacgtttctgatgttttgctttggctttcaggagtcagtcttccagcagatgcccgcgcgtggctctgtggggcactgataactccagcacgaggaggaatcgtctacagataggaaacataacacttgagacatttacttaccttccacaggtaaaattctgtgaaaacatttgcttttgcatctcatttactttcttctatggtattagtccctaatttgtcattttaagtgctctctacttgaagccattataatgatgaattttaaaatcttcctgtttacttctgactatttactatgtgccagacattatgttaattaagtactgtacaggcatttccatttcatcttcaaaatatccctcagaagtaggtattattttatcatctctattttaaattaagatgaagaaatatatacaacttgcccaaagccacacagaaagcagagccaggatccaaactcaggtctgactggctgcagggctagggttcttaaccatgtgcaatgctgtctttatggggaaaactgggatgattttaaaatatacaaggagatagagagatacatacctgagcaactaggagactttggggaaaaaacaccctgagatttgttttttttttggtttttttttgagatggagtctcactctgtggccagacgggagtgcagtggcacaatctctgctcactgcaacctctgcctcctgggttctggcactttcctgcctcagccttccgagtagctgggactacaggcgcccgccaccacacgcggctaattttttgtatttttagtacagatggggtttcaccatgttggccaggatggtctcgatctcctgacatcatgatccacccgcctcggcctcccaaagtgctgggaccacaggcgtgagccaccgtacctggtcaagatttgttttttaagagatggggtcttgctatgttgctccagctagacttgaactcctgggttcaagcgatctttccaatgtagtcccctgcgtagctgggactacaggtgcatgccactgccacccagccatatatattgcttttaaacacagaagtacaacttttgaatgactaactcaatattccgaattaaatacactgaaagactcatcagtgaaaaatattttttctattttcatatgtttgctgaaggatctaagctaacaatatttattttaagcaaaatatgaacttttaaactcacaaaaatcctgactttcttttcctatacttatggtattcaacagaatcaagaaagttcttgtgccaagtgtggtcatgggatcagtgaatggcaaatttccctttttttgaaaaaaggaggataaatatttgaagagtaatattacatataaaaaagaaccttcagattgttaagtggacagctacaacagaaaagacaaaaagcttctatcttcataggaagtggtttcctcagttctcacaatcttaataatcttaatttctaggtacagtaatagctctcagtttcctactcttcagatatgggcctctcagtagtcccagctcctactggactagcctaagtcactgattactggtttctatttgctctttctctctgttcttgattacctgttatagtccagagaaagttttcaaataataaaaaacctatgtgtataagagaacatataaacatacagaaaagacacattcatcaggtagggaaaaatcctgtaacaacatctactctcctatttctaatacctttacggaatatgatgaacctgatcaagaaaaaaaccaaaaagagaaaaaaacctttagaaccagttttactatactgaatttatcatttttttttctgaaatgtaattaaaatcctttttaatgaaggattactttatatcttcattaattactcaggtaaaatgataaaaagctgcccaaatccatcatttcctcatatactgagactcttaagatatttatttagtgaccataattgttttaagtgtatcacttttatccaaataatgaagtttgttatttttgaagagtatgttaaaataatgttagagtcggaagatcatcaagtgcaattccctcattttagagatgaggaaattgaggccttgaagggtcacatgatttctccaaggtaacaaaactgactagtagtaaacaggacttagaaccgagaccccttggccccaggcgaggttttacctaccggtctggctgtactgtatccagcaggtcctgggcctgcaagtcctgcttgaggtgaaggctgactgcgtcctggaacaaagacatcatatcatatatttaagtttaaaaaaataaacaagaaaccatgtacttatattccaagtgtctatttcacggtccagttttaagggtgaatagctacattcaagtgtttttacctatattatctttccttgttgttccagggcttttgggtgctttgaagcaagaagggaaaaaaaaattagttgtaagttaacaattaagcaatattgcataacatcagcttgctgttctgcttcattaccagcagaaatgggggcatgagatggtaacaaaacaaagcactttgctttgtataatgatgaagggtattatcagtcctgaatgaaatactccaaaagagagaaaaattacaatatttagatagacctttatgggagacaagtggtgactttagtttgatatctcactcatgggaccacttttagggtggcattccccatagaactctctcgtgaaccttgaaaacatacagtcagctgtgtgaatggtcacaagatgcggcactgctgccccttagagtctggcagacaagtggcttctgagcaacagacaggactgcatttgtcaaattacacaagaggctcctagtagcaatactttagggcttcacgctgtagatgtcactgtggataaggttatcttatgatgagatctttcggatttctataacaaaatcccatcattaagacagaagacaggcatatgttattaccaaatatctgccttatggaagacagtgttaaaaatatgttcaaactcattagaaaggtagctgaaggataaaatgaaataaattactcttggagccaaaaggagtaggagtgactatcaagggcagcatcttaaataaactctcctttttgtaaagaaattcaagtacaattgttataagaaatacatcagccttttaataactaaaatcataacaaatggcctctagtcttaaaggtcttttaaacaaatctggctcagtgctaatctataaaatagctatgttatctgaaatcaactacaaaatactatattcttggatctgaattaatagggtttaattataatcattaatttttaaaacttcagattagtaaagtacatttctaaatattttacttattctgaaaagaattttgaagacattcttaaacagtaatttcacaacctgggcatatataaactatatatgaaacagagtacaaacaacattaaggatctcagggaaattaaatggatatccattagaaactataggtgacatagaatgaagagaggaaaaaatacaaggtatacataaggaggggaaagagaagtttacagctggaccaagaaaagatttagtatgcctgcaaacactgcggggtggggaggtggggcgctgacactgagaaataaaatgagagaaccacttctataatgcaagagtcttgttaccttccatctctctcctagctaccccaggactgggaggggctccaatacctttttagagaaagaacagaaactatatattgttcagggcccacagcacagaatgaaaggcaggcacacaagacaatttccatagtaaactcacttttgcaaaaaggctcttttattgctttaaatttcttcaaagatatcaatacaaaccaaagtgactttagatgcttggcccaaatctgaatcctccctttactcaaacagaagagtagaaacaggatgacagttttctttttatgtatgcaattactaccagtagggaatttaaaaaatatgtttaatgaagacctttgctttaaaaatcatcttactccttatatccagagcaagtaaaaactctgatatttgatagtcaaaaggaaagaaatcataaatttctatgagactacgtaagtcttttgaagttagtttttgatgcattaattttaaaaactctaatgtactataatgacgtaaaggaattattgtttataggatgaaaaaacatgttgcaaacactacttacaaaagaattatgaaggggagcaatttttaaaattaagacagatttcactgtaatccactggcttgcctaacttttgacagattcattttaaatttattttctacaggatgttttcctaattaaagcagaagataagcaaaaattatcatggaaatttaaataaaagcaggagcttgaaaagggaaaaattaaatgttttctataaaagcaggagcttgaaaagggaaaaattaaatgttttctgtaggtcaatggagaaatgatcacttagctgtattcggcagaagctgtaatgctgaaataatttagctattcttatcacacgcagtcattaagatctacacacaggcaaagtcagtctgtagtaagacctgaattgctcagccatgtcactaggcaagctacaatagaaacagaccaggctacacatgcacagtgagccttagtaacactggatttgtaaaagttcttctgaggaattgtgaaaactcatctcatcttttcttgagatttagattaaataaacttgtcaaatgtataactccaactgagctctgtgagttttcatgtaaaccaaataaactatacttcaaacaaaaagtgaccctttgtgaataaaaatttccttatgaagaaaggaaaagaaaatcatacagttctttgctaatccaaaagcttttccactagaaaataaatgtatcactaatcagatacttgggaaatgttctgtatttactgtacctgaatgacttttaaaattaatataacttttgggtattaaatctttgtaaatgaatcgaccacatttattaaaaaaaaaattaggcctgatgaacaatcccagcctacctgggaaatgaaagcctttattagttttatttgtggattagttttaaactagaatgtcattcattttgacttttatcaaacaaatctaaaatgtctttcaggtgtaaaacattaatgaaccacgattcacacatgctaacaaatgtaaatggttacctccaaattcctttctagtgggtgcaggactcctagccccttatagttcataagaaaataggcagcagaaaggaaatgacattaaatacagaagtgaaatgtcaaagattgctatagtatccatgacatcaagtatcatgcaggaattacatattatctacgtactacaaaaactattattcaatgcatatgcttataattgaagtaacagcactatatttaatttaaaagaacattaaacaaatacatacaattgtacattaatacgtatgctctccagttttattatacttttacagaaattagtacattttaattattttatgcttataaatcatccagaaatgaggattttgaaaaaaattaaacctaattttacctaagaacagtttacatgcctaactagatcaaattagcaaaaacaaaataaacctctctggctggctggtgagaaggcagctaaaggcagctgtgaaaacaccttagaggaatctactctgcaaacactctaccttgtctgttgcgcctaccatgttctttagagaaaagctaagaaatagcaataatgatagaaaaaactgtaaaatccagaagctagagattggaaaacatgcaaaacattttaaaatagagtgaagaattttacatctagcagaaatggaaataaaaggttgtcacctgaaggcggaggaggtctctgtgggggagccgggcgtgtgggaggggcgaccgggcggggcggcggcggccgcttgggctccaagggctgggcggggtctttctgcggcagcggcgttgctggctgcgcgtcaataggagaacctaaaaagcgcacaggaggtaagaagatcagcttctaagtagctgttgacagaagggaacagtccttcatatatatgtgtaatgttctataaaatgtgcacaatggtgtaaagaaagggcatgtattttcagtatgaataacaaaagcagtctactattaaactgccctttggtaccatggcagcaataatgctacctctgtgctgacttcttacctaggcctcaggtgctgaaagctaatttactaagtggccctattgatatgcacaaagtattgtttgagttaagccattttgtagtctggccagtagagagaagaaaaagctcaaatagttaacgggttcataccatagaaaatcatcagttataagacatagacaaacctaaccacatagaaaaaagattaagaacaattgtcatctagtgacagttatagcaagtttcctttccattgagagcttatcatctacaagttttcctattctgtaccggagaaaacagggtgcactttatcacctaggtatgaaacttaaacgatgactctccaacatcaagcacattggccacaggaagccatacaaaactttcaaataaaatgcatactctgtgcactgggaggcccaggagttcttgacggtgctcggcttggtctgatgggaagggaaggtacaggaccctctgatattgtaggtgactggcagggactagttcggggtgaagagctgggggaagtaccaaggccggaacttgaagatggctggagatgctgaggaagaagttcctccacttcagcactatagtcatcaacatcacctaaggaaaagcaggcttgatcagagataactccattttaacttgctcagagatttttttcaccttaggttttaaaaagttaaaatacacaaaacaaatatgaacattatgtcattgcaaacacacatggattaagcatgaaggcatgtataaaaccacaattagtagaaatgcttgtttcagaagatgtaaaggtatctattgtctctgagcaataagatgtcaggtgaccaaccacttggagctggggtgacccaatgggctttcaatatgccccagagcagcttctccagtgcaagccaactcaagtttcctgctctccttccaaacctgtccactgtgctctgtggaactgccccactcccttgcctaacccaggtccagcctcagagtcaacaagctctcaggagccacacagtcttcccccagaaggctcctccctgcaaccctcaccccacaaagacccgctttgctttaattaagtaaacactggttctcccccagggtctcctcatctccacttacttctgggtaggaaagtgggcacaaggtaacccttgcaacctaactgccattccagaacattagtcttccaaccctgaacaaaaagtcctactgctctgaggctatgccatcaggaatttatgtaacatcctctacccccacttgctacagtcatctccaacgtccattcttccatttcctgaacccactcactgaggactaagcagagagcaagactgtaagtcaggtcccgcaccatctttctgcgtggcatcaaagtccatgtggacaactcgttcaatagcaaaatgccttggtcctatccttatggacattcgccttcactcctaaccctcacccctcagaactgcactcttctgaaataataaactcaaaagcttcactctgactttggcctcccagcttttcagttctctcccttggctactccttctcttttgatttcttcagaagccagggtttgatccctctaacttttacctccatctgattctgctttcttctgtacctaccttcagattctatggttcttcatctcaaacattaccctacttcactcttcttccattgcacgtgcttgacataaccccatccctgcactgattcccctgtttaatctttctgtgataacacttggattgctgactgcctctgctaaagaaaaccacccagtcctgacaactgcagtcacatttgaaattatgcttttcagtctcttctggcctaaagtgcctggcaattccatgatttgctggtttgctcttcccctcaccctttgctcttcaggagctttactgcaaaactccttaaccctcctgaaactgtgagctgtcccactcctgcagatcacttcaacacttcacagagaagagggaagtcttaagatgggaacccctacttcaacagcctgcccccaagctggagtctcattacatggttgtcacttgggtatctgaggatggaacaaatgggccccacccagcctaattttctcagtgacactgctctactattctgccttgcccttcccccaaaccatcagccctttctcctctacttttccattagcactgtgcattctcaagcctgtcccatccaaaaccaccaccctaggacctccaatcttcctagagcaattgccctcttctctttccccccaaactttcttaaagagttgtctacagacacttttctccacttcttcaccttccatccatatcaatttaccactatctgacttcatcacttctgagatcactctcatgaaatgtcaacaacagcttcccttcctgttattaaatcagaaggacacatttctgtcctcatttcttctcatctttctgtgttacaagacaccactgactactccccttccatgctccactttctttccttgatttttaagccatgaatttctcttggctctttgacatttctagaaacaattgccattgtttcttctcattttcttttcacgggcagccttcttctgtctatatttaaactctgtgtttccacatactcaatcccaggtctgtatttctccatattcgattcattctcttctgtctcgtcataatcctattggccaaagttatattaacaaatgcccatgctttgcaggctattagagctgccttgactccagagctctttcctgagcaccagactcatgtttgactgactccatgaacatctcaaattcaacatatccgaaacaaaattcatcttccatcccacacctacttctctctctgcatttcttttcttcatttactccctcacaaacatccctccataatccatttggatcctctttatccccacttagactgtgcacatgctttcttcttggatcactcctctatagcattaattccattctccctgagtctttggattctcaacttaaatttcaattcctctgggaaagcttgcccaatttcccaaatccaggttaagcaactttcccatgagctaccacaaaaccattcattatcacatttatgtcactttattataattgcctgcttacttacacgtaacacccaataagctatgagttctggaaaggcaagaaccacagctgtcgaatctccagcacccagctgtatctggcataaaggtactacataaatatgtgtggactgagtaaacaaatgaacagataatgtgaaaatgagataaccttgtaagacgttcaactcttaaatgtggtacctagctatacagggcattacaatattattataatctaaggtatgcattttaatgaaaaactggctagaatagcatattgtgttagaaaacaaatgcatttaaaaattttttcttttgataatgttgccatcaaacaaatgcatttttaaatcatgtttaaggaaattttcggcgtaattacttaaattcatttctgttcttagaatacccttttggaacttctacttttttacctcaactttaattattgggactaaaccatacaccaacaatactaatttgggtatttatccaataagaatataaattaacatttgtaaaggtcttaatatttgaatggaagaatggtaaatacatttaaagtatacgcaaaataaacacaatatgatgtgaaataaatttgttttgttttgttttgttttgagacagcctcgctctgttgcccaggctggagtgcagtggcacaatctcggctcactgcaacctctgcctcctgggttcatgcgattctcctgcctcagcctcctgagtagctgggattacaggcatgcaccaccacgcccagctaaattttgtacttttagtagagacagggtttcgccatgttggacaggctggtcttgaactcctggcctcaggcaatccaccctcctcagcctcccaaagtgctgtgattgcaggcatgagctgccgcacctggccaaaatacattctaattaatagtgctatgtacgtcccaagaagaagaagaaagatgaacttggaaaataagactttacagattggaagaaaacatatctagaactacaagaagtaaatgtgtttaagaaacaaaccttccatatcaaaatctgctgcaacctctgcatcttcaccaagcagggtagagcttgttgatgatggcaatgcaatgctaattttctctaaactcatttcttcttccaaatttttgatccagtctggactttttaaagcaatagttatagtccgattcaataactagcggagtaaaagagatataaaataaagattaacatgaaagctaactaatttggaataaagaggctgacttcgttaaactatgcaatggtatagacagttaatttagttagacaattcagctaactaaagaaatagttctttcacatatactaaatttcaaactagtttaaaggttgttcccagttctccctttaaacacctgtggtgataaataaagatcttttctaggatgcccagagatgcaagtttcctttgctacaaccactatgttttcctggccagatgtaaattcaccaacaactctgctacataactttatactttcttaattttgattcacagattaagtaattgttcccacgtgaaacaactacaaaagagacagcagaaaatctttaaaatgcatttcctgttcctgttcatttggtctttcctaacttggcatatggtcctaagagctgctatattgtcagctgctaagtgctaacctatacagttttagcatttcaaatgtcagaagaatattaagagaactgaacaccattttaaatcttcaacaaaaattaatcattctaaaaacagaatgacttctacctgtgaaactggcactctgccttctctataaatttgggtgacttttagactaaagtataatctaagacaaccaagacattataatcaaattatagcagatcgtgtcaatgtatttaaaaaatactctcaaaaaaacttgctgataacagcaagactctttggtcaaggacaaaatgtgcactagaaaggagttctcatttaaaacccatattcttataacaaacttgctttctaaatttaatctctctcccacatagtttcaatttcctttgtttgaagagtttcttaatgtgaacaagatgtgaatatttttggtatttgcaaatgaactgtgtagctgtgatcaatatgctgtgctgacagttggcacctttgtgggtacagatcttccttggctcaaagtgttactgatattagaattccttgaaggcataataatggagaggttgaaagttgctgaactgagtggcacagctgtgtttattagtaatttagcatccacactgagctttaaagtcagaatcctaagaattcataatcctttacttgccaagtagatatgagtactaaaatcaatccaatttcagaacttaacacgctttacaagtcatatattacttttcaaagtcaacaaaattcttttatattcatcaaaaaatactaacaagcattcttaaatacctatcaccataatggccaattaagatgtaattccttaggactatccccttggtagagaccagggccaaatgaaaaggaagaaatttagaagaccaaaaaaatattcaaaaagatacatagaggttcactggaatattggctttaataattaagaataggaaataatctagatgtctataggagtttggtttaataaatgtatatatttattcacaaaatgaaattaatgaagccattaaaaatgacatatttgtttaagatgtccctgacacagtcataagaggtagtaagaaaatagctttataacacggtttcaatttgtgtttgcgtatatgcatatcccatttgtgttaatgtgtttgtgtgtatataaaatcccatttgtatttacatatgtatatgctaatattaaggttaagagaaattacttcagaatggtagcattatgtgagtggtcttatttttaattcttttccatgtttcctgatacatgattttacatgagtatactagtattacatttaggaaaacaaacaaaactctacaaaacctatttcaaaagcaatacacacaaagaattttttttttttttttgagacagagtctcgctctgttgcccaggctggagtgcactggtgcaatctcggctcgctgcaacctctgccacccaggttcaagtgattctgctgcctcagtctcccaagcagctgggattacaggcgcccaccaccacgcctggctacttcttgtatttttagtagagacaggtttttgccatgttggccaggctggtctcaaactcctgacctcaggtgatccacctgtctcggcctcccaaagtgctgggattacaggcgtgagccaccgcacccagcctaatacatacaaagaattttttttctccaaagaagttgatgtgacagaagaagcagctcaggacagtgctcacagagttgctcagtgctgcaggaatcaggcctagagtacaatccatcttgtgcactgactatatacttagaaatttaggatttgggtctaaaggagttcagaaaaaaatgacagatgaagcacttcagagaagtaaaactattccaggccaacaatgtaagtttccgtcatcaatgacttttcaaatcacaggttaggaatatctccatttgttaaaaatttctaaaatacttcaatgggatggatctgttatctctggaaattaatttagttatgtttgaagaagataactaggtaagccaagccaatgaaacaaattcctaggaataatgagcacctctctcccttgttttctggtacataatgcattttcttcacttgatagaatgtttttctactatacagataagccagactacccccaattaaaactttaaaactttttgcatcataaaatgtaataaatcaaattaggtgctaaacatgtttccttcttagtctatatcaacagttaatatctctggggaggggccaaaataagcctaggctagtcagaaatccagtctaaataaaaaacattaaataactcctcgaacataccataaggtcttttcccctcccatttagataatcttgctgcatgtctataaaaatatcataccatcttcagacatttaatttcagaatggtttagaatcaacaaatgctaccttacctctttaccatttaggctcagaacattcaaggcagagcttccctccaaaaatgtaacccacattttatcttctacaaatctttaagaaaaacaataaaaaaccataattaataccatagacataacaagctcagtgactactcccatgattattgatcattaacaagggccacaagaggccaggaagtaaaaagtaaaggagggagcgcaggtagggctggtggtgacctggagagggcactcttcccctaaaaacactctaactccaatttcaaatactatgttaatggaacagccacaagaaatgagtctgtgcacctccatttgtgatcactgctaatccagtcccatccaatcctccatttcattgacaaggcaaaaagggacagaggttaagtgacttgttcaaagtgactctataaggagaatatgttacagggctgggatccaagtctccggaccccacaacccagtactatgtattttcactgtctcagtgacttccctgaagaaaatttcctatgatcaaaaaagatgagagttgccagtgaaagaaaacaaaaccagactggccccaagaagccttagataagttatgctccttgtctttcatcattgacaaacatttactcttttgggacttcaatggtctttgataggattccaagtttttacttttgaaataaaaaaactatcaagaggaaaaaaaaaataaaaaggacagaagaagttctgaagagggtcgcaggtatgtaatgaagttattattcaaaaaagaacaaattatgatgttatcagtcttattacagaaaatttggcgagttaaaccacaagttcagaaatctttacagatttttccacaatgagaggaaaacatgtacacacaaacacacacacacacacagagtatcactctccccctaaccccctacttaaactaggattccaaagtatgaattatgaatattaagaggaaaaggccaaaacaaaagtgtgcataagtacttcaccctggtaaaatcaagggcctggagggaaccgatttctacaatcccacagatatgaccaaggcaactgactcaatttctttggcataaaactaaattgcaggatgctatcctttgaaatacacagggagaccattcttacctaactacacgaaggtatctttttcagattgttggcaatggagactatccctcctccaaaggttataatcaccactgtaagcatacatttatgctgcaccagtcccctaagaccccaaacattatttgttctttgataggtaccaacacttttgtggtcctgggttagggctaatatctttgtccttattctcaatcagcaatgtgccccttacacatttctaactttaacaagggattctggttcttatatctattgatttatgtaagttcttttggaagctatattttcttcctgctttcactcactacagtaaaagcttctagactcttccttcaattaatgtaagcatctatatgtatttaaatttatcccatacacatttccagggaacctcttatttaaaaataaaggggttcacagggtttactcactccttaatggctgtcttaatctagactaaaaggtaataatcagtttcttctcactacttatagagatcctctccttgttgactttcagtgtttgctttttctcttccaacttagtcatcttggggtttaacaaccaatattccaggttggagacaccccatggttttataatgttaggttaatgccttagtttcttaccaatacttttcctaatgatgacaaacatttgtgggaaaccttctggcttcaatttaacaagttctttagaggttgggttataaagacaggtccctttcctgtatcagagtctttcatcccttatacagtttggattctttgtagctcagtgcagtattttacatttgctcaggaagacatttatctgctactctgctgcccactcacacagtctacatgatgcttctggtggtttggcatttctgtacttggcaaagtatactgtcatctgtacacttgcagatttcactgtgtactttcaagaaccttaagatttttgaaatgttttgttttgtttaatttgaaagctttgggatagacctttgtcaaaagatttgaggaaagtctaaacacaatttcttctccatttgttcatttactctctgaaaggacttgaggtgtctttgattttcactctgtagaagccataccatcttaattctgtggactacgccctttaggatctgggggtgtcattacacacatgctgactttccctactagattacaagcaggagttgtatcttccatttctcctctgctcttctacagcaactagtatagagatctgcccaccaaatatctatcaaacatacctaactaagcaaatgaatggtatttaaagggatttaatggtacctctttccctatgaaatccaaacacatgcacacatgcacatcattcagtctctcaaaactgctgtatagttggaagagaacatttttaaaacaaggaaacaggcatctggttctgcaaaaggcagatggctagatcaatgagggaaaccaagactagaaggaatgactcttgactagtcatcacatctctgttagaaattaaacatacttaaaattactcaaatttctttaactgaggcagggagggagtcattcttatctctccttaaaaaaaaatagcaatcacagcttcattttgttatagggttttgttacatgttctattgtataggaatcgtgagagttcatatctgaacttgcacctatttttgttttcaattgttcacataaagtttcactgtttagctgggtatggtggctcacgcctgtaatcccagcactttgtggggctgagctgggcagatcgcttaaggccaggggtttgagaccagcctgggcaacatggtgaaaccctgcctctacaaaaacaaaacaaaacaaaacaaaacttagccaggtgtggtggtgtgcacttgcagacccagctatttgggaggctgaggtgggagaattgcttgagcctgggtggttggggctgcagtgagacatgaacacatgactgcattccagcctgggtgactgggtgagaccctgtcttaaaaaaaaagtttcactattcatttaaactttctaagttgagaattcagttataaaaacctacagaataatatccacagtatgatcttgctttagtttggaaataaaaatactcatatactaaacactaaataaggtggtatctttcttttttaaaattctctccttccccaaataaggtgatttctatatagaaatgattgtttatgaatcacaagctacttttgcataataaacatcttaccttataagtataacttcaccaaaacttgcaaactgctgcagaagctcatcaatcaaggcatcatcaaaaaaattattttctggtaaagaacttttgattgagaccaatactgtaccatctggtggaccctgaactgcaattacttctttataaatgttttgcctctcttcagcttcaacttcaaatatatctatatcaatcagggcaacgacaggccttaaggcataaaggaagatagatgtattagaaatgtttttaaaagggtgtatttcaaacaaatttcaaacactattagaaaaactgagactgcttaaacctgtggtcagaagtcttcagctcagctcttccatagtgcagcaaagtgcctggagtccacgtgtacagaattttgctttcatcttgaaaactagcatttagaagatctagatcttcagctgcagtcagaagaaatgaaaacacaagagaagctgtataagcaggacagatcgtgtagagcaaagaggcattctccttcctttcatgagcttcagtggtttgaggctggaatgccagaaacacttggtaataggcaggcagtctaaatacctttaaattcgaaaggttttggtaaagttatcattttatgctttatttagtaaaaattaagatctggctttatttccaagattacttaaaggactgggactaaatggtgtttcataaacaattcaagagacaagtggcagttcaaaacatatgcaaaccactaaagttagcttaaaaacctaaattagcttcaattaaaaatttcacaaaaatatttccttgcttctctttacatgaaattatatgaaaataggctgaaaaattaaataagttattataaacagatctgatatttctaaaaatctgacatatttaaattttatttattctattccagttaatgtttcttgaaaaacaatattctcctcatttgatattatgtcattccctgcttcctcataagtttacattagttcatttaaataaagaagcccatttcccaacctgatctatcaaaaggccatttcctccttctccaaaggacacggtctgtccaggcaggggtgcggcacttttcactggtgtcatagtcgtcagaaaacaagtcatacttatatgtcggagcaaaggttacctttccttctaaaaatcctctaaaaacctaaaataaacatatacaaagtaagttattcccaaacagcaacaagttctgttttcattcagacagtcatccattaaatgtctattacatgctggatgctctcagaagaaatctgtatgcgtctgatgaacacttctagctgaatggaacaaagcttagaaaaataacctgagacatagcatttttcatacccatagggacaggagacagggaaattctgggcagaagtgggtgggtccctttgctgggtcccaccctcaagccaaaaagtctgttaccacagccccaaatgagaacttatatccctgttttctcgctcgaatgttgctttttccaaaaccacccatggcctgccttgcccccaatcctgtgcccataaaaaccccaggctcagctggcagagagaggagaggcagctggatgtcagagagaagcagcttgacttcaaagggacagcttggcagcacagttttggagaggagtctggccatgggatggctggatttcaggggaagattatcttattgctctgtccccttttcagctccccttcctgccaagagccattttcatcggcaataaaataccccatatttaccatcttcaattcgttcatgtgacctcattcctcctggacaccagataagaactcgggtgccatgagtgtgggagcataaggctgtcgcactgaccccccactaagctgttaacacttaagccatctgcaggcagcagagctaaaacagcactgtaacactttctgtggggcttcaggggttggaggcaccctcccctagacactgccacgggcctggtacaaagttcgctcttgccggtgcccaaaagcgctcaccccagctcctgcactcacttaccagaactccccctcctacaggggtggagtgcagtgggtcaagtgagcagagttcgccccgccagtgcccatgcactccagttcccacctgcgaagcagtcagggaaatatcctgcttcaataccacttgtttgacatttgattaaactaactacatgaataagggaattctgcctgatctttgagctatatgagacatttggaactgtaaatgggattctggaaacatctagcctgatatcttattctcaatgaggtgctgaggcctgaaaaggtaatgtggtgcccaaagattcaagtctggtgatcaccaggcaccataccagatggccactgatccttttacctaaaaaaaaaaaaaaatttaataaattcttcccaaattttgtggtcataagctttaagaagtgtttcaaaagtcagatgacatagaaacaaaagaaaagtcaataaccacaggacttaacccaaaaaaaaaacagccctaaagatgaagattctaaactatcaccaaggaaaaaaaagtttatccttctatttgaaagtgaatcttatagatacataatatatttttctttatgggaattattatgggttttctctttcctatttttattacttttaagggaggacaccaccccacatattgtcttatgcccaatttctgcctccaaagaaagaagaagtaaaaactaaaaggcagaaatggaagccacaagcagatagcccagcactgcgccctgggcctggtggttaaaaatcaacccctgacctaactgtttgtgttacctatagatttcaggcctgtatggaaaagcatcatgaaaatccctgtcctgttctgttctgattactggtgcatgcagcccccagtcacataccccctgcttgctcaattgatcatgaccctatcacgcggacccccttggagttgtaagcccttaaaagggacaggaattgctcactcggggagctcagtttttggagacgcaagtctgccgatgctcccagctgaataaagccctttccttctacaactcggtgtctgaggggttcttgtctgaggctcgtcctgctacatttcttggttccccgaccgggaagtgaggtgattaacggatggtcaaggcagccccttaggtggcttaggcctgccctgtggcacatccctgtgggggactccggccagcttgagcaatgcggatcctgagagcacttccgggtaggtaattgccccggtcgaacgcctcaccacagcagcgcatggcaggcccccatgagttaaaggaaaaacttatgttggccccagccctaggactaccagatttgacaaacccctttacactctatgtgtcagaaagataaaaaatggcagttggagttttaacccagactgtgcggctctggccaaggccagtggcctatctctcaaaacaactagatggggtttccaaaggctggcccccatgtctaagggccctggcagcaatggccctgttagcacaagaagcagataaactaacccttgggcaaaacctgaatataaaggccttccatactgtggtaactttgatgaataccaaaggacatcattggctaacaaatgctagattaaccaagtaccaaagcttgctatgtgaaaatccccgcataatcactgacgtctgtaacaccctaaatcccgccaccctgctcccagtatcagagagcctggtcaagcataactgtgtagacatgttggactcagtttattctagcagacctgaccttcgggaccagccatgggcatcagcagactgggagttatacatggacgggagcaacttcatcaatccacatggagaaagatgtgcaggatatgcggtggtaactttgaacgctgtcattgaagccaaaccattgccacagggcacttcagcccagaaggctgagctcattgctttaactcgggctctagaactcagtgaaggtaagactgtaaacatctacactgactcttgatatgcctttctaaccctccaagtgcatggagcattatataaggaaaagggcctgttaaactctaggggaaaggacataaaatatcaacaagaaattctacaattattagaggcagtgtggaaacctcagaaggtggcagtcatgcactgcaggggacaccagcgagcctccacctcagtggccttaggaaactcccaaactgactcagaagctcgaaaagcagcatctaccccttactgtgcatcagtagcagcccccttactccctcaaacacctgacctggtacctacctattctaaggaagaaaaagactttttccacacagaagtggggcaagtaataaaagaaggatggatcagactgccagatgggaaggtagctgtgccacagttgctgagagccacagtcgtactggccatgcatgaaaccactcttctaggtcaagagtcacttgaaaagttgttaggccggtacttctacatctcacacttgccagcccttgccaaagcagtagcacaatggtgtgttacttgctgacagcgcaatgtgaggcaaggccccacggttccacccagcatacaagcttatggagcggctccttttgagggtcttcaggtggatttcacagaaatgccaaaatgtgaaggtaacaagtatttgctggttcttgtgtgtacttactctgggtgggtggaggcttatccaacacaaactgaaaaggcctacgaagtaacccgtgtgcttctccgagatcttattcctaggtttggactgcccttacgaattggctcacataacgggccggtgtttgtggctgacttggtacagaagacagcaaaggcattaggaatcacttggaaactacatgccgcctactgacctcagagttctggaaaggtggagcgaatgaatcagactatcaaaaatagtttagggaaagtatgtcaggaaacaggattaaaatggatacaggcccttcctatggtattgtttaaaattagatgcatcccttctaacaggatactccccttatgaaatactgtatcataggcctcctcctatactagggggacttccaggcactccccgagagttaggtgaaattgagttacagtgacagctacgggctttgggaaaaattacacaaacaatctcaacttgggtaaatgagaggtgtcccgtcagcttattctccccagttcaccctttctctccaagtgatcgcatgtggatcaaggactggaacgtagtccctttgcggccacagtggaaaagacctcacaccatcatcctgaccacccccacggctgtaaaggagaaggaatcccagcctggatccaccacagccgtgtgaaacctgcagctgctgaaacttgggaggcaaaaccgagcccagacaactcctgaaagtgactctgaggaggatgacaagccctgctccagtcacacccggaagctgactggtctacgcacggccgaggcatgaggagaatcatcgtgggactcattttccttataatttggacttgtatagtaaaaacttccactgattttccctgcatagaagactgctctcagtgtatacatcaggttactgaggtagggtaacaagttaaaacaatctttctgttctatagttactatgaatgcctaggaactttaaaaggaacgtgtttatataatgacactcagtacgaggtatgtagcctaggaaacgactgcccagatgtgtgttatgatccctctgtggcctcccaggtccacagtttttgaagtaagattaaggactgaagactgatggggacttgtaaatgatacaagtattagccaaaacagaagaaaaaggggtgcccaaacgcataatcttgaaatttgatgcctgtgctgtcattaagagcaataagttaggaaggggtgtggcttttgattgggaaaaaggctatatgaccaaaaataagtatatttgtcatgaattaggactgtgtggaaatcaatgtggatactggtgtcatttgggccacttggataaaaaatgaaaaggatccagtgcagcttcagaaaggaaaaagtggcccttcctgtactaagggacaatgtaaccccttagagctagtaataaccaatccccttgatcctcgctggaaaaaaggggagcgtgtgaccttaggaatcaatggggctggactggatcctcgagtaaatatcttagttcgaggagaagtttacaaacactctcctgagccagtgcttcaaactttctatgatgaactaaatgtgccagtaccagaaattccaggaaaaacaagaaatttgtttttgcaattagccaagcatgtagcctagtctctcaatgttgcttcacattatgtatgtggaggaactgtaatgggagatcaatggccacgagaagcccgagaattagtacctacagacccagttcctgatgaattcccagctcaaaagaatcaccctgataatttctgggtcctaaaaacctcaattattggacaatattgcatagctggagaaggaaaagaattcactcaccccgtaggatgacttagttgtctgggacagaaactgtataatggtaccacaaaaacagtcacttggtggagttcaaatcacacagaaaggaatccatttagtaaattcccaaagttgcaaaccgtgtggacccatccggagtcccaccaggactggacagcccccactggattatactgtatatgtgggcatagagcttgtgccaaattatccaaccagtggacaggtagttgtgttattggcactattaaaccatctttcttcctactgcccataaagacaggcaaactcctgggtttccctgtctatgctgcccgagaaaagagaagcatagctataggaaattggaaagatgatgaatggccccctgagagaatcatacaatattacagacctgctacttgggcacaagatggctcgtggggatactggacccccatttacatgctcaaccgaatcatacggttacaagctgtcttagaaataatcactaataaaactggcagagccttgactatactgccctggcaagagtctcagatgagaaatgctatctatcaaaatagattggctctcgactacttgctagcagctgaaggtgggggtctgtgggaaatttaaccttactaattgctgtctatacacagatgatgaagggcaagtagttgaagacataattagagatatgacaaaactgacacatgtgcctgtgcaagtgtggcatggatttgatccgggggccatgtttgaaaaatggttcccagtgctaggaggatttaaaactcttataataggagttataatagtaataggaacctgcttactgctcccttgtttgctacttgtacttcttcaaatgataaaaagcttcatcactaccttagctcaccaaaatgcttcagcgcaagtgtaccatatgaatcactatcaatctgtcttgcaagaagacatgggtaatgaggatgaaagtgagaactcccattaatgagtgaagttctcaaaggggggaataagggaggagaccacccctcatattgtcttatgcccaatttctgcctccaaagaaagaagtgaaaactaaaaggcagaaatggaatcacaggcagatagcccagcactgtgccctgggcctggtagttaaaaatcaacccttgacctaaccgcttgtgctatctatagatttcagacattgtatggaaaagcatcgtgaaaatccctgtcctgttccattctgattaccagtgcatgcagcccccagtcccataccccctgcttgctcaatcgatcacgaccctctcacatggactcccttagagctgtaagcccttaaaagggacaggaattgctcactcggggagctcggtttttggagacgtgagtccgctgctgctcccagctgaataaagccctttccttctacaacttggtgtctgaagggttcttgtctgcagctcatcctgctacactttaaggaaagataattctattatctgtttacctacagatgcatatttaagtacaaaaagaccccaagaaaattttaaaacatcttgatttaaaaaggcatgtttcacgacccaaaatcttaatgcaagtattttctcaagtatagatatacctgtccagcatttttctgattgataagttgatctcctgctataagagaatcccaattttgctgtcttatgagctctttaacttcttcgttagggagatcgattcgatagttgaaatcaccacaccaaaatacatagtcatgggaaaatagcatccttccctgaaagcaatgagatagaattttaaattcaaaacaatcaatgttcaaaaatgttttacaactatttctttgcctgagatatgcttgtctcctcccatgtcctgtttctttgacccaacagtaataacacatgtgaaacgaaaataaatctcaggaccccaaaatcactaagcccagagaaaaatcaagccaggaactatgacaggtaaacctgcctcccattttactcctaaataagatagctccaaagataagaagctacataactccctcacaatttgcccacaggaaattccttgtggacaaagtatagactgaactcaaagtcatccctctgagactcacctgagacaaatgcacatctgactgcttcctctgccctattgtttatgcaaaaatgcagattcactgagccacactaaattgtgtattcagtggaaggctgatctaggacttaaaagaatgcaaccttttgcgtcttatctacttctaacctggaagcccccacttcgagttgtcctgccttaccagaccaaaccagtgtacatcatacacatactgactgatgtctcaggtctccctaaaatgtataaaagcaaactgtacccccgaccaccttgggcacatgtcattctgaattctggaggctatatcatggccacatccttaaccttggcaaaataaactttctaaattgactgagccctgtctcagatattttgggttaatactcatgaaatatctatttaggtgaatattcttaatgtttctaggaactatcttaaatttccaaaaacattgatgtagaatttggggcaaattaaaatatatttcaaagctttatcttcaagaacaagcagcaagagcttaccataggaaaactcaattttcgtgctatttctataaaatcttcatttctttctttgacttgtgactgccctgcagcaaagtggctacagacgaagcaaaggctggttgtatggaagagcattcggattgcaactgctcccttatttccagttgcacctcccattccagtcttcacagtatcaactgcaacatccctttgaaacaaagaattctaaatcgcagatttgaaatttcaagagttccatgtgcataggaaatgaggaatatacataatcatttaagtacacatggtatggtactttgagggcaagcctttgaaatagtacagtgaagctattggtgagtctttaatcaaaacccccaaaaccccattttaaaacaagaactatggatagtttttgtttgaagaactgaaacaataaacattctaggcttttttcttgttatttaatggtaggaagtagccttagaggagtgttctgtttactgacctgataaaaggagcatgctgtggtctgataaaaacaaacaaacagacgcccaccaactgttcagaagccagcagcacatacttgttgtctctggagattgtcttctgaagttctacagcccagagcttctgatttgttgtgctacaagaaaatattaaaaagagaattttttaaaaaggtattgacaatagcctattttatgacaattgtcaattatacctttatctacccaaatatcctaagactctgaaggaagcttaggctgtttttgtttcctttaaaaaggaaaatctacaatttagccaaaagaaaaccacatttcaaaatctaatctattacttctttacaaagaaaatataaagacattaaatggctactcactgggtgagtaaattcaaacttatacattttactttttccttaagtattcattaagatcacagagaagtatagaagtatctgtgggagattggtttcaggacctcccatgataccaaaatccaaggatactcaagtcccttacataaaatggagtaatacttgcatataacccatgtaaatctctcgtatactttaaatcatctctagattacctataatacctaatacaatgtaattagttgttatattgtaatgtttagggaataacgatacaaaaaagtctgcaagtaaaaaagacaaaaaaaaaaaggctacacatgttcagtatagacacaattttaaaaaatatttaatattttgatgagttgaatccaaagatgtcagacccatggataaggacagctaactgtgcacatatatgtgactatatgtgcttccaaatacatttccccacttttcaaaatttttctaaattataactaatgtctttttaaaaaatcttgctatgggaaattagaagacataatcattaaacaaaccaccatatacccatttcaaaattaccaacattttgccaatctattttttccatcctcttcaccttatcacatttaaacattaataattccttaatatcatctaatagtttatacttaaagttccccatttattaaaaaaaaatcttctaacagttggtttgtttctttaaaaagggtccaaacaaggtctacatattgcatttgcttgtcatgtctcctaatctctctttttttcttgagatggggtctcactctgtcacccagggctggagtgctgtggcaggatgtcggttcactgcaacctctgcctgagctcaagcgatcctcccacctcagccccgcaagtagctgaaactcattcctcatcttctcaatgaaccttatcttgatcattcatttgagacttccaacacttccctgtgtccctatagttgatctccttttcctctcttttccattgcacttttctaacatgctgtataatttacttattgttgttattgttcactgtccgtttcttcccactagaatacgaagtccatgaagatagggatttttgtctgtttgattcattggaggtacttaagagtggtactcagtaggtactgcttaaataaatgaataaatattcactactttattaaagaagaatatatatgtgtgtgtgtgtgtgtgtgtgtgtgtgtgtgtgtgtgtgcatgtgtgtatatatatatacatatacatatttgagacagagtcttgctctgtcactcaggccggagtgcggtggtgcgatctccactcactgcaacctccgtctcccaggttcaagcgattctccctgcctcagcctcctgagtagctgggattacaggcacggggcaccacgtccagctgatttttttgtatttttagtagagatagggtttcactatattggccaggctggtctcaaactcctgacctcaagtgatccacctgccttggcctcccaaagcattgggattacaggcatgagccaccacacccagcctaaagaatttgattaaacctagcctaaagaagaatttgattaaactctatttagacaaacaattgatccatgcacttagtactaggaaccctcagagttatagtctagtttaggacctgaatatatttttcaggaaacataatcaaacaacaaaatgggtgaagttgatttctttccaattttcctgatgtgaattgtttttcattttgcctaataaaatatttgtcacttgcaagattgatgactatttcagcctataattttctcctaaaaatctttaaaaatgtcataaaagatgggaaactgctgaaatttaaaagcaagcatactttgttaaaataaaacactgaagttttaagcctcactcatataatttgtatttataatatggattcagaacagcgttcccaaagtgtgatctggagacatctttgagggttcccaaagcccatggggtcacaactattttcatcatactattaagacatctttcactgtgttgactaacatttgcactgatggtgcaaaagcaacaatgggtaaaagtgctggtgctttcactcgaatttaggcaccaaactatactagtcatcattacaatccccactgccatatacttgcaggaaaaaaaaaatgccacttcgcctaagaatgtccttgatgaagcaacagacattattgattttattaaagctcaacccaggtcacatctttttaatattctgtgtgatacacaggaaatacatacaaagcacttgtgttgcatactgacttatgatctgtaacaaaaaaagaaaatgctttaaattgtgagtcaaactgccactttttttttggaatacaattttcccttaaaagaactaatgacagacggtggttattcagatttaggttatgtggcatttttttcaactaagcctgtctctttaagaaaaacaaccaagagcatttgttttcaatggaaaaacttgcgttttcaggcaaaaattagtattctggaaaacttgtatctgctaccatgatccttacagcttcccaacaattattttctgatgcagttaccaatgctggtaattaaccaatatgatgctttgatattatataatgaaatgtgttaaaatttggaagtgctacataacttagggaacccaagtgaccaatacatgatgttacaaaatcacgcaaaggtaaaagatgaattttagataatagagcagaaaaagttcatcaatatggtttcagattccattttgcaactaacctttaggacactaccatttggtatagtgtcttatccacacactacaccaagataatacttctctgttatctatactacagcagagaataaattatctgttttggtgtagtatcagagaagaaattatctagaaaggttattaaaatatttccttttcaaactacatagttatgtgatttttcttcatatacttcaatcaaaacaacatactgcagcagactgacacagaagtagatgtaagaatctggctgtcttaaactagacattaaagagatttggaaaactacaagacagtgccacccttctcagtaaattttttgttttgaaaaagttatttttcaaaaaatttattttaagttagcatgtaataggtttattattgtttttaagtgaattaaatgtttttaaattttcatttttaattcctaatataacaaagatataaacaacattagcaaaagttatttaacattctcaatatttttaagtgtgcagagagatcctcagacccaaaagtatgagaaatgctcttttacagttttacgagcacccttccatttattatttcaaactatccttgtaacaattacttaattatctgtcctccatagtttccctcaactggcaaatttttcagtggattaatgtggctagcttaccttgcactcacaatgtttccagcattcaattctaccatttcttcaaaaccaattgcaaatatatcagttggcttacttcttttatctaaaattaagcatccaagaaatacttttaaatatagcctcaggcaaatagcaaccccatccaacacaacataacaccaggtctcataaagactgatttctgtgttttgagtttaaccaaattcatattaaaggcaaacactcttgagtggaatgaaattattaaaatttactttctattagggtgtcctaagtttgcttctttaagacggttatccttgaagattcttaagccctttcagaattcactttgaaaaaactcttgctaaagtttttaccagggacagcacagaaacaaatcatttctcaaatcaaaatctcacataaaactggagagagaaattattcagaaaaggcacaaagaataaagtgactgagaaactacctcaaattgctggtaacagttgggaggaatttttcacattcatatttgaaaaacataatcttgatctttttgctattttctgggtgaaagaaatccaggaaaactaggagagatccagaaagtaagacacatcactctgtctagctgctggcactctggaaactacaaggactaacggagaacagagctgcctgagaaagcagcccagggagacttcgggtgccccaagtttctagaaatgaggacaaatagctagaaagagcctatatggccagatgctacagcccctgcctgtaatgccaaacactttggaaggctgaggtgagaggatcacttgaagccaggagtttgagaccagcctgggcaacatagtgagacccccatcactacaaaaaaataaaaataaaaaaattagcttagcatggtggcatgcctagctattcagaaggctgaggagggaggatctcttgagcccaggagtttgaggttatcgtgacctatgatatggagactgcaccactgcctgggcaacagagaaagaccctgtctcaaaaagaaaaaaaaaagaagagcctataaatagtctgaactaacactgaaattaaaaaaaaattattgactgctattatgtgcaagtctcatgcatacatcatcttatttaaactgccataaaaacatcttctaagaaagattatttttatcttttatttacaaacaggaagcttgcccaagttcacacataaaatgcagcctggcatacacactctaaagccaaactgcctgagttcaaatcctggctttgccactactgcacaaacatgggcaggttccttccctttcaatgtctcagtttcctcatctgtaaaattggaataatggtgtctatgaaataataggtcagctctgaggattaaatgaacacatgtaaggtacatagaattatagtgttagctgttattttattatcattactatcacaacttcaagttaggttcaattaagtaagaaagggcattttaggccaggtgcagtgcctcacgcttgtaatcacaacactttgggaagccgaggcgggtggatcacctgaggtcaggagtttgagaccagcctggccaacatggtgaaaccccatctctactaaaaatacaaaaaattagccgggcacggtggcagatgcctgtaatcccagctactcaggaggctgaggcaggagaatcgtttgaactcgggaggtagaggttgcagtgagccgagatcctgccactgcactccagcctgggcaacaagagctaaactcaatctcaaaaaaaaaaaaaaaaaaaaaaaaagaaaaagaaaaagaaaaagaaaagaaagaaaggtattttaataaaaagtttggggagaatcccagggtttaagatgaaactgatgaaaaataactaaaaaagaaaaattttatctcacaccatttcctatacacatcaccctcacatataaaacttggtaattatatactattttaaaaaggaattaaagttaatttttaaaaagaagaaaattaagttcatgattctaatcaaaatctttttctttctttctttttttttgtttttttgtttttttgagagtttcactcttgtcacccaggctggatgcagtggtgggatctccgctcactgcaacctctacctcctggattcaaacatttctcctgcctcagcctcccgagtagctgggattacaggcgcacaccaccacacccggctaatttttttatttttagtagagacggagtttcaccatgttggcgaggctgatctcaaactcctgtcctcaggtgatccacctgcctcggcctcccaaagtgctgggattacaggcgtgagccaccgtgcccagcccaaaaccttaacaaaagtatcctctgctaaatgtttggttctggctatttattaacagtttggtgcagagaacccaaactgaatgccaacaaagtttttcaaggataaaccagtgctcttaagttattacataagtaccaataaatatcacaagttttataaggctgctcaagacccactctgacatttcttatcttagtaactaaatagaggattaagaattgaaaaatgggacatagtaggtttgaaaaataaaactcaagtgatcaattatattttaattatgtaattttaattaaaattaataaatgatcaatgttaaatggacataatcttggtttatgtccataatcttggtttatgtccatttaaaataaaaacaaaactagattttcttatatgtgtggttgccttcaaagaaatctatgtgtgaattcctatttcctgagaatcaattatggaaaaaagattttttgttttaccatcatatatttttatgaagtagaaaataatggtctagaaattttaaaaagctgagattttaatagatgtgatctttaaagatgttgttggtcttcaaatgtatagctccaagtttctttcatcaattaatgcatcctctgaagtgctatatttgttttctagatcaatacaacacagtcaggatttattaactaaatccatattataaaaagccaaccttgaaactcctggatgccagctaacttgggtgcatcaagaagccagtcagtgagtgtctgattcttaaaagctatgctgcgaaattgcttcccaccattcacattccaggttccgacacatactcgaattttcttaggctttgaatatttgtagaaattctcacacatgctctttagtactttagaagatgctaatcaagagaagacacaatagaattttagctgcatcaaaccatttataaaaattgattttcataactgagatacgatgtccgctggaaagcacaattattatcacaagcacaaacaagcaaaagatacaggcacaggcacaaaaaaagatcagccttcaatgcaaagcctggtatgaggcaattaaccaacacatctttaaaaaaaaaaaaaagtcaacattaaatacaatagccaaagtaaaaaaaaaaatactacacatacagaattattgcagcaacatgcagaacaaatagttctgtttcaatgaaatggtacattaatgtacaaatccaatgaactatacatttttaggaatatagcaattaactttctacaattttcattaagagtctggtaaaaatataaattttatttttctccaaacaaaaacatttaagaacatttacatttaagattgtagctactgacaggcagcttgatgaataatggctccttgagaaaaatacaagctgatatttctgaaaatgaaatcactactaaatgcttcccatctcactcagagtggaagccaaagtgcttaaacaatggtccacaaggccctcaacaatttgtcttgtttttccaccctcatcttccactctccctggtgcactcactgctcagacactggccttcctgctgtttcaaaaacatatgaggcctgcttccaccacagggcctttgcactggctgtgcccacagcctgcaacactcttcccgcacatccttcaagtctttactttccaatgaggccttctctgaccactttatttaaactgcactctgcccttaactttccattatcccctccctgctttatttttctctatagcatttatcacatttataaactatgtattttatttatttatcctgtaactgtctcccctcatgagaatggaaaatccatgagggcagacatgttagtctgttttctttatgggaatactcctagtaactaaaagactacctggtacgcagtaagtgctcaataaataattgttaaatgaatgaatgttcaatacattttgaatcctcaatctctcccgtttttttttttttttggtctacaacccatcttttccctttctaaaccacattctatcctggttaaattctcagcatagaaccttaaaagcacctcaacctaaaaatctgtacttcattggtagctaaccggtaacaggaaaaggacatcaaaactactttcaccttttaccacatgatcttattttattatgatattctcttatgataccaagatatagcagtcttatgaggaaatgagagtgaaaaaggcgagtgatgtcttagtattcttgtaaagataattttgacctgtggaactgctgatttagataagtatatccccattgtttccaggggcagatatgcagatttctcaccacctagctgtttgctttgattgcttgtatagaggtgtctgggtggtaatgaaagcagattacttgtctggcctgttggtatggttaattcaaagctgactgtacctagataaaaataattctctataattatggtttatcattgctcttaaaaattgaagtcactgcttgttaccaatgcgaacatagtgtctataatccattctatatcaacacacaagttctataataattacacggcttaaaatattcagcaagacaatgaactgtgtgaataaaaacgtactgcctcactgtatgaactaataaagtcaagtcagtttttaaatgaaataaaaagataaaaaatagtcctagtttattcttaactggtgccaccttaatgtgcttaaagaaacagagagtcaaaaaaataaaataaaataaaaaattttaaaaaagaaatgagtctatgctcaaacaacagatgtccatccctaaataccatactatttcagaaaatggtgttcattatataactcaaaaatatatctaggtgctctcttcctctacccttctcgagaaaataatcaacagcttctcaaaacattcagaacaataactaagccaaacaattcttaagtgatagcaaatccttttcaactaaatttctggcaagagttaagctttcattccttttgccacagattcatgtttaaagacaagatcataaaccttgcccagagaatgaagacgtgagattcctaggaataaataggcaagaaaaataataaatagtctttaggtctcacacacttaactattctttgttagaaatcttggcactttttaaaattaaaagatttcagatcatattttagtgcaagtctatagttttgaaactatttcattcacaataaggaaatgcaacaatgccttcttaaatattatatgtgagaaacactgtttagtagttgtaaatatcacggatggcactcagaaattaattcaaagtagttacatctggatttttttccatcagcctattaagagtaaggcataacactaataatatttgttcaatgaaatgtaaaagtgaaattaaaactagctgaattatctttaactggaattaagcaattgctacaggaagacaaagagcactgcacattttcttcagaatgaagtacttaattttctcaagcttgaaattcttttctcagattaaaacaagatatcaatttatcctgttaggatctgatggcaaaatgagaaagtttccaattatatggctttatttgtttacaatatcgacttcagaaaaaataagaaaaaattgcttttatttatagattgattttctatactgtacctgactgtaatgtctgctcagaaactatggatgcaacaagaagaaaacaaagaatcattagtaaaaacaagttacaattaaaatgttgagtatagtgacaaaacattttgagaagacctcacttaagtcaatttgatgactttatttttttctgatagctatagaacaccaagtgttacaaataaacgacaatgattgatacaaaccttctgcacctaagaagaatcctacagtgactcagtgatatccaccgtttcaccatcagaagctcctaggcctgcgcttctggctgctcctgtgtgtatgttatgcatgcatgcgcacatgtttgagaatattatgaatataaatatgaaaacctaagaagatggaggatgttgaagatatggaagatactgccctaatacacaccttttagtattctttctgggacttagcagttgataagtataatcacttcagctataacaagaaaaatgcattctaaaaacatcaccatgctatgcaaattttgcaaattcccacagccacagggcttatgggaaaaatggggttggggtaccacgttcaaaaacttcaacaatgacacatcaaaaaagatgggaacctcataaaaatagtagcaagacattatacatgttaaatggttatgaaatgcatgaatataaccattaataaggcacttcatcttgaatgaagttggcttgtagaaatgggcatcaggcagagtgcagcttgtaatatgaataatggagaaagggatatctgaaattcaatgaaaagttgaaagaacagatgtgaatgtgtatggctcataacacacatagtgaactgaggcaggggaagatgtttgaggtgtgtgtgcatatgtgtatgtgtgttttatatgttgtacatatttctagccatcttagttctgctgggtgcacttttctgcatttacctagtgttgcttcccagcaaaatcatgcataagctcatgcaaaattggccttatgctcaaacagttccctaatatatcatattggaacaaattcccattctcagaacaagcgttacagcagaactgactgtacttttttttaaaggtatgattttacttatagtaaaatgcgcaggaaactaaaaacactaatgctgaagtttgaggattacataggtcccttgtttctcctcttctttccttcaaccacttactttcaattgttgcttattaatgcctccacatcaatgtaggcacaggtggaaagaggtgacaaaacacaaatcagtcaagtctctacttttggaagccaggaagaaagcctgaagttgaaagtagtagctaagatcagacattttttggagttttagtaggtctaagttccctagcccacttacaggtccctgaggaactgtccgtaattaactacctttaggcaccatgcaaattctaaaataatccataacttatttgaccaagtaattacccaagaatacattacttgatgcagaaacaattttctcccacttgaacagggaacattaaaaagtttggtttagggctaacagaaaaaaaatttctttttcagagtgctaaaaagttaaaatggaaaaaatttattttgtcaattatacctcaatacattttagagaaagaaaaagtaagtctaatctattaaattctacaatgaatgttgagttttcccgtcatgctacttttatgtgctcactgataggagaagtttttttttaaaagacacagtggaaggtgaaaacctattctgaaggtcatatatttatttcaaatattaaaattggtaatagcagttagtgcccaataattagcactactttaaattattaatatgatttaatgcttattcaaacaatagcaattaaaagttaagaccaagttacagaaacttttgggatagtgatttaaaaaataaccaatataggcattagttttcccagtaaagcatttttctgcataattagattattaaatgctgtattacaagtactagctgaatattctatgaaatactgccttgtacaaagttaacaatgcttaattatttacccctcaatcataatctatagaagaaaccatgcaagggcctcagtttacagcttagtaataccactgattgtacaaatattttaaaacagacaaacttcccttggagaatgtacttttcaaaaattacctttacagaaatcccttcaaaaactattttaaccaactaaaaattctgtgtaaataagtttacatttacctcttggacctttaggaatataaataacaaataaaatataaagtgcacataccacgcaaacttccagtagttaaaagtgctcgagctttgtcagctaaatcactattcagagtatttcccagtagcaaaacatcaatggcctcttgcttggagctgtcaaagaagttattctgaattgttcgggtaacagagcgagcaccatcttttaactttccagcctgttaagaaaggagcgcagattttcattttaaatattactgattttactcattaggttttttgaaattttaaatcagttttatatgattttagtataaaaaaggacctaatcgttctattttgaatatatagtcatgacaattaaaatgcctccaacatgtcactgtttcctttcttcttttggattaaagctctgcacaaagaaatgaaaaagctcagtgctacaacctcatccagtaattacatctagggcaacaaatgtttaaaattgcttattacaaaggaaataaactgaagtgaacttatttaaaacaagaaaattccttcttacaaggtaatttgtaaacttggggataaaatgggtaaggagaaatgggagataaaagaagatacactgagcttaactgcccctagaaaaacttcaaattactttggtagtagaaaaagaaaatggaaattgctcccaaatagcttacatgagttaaaattaaaactaaacctaagaatgaaggtctagtctcaaaagaaatttacaagtacagttcataaacgaatattacatgtaaactacagtttgtatattttgagtcattttattgcccatgcaaaaatacatcataagataataaacttattcctatagtgagatttgattataacttttaatgaatatatattttacttaggcatgttagttaccataatgatttattttgatcttacagattttgatgattgtcaaaacaaaaaacttgcgtcttttaggaaataacttcagtttgcaatatgtaatttttattctttaaagaaataacagtaactcaaggcttctttttagaataaagagccaattttcttaaatgccactaaatgaagaaccagttttcttcaatgccattaaatgaatgctactatatttaataagcaattaatgtttggcattaagtgttatttctttctatataatagcatatgcaaatgacattatttgaaaagacactcaccattcacattatcaggcaattaatcaaaaggaacccagagaaaaggaaaagaaagagcagttcagatgttagattttagttcaattcaggctagcatatttaatgtataaaattttatatctatatattatgttaaagataaaagaccactgaaaatatatgtaacctctgtacatatattgtagtcactgcagaaatgaaaaggtagaagtatataaaagaatattttaagcaatagtttgagaatcagcttttaatagcaagaattatgttgtttaaaaggaataaatcaaagtttaacaatttgatgtttacaaaaatagggaccacttaagaagtaaatatttgtaaaagtcaatacaaattatttctatgagttgaacaaaagaaactttgcaggtaaggccaatacctctgggcagaggcatggcatattatgagacacagaagaggaagacttggaaattaaaagaagacttggagaccatgaatggtctttaaagaatttcagttgctgtatggaagaagctgaatgagaactataaaagtgataaatgttctcatttctattcttgaaataatttgagaaattgtggagatttagaaagttgataaattcaagtgaggccaggatccttaaaaagttaaacaatatttaagaatataaaataatgaaaactatctcaagtattgttccaaactccctcaataagggacaaatacttgagaagaaagtagtctgtagataataccaggaaataaaaagtaatgatgaaacagacaattataattaagtccattcttttttttttttggaacagagtctcactctgtcactcaggctggatggagtgcagtggcgtgatcttggctcactgcaaccaccacctcctgggttcaagtgattctcatgcctcaaactcccgagtagctgggatttcaggtgtgcaccaccatgcccagctagtattttctattttcagtagagatgtggtttcgctatgttggccaggctagactagaactcctggtctcaagtgatccacctgcctcagcctcccaaagtgctgggattataggcgtcagccaccacacctggcccatatctcacacttcgttggcacatcttgatagccacctttctaaggtaagataagtaaagatcaattatgccctaatcttgggttcctagtaagcactgcataagctgttgatggacttacttgtccaagtggcatacgtcacacatctattaacagtaggcactgtgttaagtgcagggaacgcaaagccaaataagagagaaccctttattaagaggtctatggttttaaaaatcatatttgtaatcaaaacaaacaatacaaaaagtaaaacagatatacaagggaaatcatgaaaaaaagagcaatatatatcatcttagtggattgtcactaaatgactagatacgttatatatacatacttcccaaacttagggaaatacctatcttccatttattcactagtatccactgtgaaaggaagtatcaaagaaggcataaaagcacattaaacagaattctaagacacatctattaatttaaaccatctattaacttttaaaaggccatttaaaagctttatgaagagaggaaaaagaggatattctgtaatgttatgatagatctagatataccttcgctttcccttcaagagctccagttcctgcatatatcttactgattgaatcaccattcacggaccacattgaccgaaaaacttcttgaaagcgagtcaccaactgaggcttttcagctaaaccaagagcttccaactgtttagctagcatcttaaaaagcaaacaagaaatttttataagtacattaatatattaattgtaatatggcttttaagaactaccagaatcaaaccaaaaatttatcattatagcactatttgggactagcttctgaaaacataacagtttactaggctgagttatttcccatcatttcaatttttaaaacaaatactgtatcaatggaaactacaagtattgataaggacttctttctggttaaatgataaaatttatcttattaaagtatccctataaatcagagttgtttaccttgcccacctaaaagaattcatcaatcaacagcctgcattagaataaaaaaaagtttacttagtcctaaacataaataactaggtctctttaacttttggatttggctttataagtttaagtaattaaggtaaaaaaaatgaaaaaaaggagttgctcttaaattgtcacaaaataaagaaaataagtaaaacttctgaatgaagtcatgacagctttttatgcataaaatccacatcggtaatatatataagggaagaactagggggaagagcatgcaagaaattcaaggacctctcggcttccacaagtccttatcacatataacaataaaagtgttccaaaaagttattgatctttatatgcaagaattctagcctataaatctgacagagtcaatgttcgatctttatccaatctgtgtatttggaatctagtcatattctatgccttgcattttaacttaactctttccaatttacgttttattttatcatgtaagtatggtgatcatccataattatagaagaaccaaaagctaaaataagattaaaaaaaccttaaactgggttcatttaattacctagagacttacaccagagctgttctttgctagcatggagaataaaacaaaatgagccccagggcctcctttatcatttaaatctttcttcaaggaactgggcaaaactgatcttattcctctactagtttggctttgtctatcttggtgtcaaactttgtaacctgtcaaccaattgctatcctagggagttttctaattcctaactatcaacagtggagaatcagctaagtcagatcctgaaaactaacatctgttataattttgatgaagaggtccaagtacttcaataagcttattatcagaatccatgtacatttattcagccacttaaaacttgaaacaaatccaaggcatgtgataaactcttatctaaatgaccaacatgcttgctttcattttcttgtttctgtcaaattttctaaataaattacaaataaacatcaaaaacatactcaaaaaatccaaacagtaaaatttatttagttacatgaaaaatatattctgtagtagagaattttatacactgtactttcatttttgagataaagaacctcagctgcaaagtaactaattaaccaatactcaggtcaaatttaagatcattaactaaaggaaataagaacatgtaacttcctattgctgtttttttatagtatttgagaactatgttaagttctgatggaactaaacgaagtttagccacagccttataaccttaacttgcagaggagggaagacttagaaagctcagcattgctaaatagtttgtcaaagagttgagactatgtttatcttaggctgaatctgatggataagtagtaaagaaaaaaaaaaaagaaaaaacgttgcaaacagcgaccttatcagagaagttgaattgcattcattttcattctcactaactatggcattttcatctgatcctgtttttttatagctactaatttgaaaacaccaaacaaactggattggtatcagagaagttgaattgcattcattttcattctcactaactatggcattttcatctgatcctgtttttttatagctactaatttgaaaacaccaaacaaactggattgggttacaaattgtcaaaaatatagtcctatataattgtacatatgaaaatagacccttcttatcctaaaatagatttttaaaagacaacacagagaataaaaggccaaatacacacatacacccacacccacacatatatatttcctccaaaagacagggaaaaaattgttgaaatactataaacagcagattttaaaagggagaataaggaacaacagaagtagatagagagctacctaaagagaatatgaagatcaggtaaaggaaatatttaaatcaaaagaaagtttggccaaaaaaagagacagagattagaagtacaaaatgaagcataacattacatacactttctggaaggtaataagaaacataagtattcaaaaagcacttaaagaggcagatgatacaaggcacatacattttaatttattcttttacctctaagccaagaaatgcctgcacactatttgttctatcaagacaatccaagcagtttgttcgaactgtaccactctggcatctgtaaccaataaagttaaatatccagtttggaacaaaaataaagctaaaacaaacagtgaataattgaggtaattaaaatgtagcatccaccttccctctccaactttttattattacagtattcaaatatacaaaaaaaattatactgtgaacatccatatacccaccatttaaatttgacaactgttaacattttgtcacatatgcttcattacattatctatcacacacttatttttaattaggccaacaattagaaactaaatatacattcaggtttatgctcttacagttctttgcacataaaataaaaatatttatagaacaaaatttttttaaacctaagatctgttatctctaatgactgtgtctacagcattgatgctaaataaaatacaaattgaaaaattaaaaatttgagctttctgcactaaagtttcccttaacctatattctgaacttaactctcttaacatttacttttctcctctatttcacatacaaaaactgaatatttaaattatactaaagcagacagtaaacaaagcctttcacttctatttgcatttaataatctttactggcatcaagaaatattaaaacgtaagttttaaaagagaagcaaaacagtttcatatataacagcatgaagtatggagccagacgaatcccagttctaacacttgctaattatgagacttgcagcagatggaaatgggcataataatagagtctatccctataattgttattgatacatgttaagacttaagtacggccgggcgcggtggctcacgcctgtaatcccagcactttgggaggcggaggcgggtggatcacgaggtcaggagatcgagaccatcctggctaacacggtgaaaccccgtctctactaaaaatacaaaaaaaaaacagccgggagtggtggcgggcgcttgtagtcccagctactcaggaggctgaggcaggagactggcatgagcccgggaggcggagcttgcagtgagccaagatcgcaccactgcactccagcctgggcgacagagcgagactccgtctcaaaaaaaaaaaaaaaaaagacttaagtacactgcctgctccataaaatgcgctcactaatgtaacctctcattattatttggtgaattctaaagaaagaaaaacaagtttaaaatcaagtataggatgggtgagatggctcatgcctgtaaacctagcactttgggaggctgaggcaggtggatcacttgagcccaggagtttgagcccagccagggcaatacagggagacccccgtctctaccaaaaaaaaaaaaaaaaaaaaaaaataagccaggcatggtggcacacacctgtagtcccagctactcaggaggctgaggtgagaggatctcctgaaaccagaaggcagaggctgcagggagctgagactgcaccactgcacaccagcctgggcaacaaagtgaggccctatttcaaaataataaaaataaaaataaaatgaaatatttaaaagatatttaattataaactttaattttaaaaagaaaatttaagagttcaacgttaagaataatttttaattaatgttccaattcaaagaacagagaaacagaacagtcaaacctttgaacttcacttccattgaaataaaaaaatccataatctagaaacttctggacttgaggtttaagaacactatgtaatttttctgcctttcctcccttaaccatttgatgatagtcaaaattcaccatctggatatcagcagcatgttcagaagctttcaaatgactctgaaagtaaaaaggcaaatattcatctaaatgaaagtaaaaaggcaaatatccatctaaatattcatcacatttcattgacactggcaataaatcttttccctaaagcctcaaaaactatccctgagagatacggtgacacaattaacatcagtgtacttaaataatattctcatctggcttaggaaataaaaaattatttccaattgccagcattttatttttacaacacaaacttactatttagacctattatagaatctcaaagtcatctaagacaaagcctatcaaagactgaaagattcatattttataacttcattcaatacatacaaatattcttaaattttaccataaagtcactctgtaaagtataatctgtttattaacaatatttatttcaccagattaaaaaaatagctataaaatcaggatgcttttggacttaggagattgaactttagaaaatgttttctaacaatcttgtttaagtttataatcttatgtaacaacataatttatattaattcattattaattcaataagtgttcattaaaatattttttctttagaagtcaggcaattttggggttctttttgacatgaaattctcaagttttctctcatcagtacaagaaggtatagcgttgcatgtatataaatgcatcattcacaattccataggtgaaaaacaatgactatggttctaggaagcaggcaaagcaatcaacagatgaagaaggaaactgctatttctctactagtgacagataaacatttttggcaaggagggtatttttctgtttctctacaaaataaaaaagcagattagaaaacagtgtcatttgcattgaaagctttttagaatcccaatttcagcaacattagcctaaattgtttcttaatagacccaaagagttcaagtttccaacaagtacccaacctttttcttggaagtaatttacttcctggaagaatctgattactgtattattttattttttaataccattctaggtgtccatgggccagaatgaaataagaaatgaccatacttacctggaaagctttacttagcatatgttcaccttccttagatccaagcaaatttactattatttgtttaccatataagttcttaagtgttctaaaatgcctatttaagaaagaaaggaaataaatacatgtcaaataagaagcccaattttttcaataaacaataatccattattaaatataacttacatggcagtattttaaacacagaattggaaaactgggtgcgaattcattgtacatggtctcaaagccgaatttacgaaaactcatgaatgcaacttcctctctgacttatgggtactgagacttccacccctgttggagctgtggaggcatccagcttctgcccactctgtgaggctggcaccagacaagacagacaccagccataagcttgactggaaaggcagtaagggcagatggcaaagggctgctgctcacatgtgaggacatcacctactccgttgagtattcagagggacctccttactagctccagtcttcagaaaaatgggccccaaatacgagtcttttctctttccagcttctaaccattccagaaactatgtagagcaatgccacacaaagaaatgtaacataaaccacacctataatgttaaattttcaagaaggtgcatttataaacatgaaattaattatactttctttaactcaacatgtctaaaatatcatttcaacatgtaatcaatataaaacaactacagttaacctttcaacaacacaggtttgaactgtgcaagtccacttatatatggatttttttcaaccaaagaagaatcaaaactacagtattcctggcatgcaaaacccatgaatatgaatgatgacttttcataagcatgggttccacatggccgactgtgggacttgagtatgcacagattttggtatgtgagggtagaaccaatactctgagtataccgaacatgattttactaatgagataccttacattcttttttattttttaaggcagtctttgaaatctagtgtgcattttatacttgcagcacatctcaactgagactagtcacatttcaagtgcccagtagctacatgtggctagtggctgctatactggacaatgcgcccacagaggaagttttaaggtcaagagatcaagacccacacttccagcactaccacccccagaagtcgtaacactaggtgtcactgtctttcaattaaattaggagtcagaggaattttatttaaagccaaaaaagtttgaagtgaatcagtaaatacaagcagtcccactgcttagcaatatcaaaacttaaagcactatgtaaaaattgtcttacctgtcaaaagcaggtgcattggcttcaaatccccttgacatacggacacgatgagatcccaccttagacaagaaaaatatatttaatcaaaccaaaaaccaacatatagacgaaagaaatatcactgcttacaatatctaacaatttctttgctgaacacacagtcgttaatcaaataactgatttccattcatgatatgcttttaaaaaaacaagttccagggaatttccaccctccacctttatttttaaaaaaccaacctcatcaaaaaaagaagttacatcattatgaaatactcgtaaactagtaggaatttttattgatgaaaactatttttaaaggtgttttcatatatggtactttgttttaagttcaaactacatgccctgtgtaacagatactattaccatttgggtaattaaaaaaaccaaaataccaacaggtaaaataacttgctatctgagatcaacataaccaattccaaaagagattcagatgagactttatgtctctgacctaaattcctactcctccaagctgcctaccaatacaaatgtctatgtgttttcttctctactatgttgaatattctattcacaccaaagttccaccaaattgagaatatcattccttcctggaaaagcagactttccaagtcaaccttgccatcacccaattatagtatttgcacattttgcagaatcaggaattttgggttaagcaaattaaacaagatggaaaatatctacctattgtatattgttataatttttcttttcttacacaggagaatagcagagagatgaggcataattgagaaagatataacatgccaagaagaaatatataggtgagaccagattatttccctgaacttcaatttaaacatttctctctgagacgttggaatgaaggttgcccaatcacaacaaggatcactgagggggggcaaaaaagttgcccaaaattcattcttgctaacctgtgaacaaagtgcttttttttgtgggggacggagtctcactctgttgccaggctggagtgcattggcgtgatctcggctcactgcaacctctgcctcccgggttcaggcgattctcctgcctcagcctcccgagtggctgggactacaggcgcccgccaccacgcccagctaatttttgtatttttagtagagacagggtttcgccatgttggccaggatggtctcaatctcttgaccttgtgatctgcccgcctcagcctcccaaagtgctgggattacaggcatgagccaccgcgccccgcgcaaagtgcttttaaagagggtgtaaaaggggggttgtcaaatcagtcatgtaattggacaagtaaaaccagaaaataaactctaatatgctcatccaattccaaaactgaattaacagtacagtattatcattcattaagcattatccctcactgcactaagtcagataatctaatgagtattctgataaccaggggattctctctttaatttttaaataagaaatcaattagcctaatgtcacatctgtgttcaatttcattttatggtacttaataatattcataaaagtttaaaatttgaaagacgtatgtcccaggacattaagcattttagactgcagaaaactcacaagttgatactttttctttggagtaatcccagattaattgcctatcactccatacaagttcaaaacttagcatttttgtttactgattaacatttattttgcatagtactgcaacggtgcataaggtgaaaaaaatccagttttcatgtcttccaggtaatgcctatggttgttttccaccactctgttccccaacacatatatacattcagctatgtatcacagctctcatagcaatatactggctagactagattagatttctgtttttgtgttattagagacagggtctcactctgtaaccatgctggaatgcagtggtgcaaccatagctcactgcagcctcgacctcctgggctcaagggatcctcccacctcagcctgctgagtagctgagactacaggcacacgtcaccatgcccgaatgatttttatttttttatttttttgtagaaatatgggtctatgttgcccaggatggtcttgaactcctggtctcaagtaatcctcccatcatggcctcctagactaggttttattactcaatgttgaaagaaaagttttacaataacagagctattgccaatcgtgataaaagtagcactccagaaagtgttaaggctttaaataaccataactttacccaattaaaaaaaagttgcggccaggtgtggtggctcatgcctgtaatcccagtacttggggaggccgaggcagctggatcacctgaggtcaggagttcgagaccagcggatcacctgaggtcaggagtttgagaccggcctgaccaacatggtgaaaccttgtctctactaaaatacaaaaattagctgggcatggtggcacatgcctgtaatcccagctactcgggatgctgaggtaggagaatcacttgaagccgggaggcggaggttgcggtgagccaagactgtgccattgcactccaatgggcaacaagagctaaattccaacttgggggaaaaaaaaagcttgcattaaaggtatttttaaaaatcatttaattgtgtggtatggtatatcattttccatcaatattacttctttaccttcacatatttctgaaatttcaaccaaaaattgggggtagaccttacaatgtttaccattttttgactgattgatacggtttggatctgtgtaccccctaaatctcattctgaattgtaacccccaaggttgaaggtggggtctggtgggaggtgactgaatcatgggggtggagttctcatgaatggtttggcactatgcccccttgtattgttctcatactagtgagtgagttctcatgagatctggttacttaaaagtgtgtagcacctcgctcttatctttcttttgctcctgctcccaccatgtgagactcctcgctccccttttgccttttgccatgactggaagcttcctgaagcctccccagaagcagatgctgccattcttcctgtacaacctgcagaaccataagccaattaaacttctttcttcataaattactcagacttgggtatttctttacagcaatgtgagaatggactaataaactgatatatactgtaaatgtagtataataatatatgatctgagtattataagttataaatgctaaacaacttcagggaaaggaaatcataagtaaaaggaaaatcacaagtcaaaggaaatcataagtaagttgccagcactaaaaatgtcattcttacttgtgtaacaccttatgacaattcttataatgcctcaaacaaattcatcttggtatttatcttttccataaaaggcctgagtgcccaaatggcaacctctctatgaagcatcattatatctttgaatctctcatagcacctagcataaaataacatacacaggaagaactcaagtatttagtgaagagatctgagtggccactgaaggacaataaatcttaattttggaagtagaggattcctgctagaaaactgcaaggcctgaagttggacaggctgagtaaaccagatcataaggacataggtgcctagtaaatctgacacgcataacatatatatcaaaaataagaagacctgtcggagctagtaggaagcagggcctagagggacaagacagaaaactgtgagaatcttccaggctagaagaaattatgaaaaccttaactcagaggatagtagtgggaataaaaagaaagtcctactgcctagaacaatgctgagactaatggtaacagggctacttttcacttggtcaggactggctgcttcatagccattagagtaggatcttataaaatagaagttcttgactttgagtggtagagaacttggttaaaaatgaggattcctggccgggcacggtggctcatgcctgtaatcccagtcctttgggaggccaaggcaggtggatcacctgagatcaggagtgcaagaccagtctggtcaatatggtgaaaccccatttctactaaaaataaaaaaattagccaagtgtggtggcacgcgcctatagtcccagctctcgggaggctgaggtaggagaattgcttgaccctgggaggcggaggttgcagtaagctgagatcgcaccactgcactccagcctgggcgacagagcatcattccgtgccaaaaaaaaaatccataattttccacctatcaccacataacattagccaaccagaccgtataggaaggaaagcacacaggagaaggaaggcacaaggaagtcccactcaaggaagatccctcagtgtaactactcaggacgcaaccttattggatcatcaaaacactgtaattcagaacttattaaaataacacaggccaagtacagtggctcaggcctgtaatcctagcattttgggaggccaaggcaggagaactgtttgcccaggagttcaagaccatcctgggcaacaaggtgggaccctgtctctacaaaaaatagtggtatgtgcctgtagtcccagctacctggcaggctgaggtgggaggatcacttgagcctgggagatcgaggctgcagtgagccatgattgcaccagtgcactcaagcctgggtggcagagtgagaccctgtctcaaataaataaatatataaataaataaatataaataaattaaacaaagaaataaaataacataaaaacagtgtaccatagggctcataaactggttattagaatctctaacactagcctgtccctaaaacaaaagcattcacctcgcatcacatcagggtttcagcaatgttcttaaagcaaatactccaaacacccactgttgatcatgaaagcgtaggagaagtggggttctgttggcattctctcctaagggaaatttagggaaagatatatctatttacgttatccctacaaagataaaacaagtcaaatcgtcttgacaagaattcaagaatttttgcagagcagtagaagtgttaatccttgttaactcttagactgtcttaaataaaatgttactaaaaaggttcaagtagtctgtaatttttctctgcaataaccagtctaagatgtaagagatccagcagtcaaataaaggaagaaagatttttttttctttcccttttctcaatactataggctgaagcaccaaacttactagactatacatacccagatcctaaagtaaatatgatatacttcaaggactaataaattttgaataaaaataaaatgtcaacaatagttaacccttacatggtgctgactgggggccaggtgctattctaagtgcttttaatttaatccttacaacaaccctataaagtaggtactattaatattattcccattatacagataaggaaactgagacacacaagggttaaattatttgcccaagatcacacagctagtagtggtagagtaaagatcccaattaagaagtctggttcccaaggctttgttttatctactacattcttctgcctaaagagactaaatcattatatactaagataagaaggtaataaatatggaatcacattgcaaatcaatacactataaagacttcaaaatttttaacactaaatacagcagctcaatttcaatggctatttgaaagagcattaaaagaaaaaatatctaagataattccagaaactctgtactcgtctagacccttatttgcaaatccagctaacattattagatggaataatggaaccatcaatgaattaattaataaactatccagaaagtttagaaaatatgaaaattgttcaaaaaacaaaaataactgaatgtcaaacacatacttgcaaccctggttgctcccagaacaatggaacagatcctcggatttgtatgaaggaagaaactgagtcatctaagtacacaacctacagaaaaaaaaataatatgtaaactatttccacagaaaagttgttacacttacattagaaaaacaaatttactaaaatctattgcatactagttacattttatgatctaactctcatatacaattgtccaaaacaggccactatacaggtttgacttttttttctgttagcgatattaaccaaaaaaattagtaaaattataagcataagattcacaactttaaaaaataaattccttttaaatcttaatattttacatacatatctttatatttcattttgtttagctctttataacctaatttgaagatctgtgttgggctgggttcatggcctgaatttataatcatatagtttcatagccaaaaatatcataatttctgatttttagatggtacacatatttgccattaagagctgggtttaatttcacttcacaaaaaaacaagttgtctaactctacagctgaggattttaaaattcattaaaattcaataccaaaacacacaacactgactatgtcatgctgattagtgacatcttcttacctagatgaagagccacaccaaaataagttttttttagggaagcctttttttaaggcccataagtaaccaagaacaatcataaaacattatagatgttaaaataagctccgaatcaaataaaaatctgttattctagtattttctgtgcttctcctataataaattaattaagtaatataaaacactatatatacctgttctgtttctacaaaattggcaacatgaccatcatcatttgttccccggacattaaacctggtcccagctcgttcacagcttaatcttgaaatgaggcaagccttcgcctgtttatgagcagcataaattgttctgatttctactcctccacacataagacgtaataaccagtcatcacaattcacgccatagtgtttgagatgcaaatgcaaagactgattcctaataggaaaagaaataaatgattagcttatggaatactaagtaacaaagtatgacttttaaaataatctcctggaaaattaatttaatattattaaatttaaaggcacaaacaacaaatcaattcatttacatttactatgctagggatcagaagatagggctataaaacgagatccttcaacatgtgatctatgatccacagaaaaggagtatttttgtgtttttagtatctgtggcccatttctgttatgtctttatatataatgtgtttataacctaacttgttccaaaaaggaatacatatgcatgtccccaccccaatttatgaagctctactttttaaaaaaatatttatttatttatttatttatttatttatttatttatttatttttgagatggagtctcggaatgttgcccaggctggagtgcagtggcattatctcgtctcactgcaacctctgtctcccaggttcaagcgattcttctgcctcagcctcccacgtagctgggattacaggcatgcaccaccaagccgggctaattttttgttttgttttgtttttttttttcttttttgagacggagtctcgctctgtcgcccaggttggagtgcagtggcgggatcttggctcactgcaagctctgcctcccagttttatgtcattctcctgcctcagcctcctgagtagctgggaccacaggcgcccaccaccatgcttggctaattttttgtatttttggtagagacggggtttccccgtgttagtgttagccaggatggtcctgaactcctgaccttgtgatccacctgcctcggcctcccaaagtgctgggattacaggcgtgagccaccgcgcccgcccatgaagctctacttttaaggcttgacttttataaggctctattttaattaatttaaatttaaatagcaagatgtggctagtggctaccacattagatagtgcaggcatagggtttatcatcgctccaaatacttttagcattctaggtaacagatgtggcctggtttccaaacttttttcagagaaacaaattttattcaaacaaacatgcagaagcccaatgattatgatacagataaaagctgctatggctaaagtggggattgggactgaactttgctgggttggccttctcaccctgattacccctcagggatctctcctggaaccttagacctccacagaacatataaagaagctactaacaatataccactaaggaaaatacattgttaagtggaaaaactctatcaatttgaaaatgagttttctatattattgaagcttgactctttaggttttaagtggaattcttctacttaagtgctccgtactctctctctcttcctgtcttaaataaggtataaaagatgtaatagcattatcttgaagactcacagcaatagccccaactccctgccagcccctcagattacaggctgcaacagagataaaaagggtggtcagcagttctggaaaaccagctatgaccccaacccctcttatccatccaggaaatcacacgggaatataaatgagtgatgatattacaacagggataatgttaaatctgatgaccattacttattttaaaaatacactgacttaaacttccatactttactattacccacattgatctgaggcaaagttcaaactggttgtgacccagtatgtccaaccaccacagctgagacctacgccacagcaaagttataagaaacttacttgtcctcatttaaatagaccttaaatcctatgcattttgtgcaggcagagtttctctctctgctgtcagttttcatttttctttgctgtcagtgtgtcactgttttagcatttaaatttatacatgacttttgactggcagcagcttagaatttccaatggagtaaagctatctgggctttgtcacaggtatctgccactctttggctacaaaaattacatggttgtatcctggaaaatattgctactaagtgcaagggtatgcacaatgaattccaaaagttcccgtttttctatataaactgaagctcaagaatgccaatccttagcaaaattgtaaaatgagcaaaattcacctttggtgctctagctgtccctttgttcaacctgtctcctgctggacaaatctcaggctttcttttatctgactttgcccccatctctactcttaagtgaattaaaaaaaaaaaaaaaggaggccaagtacggtggctcatgcctataatcctagcactttgggaggctaaggtgggggggatcacttgaggtcaggagttggagaccagcctggccaacgtggtgaaaccccatccttattaaaaacacaaaaatattagcctgcgtggtggcgcacgcctgtggtcccagctacccaggaggctgaggcaggagaattgcttgaacccaggaggtgaaggttgcagtgagccaagatcgcgccactgcgctccagcctgggcgacagagtgacactcaaaaaaatcaatcaaccaaccatccaattaatcatgcctattgattaaacctaggcaatatatctgcatctgcttggacttctaattgttgtatgaaagcttttatctctcaatctaagaaactttgggtaaaaatgaggagggaaaaaaatgtaaggacagctgcaacacatttaccttttcaagggacttcaacatcttctactagaaaaaatgtagtgttggcatggttttaactcttggaagcctatttctcaatgcttcacaaaagtacatcccatcactgctagcttctttgggcaggcaggaactcatgtccattcatctgccctgttagtccctgcatcccctctctcctttcctctccctcatggtctcctcctctgctaaacccaagtctctaacacataatgctataaaccctgtttttattctgtccactcttctccctgatgccaccactctgggtcaaaacacttccatgtgagctacaacgtgaccaagctgttgctctaaagttaagtttcttatcctaagtttgttgttgactttgagtcttctgacagctagggcaaatgggtgacacccgaatgtgctactcaaggactatataagtgacagtgaaagtgtgagagagaaaaagtacacaagaggaaaccatcttgaatctgaactgttaagggaggccaagagcaaagagtcctgaactttggccttataacatatgtcaatataataatacataatttgcacatgatatcaagagaaaaagtcaacatcaatgctggctgtaaacaacagaaccactatactagaaatctggtctgctgcaatagaacaatgctaattatagtcccatgtgttctgctcaccatttgtgcctacttagaatacagcacagttatgcataatcatgaaatacatcacacttacctacataagtcctaacttattatagtactagattttgtcccagtatactacttcttcacaatctgttgctcttgaatcaagaccacctacttataaccttaaaatttagaataataagggaatgttggcttagaaagggaatgccgccagagacaagatctcaaaaccaagaataggaaacgtgagtaacacagttttgttacaattaaattcatttctaaatatacacaactattttaaatgtattttggaaatgaaagttcagtgtagactggggggagcacaggggttttatgtcacatgccaacttcaataaaccgacattggctgcctgccatgctctgctgaggactccagagaaggaaagatggatacactcaattagcaatgtctatcccttgttatctctagacataacaactgctgaactttttttctttgtaaagcaagcaaaagttttattgaggaagtacaagtacactccaagaaaggagtgggctgaccctgctggaaacacccccaagacattctgcattgtgatcttctattgtctcagttctttctttacccagttctcaccaaggtttgggggatcctcccttactgtgcttaatgcacatgcacgggaaccagtgatcaatatgaatcctatctaatggtggcactgcttattaccaccaccccaggaaggtatagccatcaattttgtactcattatgcctgctcagctctcaggaattcccctttgcctttttccttccttatcaggatctacttaacaacattctgacagttcgaccacggagtgagtactgagcatcctaagaggagttccggggcattctttccaacacgtataccaccccctcgtgcctgctcatatctgactgtctactcttacattgctccctcaaggcgttgggacccagaaatcttttgggagatgaggtagaggtcattctctgtagctacttgctgctgaaaaggggcatcgagggtcttcagggttcttcctcctttcttgctgtcacggtgaggaggtttttgatgactgaacaactgctgaacatattatgtcccaaatcaccaaaagggaaaaaatgaactcaccagaaaaatctattatcagttgtctgttcttgcatgctacgatgcgcattaagactcaaatctaaactgatgccagatgcagaccatgcaaaataaaagtttcctgaattcaaaactttccgcacttctgaaatgcgatcctcatctgaagaatcgattcgcagtgatataaactcagtggaagtaactcggaaaacttcagattcttgaatttttccaacagacatacatccagtgactaggaccagataatgtaacatagtatcacctgcaaaacccaaagattttactggatgaaaaatcccaacattttcaagctattccatttcttcttgcacctctattttttaaatctgacattgtgattattttaaacttatcatggatgtgttgaaattcactagacattttagttgaaaaaaatccttgtttaaatatattaagtataataaagcatttaaacattaacaggataatctcacacgaaattgttcctgaacttattctgaggctaaaaaaactttatcgaataattggctgggtgcggtggctcacgcctgtaatcccagcactttgggaggctgaggcaggtggatcacctgaggccgggaattaaagaccaccctgactaacatggagaaaccccatctctactaaaaatacaaaaactagctgggcgtggtggtgcatgcctgtgatcccagctactcaggaggctgaggcaggagaatcacttgaacctggaaggtggagtctgcagtgagccaagatcacaccattgcactccagcctgggcaacaggagctaaaactacgtctcaaaaaaaaccacacgaacaaacaaacaagaaaaaaactttatcaaataaaaaagtatgtgttaccttctctacttttgcttaatgattgtcagaaaattcaggtaagataatgaattcacactcattttaacaagttctttgtaaatagtaaagttgaaaaaatggtatactattatcagctgatgatgttgatgacaaatggacaaaagtctctggtaacaacttataaagcaatttggtttacaaaaactttcacagagatttttttcatgtaattatgacaaaaagcctatgaaattagtataaagttgaaattgagcaatggtatactgtgagcatgggctctgacacaggtagaagcggccctgaatcttggctccattacttattacctggaccaatttcagtatgtagcataacgaacctgagatatcatctcttataaaaagagattaaagcaaatacctcattatactgtgaggcttacccaggagtaatcagtaaagcacctaagcgcagtgctttatatgtgatagattcataacaaatgacaaatctccattttatagaccagtgctactcaaagtatggtccatgaactgttaccagctcacaatgagaaaggacacttacaccagaatggaaatcaactatattactaagttcaccctttagttgagctgacttttttttctagtaagactttatcaatgaaggaagccacatgttgatttgtatcatagtgcaagctccttatcttatcacggatcaataacaaaatgatttatggaccagtaccaatgttgaagaacactttgagctgcaaaattacagataaactagtaactgcaaaggttactctgcagctcacggtgacattacgtggcaaaaaaaaaaaaaaggctcaagcagacactttctgaattcaaaacagatgtcttttccaatacaaaccaagaaaaatcagtgtagttctcatgcagacactttttcctaaatgcactgaatcaacaaaaaggagaatgttctgattttctcttttgacaactgatacttatctcttcaagtggtcaaaccagagactgtctccgaacttccactcacatgagtttgagcatgtagcacgcctttttgggcaacaaacattatcacaatattagctacattaatgtttaaaagatgttagcacatgtgtagcttaaatatggagtctacaataattcatagctagtccctctcaaatccttagaattacaaaatagaaatgaaaaaatggatgaattctactgaatgataaacttaccaagatttaaccgcagaacacctaagagtccatatgcatccagtactttggagtatgtacccttgattgcctctttttctgcagatgctacaaaaaaaagttttagtttaagaaaaatgacctgaaacattggattctatttagctaagtataaatccagagtttcaatcaaaagtttctaaatctgatattcttaaaataaatgtactgcatattttcttaaactagtaacattagtattcttcccaaagagttaataaattattccaagaccatctattaattaatccatcctgtccactgatctgaactctgtcttcttacccttttattcttgacagaatagtgctcgacacttagaaactgacaaaacatttaaatgataaaagctaatggcaacacttgactacacaaatgtagggcaagaatagggaaatctgattctgaaaggacaaaagtctggtctttgccttgatttatttcttctgctataaagttaacgttaccttgttaatgaatataaaccacagaataattttcctaagacaggctattatgattattctattgagaagaaaaaacaacaaaaaaaaatcaaatcctgaaacgttaaagaaaaaaccttcctagcacttagcaattacacattaaaaatttcacaaagaaccaaagaaatattaacaaccagtatttcaaaggacaaatacaaataatacatcccacagtctacagttgatccttgagaaagataccttcctttccttccaggtttctttccttctttgcttttttcccttttccattatctacaccacactcaactcacctcctggctgactggttcataccttatttacttcttatctcttacacttatcccctttcctttatctacaaaataggatgtttggcaacactgacgtgttccacgttagaaaatcacgtaagtagatacttatgactgtctcatttcctgtccatctttattgccaacaaaagggctcttctcagcctactgctttgcctaatactcctttgtactttgcattagagatcttctactttgcctgaagctcttctccagagtcctatagaacatctcactttccctgcctgcttcacctcttttcagaccacgtaggcttaagccttcttcctagtgatctggcttctgccttctgatgagttttgctctgctagttgcagcacaggctaagactaactgactcagtcactcaattagctgatattttcacgattctctaacatgttcattattaagtgtgggccattatcaaaccacccagtatgaaattagggagtggagattcgccaacccgttaaagtgatggggatttatatttcattctgtattccttgagttcctattattattacatcttatgtttatccaacagttgatcctaacattccatgacaagcaacccaaatgtaaaacattacaatataaactttaattacattttataaagcaaaatagaattgccttctaaatactgcctcgttaagagtaccatatgtactgtaaacattagagagacttgttatacctctcaggacagaaggcatgacttccaggataaatattattctagaggtttacaagttatatgccatatacatttaaaatacaatcactaatatagtaatatagaaagtactagatatatccatttcagcagcaatcatcatttgggttcaaatgccaggaggcagtaggagttaagaagaaaatatagttttatttttatttttattttttttttttgagacagaggctggagttcagtgacacaatcacagctcaatgcagccttgacctccagggctcaagtaatcctcccacctcagcctcccaaggagctgggactacaggcatgtgccactatgtccagctaattttttttattttttatttttgtagagatacagtttctctacgttgcccaggctggttggaaactctcgggctcaagcaatcctcctgtctgagcctctcgaagtgctaggattacaggcatgggcaaaaaacatattcttaacattaagtcaccaccttcctttagaaaacagagaagtcattctataacttaaattaccatgtaacaaaatgttctctcttctaataatgcataataactatcttctcattaattacactccaaatacataaacgtatgtctctcaggactgatgaaggcccatctattagactatcatctaattcaaacatgcaaacaaatgccttgcagtttagttatttacatgtttgtattctattcggacactcaggaaacaggatacacacacacccacacacacaccttaaagtgcatactcttagagccaaaggtacttttaactccagacactccaaatttcttaagagaaaacagtatcttcttcataaatacatttgtatctgaaggacagtagatgtttccctactttacgatatatgcttcaaaggttttgagtagactggagggaggcccagtaatggccactaggagaaggatggcctgtgcaagaagctgaagctagaggcaggggaaaagggcgtccacttgtgggaggggccgcctggcatgagttcctgaagtctgactagggtgaggagaggactgtccacccatgggtgttaggggcaccccggcatggtaagttagagcttgagagggatgggaaaggcagggttttgaagtgccagtggggtaaggagggcacctatgcagtggaggaggctacactggcaataggagagtggttatctatggggtatgatcaaggataatgagagccaggtttctcactgtcagagaaggtactcacaaatgcaaacagagaaactagaatggacagtgttgattagaattggagttaccaggccgggtatggtggctcacgtctgtaatcccagcactttgggaggcccaggtgggcggattatgaggtcaagagattgagaccatcctggccaacatggtgaaaccctgtctctacgaaaaacacaaaaaattagccaggtgtggtggcaggcacatgtagtcccagctactcgggaagttgaggcaggagaatcacttgaacctgggaggcgtaggttgcagtaaaccgagattgcaccactgcactccagcctggtgacagagtgagactctgtctcaaaaaaaaaaaaaaagaattggagttaccagtgttttctagatagactaaagacagacaaaaagatagaaacacagatataagtatatatgtcatatacatatatagttacatatactccttagcactagccactgagcagacccaggatctacaatactctgacagcaatgcgcatacctagcatactttggcttctacataccattctccactaaaaggaactactagcattccttggagaaatggttgattccagggcaaaggcagggacaaaatgagcctaaaacatagtattgtgccaaaaagtaagcaagtgttcaaaggataattgagatatgtcacaaacatgcagaaggcagcttgaaggggcttctactggtgaaatccaggacaatttgagcatcaaaataaataataagagtaatgggttataagcctatgaattgaaagtctcatgaggaatgggcaaaacaattataaagggaaaaaaagtcttcccgacatgcctagcaaaccatcacctttatcaagtaatcaaagtgaacaccaacaggggcctggcacagtggctcacgcctgtaatcccagcacttcgggaagctgatgcagaaggaccccttgaacccaggagttcgagaccagcctgggcaacgtggcgagaccctgtctctacaaaaaaatataaaaattatccaggtgtggtggcatgcacctggggtcccaactactcaggaggctgtggcgggaaggttgattgagcctgggaagtcaaggctgcagtgagctgagatcatgccactgtactccagcctggccgacagagtgaaaccctgtctcaacaacaacagcaaaccaaagtgaacaccaacagtaagaggacaagtcaaaactgcgagccacttgtcaagacactatgaaaaaagcaccattgctgcaatactcctgccagaggtgaataacctgaatctacgcatgagccatcagacagacccaaagtgagggagaatctacaaagtaactggttttcactttcaacatttttaaggccacaaatgtcacagatcgagaaatttttccatttaaggagactaaagagacatgacaacaaaataaaatgtacacatctgaactggatccttttgctataaaagacattgttggggcaattggtaaaaattgaagagaggataaggattagatagccataatacatcactgttaattttatgatagttttacaagagaatgtctttctaggaaatacatagcaaagtatttgggggtgatgggtcatcatgtcagcaacctattcttaaaaagtccagagaatccactcagttctggggcaaaaaaaaaaaaaaagaagtccagaggaaaaaaagttatttgtactatacttcaacctttctttatgttttaaattgctgcaaaattaaaattttttcaatgtaaccagcaaaaataatttttaaaaatacatatacttattcccagataaagaagcttttatctctgacgttaataaggtaaactcttctaaataccttgttattccctccctgtacatttttttaatggggaaaaaagatttccttattttatgagactccataaacttcacaaaaatacatgatggaagggggatgaacctaattaaatttctgccccacttctctgataatttaattccagaaaattattttagaatcttctactataaagagattatttaaaataagaaaggctatatacaacattacataaaataatatgtataatctttagataaaatacagcacttggaaatattttacaatcatcaccatcattctttttcccttaataatctcccttgcatcccatgcttcagccaaaatgaataattttgttgcccacatgttccacattctcttccctttctcccttttttcatactgttgtttcatctggaccaacctttaatcatctttgtgtttccaaatattacctatccttcagttccaaattaaaacaccacttcccttcccaaagattttccctgatcactctagctggaggtaaatctttctcctattttatactatagttacatgtaaactagtaacaacagaaactaagtcttatttctttttcctttttttttttttttttttttgagacaggatctcactctatcacccaccctggagtacagtggcacaatcatgactcactgtaacctcaagctcctgggctcaagtgatcctcctgcctcagcctccttcctgagtagctaggactacaggcactaatactacaggactactactgagtagtattaggactacaggtacgtgccaccatacctggttaatttttattttttgtagagacagggtctttctatgttgcccaggctggtctgaaacttctggcttcaagtgatcctcctgccttggcctcgcaaagtactgggattacaggcatgagcaactgcacctagcctcatttccttatatctcaacacaatacctaacctaacacagagactctgaatggaacactgcaattgctgattaaatgttcatctaatagacaaaaacaaatggaaaggttgtgcattaaagaacatgttttgctaatataaaaataatatataaagtggatcacctgaggttgggagatcgaaaccagcctggccatcatggtgaaaccccgtctctattaaaaatacaaaaattaggtgggcgtgatgatgcatgtctgtaatcccagctacttgggaggctgaggcaggagaactgcttgagcctgggaggcggaggttgcagtgagccaagatgtgccaccgcactccagcctgggtgacacagtgagactccgtctcaaaaaagaggtaaaacattttactttatcattgaaagtatttgaatgccctcattactgagattcacattcaacaactcctcagttacgtctggaaactttcaaatgtgtatgcctgtggcagggagtagtaaggtgggggtgggaaatataggcattgttaaatggttgctaactagggtttaaaatactgaagtttatgaagtggcagggtgtgtggggagctcagaggaaacaaactgaaagaatgagcggaaatgaaagttcggaagataccgtgttagggaggaagttcaggtcactttcctgctagtgcagtctttcaaggcatccactgcactttcaacgaatggaataaactcccttttgtgaagaggtattttttttcccctcctattcatggtggttattaaacaaacgagatgctaggcaaaacaaacctttctttgtaagttactgatttctaaccataagtaggtaggaatgtcccagaagagaattgctttcggagtgattctgagcccatcaagatcgacagcagttcaggtgaggtaaggcggcctgcaccgcattagttcacatgctgaacacataagctaaagcaaattccaacttctaaagtttctgctataacacctcaggaataaatagtacctaactccctctatagcttattttaaaggaaaagactatttttcccatgtcatactcaacaccatctttcattcataccttttcttaggtaccttttttttttttcatttgataccagctctttattagaaaagaaaaacttctttgtgggcccaaaaagaatcattttgctgggtgtggtggctcacgcctgtaatcctaacactttaagaggccaagcaagtggattgcttgaacccaagagttcaacaccatcctaggcaagatagcaagaccccacctctaaaaaataaaaaataaaggtggaacaatatgtaacaggtgagggataaccaaaacttgccatataaagacaataagaagattttaacaattaacaagattcatttttcaatggcttgttaatcacagaacaattaaaaagctaaataaaaaccaatcttacttatgtattagaaatatatttcaattcacccatggatccaacacgcttttagacagtaaaatttttactgacttaagaaaaaacactgccggttgggcacagtggctcacacctataatcccagcactttgggaggcccaaggtgggtggctcactgaggtcaggagtttgaaaccagcatggtgaaaccctgtctctactaaaaatacaaaaattagcagggcgtggtggcgcacaactgtagtcccagctagtcaggaggctacggcaggagaatcacttgaagccggcaggcggaggtagtagtgagccaagatcacaccaccgcctttccaccctgggcgacacagcaagactctgtctcaaaaaaaaaaaaaaaaaaaaaaaagaaagagattttatggagtgtttttttttttttgagacagagtctcactcttgtcacctaggctagagtgcagtgacgcgatcttggctcactgtaaccttcgcctcctgggttcaagcaattctcctgcctcagcctctcgagtagctgggattacaggtgcccaccaacacgcccagctaatttttgtatttttagtagagatggggtttcaccattttggctaggctggtcttgaactcctgagctccggtgatcctcccaccttggcttcccaaagtgctgggattataggcgtaagccatggtgtccagccaaaaacactgcctattaaactcatgtacttatgttatgcttaaagagtattgacagaattctcactgccatgtgtttcatgtgaaagaaatggaaatcaggtggggtgtggtggctcatgcctgtaatcccagcactttgggaggccaaggtgggaggatcacttgaagtcaggagtttgagactagcctggccaacatggtaaaaaacccatctctactacaaaaaatacaaaaattagccgggcatggttgcagacacctgtaatcccagctacttggaaggctaaggcataaaagctcgaacccaggaggttgaggttgcagtgagccgagattacatcattgtactccagcctgagtgacagaacaagatgccttctcaaaataaataaataaaaacataaataaataaataaataaggagggagagatagtaggtagaaatatagaaaaacaaaagtgtccatgagttgatattatggaggctaggtgacatatgtaacagttacactatttctccaaataaaatgttaaaaaaattattacattctttgaactattggataaattcagaaaggagagagataactctggccaattatcttgagacagccagaagctactggaattctaagggatcagagaagaacttttctctaattaccctagaccaggagtgcattagccaaaagtttaacagacatttgaacttttttttttttcccaaacaggatctctcactctcacccaagcctgagtgcagtggcatgatcatagctcactgtaacctgaaacccctgggctcaagcgattctcccgcctcaacctcccaaagtgctgggattataagtgtgagccattgcacctgattgatttggacttttataaacttcaaagggacttgtaagtcctacaatctttagaatggccccatagcccacacttcccaaggctctcaaacactcatcaaatagtaaatatataataaattaagaaaggaaaagatttagtaattccagaatggaggccttaggaagggtaaatattgttataccctgccatcaatgttttccttatattcttcctaaataatttagttttaatattctaactgttgaaatggaaactatacttggaaaataataagtttgtttttgctcattatcacagaagttaggaaatatttaaaactatataaagccatgaggtagtaatatcctacaacttaattcagataactcaactccttccttattttagttttgtgcatgttttcaaacttcttttaactgaacaaattcatgcatgactgaagggagccccaacctacaacttttcctcgttaagctactggaaggtgacaaaaatagaaacggtagaggtggtctatttatagactacagaaaacactcagagtataaatatatcaattgttctctatcaaaatttaacatatcaattgtgctctatcatattatttgacatcctccacctttttcttttttctggagtgacttacttttttttttttttgagatggagtctcgttctgtcgccaggctggagtgcagtggtgtgatcttggctcactgcaacctccacctcctgtgttcaagcgattcttctgcctcagcctccagagtagctgggactacaggcgcgcgccaccatgcccagctaatttttgtatttttagtagaaacgggtttcaccatgttggccaggatggtctcgatctcttgacctcatgatctgcccacctcagcctcccagagtgctgggattacaggtgtgagccaccgcgcccagcaatgacttataatactatgtcatgtgacataactggcattattcagcattgttgtattacaacctcgtttctcaaattagaatttaaggcaaataatgaagtattaggatcaaatataaaaattcagatgaagacataatcatatacctatttcttgattttcatgagttgtggctctaaaagagaggcttgttaaacataacatagttgtcgcatgataatcacacctgcattgctaactccacatctgaacagaaaagaaacaaaattaacttcttatccaagagcaataggtaacttaaatgtcactttcattttactttaaaagtattttcaggattaaatttaaatgtaaatttctccaacttctgatggattataataatttaagctaaataataaagccatccaaatgaagggcctactatccaatgtcaacattctgctgtgggtcaaaccttgcagtctgagaatacactgttcttccccagctgatacagaagactaagctaaagaaggtcaataacaatgtaaaaataagactgcatgttagaatgatctctctagaaccacaatttgcctgtggttgcatgcactgcagtttgtggtgagcttatttgcatgcagacagcactttggtatagaaccagagaacctcctgtatgaggatcctagagatcatgtaatccaagcttctcattttcagaagaaaaagagtagagattagatcattcatccaagatcacataactagctggcagtaaagcttctttccatttcatcatatataaagagaaaaattattttaaaaggaaaaggtttctcttacaaaagtaattaaaattccagctgaaagatattaaactatctaaattaatgtcctatttaaacttcacattccaatcttggtgacatttaaggaaaaaaaaaaaactttcattcacgcaagaagtatttattgaatgcctaccatgcaccaggcccctggcaaggttctaggaataaaaacagtcagtaccgtgacaccttcttaggaatcagattaggaagacaggaattatataaccatacaaatgcaaaattataaattatagtaagtactataatggagttctaacagattacaatgggagaacctaattttaaattgtttgttggaggaggacaatgattagaataaacctcactgaggaagtgacctttatagtgagacaggaaggctagccaaataaacggtggagataaaaatgtttcaggcgacatacgtatatactgtgatccagcaattccattcctaagaatacagccaacagaaatgtgtacatatatgtaccaaaaaacatgtacaaggatgttcatacttgtgtcatttataatagcaaaattggaaataaagcaaatgtcaacaaaacagctaaatattttaatattcataaaatggactacactgcaacaaatatgagtaaactactgccacttgctacaacatggatgatttcccatatgtcaacatggatgatttcccatatgtcaacatggatgatttcccatatatcaacatggatgatttcccatatgtcaacatggatgatttcccatatgtcaacatggatgatttcccatatatcaacatggatgatttcccatatgtcaacatggatgatttcccatatatcaacatggatgatttcccatgtcaacatggatgatttcccatatgtcaacatggatgatttcccatatatcaacatggatgatttcccatatgtcaacatggatgatttcccatatgtcaacatggatgatttcccatatgtcaacatggatgatttcccatatgtcaacatggatgatttcccatatgtcaacatggatgatttcccatatatcaacatggatgatttcccatatatcaacatagatgatttcccatatgtcaacatggatgatttcccatatgtcaacatggatgatttcccatatgtcaacatggatgatttcccatatgtcaacatggatgatttcccatatatcaacatggatgatttcccatatatcaacatggatgatttcccatatatcaacatggatgatttcccatatatcaacatggatgatttcccatatgtcaacatggatgatttcccatatgtcaacatggatgatttcattgagtgaaaggagctagataccaaagaatacacagagaatgactccatttatgttaagctgaaaaacacttaaaactattccatgatgtaagaggtctgaatagtgattatctttgcagatcataataaagataactgggaaggagcatgaggggattattctctggaaagctctctggtatgctagtaataatattctatttctcaacccagttgtggtaataagggtatgttcattctataataatatatcaagctgtatgtttaagatttatatacttttctacatgtattataatttaaaaagcttattattttaaaaaaatacatttgagcagacggaacagcatatgtaaagaccctgacgccagaaagaatttggtacattcagaactgaaaggcggccaatgaggttagaacatagaaaccaagaggtaaagtggtaacaggttgaagagggaagcagaaactcgattttattgtaggtcatcttagagtttagattttaacttcagtggccaatcactgaagagtattaggcaggggattaataagatctaaaccatgttttttaaaagactggggtgtaggcgtggtaagtagaagcagagggaccagttaaggagggaattgtaatgatccatgaaagagacaacagtgtcttgattgaaacagagccagctaaatgcaggcagttgcatggaatctcaaggaaattaagaggaggaattgactagacttggtaatagagagaatgtgtgaaatgtgaggggaagaggtgttgaggatgattcttaagttgtttgaaacaacttggtagatggagtgcaatccattgacataagggagactgaaggaaagatcaggtttgaggatatgcagtggttggtaagaccatcaatacggtacctattccaactcttcctcatttggtagccaccaaacagtttgtgatactatggaaatcacagaaatttctaccttcttctgccaatgatctacctgatgcaaacagcacatgatatctcaacagtcatttttggttcaggaatacacaaacactcaatccggtgcaaggggaagtgcattttccttttgtgggttctaacccattatctgagtttcaaaaagctggatctcaattgtgtcatccaacataattattcaacccagctctcatcaatcctacgtcactttgccacaactaaaaatctgaaaactgtactttctactccattctctaagagaattgataaaactgggaacaagataggccaaagatatattcccaatgctaaccaaggaaagacaactaatgagcactaaggtacaaccagctagaaatttatttaattataagattctggaatttaaaaataaaaacaaaaagaggccgggcacggtggctcacgcctgtaaccccagcattttggggagctgaggcaggtggatcacttgatgtcaggagttcgagaccagcctggccagtaaggtgaaacctgtctctaataaagagatacaaaaatcagctgggcatggtggtgcacacccataatttcagctactcgggatgctgaggcaggagaatcacctgaacccaggaggctgaggttacagtgagccaagatcatgccactgcactccagcctgggcaacaaagtgagactctgtctcaaaaaaaaaaaaaattgaaaaaagaagattcattctacttatagttcacacatggtccacaggatattaaatgattttgtttatctatatttcagcaacacattcaagagattacagcaatcctatggtccactagtgaacagaatgaaacataactcataataaatatttattgctaagagctagttatataagtaaacacacctttatatataaaaagttaaataagactataatgaaatagaaacacaaaattttaataagtacatttaacatatagaaatatttaatgttttgagacaataaagtttttttttaatttttttcttttcactgactcagttggcccagaattatccaggaatttcaagggtctaaaattttttcattctgaactgaggaagtaatgagtatccaaccaagaagaatttatatatctctccaaatgccaaatttattttctccaagtgccaaatcattcatcatttggttcagtagctatgaaatgcaacccaatgtgaatgcatgtgctcacatacgtaacactactgatcagcaatggcttatatttataaactctatttaagctggaaaaagataaaatacaaattcttattaacaaccattaaaacactcaaagcaaattttaattgtcaccagtaaaaatcatgcacaatttttaaaactatacttccttttgatactctaacaaggctaaacaattgcactagcccattccactctttattgcttctttcactttgtatgcttctttcaaaatttcactgattcagactttataatctcaaaagttttgaaaatgttggtattggatactaagaaaggtaatactacaatattaaactgctagtcattataattagctcatattttttcaaccttcgaatgtctgaaaagtctttacatcttcatttgtggttgggtacaaaactctaggtgaatggtttggtttggtttcttccttccagtactttaaagatgttcccaatgtcctctggcttggattgcttgcaaagaaaagtctactatcattcttatcttcactcttctgtaaatgtgtgtcttttcttccttgggctacttttaagatcttctctgtatcactggtaaacagtaacttgatcatgtatttgggtatagtgttctgctttatgttcatttagcttcttggatatgtggattcatagctttcatgaaatttgcaaaagtgccagctattatttcttcaagtgtttttcttccctaccaacttctttctgggatccacatattcatgtatattgggtcaccggaagtcgtcctgcagttcactgatgctctgtgtatttatttattttagccttttttctctctgtattttattttggacagtttctattactatgtcttcaagtttgccaatcatttcttctacaatgtctaatatagtaatccctaccacatctagaagtctaatttgggtctttcactttttttttttttagagacggagtcttgctctgttgcccagactggaatgcaatggcatgctcttggctcactgcaacctccaactcctgggttcaagtaattctcctgcctcagcctctcgagtagctgggattacaggtgcctgccaccacgcccggctaattttgtatttttagtagagatgggatttcaccatgttggccaggctggtcttgaacacctgacctcaggtgatccgcccacctcggcctcccaaagtgctgggattaacagtgtaagccaccgtgcctggcctctttcacatttttcatatctcgtcttaacaggttcattttttcctctacttgttgaacatatggagtatatttacaatagctgttttaatgtccttgtctattacagcatctgtttctacatttgactttgctccttatgaggtatattttcctatattcctataaatattcttaaacttcgttctgggatacagttatttggaagttcggttacttggaaacagtggcatccctttgggtcttgcttttaagctttgttagggagggctggagtggaatttagtctaggactactttgcccctttactgaagcagtataccctttgcagtactcaacctaattctccatgcaggacttctccactctagttgttaaacatgaactattcccagccctgtgtgagctccagaaatttttctgcctactcctttttggtgattctttccctgcctcaaatggtttccttacacactggcaccgatcaacactgagctgaagtctcaaacggagtcctctacagatctctggagctctttgtgcaactgtctcatctctagtacacagccctgagattctggctgccttggcctccccatattccctactcaggaatcctgtcaagctttgcttgagtgactcttctgctgctgtggcctggaagctctccaggcagtaagctggagcattcataaaacccacctcatttgtttcccttctctcaggggtcagcatcttgtgctgccttttgttcaaggtctgcaaatcattccatgtattttgttcattttgttgttgttacttaaggtaggagggtaaatctagttcctgttactccactatggtcagaagctcccgttatagtcctgagttacgtatattttataggacaagttagaacatctgatagacctgagatgatgtaataaaaagccacagagtttttactattcagtgagagtggaagttctgcctttcctttttatttcctcatagcaaagttaagtggtgaagaaatgaaagcacttaagaactaactactggtttgaccctaggtcaatcctactaccaacccagaataaaaaagtttggttgattttctttttaaagagttgacatttaagttactttctattaaatacgtacattcctcagactacaggggcacataaaaaaagaaagaaaataaatatgcaccttccaaaggtatttataaaaagaaaatgaatttttgcaaccctaacataaagtgatatataacaagtctaaatttcatgatttctctgctgaaaaagtcaactataaaaagtcacttcttccctcaacttgcaaatttttctttaaaagagacaggacactgcaacttatctaaagggcaatcatgttgacagcgtttggcaattaaaaaaaaaaaacaaactacacacactgtttggcattaccacctactatatttatccaaaagtctagaacctgacatttaacttggcccaggaaagaaactttgtttttaatgactttactgtaaattaaaccatactttctcctctaatatattaatatgttaatagtttgtagggaaaaacacaagtgtacagttccctcattagaaaatgctaccaattacactcttaaccttaacgccttcccttatttttacacttcattccccacccctgaaaataatagccacacaatatatggtaatacaatagcctcacaacagcacaaacaataattacagtaaaaaaaaattaaatggtaggactatgtcattggggcagttatctttccaatcctcagtttccaaatctctgaaatgtggataaaagcacaatctgaactgaatgaaataaagtgtgtcaaatgccacatctcctgaactgtgtgctcagatgccccacggcactacagcaaactcccagggaagctgcatattttaaacagaaggaaacactgagattctcaacacatgctggaaaccagccaaactattaacctgaggtgcttgagttgtcatattagattgcagtgcattccttggatgatatatattagtgaaaccgggtttttgctggttgctgtgataaaagcaagtgtcacttgaaaatcaatgtggaacaggaaatgaggacggcagtgtactctgttccaaggtttgaaaagctatgcaggctgggagcagtggctcacgcccgtaatcccagcactttggaaggccatggtgggcagatcacctgaggtcaggagttcgagaccagcctggccaacatggtgaaaccccgtctctactaaaaatacaaacattagccaggtgtggtagcgggtgcctgcaatcccagctacttgagaggctgaggcaggagaattgcttgaacccgtaggcagaggttgcagtgagccgagaccgtgccattgcactccaacctgggtgacaagagtaaaactccatcttaaaaaaaaaaaaaaagaaagaaaaagaaaagctatttagtgctcagtgctcaacaagcacacacatctcattagtaaattgtggttacttatgaagaaaataaatgttctattttttctgcatttttttttttgaacagctacaaaagctgttgggacacaaatattttttggacctaactatttaataaacagaactattaagtattgtttgtggcctaggggtgttgtgaaaaacttaacgaggccaggcacagtggctcacacctgtaatcccaggactttggaaggccgaggtgggcagatcacctgaggtcaggagctcaagaccagcctgaccaacatggagaaaccccgtctctactaaaaatacaaaattagctgggcgtggtgccacatgcctgtaatcccagctacttgggaggctgaggcaggagaactgcttgaacccgggaggcagaggttgcagtgagccgagatcgcaccattgcactccagcttgggcaacaagagcgaaactctccctctcaaaaacaaaaacaaaaacaaaaacaacttaatgagataataaggtcaccataaaacaatgaagtttaaaaacctctggcttaatgttgtgactggcagaataagcttccagtaagtggtagccattatcatttcactacgattagtcctttacgcagttttatagaaaagagaggatatttcatattctgtaataaagatctcagaatatcatcctatagtattatgacttatattgagtattatatatagtattatgacttatgttgtaagaaaaaattaggtagacaaagaatctcataaggacaacttggaggaaaaccaggtgcagtgatatggccttgctatttataaaatgcatgatttgagtcctaatctgactcaaattatgctacttgaaaagcctgaaagtaatcttaccactagacagataaaagcaattcatccttactcccatgctagcatgtaatatggaaaagagcaaaagctttaattttaagagttaggaatccatggcgccacctcacctccccatcttttacgtagaggtccataacttctgtttttagagttatcctccatttcccatatgttgaccttttctttactccatcttctatttaggatataattatgaaatgaatcattcactttattgaagcctgagatgggctgtaaaatattgagattgtgaatttaatgcatgtatgtcagactgacagcttgtccttctcctgtgacagtctttgtgtatgtgtgtgtaaactggagaaagactaagaacaatgaattgtacacaaagctgagagacatcttttatctcttaataaattgtttccaggaaaaaaatatgtacctgtttataacttgctaaccatcacacaagctgcttaaactggtagatgcagcaaactagtcacagagctcacctgctacactgaaccactattccaaagacatcaaattgcaatttaatcaaacacttgctgtacaaatacttttcaaaactgagtaatgctaaaaatgggtacactcctaaaaaacatattaactgttatctaagggtaagaactttttagaaagtgttttaaataaatcaatgcaacagaagaaataataatgaaattattttctattttaaacaggtaattttgaaggccaggcgtggtggctcacgcctataatctcagcactttgggaagctgaggtgggtggatcacaaggtcaggagtttgagaccagcctggccaacatggtgaaaccctgtctctactaaaaataaggaaaaattagctaggtgtggtggggggcgcctgtggtcccagctactcaggaggctgaggcaggagaactccttgaacccaggaggcggaggctgtagtgagtcaagattgcaccactgcactccaacttgggtgacagagcaagactccatcttggaaaaaaaaaaaaagtaattttgaaacaaattaatagtacttatagaaataataagtaacatttatcatagacatttcaaattggcatttcagaagaaccttaataatgtggttaacagttatttccaataggatttgtcaataacaaatctaaataatgtgtaatatacatcttttatatcagcagttcagtcagataacaattctcaaaaacataggaaataggccaggtgcagtgacttatgcctgtaatcccagcactttgggaggccaaggcgggcggatcacctgaggtcgggagttcaagaccagcctgaccaacatggagaaaccctgtctctactaaaaatacaaaattagctaggtatgatggcgcatgcctgtaatcccagctacttgggaggctgatgcgggaaaatcacttgaacttgggaaggggaggttgcagtgagccgagatcgtgccattgcactctagcctgggcaacaagaatgaaactccatctcaaagaaaaaaaaaaaaaaaaatatatatatatatatatatatatataatgtatgcatgtatgtatatgaaataagttttatagggctgggcttggtggctcacgcctataatcccagcactttgggaggccaaggcaggtggatcacttgagttcacgagttcagatcagcctggccaacatggtgaagccccatctctactaaaaatacaaaaattagctgggcatgttggtgtgcgcctgtagtcccagctactcaggaagctgaggcacgagaatcacttgaacccaggaggcggaggttgcagtgcacggagatcataccactgcactccagcctcagtgacagaacaagactctgctcaaaaaacaacaacaaaaatttacggaaaaatatctcttattttcaaacataataactgcatgtttatcaactttgtaatctaggttagtctttcccttgctgtcattcatttaataatcacattttcttcaagtatgagtaaaacactacactaagcactaagactgcaaatattactaagacacacaggccttttcctcaaggagtgcggcatccagacacagaacctgagcagaattccatatgatatgaaggcactatactcaaagtgctacaagagtattagcacttggttcagcctgacagtttcaagaaaactacttagtagccccataaaagacaacagcaccaaaattctggaaacatggttattttggataaaatctgcaagccaaaaaaaagcaatcccctaatctatcatagaaaggcctaaatacactttgctcagaaatgagcatcacaatctaattatatcagaatatccagggggctagagcccagacagtagtatttgtaaaagctgcccaggtgactgtaacactgataatgtcataacatcatgactgatttaagcttagaatcctatcgacataaagacagagtcttgaggctgcattagtgaacacgtgggtccctaaggggatccattgtatgagactattttcattgtatttttacttgcaatcttttggtatgtgctaatagtatgaaagacaaaatttcatgttgggtatctcatggcacttcagcaaaggccaagaaaattaagtgattgctaatcctcaacactgtatgctgactaaaatgtctgtttaaaatttactttttaaagtaaagccagggcaagtagagacttgaaattaggaactttgtgtacataaagaccaagtcctgctaaggtcacttccaccacccctttccaagaaaaacacctacatatgagcatttagacaacaacaaaaccagcacataagaagtatgcgtcttggctgcgagcagtggctcacgcctgtaatcccaatactttgggagcctgaggcaggtggaaaccatgaacccaggagtctgagatcagcagggcaacatgaggaagccccctatctacaaaaaaatacgaaaaaaattatctgggcatagtcgtgtgcgcctgtagtcccagctactcaggaggctgaggcaggaggatcaattgagcccgggagttccagggagttcaattacagtgagctgtgatcatgccactgcactccagcctgggtgacagaacaagaccatgtctcaaaaaataaaagcaaaaaagaagtatgcaccttgtgatacagagtaagttctagagaaatgaagagaaggtagagataaaggtgagctggagtggttggggcagagtcttatgaaggaagaagacctgagtaggacctcggtgggactgacaggctcagattagagaagcagcactctagctgtcttggaggaagaaggtgtaaaaagcaacagtatgatgaagctgaaaaaagcatggtgcttgggaaggcactgaggaaacaccagatctccttaaaggagatcaacactggacaaatgacaggttgaggagtacaaacttaatcttggtgaaaaacagggttacactttgctttaatataaaaaatgattttagggctgggcgcggtggctcacgcctgtaatcccagcactttgggaggctgaggcaggcgaatcacctgaggtcaggagttcaagaccagcctggccaacatgatgaaaccctgtctctactaaaaatacaaaaattagcaaggcgtggtggcacacacctataattccagctacttgggaggccgaggcaggagaaccacttgaacccaggaggtggaggttgcagtgagccgagatcatgccactgcactccagcctgggcaacagagtgagaccctgtctcaaaaaacaaacaagcaaacaaacaaagaaaaaacatgattttagaagattcttcaggtagatgaatatgcagaatgcactgaaattcagggagctgggattattgaagatgaagagaacacattgatattttccaagcacagcttctgaatacaataggcatttttaaagtgtgaagattttaagtgaacactgtacagcacaatacaaaccttggtatcactccaaaatgaaggccaaattaattttaaaagtcaaatgacttaagaaggtttgttagctgcttaaatattaatatgttaagtattactgtaaagcttatagtaggaaagataatgacattccaagagattagacatccatttatgttagctttacagaaagagtcaatattccaacattttttttctgaattgctcacatagtctaaatctaatgaaaatagaatagcttagacaatattttaatattctttctccttagaatgcacattaatgccaaaataaatgttttagggccttttggtaaaaacaaaccattatttggcataaaagacggctgctggaggttttggaaatattattattcttaggtttcctaaccttggagtaaagtgtagcaataattctaaaaactataagtaatacacagtttgtagctgaacatttgacttgctattatgagtaatcataattaaagaaacatttagaatttatacaagattagtaagtcaggtaacgtcaccaaaaaacacaagcagctgaaaaatgcttcccatacaaaaacaaacattcgccccacccaacccccacaatattttaattcagaattcatcagtataagaattccacttgtagtaaaaaatatatgcaatggaaattaatactgtaccaaggtatagtttaaatacaaaaaacaacttgaagcaattaagtccatactgattgagtatagccaatattatttatacttatttcttggaagacctagagccccttctccttcattcaaaaaatatatgtaccaaatatatatttcttatatactgttctttgcttaagacttttcattatgtcactatctttttccccatcaagatgcaattatactatttagtcaagttaacactttaactgacattaatattctacatgcaaagagtgaggtcttatgctcttcatttattgaggctggagaaagcttagtagtttaagatatttaagggcttatatttgtaagtatgcctttcaaacactatttttaatttataaagatataatcagtaactaaactaatcccaacactaggattatttgcctaaatcatatatatgtgtatatataatcatatacttttttttctttttaatttttgaaacagggtctcactgtgttgcccaagctggagcgcagtggcgagatcaaggctcactgcagtctcgaccttccagactcaatcaatccgcccacctcagcctcccaagtagcggggactaaagggcacacgacggagccgaactactttttgtattttttgtacagaaagggtttcaccacgctgcccagactggtctcaaactccccgcctcaagcgatcagccccccttggcctcccaaagtgctgggactacaggcgtgagcccccacacctggcatatcttacattaagaaagacccagtatccaaattaattttaatttcatccatctgcccctaaaataactcaaacattactaatctatttttcttgtggtacaatagtccttttctttaaattagactatcaaaatacttttaaaaataatacaaaatcaatcatgtatctcacatgaaaatctagaggttgtttacaattcccttaatgaaaacacaacggccataacagaaatactccaacaatattggataatattagataatacctactactataactgacctaccagtaaatatgtcaagcaagacactgtatgggtttatgtgatacatgatacaaactgaaacaatatttctttggaaaaaacatttacttttagaagcagcagcagaacccaagaaagcaaaatcctgcaaccaaaacctgcatctccctgcaccccctcaacaaaaacctgttaacaaaaagtttgcaggaaaataagtttgattaaaaggaaatacaagcataatctgctagaggaaatacagtgaaagggttgtcgggctcttttctaaaaaatggttgcatctgaattgtttcaaatcaaaacagagaccatgacaaattgggctctaacagatgacttacagagcacagcgacagccccagactcgaacatgagacattcttccttatgcctagtttccactatgaggctgaaaggtgggggatccaatttgtgatagatccggaatcctttactgaacgccattctcctttcttcggaggcagccctgcgaaaaccaagcaaagcaaagcaaatgaagctgatgtttccttctgcagcaaggactgcaaagcatccaaaagtccctccccgccaggttttgatggggggttggggtgggaaaaaacagacagctctgggagaaaatggctttttccaaaagataagtcgtcacttaattttaccaaaaagcaagaggaaaagctatcaattctcataccaaggcaagacaaggttttagcactgtaagtcaatcaacggtctggttgagtttcccgtttaatttatgcttactgaaaggaaaaattttgagcgtatttcgtccggagctgtttatcagcttcctgcttcaagatctgtcactacgttgaaagggaacctatttggaaacttcaagcagttccttcgaggtgaaaggagcggaggtgggagggaagggtgacaaggctggttcaaagctccttagggggcaggagaaggaaaaggattatcccacgcgacaggctctcccgggggtggcgatgaagggcaagggaaaaggcacaggttaccgccgcctctcctgccccgggctaccgccggctggggggacggcaggcggggccgataaatacgaatggccacccgggaagagtcacgactcggggcaccgacccgactggggctcctcgggggtcccgggcagtcgactgcccgggaaagcggctccttctcggagagacggaagagccgagcagcccaaaccctccatttatgcgccagaagagataccccggcgcccaggcggattcggttcgttcccgcgggcgggctgacagccgctgtcaccacagcccccagcctgacgcggcaccccgcacaaccagtggtctgctcacaaccccgcccgtcctcccgcaccccggctgctcgcggtcgcccctcaccgctcccgctgacgctgcggaggcagagactggtcttggaggcgtccgcccgcccggctgcccgtgggtctggccgcagcagctccccgccccccgccggctt

SEQ ID NO: 786 - DNA, 99182 bp, Homo sapiens; identical to SEQ ID NO: 785

SEQ ID NO: 787 - DNA, 99283 bp, Homo sapiens
catggtaaagacagatatatttatttcatatgacagcacgtttcacaggatatgtacagaatgtctgtgtaccactgactttaatactgtacttctataaagtttatagttataaatattgtatgccacataagcaataaaattcttacatataaacagcaatctaatatagagaacacagagttcacaaagagatccttagtgtctaacttctgctctgcttttaacagaactagtaaatatttaataatacatagaataatggctagttatttgcagcatacctttaactttcataactttgtgcattttcagcaacttgccaagtataattttcctgataaaggctgggctgctgatatgtatattttagacagtagtttatattcaataggaaacattgctcacagatctgcaatttgcactagtgaagtttacctaacaatgaattattttgctaatggagagcaaataccatatacactagtcacatggatgttaaagccacagtttcaacaagttaattcacattttgaagcaactgcttatagtaatactgctgtttaagacgctactgctgaaatgattagaacctccaaaaagcacaatataaaactcacaagagttatttctaacagcaaatcttggctgttaacagagaagattacttctataaatatagtattttgataacatttgagcatttagaaaaatgctttttttctaatagatttgctttataagtgcagtgcagtttgctgtgcttttaacattctacatattcgtagccatgaacgctattttttgatattccctcaatgtacatctttaaaggttaagtgtggacataggaatttaggtggacatatacaactctttatataaaaggaatgttaatgtaagtcttaatgggtaaagatgattgtaactgaaactgacaaagaaacaactattgctcaaggagttttctgattggtttacttaatgatatcaaaatactacattctgtaaaaattctgtgtacttcttcaaaaaattaataaaagcgggatcagttgcatattggcagtgcaggagacaaaatccgcagctactttgaggtatagcctctaaaaacttaaagcagcatcatagatgtgttatgtagcctcgtaagaggggggagaacacacactgggtatattcccaattcaaagcactcaggggacagctgctttccctgctaaaagcaaagttccagagcaaaagcagcaaaaagaaaatatgggagggatatgggcaacgtatactcgaacgtacgcagagaagagagtacggttagctctaatatttctcattgaacttggtggtatgtgccttccctgcatataaggccatagtgcttttttgggagcgctagaatatccatccacttgacagtgaccacaaaataggctgtttccagctgcaagaacctcctcctggagaaaagcgtatgaaggtgctggagtgaaaagtaacaaggttgtgtgtatttgaaggggttgggtgtggaacggtagaaaattctgattctgtggtgagattattctagttttgaaaacaaaattaatgaaaggtccaaattacatttgcagccatctttttggtaatgtgatattgaaaaagggactttgttggaacttttaggtataatttggtctgagttatagcctagaaattaaagtatgaattgtaaaaatatgtaaatgtatacagaagtacatgtgtttgtatgtattatatatgtacacatacctatacttttttcctttaaagcaatgcctttcaaaactctgttcactgtaaccttggcagctctttggtaaatactcaaagataccaattgttaacaagtatgagagggctggtggaaatgtcagctgaaagttgggtgggctttttgagattcttcagaagactgaccgaaaagtttctgaataaggactgttttctaaagtataagtactttttatggctactactgtctcctattcatccaaagagaaatacatcaaaactccagttaacaatgagaagggtttttccttatttccaatatacacatagtccaactctgtacacatcaaatagtggtgttttgtgaagatatcagtgcacttacaatgacttattgcacataatgaaatactaatgcccaattctcttagctctatcctgccaaaagcaagtacccactgttttctattgcatggcgttatctttctgtaaagtccagtgtgggtgaagccttagaggccaaggtcgtgaaaggatctactggagggctggtgccgggcgggagcagagggacaggaggtggaggaggtcttcttgacggcaacacacagaaggagacatttgtacctttattccagtcatcattcaatgtcaggttggagccagaaaatgaacttggctgattacccagtaagtctgaacaagctgactttgacttccctttcacaccaaaatcctcttcttcctcgaaggttacccatcctttcgggttgctaatttttaatgtagactggccctgtagatcaaaactgtccttaaagccatcaagtgaagatgaagccctgcttttgttatgaccaagaggctgcagagaagggaaaggactgatagtaacgggctcttctttggagaaccatgaagttgcctctgattcttcagacttggctctaaatgggtttccaggagcagcagtcctgtcactgaaaggatttgtcctggtcaagccagtaataaatgggtttggagaacttcgcatattttcctgggattgactccgagctggaattggaggcattgttggcatgcaacttacagaactcaaaacattactttgcgttgcagaaggcaactgaatcaacctctttgggtctggggtgggaacaggtgacgtttgaacagatagctgagcctttgatacagcaagcagattaaatgacagatcttcaaatgggtcaatctttaatggtgattctcttttgccatcagagattccatttgtttttacctgcaaaagaaagggagcactgaaaaatcagtttatatttactcttaataccccctattcttcctgtctcaattattcttcccttttaggggcaagcatgtaaatttagaaactaaaaagtagctttgtgtagtttgttactccggtggtttaaataacatgaaacacctacagtctttaaaaacttctttctaaataaatcctttctaattaaatccatttttaaatccctcaaaatcaaagagcttatttcattcatgcaagttttgaaatggtaagaaggagaattgtacagaattaacaaatttgttcatgcccagttctatcacatttcagcatgaacttaagaaatccatacttataacttatgctaaatctatataaataaaattctaacacccatctatgatgatgatgtggtttcattgttcttttaagtgtgttttctaaaattaatgttactatggaaattcaattttatagataaaattaattctattagcatattttattcctaagacgaagactccatctttctgtcttctacttggaaaaataaattttgagagttctttgcccaccccctcttttttttttttttggagaccaagtcttgtgctgtcacccaggctggagtgcaatggcacgattttggctcactgcaacctccacctcccgggttcaagtgattcttgtgcctcagcctcttgagtagctgggactacaggcgtgtgccaccaggtctagctaattttttgtattttagtacagatggggtttcactatgttgcccaggctggtcacaaactcctgagtgcaggcaatctgcccaccttagcctcccaaagtgtcaggattacaggcgtgagccaccatgcccggcacagctgacttttaatgtaagctctcctttgttgaataaactgagtaatgtgaggctgggcgcggtggctcaagcctataatccctgcactttgtaaggctgaggcaggtggatcacctgaggtcaggagttccagaccagcctggccaacataatgaaacctgtctctactaaaaatacaaaaaattagctgggcatggtggtgcgcgcctataatcccagctactcaggaggctgaggaaggagaattgcttgaacctgggaggcagaggttgcagtgagctgagatcgcaccaccgcactccagcttgggcaagagcaaaactccgcctcaaaaaacaaaaaacaaaaactgagtaatgtgacaactttccataaaaaaattgaccctcctgtcttgtaaaaatattccaaaacagatacactattagtaaccaaatgcaaccattgcttaaaaccagaggaaaaaaagttccattttctatttggtttatgaagtctacaaccacaatgatgtgcctagagtggtgcctggtcccttctatgtgacagagttggctgtgaactgttatcagtaggaagagtgcttggaattccttcactcctgccctaaatcccttggtccctactccataaagaaggtggttggagtggagcacagccaagggactgagcaaagacaaatgatcggatgaaggaaaagaactatgattcttgcctcataagcaaattagcttatcaggcatacattattaattttgaaaaaaatgtatataattcttaaaactagggtagatgacttggacacttatgctaacttaagaaaacttcagggttggatacgatagggcaaaaaaaaattcagttcaagactggcaatgtaataaaatgagcactgcccaaaaggaatttggatagttgttaaagcaacataactatactttcatgaaatatattggaaaaaaacagcagcagtctcaataaaatgtaactgcatactatgaaacacttagttactgcttaagaatatggaaggatgttcacttgtaaaaggaaatggatgacttaagtgaataactttcaagtatctgttttattcaactatcctagaatatgctttataattggttgaaacagtatatttttcttcaaacttagtgtgataaatttgtacaaaactaaagagaaaacatgtcacagactttaaactgtactctaaatgtcttaggtaagtagacctatatgtggaaatgtacttaaaaggaaatttatatagatattataaaattaactctatattaccaaaaatctctggactatttatagttaatacaaaatgaaatacttctgtctgagacaaaattctcctatggcagatagaatcgtctgcaacacagacattataggaaaggagaattttgtgctctgccagcttagaacagaagtcacctgctgcatcagtgctatacatttaaacacctttatttgcatatataagaaaatttttatttcaaaataagttaatttgatagaatcaggatcatttttcccagacttgaaattacaatgacaaccacatcaccattcatcacattagaattaatttgtaatctaagcaggatttgtgatgacaatattaaaattggtgctatttttacagagaaaggtgttggaaggacctttagataatcttgttatactggtaactttcatctttctaaaccatcaattcttccttaccaataacaatcttgctactaaaaccatttgaaaaaatatttcccccaaatattttttcctaaaaaacatactgaattttgtgtttatgtaattacataaatgccattgttaaaaccaagaaccgatctggttttgccaaaaaggccttcatatacctaaatcttactttcttgaagttacactttttagttttgttaattttcataaaaaaatgaagcaaaaagtggtaaagcattagcaagaacaactacatggttcctaaaatccaaaatactaagaaaaagaaaaagcaggttttatggtatgatagaatttattaatggagacaggtggttttaaaaatgggtgaaactttagatgtatgaagcagagattcatacatctaatgtgttgagacggatgaaaacacatgtaagattgataaattgtcagatacctgttaccctgatggttgctcctgctttgagaaaggaaacagacatcaaaggaaagagttaggaggacaatccgagatcaaccagcaaccctaacaattcagtcaacaaaatgctttctaagttacagacagaacccaagagcagcaatatttgcaggttgtaacataaattcaaaagacaattccaattccttttataattttgttgaattagggtccagactttagttttgtctgaggttgattactaaccagttcagttttgttattccaaaaataatactccaaatgatttcagagttctaaaatattttaagcaacctgttatggactgaatatttgtgtgctctcccctcccaaattcatatgttgattccataagcccctgtgtgatggtatttggaggtggggccactaggaggtaattagagttagatgaggtcatgaaggtgggaccccatgatggaatcagtgtccttatgagaagagacaccagagagcgtgtgcaagggtgtgtgcatgctctcattccaggcaccacatgcaatgaggctgtgtgaacacacagtgagaaggtggctgtcagcacaccacaaagagtgccctcaccagaactcaaccatgctggcaccctgatctcagacttccagcctccaaaactgtgagaaaataaatttctgttgtgtaagccacccagtctatggtatttcatatgtcaacccaagcagactaagacacagccttaggatagcctagggatgtcattattagagaaaatggcaatgtaatggtacaaaatggtaccatttttggtacatactattttgcaaaaagactaccctactgaaaattagtactcatccagcttgttttatcttactcaaattttctgaaggatgatactcttaatatcattaatttacttcataatgtattagttggaaggtacaagaaacttgtaccttacaagaaatttggaatttacctttgtttaaaaatgaaatcataatccctctataatataccattattttttaaaatctagtatcctcaagcaagttttgaggtaaatcttctccaatatctaaacctattactaaatagcaaaactaattttgacaattcagagacatcacccagaaatatattaagtactttagaatttcctgcctagtaaacatgagactcttatttaacactcagagttttatgtatcagctctggcagtggacaggagatcaggaataggtttatactgagaggtacaaggttgctgtatcctccattaaatgggtctagaatgctgtgatttttctaccaggtctcacagtaacagtatagcagtgagttcggttcctttacttccagttgcatttccttatttctggctctcagctgataaagatgactaagatgctagaagtcagatagataagtgaggattttttatactttgtaaaggacgtataacatgttatataatcactcgaattaaatgaatctcttctatacaaaattataaagtcaaaggataaataataaaaagtaaaactgggtcatatacattatgttttaaataccttgtagatttggaataggataagtaaagacttgtaaaaattacaaatgttcaattctaaaactatttcatgtcattacaaaatatcaaacttgtcatatttaaaaatctcaccatcaggtttgaaaatcttgtaaattgttcaacttaacagctacttccaataatttaaaattttttttattatttttaaaataggcattattttacggttcaaaattcaaaaggtacaaaaagatagaaagactcctcctcacctgcctcctggcccccagcattgggcattccctggaggaaactgtaaccactttgtgatccctcacaatgacactctgcatgtaaacaagaccccaccctccaagaaagaaaagtgtgtctgtgtatctaatattaaggagtttgatatcaatgactgaggcaaaaagatacttcaggatttgaaacaaatatctttgtctttttgatgaactgacaaccatgagattcaagaacacaatctaagggggcacacacaaagcatgtgcccgtcggccaccaaatcgctatactcacttcaatgaaaaacataaaacaatggaaagttttctgagaaaatgatatgtgtcttagaatgattttataatgataactacaatctcagctaacagtttgcacctccggaagtttttcagagtactttatctacttttgtattggtctaaggacacttaaaccatcagagttttagtaattatggcacgcaactacaatgagatggatgccctaaaacagtcctagaaagctcagagtggctagttgaaaaagttttttgcccttcaattacattttaaaaactacaaaagagtatacaagaaaataagaaaaattcacgattcactaaaaatggattagcagaaaaaaaaaatcattatttgaaagagttctaccattattatatattttcaccatcctcaatttttcttttttcttttttttttttttttttttgagatggagtctcgctctgtcacccaggctggagtgcagtggtgcgatctcagctcactgcaacctccacctcgcaggttcaaccaattctcctgtctcagcctcctgagtagctgggactacaggcgcacaccaccatgcctgggtaatttttgtatttttacaaaacaaaagagacagggtttcaccatattggtcaggctggtcttgaattcctgacctcaggcgatcgacccgccatggcctcccaaagtgctgggattacaggcatgagccaccgctcccagacttcatcctcaattttctaaactaaaaaaatatagaattctttttggtattaaccagcttaagggaacatttatttttctgtattatatatccttcaacttttacaaatgtgacttaataaatgctaactgctaactttattcatattgtattgaatcatatttactttaatatctgttttcaccctgtagacacttaagaaactgctcacttctgccaactagctggacatacctatatatctgtaaaaataaatgtaaactattacttataaatgtgttaaagggacattgccaatacgtattatttctgtatttcagatctttccaaagtgtaaaagaagactttttatttatttattattatttttggaggtacagggtctcactgtgtcaccaggctggaatgcagtggagcgatcatggctcactgcagccttgatgtcctgggctcaagtaatcctcccacctcagactcccaagtagccaggaccacaggtgcatggcacaacacctggatagttctttaatttgtagagacaaggtttctctatgttgcccaggctggtcttgaacttgcaggctcaagggatctgcccacctcagccttccaaagtgttagggttcactcatctcacagttttttcaaaagagtttaatgagatacttttaaggaaagatcactttgaaaattcagagtaggctgggcatggtggctcacgcctgtaatcccagcactttgggagactgaggtgggcagattgcctgaggtcaggagttcaagaccagcctggctaacatggtgaaaccctgtctctaccaaaaatataaaaattagccgggcatggtggcaggcacctgtaatcccagctactcaggaggctgaggcaggagaatcgcttgaacccgggaggcggaggttgcagtgagcggagatcatgccacttcactccagcctgggagacagagcaagacttcgtcttaaaaaggaaaaaacaaacacacaaacaacaacaaaaaacccaaacatatatatatatatacacatatatatgtataataacaaatataaaaagaaaattaaaactcgtatttatttttacttcttataacaggcaataattaaaataggtatgttcaaagactaaatcatatgcatcaaagataatattttgtgtaacaaatgagacttacttgcggttgtgaggaagcttctgaaggcaagctatgggatgacctgcttcgaggtggtggttgtggtggggtttccaaatttggctgggggccagactgaggcataggtgctgccacagggacaagaggctcttgcaacctttgagcaggcgggggcaaagaagactgcggaggaaaagcagcctgaggcttcagtggttcaggaaggaaagttgaacctaaaaaaccagtggttgtcagatgttaggtatattctagaaaaccatgtttttttccttctttagtgaaatgttaggagaacattctagttatttcttcccccaataagtagcctcatttcttgtggtataatgaaggaaggatatagctatctgaatatatgttgtagaaggtgggagatgacagaaggaaaaagagaaaaatatacaacaaaaccagtacagtatttctaatatagtatctacctttcttttctctcaatttttaaaaatttttgatttttgagacagggtcttgttcttttgcccaggctggagtgcagtggtgtgatcacggcttaccacagtctcaacctcccaggctcaagtgatcctcccaccttagccgcccgagtagctgggaccacaggcatgtgccatcacccctggctaattttaagagtttttaatttttttacaggcgggtctcactatgttgcccaagctggtctcaaatttctgggctcaagtgatcctcctgcctcagcctcccaaagaggacctacctttcgacgtttctgatgttttgctttggctttcaggagtcagtcttccagcagatgcccgcgcgtggctctgtggggcactgataactccagcacgaggaggaatcgtctacagataggaaacataacacttgagacatttacttaccttccacaggtaaaattctgtgaaaacatttgcttttgcatctcatttactttcttctatggtattagtccctaatttgtcattttaagtgctctctacttgaagccattataatgatgaattttaaaatcttcctgtttacttctgactatttactatgtgccagacattatgttaattaagtactgtacaggcatttccatttcatcttcaaaatatccctcagaagtaggtattattttatcatctctattttaaattaagatgaagaaatatatacaacttgcccaaagccacacagaaagcagagccaggatccaaactcaggtctgactggctgcagggctagggttcttaaccatgtgcaatgctgtctttatggggaaaactgggatgattttaaaatatacaaggagatagagagatacatacctgagcaactaggagactttggggaaaaaacaccctgagatttgttttttttttggtttttttttgagatggagtctcactctgtggccagacgggagtgcagtggcacaatctctgctcactgcaacctctgcctcctgggttctggcactttcctgcctcagccttccgagtagctgggactacaggcgcccgccaccacacgcggctaattttttgtatttttagtacagatggggtttcaccatgttggccaggatggtctcgatctcctgacatcatgatccacccgcctcggcctcccaaagtgctgggaccacaggcgtgagccaccgtacctggtcaagatttgttttttaagagatggggtcttgctatgttgctccagctagacttgaactcctgggttcaagcgatctttccaatgtagtcccctgcgtagctgggactacaggtgcatgccactgccacccagccatatatattgcttttaaacacagaagtacaacttttgaatgactaactcaatattccgaattaaatacactgaaagactcatcagtgaaaaatattttttctattttcatatgtttgctgaaggatctaagctaacaatatttattttaagcaaaatatgaacttttaaactcacaaaaatcctgactttcttttcctatacttatggtattcaacagaatcaagaaagttcttgtgccaagtgtggtcatgggatcagtgaatggcaaatttccctttttttgaaaaaaggaggataaatatttgaagagtaatattacatataaaaaagaaccttcagattgttaagtggacagctacaacagaaaagacaaaaagcttctatcttcataggaagtggtttcctcagttctcacaatcttaataatcttaatttctaggtacagtaatagctctcagtttcctactcttcagatatgggcctctcagtagtcccagctcctactggactagcctaagtcactgattactggtttctatttgctctttctctctgttcttgattacctgttatagtccagagaaagttttcaaataataaaaaacctatgtgtataagagaacatataaacatacagaaaagacacattcatcaggtagggaaaaatcctgtaacaacatctactctcctatttctaatacctttacggaatatgatgaacctgatcaagaaaaaaaccaaaaagagaaaaaaacctttagaaccagttttactatactgaatttatcatttttttttctgaaatgtaattaaaatcctttttaatgaaggattactttatatcttcattaattactcaggtaaaatgataaaaagctgcccaaatccatcatttcctcatatactgagactcttaagatatttatttagtgaccataattgttttaagtgtatcacttttatccaaataatgaagtttgttatttttgaagagtatgttaaaataatgttagagtcggaagatcatcaagtgcaattccctcattttagagatgaggaaattgaggccttgaagggtcacatgatttctccaaggtaacaaaactgactagtagtaaacaggacttagaaccgagaccccttggccccaggcgaggttttacctaccggtctggctgtactgtatccagcaggtcctgggcctgcaagtcctgcttgaggtgaaggctgactgcgtcctggaacaaagacatcatatcatatatttaagtttaaaaaaataaacaagaaaccatgtacttatattccaagtgtctatttcacggtccagttttaagggtgaatagctacattcaagtgtttttacctatattatctttccttgttgttccagggcttttgggtgctttgaagcaagaagggaaaaaaaaattagttgtaagttaacaattaagcaatattgcataacatcagcttgctgttctgcttcattaccagcagaaatgggggcatgagatggtaacaaaacaaagcactttgctttgtataatgatgaagggtattatcagtcctgaatgaaatactccaaaagagagaaaaattacaatatttagatagacctttatgggagacaagtggtgactttagtttgatatctcactcatgggaccacttttagggtggcattccccatagaactctctcgtgaaccttgaaaacatacagtcagctgtgtgaatggtcacaagatgcggcactgctgccccttagagtctggcagacaagtggcttctgagcaacagacaggactgcatttgtcaaattacacaagaggctcctagtagcaatactttagggcttcacgctgtagatgtcactgtggataaggttatcttatgatgagatctttcggatttctataacaaaatcccatcattaagacagaagacaggcatatgttattaccaaatatctgccttatggaagacagtgttaaaaatatgttcaaactcattagaaaggtagctgaaggataaaatgaaataaattactcttggagccaaaaggagtaggagtgactatcaagggcagcatcttaaataaactctcctttttgtaaagaaattcaagtacaattgttataagaaatacatcagccttttaataactaaaatcataacaaatggcctctagtcttaaaggtcttttaaacaaatctggctcagtgctaatctataaaatagctatgttatctgaaatcaactacaaaatactatattcttggatctgaattaatagggtttaattataatcattaatttttaaaacttcagattagtaaagtacatttctaaatattttacttattctgaaaagaattttgaagacattcttaaacagtaatttcacaacctgggcatatataaactatatatgaaacagagtacaaacaacattaaggatctcagggaaattaaatggatatccattagaaactataggtgacatagaatgaagagaggaaaaaatacaaggtatacataaggaggggaaagagaagtttacagctggaccaagaaaagatttagtatgcctgcaaacactgcggggtggggaggtggggcgctgacactgagaaataaaatgagagaaccacttctataatgcaagagtcttgttaccttccatctctctcctagctaccccaggactgggaggggctccaatacctttttagagaaagaacagaaactatatattgttcagggcccacagcacagaatgaaaggcaggcacacaagacaatttccatagtaaactcacttttgcaaaaaggctcttttattgctttaaatttcttcaaagatatcaatacaaaccaaagtgactttagatgcttggcccaaatctgaatcctccctttactcaaacagaagagtagaaacaggatgacagttttctttttatgtatgcaattactaccagtagggaatttaaaaaatatgtttaatgaagacctttgctttaaaaatcatcttactccttatatccagagcaagtaaaaactctgatatttgatagtcaaaaggaaagaaatcataaatttctatgagactacgtaagtcttttgaagttagtttttgatgcattaattttaaaaactctaatgtactataatgacgtaaaggaattattgtttataggatgaaaaaacatgttgcaaacactacttacaaaagaattatgaaggggagcaatttttaaaattaagacagatttcactgtaatccactggcttgcctaacttttgacagattcattttaaatttattttctacaggatgttttcctaattaaagcagaagataagcaaaaattatcatggaaatttaaataaaagcaggagcttgaaaagggaaaaattaaatgttttctataaaagcaggagcttgaaaagggaaaaattaaatgttttctgtaggtcaatggagaaatgatcacttagctgtattcggcagaagctgtaatgctgaaataatttagctattcttatcacacgcagtcattaagatctacacacaggcaaagtcagtctgtagtaagacctgaattgctcagccatgtcactaggcaagctacaatagaaacagaccaggctacacatgcacagtgagccttagtaacactggatttgtaaaagttcttctgaggaattgtgaaaactcatctcatcttttcttgagatttagattaaataaacttgtcaaatgtataactccaactgagctctgtgagttttcatgtaaaccaaataaactatacttcaaacaaaaagtgaccctttgtgaataaaaatttccttatgaagaaaggaaaagaaaatcatacagttctttgctaatccaaaagcttttccactagaaaataaatgtatcactaatcagatacttgggaaatgttctgtatttactgtacctgaatgacttttaaaattaatataacttttgggtattaaatctttgtaaatgaatcgaccacatttattaaaaaaaaaattaggcctgatgaacaatcccagcctacctgggaaatgaaagcctttattagttttatttgtggattagttttaaactagaatgtcattcattttgacttttatcaaacaaatctaaaatgtctttcaggtgtaaaacattaatgaaccacgattcacacatgctaacaaatgtaaatggttacctccaaattcctttctagtgggtgcaggactcctagccccttatagttcataagaaaataggcagcagaaaggaaatgacattaaatacagaagtgaaatgtcaaagattgctatagtatccatgacatcaagtatcatgcaggaattacatattatctacgtactacaaaaactattattcaatgcatatgcttataattgaagtaacagcactatatttaatttaaaagaacattaaacaaatacatacaattgtacattaatacgtatgctctccagttttattatacttttacagaaattagtacattttaattattttatgcttataaatcatccagaaatgaggattttgaaaaaaattaaacctaattttacctaagaacagtttacatgcctaactagatcaaattagcaaaaacaaaataaacctctctggctggctggtgagaaggcagctaaaggcagctgtgaaaacaccttagaggaatctactctgcaaacactctaccttgtctgttgcgcctaccatgttctttagagaaaagctaagaaatagcaataatgatagaaaaaactgtaaaatccagaagctagagattggaaaacatgcaaaacattttaaaatagagtgaagaattttacatctagcagaaatggaaataaaaggttgtcacctgaaggcggaggaggtctctgtgggggagccgggcgtgtgggaggggcgaccgggcggggcggcggcggccgcttgggctccaagggctgggcggggtctttctgcggcagcggcgttgctggctgcgcgtcaataggagaacctaaaaagcgcacaggaggtaagaagatcagcttctaagtagctgttgacagaagggaacagtccttcatatatatgtgtaatgttctataaaatgtgcacaatggtgtaaagaaagggcatgtattttcagtatgaataacaaaagcagtctactattaaactgccctttggtaccatggcagcaataatgctacctctgtgctgacttcttacctaggcctcaggtgctgaaagctaatttactaagtggccctattgatatgcacaaagtattgtttgagttaagccattttgtagtctggccagtagagagaagaaaaagctcaaatagttaacgggttcataccatagaaaatcatcagttataagacatagacaaacctaaccacatagaaaaaagattaagaacaattgtcatctagtgacagttatagcaagtttcctttccattgagagcttatcatctacaagttttcctattctgtaccggagaaaacagggtgcactttatcacctaggtatgaaacttaaacgatgactctccaacatcaagcacattggccacaggaagccatacaaaactttcaaataaaatgcatactctgtgcactgggaggcccaggagttcttgacggtgctcggcttggtctgatgggaagggaaggtacaggaccctctgatattgtaggtgactggcagggactagttcggggtgaagagctgggggaagtaccaaggccggaacttgaagatggctggagatgctgaggaagaagttcctccacttcagcactatagtcatcaacatcacctaaggaaaagcaggcttgatcagagataactccattttaacttgctcagagatttttttcaccttaggttttaaaaagttaaaatacacaaaacaaatatgaacattatgtcattgcaaacacacatggattaagcatgaaggcatgtataaaaccacaattagtagaaatgcttgtttcagaagatgtaaaggtatctattgtctctgagcaataagatgtcaggtgaccaaccacttggagctggggtgacccaatgggctttcaatatgccccagagcagcttctccagtgcaagccaactcaagtttcctgctctccttccaaacctgtccactgtgctctgtggaactgccccactcccttgcctaacccaggtccagcctcagagtcaacaagctctcaggagccacacagtcttcccccagaaggctcctccctgcaaccctcaccccacaaagacccgctttgctttaattaagtaaacactggttctcccccagggtctcctcatctccacttacttctgggtaggaaagtgggcacaaggtaacccttgcaacctaactgccattccagaacattagtcttccaaccctgaacaaaaagtcctactgctctgaggctatgccatcaggaatttatgtaacatcctctacccccacttgctacagtcatctccaacgtccattcttccatttcctgaacccactcactgaggactaagcagagagcaagactgtaagtcaggtcccgcaccatctttctgcgtggcatcaaagtccatgtggacaactcgttcaatagcaaaatgccttggtcctatccttatggacattcgccttcactcctaaccctcacccctcagaactgcactcttctgaaataataaactcaaaagcttcactctgactttggcctcccagcttttcagttctctcccttggctactccttctcttttgatttcttcagaagccagggtttgatccctctaacttttacctccatctgattctgctttcttctgtacctaccttcagattctatggttcttcatctcaaacattaccctacttcactcttcttccattgcacgtgcttgacataaccccatccctgcactgattcccctgtttaatctttctgtgataacacttggattgctgactgcctctgctaaagaaaaccacccagtcctgacaactgcagtcacatttgaaattatgcttttcagtctcttctggcctaaagtgcctggcaattccatgatttgctggtttgctcttcccctcaccctttgctcttcaggagctttactgcaaaactccttaaccctcctgaaactgtgagctgtcccactcctgcagatcacttcaacacttcacagagaagagggaagtcttaagatgggaacccctacttcaacagcctgcccccaagctggagtctcattacatggttgtcacttgggtatctgaggatggaacaaatgggccccacccagcctaattttctcagtgacactgctctactattctgccttgcccttcccccaaaccatcagccctttctcctctacttttccattagcactgtgcattctcaagcctgtcccatccaaaaccaccaccctaggacctccaatcttcctagagcaattgccctcttctctttccccccaaactttcttaaagagttgtctacagacacttttctccacttcttcaccttccatccatatcaatttaccactatctgacttcatcacttctgagatcactctcatgaaatgtcaacaacagcttcccttcctgttattaaatcagaaggacacatttctgtcctcatttcttctcatctttctgtgttacaagacaccactgactactccccttccatgctccactttctttccttgatttttaagccatgaatttctcttggctctttgacatttctagaaacaattgccattgtttcttctcattttcttttcacgggcagccttcttctgtctatatttaaactctgtgtttccacatactcaatcccaggtctgtatttctccatattcgattcattctcttctgtctcgtcataatcctattggccaaagttatattaacaaatgcccatgctttgcaggctattagagctgccttgactccagagctctttcctgagcaccagactcatgtttgactgactccatgaacatctcaaattcaacatatccgaaacaaaattcatcttccatcccacacctacttctctctctgcatttcttttcttcatttactccctcacaaacatccctccataatccatttggatcctctttatccccacttagactgtgcacatgctttcttcttggatcactcctctatagcattaattccattctccctgagtctttggattctcaacttaaatttcaattcctctgggaaagcttgcccaatttcccaaatccaggttaagcaactttcccatgagctaccacaaaaccattcattatcacatttatgtcactttattataattgcctgcttacttacacgtaacacccaataagctatgagttctggaaaggcaagaaccacagctgtcgaatctccagcacccagctgtatctggcataaaggtactacataaatatgtgtggactgagtaaacaaatgaacagataatgtgaaaatgagataaccttgtaagacgttcaactcttaaatgtggtacctagctatacagggcattacaatattattataatctaaggtatgcattttaatgaaaaactggctagaatagcatattgtgttagaaaacaaatgcatttaaaaattttttcttttgataatgttgccatcaaacaaatgcatttttaaatcatgtttaaggaaattttcggcgtaattacttaaattcatttctgttcttagaatacccttttggaacttctacttttttacctcaactttaattattgggactaaaccatacaccaacaatactaatttgggtatttatccaataagaatataaattaacatttgtaaaggtcttaatatttgaatggaagaatggtaaatacatttaaagtatacgcaaaataaacacaatatgatgtgaaataaatttgttttgttttgttttgttttgagacagcctcgctctgttgcccaggctggagtgcagtggcacaatctcggctcactgcaacctctgcctcctgggttcatgcgattctcctgcctcagcctcctgagtagctgggattacaggcatgcaccaccacgcccagctaaattttgtacttttagtagagacagggtttcgccatgttggacaggctggtcttgaactcctggcctcaggcaatccaccctcctcagcctcccaaagtgctgtgattgcaggcatgagctgccgcacctggccaaaatacattctaattaatagtgctatgtacgtcccaagaagaagaagaaagatgaacttggaaaataagactttacagattggaagaaaacatatctagaactacaagaagtaaatgtgtttaagaaacaaaccttccatatcaaaatctgctgcaacctctgcatcttcaccaagcagggtagagcttgttgatgatggcaatgcaatgctaattttctctaaactcatttcttcttccaaatttttgatccagtctggactttttaaagcaatagttatagtccgattcaataactagcggagtaaaagagatataaaataaagattaacatgaaagctaactaatttggaataaagaggctgacttcgttaaactatgcaatggtatagacagttaatttagttagacaattcagctaactaaagaaatagttctttcacatatactaaatttcaaactagtttaaaggttgttcccagttctccctttaaacacctgtggtgataaataaagatcttttctaggatgcccagagatgcaagtttcctttgctacaaccactatgttttcctggccagatgtaaattcaccaacaactctgctacataactttatactttcttaattttgattcacagattaagtaattgttcccacgtgaaacaactacaaaagagacagcagaaaatctttaaaatgcatttcctgttcctgttcatttggtctttcctaacttggcatatggtcctaagagctgctatattgtcagctgctaagtgctaacctatacagttttagcatttcaaatgtcagaagaatattaagagaactgaacaccattttaaatcttcaacaaaaattaatcattctaaaaacagaatgacttctacctgtgaaactggcactctgccttctctataaatttgggtgacttttagactaaagtataatctaagacaaccaagacattataatcaaattatagcagatcgtgtcaatgtatttaaaaaatactctcaaaaaaacttgctgataacagcaagactctttggtcaaggacaaaatgtgcactagaaaggagttctcatttaaaacccatattcttataacaaacttgctttctaaatttaatctctctcccacatagtttcaatttcctttgtttgaagagtttcttaatgtgaacaagatgtgaatatttttggtatttgcaaatgaactgtgtagctgtgatcaatatgctgtgctgacagttggcacctttgtgggtacagatcttccttggctcaaagtgttactgatattagaattccttgaaggcataataatggagaggttgaaagttgctgaactgagtggcacagctgtgtttattagtaatttagcatccacactgagctttaaagtcagaatcctaagaattcataatcctttacttgccaagtagatatgagtactaaaatcaatccaatttcagaacttaacacgctttacaagtcatatattacttttcaaagtcaacaaaattcttttatattcatcaaaaaatactaacaagcattcttaaatacctatcaccataatggccaattaagatgtaattccttaggactatccccttggtagagaccagggccaaatgaaaaggaagaaatttagaagaccaaaaaaatattcaaaaagatacatagaggttcactggaatattggctttaataattaagaataggaaataatctagatgtctataggagtttggtttaataaatgtatatatttattcacaaaatgaaattaatgaagccattaaaaatgacatatttgtttaagatgtccctgacacagtcataagaggtagtaagaaaatagctttataacacggtttcaatttgtgtttgcgtatatgcatatcccatttgtgttaatgtgtttgtgtgtatataaaatcccatttgtatttacatatgtatatgctaatattaaggttaagagaaattacttcagaatggtagcattatgtgagtggtcttatttttaattcttttccatgtttcctgatacatgattttacatgagtatactagtattacatttaggaaaacaaacaaaactctacaaaacctatttcaaaagcaatacacacaaagaattttttttttttttttgagacagagtctcgctctgttgcccaggctggagtgcactggtgcaatctcggctcgctgcaacctctgccacccaggttcaagtgattctgctgcctcagtctcccaagcagctgggattacaggcgcccaccaccacgcctggctacttcttgtatttttagtagagacaggtttttgccatgttggccaggctggtctcaaactcctgacctcaggtgatccacctgtctcggcctcccaaagtgctgggattacaggcgtgagccaccgcacccagcctaatacatacaaagaattttttttctccaaagaagttgatgtgacagaagaagcagctcaggacagtgctcacagagttgctcagtgctgcaggaatcaggcctagagtacaatccatcttgtgcactgactatatacttagaaatttaggatttgggtctaaaggagttcagaaaaaaatgacagatgaagcacttcagagaagtaaaactattccaggccaacaatgtaagtttccgtcatcaatgacttttcaaatcacaggttaggaatatctccatttgttaaaaatttctaaaatacttcaatgggatggatctgttatctctggaaattaatttagttatgtttgaagaagataactaggtaagccaagccaatgaaacaaattcctaggaataatgagcacctctctcccttgttttctggtacataatgcattttcttcacttgatagaatgtttttctactatacagataagccagactacccccaattaaaactttaaaactttttgcatcataaaatgtaataaatcaaattaggtgctaaacatgtttccttcttagtctatatcaacagttaatatctctggggaggggccaaaataagcctaggctagtcagaaatccagtctaaataaaaaacattaaataactcctcgaacataccataaggtcttttcccctcccatttagataatcttgctgcatgtctataaaaatatcataccatcttcagacatttaatttcagaatggtttagaatcaacaaatgctaccttacctctttaccatttaggctcagaacattcaaggcagagcttccctccaaaaatgtaacccacattttatcttctacaaatctttaagaaaaacaataaaaaaccataattaataccatagacataacaagctcagtgactactcccatgattattgatcattaacaagggccacaagaggccaggaagtaaaaagtaaaggagggagcgcaggtagggctggtggtgacctggagagggcactcttcccctaaaaacactctaactccaatttcaaatactatgttaatggaacagccacaagaaatgagtctgtgcacctccatttgtgatcactgctaatccagtcccatccaatcctccatttcattgacaaggcaaaaagggacagaggttaagtgacttgttcaaagtgactctataaggagaatatgttacagggctgggatccaagtctccggaccccacaacccagtactatgtattttcactgtctcagtgacttccctgaagaaaatttcctatgatcaaaaaagatgagagttgccagtgaaagaaaacaaaaccagactggccccaagaagccttagataagttatgctccttgtctttcatcattgacaaacatttactcttttgggacttcaatggtctttgataggattccaagtttttacttttgaaataaaaaaactatcaagaggaaaaaaaaaataaaaaggacagaagaagttctgaagagggtcgcaggtatgtaatgaagttattattcaaaaaagaacaaattatgatgttatcagtcttattacagaaaatttggcgagttaaaccacaagttcagaaatctttacagatttttccacaatgagaggaaaacatgtacacacaaacacacacacacacacagagtatcactctccccctaaccccctacttaaactaggattccaaagtatgaattatgaatattaagaggaaaaggccaaaacaaaagtgtgcataagtacttcaccctggtaaaatcaagggcctggagggaaccgatttctacaatcccacagatatgaccaaggcaactgactcaatttctttggcataaaactaaattgcaggatgctatcctttgaaatacacagggagaccattcttacctaactacacgaaggtatctttttcagattgttggcaatggagactatccctcctccaaaggttataatcaccactgtaagcatacatttatgctgcaccagtcccctaagaccccaaacattatttgttctttgataggtaccaacacttttgtggtcctgggttagggctaatatctttgtccttattctcaatcagcaatgtgccccttacacatttctaactttaacaagggattctggttcttatatctattgatttatgtaagttcttttggaagctatattttcttcctgctttcactcactacagtaaaagcttctagactcttccttcaattaatgtaagcatctatatgtatttaaatttatcccatacacatttccagggaacctcttatttaaaaataaaggggttcacagggtttactcactccttaatggctgtcttaatctagactaaaaggtaataatcagtttcttctcactacttatagagatcctctccttgttgactttcagtgtttgctttttctcttccaacttagtcatcttggggtttaacaaccaatattccaggttggagacaccccatggttttataatgttaggttaatgccttagtttcttaccaatacttttcctaatgatgacaaacatttgtgggaaaccttctggcttcaatttaacaagttctttagaggttgggttataaagacaggtccctttcctgtatcagagtctttcatcccttatacagtttggattctttgtagctcagtgcagtattttacatttgctcaggaagacatttatctgctactctgctgcccactcacacagtctacatgatgcttctggtggtttggcatttctgtacttggcaaagtatactgtcatctgtacacttgcagatttcactgtgtactttcaagaaccttaagatttttgaaatgttttgttttgtttaatttgaaagctttgggatagacctttgtcaaaagatttgaggaaagtctaaacacaatttcttctccatttgttcatttactctctgaaaggacttgaggtgtctttgattttcactctgtagaagccataccatcttaattctgtggactacgccctttaggatctgggggtgtcattacacacatgctgactttccctactagattacaagcaggagttgtatcttccatttctcctctgctcttctacagcaactagtatagagatctgcccaccaaatatctatcaaacatacctaactaagcaaatgaatggtatttaaagggatttaatggtacctctttccctatgaaatccaaacacatgcacacatgcacatcattcagtctctcaaaactgctgtatagttggaagagaacatttttaaaacaaggaaacaggcatctggttctgcaaaaggcagatggctagatcaatgagggaaaccaagactagaaggaatgactcttgactagtcatcacatctctgttagaaattaaacatacttaaaattactcaaatttctttaactgaggcagggagggagtcattcttatctctccttaaaaaaaaatagcaatcacagcttcattttgttatagggttttgttacatgttctattgtataggaatcgtgagagttcatatctgaacttgcacctatttttgttttcaattgttcacataaagtttcactgtttagctgggtatggtggctcacgcctgtaatcccagcactttgtggggctgagctgggcagatcgcttaaggccaggggtttgagaccagcctgggcaacatggtgaaaccctgcctctacaaaaacaaaacaaaacaaaacaaaacttagccaggtgtggtggtgtgcacttgcagacccagctatttgggaggctgaggtgggagaattgcttgagcctgggtggttggggctgcagtgagacatgaacacatgactgcattccagcctgggtgactgggtgagaccctgtcttaaaaaaaaagtttcactattcatttaaactttctaagttgagaattcagttataaaaacctacagaataatatccacagtatgatcttgctttagtttggaaataaaaatactcatatactaaacactaaataaggtggtatctttcttttttaaaattctctccttccccaaataaggtgatttctatatagaaatgattgtttatgaatcacaagctacttttgcataataaacatcttaccttataagtataacttcaccaaaacttgcaaactgctgcagaagctcatcaatcaaggcatcatcaaaaaaattattttctggtaaagaacttttgattgagaccaatactgtaccatctggtggaccctgaactgcaattacttctttataaatgttttgcctctcttcagcttcaacttcaaatatatctatatcaatcagggcaacgacaggccttaaggcataaaggaagatagatgtattagaaatgtttttaaaagggtgtatttcaaacaaatttcaaacactattagaaaaactgagactgcttaaacctgtggtcagaagtcttcagctcagctcttccatagtgcagcaaagtgcctggagtccacgtgtacagaattttgctttcatcttgaaaactagcatttagaagatctagatcttcagctgcagtcagaagaaatgaaaacacaagagaagctgtataagcaggacagatcgtgtagagcaaagaggcattctccttcctttcatgagcttcagtggtttgaggctggaatgccagaaacacttggtaataggcaggcagtctaaatacctttaaattcgaaaggttttggtaaagttatcattttatgctttatttagtaaaaattaagatctggctttatttccaagattacttaaaggactgggactaaatggtgtttcataaacaattcaagagacaagtggcagttcaaaacatatgcaaaccactaaagttagcttaaaaacctaaattagcttcaattaaaaatttcacaaaaatatttccttgcttctctttacatgaaattatatgaaaataggctgaaaaattaaataagttattataaacagatctgatatttctaaaaatctgacatatttaaattttatttattctattccagttaatgtttcttgaaaaacaatattctcctcatttgatattatgtcattccctgcttcctcataagtttacattagttcatttaaataaagaagcccatttcccaacctgatctatcaaaaggccatttcctccttctccaaaggacacggtctgtccaggcaggggtgcggcacttttcactggtgtcatagtcgtcagaaaacaagtcatacttatatgtcggagcaaaggttacctttccttctaaaaatcctctaaaaacctaaaataaacatatacaaagtaagttattcccaaacagcaacaagttctgttttcattcagacagtcatccattaaatgtctattacatgctggatgctctcagaagaaatctgtatgcgtctgatgaacacttctagctgaatggaacaaagcttagaaaaataacctgagacatagcatttttcatacccatagggacaggagacagggaaattctgggcagaagtgggtgggtccctttgctgggtcccaccctcaagccaaaaagtctgttaccacagccccaaatgagaacttatatccctgttttctcgctcgaatgttgctttttccaaaaccacccatggcctgccttgcccccaatcctgtgcccataaaaaccccaggctcagctggcagagagaggagaggcagctggatgtcagagagaagcagcttgacttcaaagggacagcttggcagcacagttttggagaggagtctggccatgggatggctggatttcaggggaagattatcttattgctctgtccccttttcagctccccttcctgccaagagccattttcatcggcaataaaataccccatatttaccatcttcaattcgttcatgtgacctcattcctcctggacaccagataagaactcgggtgccatgagtgtgggagcataaggctgtcgcactgaccccccactaagctgttaacacttaagccatctgcaggcagcagagctaaaacagcactgtaacactttctgtggggcttcaggggttggaggcaccctcccctagacactgccacgggcctggtacaaagttcgctcttgccggtgcccaaaagcgctcaccccagctcctgcactcacttaccagaactccccctcctacaggggtggagtgcagtgggtcaagtgagcagagttcgccccgccagtgcccatgcactccagttcccacctgcgaagcagtcagggaaatatcctgcttcaataccacttgtttgacatttgattaaactaactacatgaataagggaattctgcctgatctttgagctatatgagacatttggaactgtaaatgggattctggaaacatctagcctgatatcttattctcaatgaggtgctgaggcctgaaaaggtaatgtggtgcccaaagattcaagtctggtgatcaccaggcaccataccagatggccactgatccttttacctaaaaaaaaaaaaaaatttaataaattcttcccaaattttgtggtcataagctttaagaagtgtttcaaaagtcagatgacatagaaacaaaagaaaagtcaataaccacaggacttaacccaaaaaaaaaacagccctaaagatgaagattctaaactatcaccaaggaaaaaaaagtttatccttctatttgaaagtgaatcttatagatacataatatatttttctttatgggaattattatgggttttctctttcctatttttattacttttaagggaggacaccaccccacatattgtcttatgcccaatttctgcctccaaagaaagaagaagtaaaaactaaaaggcagaaatggaagccacaagcagatagcccagcactgcgccctgggcctggtggttaaaaatcaacccctgacctaactgtttgtgttacctatagatttcaggcctgtatggaaaagcatcatgaaaatccctgtcctgttctgttctgattactggtgcatgcagcccccagtcacataccccctgcttgctcaattgatcatgaccctatcacgcggacccccttggagttgtaagcccttaaaagggacaggaattgctcactcggggagctcagtttttggagacgcaagtctgccgatgctcccagctgaataaagccctttccttctacaactcggtgtctgaggggttcttgtctgaggctcgtcctgctacatttcttggttccccgaccgggaagtgaggtgattaacggatggtcaaggcagccccttaggtggcttaggcctgccctgtggcacatccctgtgggggactccggccagcttgagcaatgcggatcctgagagcacttccgggtaggtaattgccccggtcgaacgcctcaccacagcagcgcatggcaggcccccatgagttaaaggaaaaacttatgttggccccagccctaggactaccagatttgacaaacccctttacactctatgtgtcagaaagataaaaaatggcagttggagttttaacccagactgtgcggctctggccaaggccagtggcctatctctcaaaacaactagatggggtttccaaaggctggcccccatgtctaagggccctggcagcaatggccctgttagcacaagaagcagataaactaacccttgggcaaaacctgaatataaaggccttccatactgtggtaactttgatgaataccaaaggacatcattggctaacaaatgctagattaaccaagtaccaaagcttgctatgtgaaaatccccgcataatcactgacgtctgtaacaccctaaatcccgccaccctgctcccagtatcagagagcctggtcaagcataactgtgtagacatgttggactcagtttattctagcagacctgaccttcgggaccagccatgggcatcagcagactgggagttatacatggacgggagcaacttcatcaatccacatggagaaagatgtgcaggatatgcggtggtaactttgaacgctgtcattgaagccaaaccattgccacagggcacttcagcccagaaggctgagctcattgctttaactcgggctctagaactcagtgaaggtaagactgtaaacatctacactgactcttgatatgcctttctaaccctccaagtgcatggagcattatataaggaaaagggcctgttaaactctaggggaaaggacataaaatatcaacaagaaattctacaattattagaggcagtgtggaaacctcagaaggtggcagtcatgcactgcaggggacaccagcgagcctccacctcagtggccttaggaaactcccaaactgactcagaagctcgaaaagcagcatctaccccttactgtgcatcagtagcagcccccttactccctcaaacacctgacctggtacctacctattctaaggaagaaaaagactttttccacacagaagtggggcaagtaataaaagaaggatggatcagactgccagatgggaaggtagctgtgccacagttgctgagagccacagtcgtactggccatgcatgaaaccactcttctaggtcaagagtcacttgaaaagttgttaggccggtacttctacatctcacacttgccagcccttgccaaagcagtagcacaatggtgtgttacttgctgacagcgcaatgtgaggcaaggccccacggttccacccagcatacaagcttatggagcggctccttttgagggtcttcaggtggatttcacagaaatgccaaaatgtgaaggtaacaagtatttgctggttcttgtgtgtacttactctgggtgggtggaggcttatccaacacaaactgaaaaggcctacgaagtaacccgtgtgcttctccgagatcttattcctaggtttggactgcccttacgaattggctcacataacgggccggtgtttgtggctgacttggtacagaagacagcaaaggcattaggaatcacttggaaactacatgccgcctactgacctcagagttctggaaaggtggagcgaatgaatcagactatcaaaaatagtttagggaaagtatgtcaggaaacaggattaaaatggatacaggcccttcctatggtattgtttaaaattagatgcatcccttctaacaggatactccccttatgaaatactgtatcataggcctcctcctatactagggggacttccaggcactccccgagagttaggtgaaattgagttacagtgacagctacgggctttgggaaaaattacacaaacaatctcaacttgggtaaatgagaggtgtcccgtcagcttattctccccagttcaccctttctctccaagtgatcgcatgtggatcaaggactggaacgtagtccctttgcggccacagtggaaaagacctcacaccatcatcctgaccacccccacggctgtaaaggagaaggaatcccagcctggatccaccacagccgtgtgaaacctgcagctgctgaaacttgggaggcaaaaccgagcccagacaactcctgaaagtgactctgaggaggatgacaagccctgctccagtcacacccggaagctgactggtctacgcacggccgaggcatgaggagaatcatcgtgggactcattttccttataatttggacttgtatagtaaaaacttccactgattttccctgcatagaagactgctctcagtgtatacatcaggttactgaggtagggtaacaagttaaaacaatctttctgttctatagttactatgaatgcctaggaactttaaaaggaacgtgtttatataatgacactcagtacgaggtatgtagcctaggaaacgactgcccagatgtgtgttatgatccctctgtggcctcccaggtccacagtttttgaagtaagattaaggactgaagactgatggggacttgtaaatgatacaagtattagccaaaacagaagaaaaaggggtgcccaaacgcataatcttgaaatttgatgcctgtgctgtcattaagagcaataagttaggaaggggtgtggcttttgattgggaaaaaggctatatgaccaaaaataagtatatttgtcatgaattaggactgtgtggaaatcaatgtggatactggtgtcatttgggccacttggataaaaaatgaaaaggatccagtgcagcttcagaaaggaaaaagtggcccttcctgtactaagggacaatgtaaccccttagagctagtaataaccaatccccttgatcctcgctggaaaaaaggggagcgtgtgaccttaggaatcaatggggctggactggatcctcgagtaaatatcttagttcgaggagaagtttacaaacactctcctgagccagtgcttcaaactttctatgatgaactaaatgtgccagtaccagaaattccaggaaaaacaagaaatttgtttttgcaattagccaagcatgtagcctagtctctcaatgttgcttcacattatgtatgtggaggaactgtaatgggagatcaatggccacgagaagcccgagaattagtacctacagacccagttcctgatgaattcccagctcaaaagaatcaccctgataatttctgggtcctaaaaacctcaattattggacaatattgcatagctggagaaggaaaagaattcactcaccccgtaggatgacttagttgtctgggacagaaactgtataatggtaccacaaaaacagtcacttggtggagttcaaatcacacagaaaggaatccatttagtaaattcccaaagttgcaaaccgtgtggacccatccggagtcccaccaggactggacagcccccactggattatactgtatatgtgggcatagagcttgtgccaaattatccaaccagtggacaggtagttgtgttattggcactattaaaccatctttcttcctactgcccataaagacaggcaaactcctgggtttccctgtctatgctgcccgagaaaagagaagcatagctataggaaattggaaagatgatgaatggccccctgagagaatcatacaatattacagacctgctacttgggcacaagatggctcgtggggatactggacccccatttacatgctcaaccgaatcatacggttacaagctgtcttagaaataatcactaataaaactggcagagccttgactatactgccctggcaagagtctcagatgagaaatgctatctatcaaaatagattggctctcgactacttgctagcagctgaaggtgggggtctgtgggaaatttaaccttactaattgctgtctatacacagatgatgaagggcaagtagttgaagacataattagagatatgacaaaactgacacatgtgcctgtgcaagtgtggcatggatttgatccgggggccatgtttgaaaaatggttcccagtgctaggaggatttaaaactcttataataggagttataatagtaataggaacctgcttactgctcccttgtttgctacttgtacttcttcaaatgataaaaagcttcatcactaccttagctcaccaaaatgcttcagcgcaagtgtaccatatgaatcactatcaatctgtcttgcaagaagacatgggtaatgaggatgaaagtgagaactcccattaatgagtgaagttctcaaaggggggaataagggaggagaccacccctcatattgtcttatgcccaatttctgcctccaaagaaagaagtgaaaactaaaaggcagaaatggaatcacaggcagatagcccagcactgtgccctgggcctggtagttaaaaatcaacccttgacctaaccgcttgtgctatctatagatttcagacattgtatggaaaagcatcgtgaaaatccctgtcctgttccattctgattaccagtgcatgcagcccccagtcccataccccctgcttgctcaatcgatcacgaccctctcacatggactcccttagagctgtaagcccttaaaagggacaggaattgctcactcggggagctcggtttttggagacgtgagtccgctgctgctcccagctgaataaagccctttccttctacaacttggtgtctgaagggttcttgtctgcagctcatcctgctacactttaaggaaagataattctattatctgtttacctacagatgcatatttaagtacaaaaagaccccaagaaaattttaaaacatcttgatttaaaaaggcatgtttcacgacccaaaatcttaatgcaagtattttctcaagtatagatatacctgtccagcatttttctgattgataagttgatctcctgctataagagaatcccaattttgctgtcttatgagctctttaacttcttcgttagggagatcgattcgatagttgaaatcaccacaccaaaatacatagtcatgggaaaatagcatccttccctgaaagcaatgagatagaattttaaattcaaaacaatcaatgttcaaaaatgttttacaactatttctttgcctgagatatgcttgtctcctcccatgtcctgtttctttgacccaacagtaataacacatgtgaaacgaaaataaatctcaggaccccaaaatcactaagcccagagaaaaatcaagccaggaactatgacaggtaaacctgcctcccattttactcctaaataagatagctccaaagataagaagctacataactccctcacaatttgcccacaggaaattccttgtggacaaagtatagactgaactcaaagtcatccctctgagactcacctgagacaaatgcacatctgactgcttcctctgccctattgtttatgcaaaaatgcagattcactgagccacactaaattgtgtattcagtggaaggctgatctaggacttaaaagaatgcaaccttttgcgtcttatctacttctaacctggaagcccccacttcgagttgtcctgccttaccagaccaaaccagtgtacatcatacacatactgactgatgtctcaggtctccctaaaatgtataaaagcaaactgtacccccgaccaccttgggcacatgtcattctgaattctggaggctatatcatggccacatccttaaccttggcaaaataaactttctaaattgactgagccctgtctcagatattttgggttaatactcatgaaatatctatttaggtgaatattcttaatgtttctaggaactatcttaaatttccaaaaacattgatgtagaatttggggcaaattaaaatatatttcaaagctttatcttcaagaacaagcagcaagagcttaccataggaaaactcaattttcgtgctatttctataaaatcttcatttctttctttgacttgtgactgccctgcagcaaagtggctacagacgaagcaaaggctggttgtatggaagagcattcggattgcaactgctcccttatttccagttgcacctcccattccagtcttcacagtatcaactgcaacatccctttgaaacaaagaattctaaatcgcagatttgaaatttcaagagttccatgtgcataggaaatgaggaatatacataatcatttaagtacacatggtatggtactttgagggcaagcctttgaaatagtacagtgaagctattggtgagtctttaatcaaaacccccaaaaccccattttaaaacaagaactatggatagtttttgtttgaagaactgaaacaataaacattctaggcttttttcttgttatttaatggtaggaagtagccttagaggagtgttctgtttactgacctgataaaaggagcatgctgtggtctgataaaaacaaacaaacagacgcccaccaactgttcagaagccagcagcacatacttgttgtctctggagattgtcttctgaagttctacagcccagagcttctgatttgttgtgctacaagaaaatattaaaaagagaattttttaaaaaggtattgacaatagcctattttatgacaattgtcaattatacctttatctacccaaatatcctaagactctgaaggaagcttaggctgtttttgtttcctttaaaaaggaaaatctacaatttagccaaaagaaaaccacatttcaaaatctaatctattacttctttacaaagaaaatataaagacattaaatggctactcactgggtgagtaaattcaaacttatacattttactttttccttaagtattcattaagatcacagagaagtatagaagtatctgtgggagattggtttcaggacctcccatgataccaaaatccaaggatactcaagtcccttacataaaatggagtaatacttgcatataacccatgtaaatctctcgtatactttaaatcatctctagattacctataatacctaatacaatgtaattagttgttatattgtaatgtttagggaataacgatacaaaaaagtctgcaagtaaaaaagacaaaaaaaaaaaggctacacatgttcagtatagacacaattttaaaaaatatttaatattttgatgagttgaatccaaagatgtcagacccatggataaggacagctaactgtgcacatatatgtgactatatgtgcttccaaatacatttccccacttttcaaaatttttctaaattataactaatgtctttttaaaaaatcttgctatgggaaattagaagacataatcattaaacaaaccaccatatacccatttcaaaattaccaacattttgccaatctattttttccatcctcttcaccttatcacatttaaacattaataattccttaatatcatctaatagtttatacttaaagttccccatttattaaaaaaaaatcttctaacagttggtttgtttctttaaaaagggtccaaacaaggtctacatattgcatttgcttgtcatgtctcctaatctctctttttttcttgagatggggtctcactctgtcacccagggctggagtgctgtggcaggatgtcggttcactgcaacctctgcctgagctcaagcgatcctcccacctcagccccgcaagtagctgaaactcattcctcatcttctcaatgaaccttatcttgatcattcatttgagacttccaacacttccctgtgtccctatagttgatctccttttcctctcttttccattgcacttttctaacatgctgtataatttacttattgttgttattgttcactgtccgtttcttcccactagaatacgaagtccatgaagatagggatttttgtctgtttgattcattggaggtacttaagagtggtactcagtaggtactgcttaaataaatgaataaatattcactactttattaaagaagaatatatatgtgtgtgtgtgtgtgtgtgtgtgtgtgtgtgtgtgtgtgcatgtgtgtatatatatatacatatacatatttgagacagagtcttgctctgtcactcaggccggagtgcggtggtgcgatctccactcactgcaacctccgtctcccaggttcaagcgattctccctgcctcagcctcctgagtagctgggattacaggcacggggcaccacgtccagctgatttttttgtatttttagtagagatagggtttcactatattggccaggctggtctcaaactcctgacctcaagtgatccacctgccttggcctcccaaagcattgggattacaggcatgagccaccacacccagcctaaagaatttgattaaacctagcctaaagaagaatttgattaaactctatttagacaaacaattgatccatgcacttagtactaggaaccctcagagttatagtctagtttaggacctgaatatatttttcaggaaacataatcaaacaacaaaatgggtgaagttgatttctttccaattttcctgatgtgaattgtttttcattttgcctaataaaatatttgtcacttgcaagattgatgactatttcagcctataattttctcctaaaaatctttaaaaatgtcataaaagatgggaaactgctgaaatttaaaagcaagcatactttgttaaaataaaacactgaagttttaagcctcactcatataatttgtatttataatatggattcagaacagcgttcccaaagtgtgatctggagacatctttgagggttcccaaagcccatggggtcacaactattttcatcatactattaagacatctttcactgtgttgactaacatttgcactgatggtgcaaaagcaacaatgggtaaaagtgctggtgctttcactcgaatttaggcaccaaactatactagtcatcattacaatccccactgccatatacttgcaggaaaaaaaaaatgccacttcgcctaagaatgtccttgatgaagcaacagacattattgattttattaaagctcaacccaggtcacatctttttaatattctgtgtgatacacaggaaatacatacaaagcacttgtgttgcatactgacttatgatctgtaacaaaaaaagaaaatgctttaaattgtgagtcaaactgccactttttttttggaatacaattttcccttaaaagaactaatgacagacggtggttattcagatttaggttatgtggcatttttttcaactaagcctgtctctttaagaaaaacaaccaagagcatttgttttcaatggaaaaacttgcgttttcaggcaaaaattagtattctggaaaacttgtatctgctaccatgatccttacagcttcccaacaattattttctgatgcagttaccaatgctggtaattaaccaatatgatgctttgatattatataatgaaatgtgttaaaatttggaagtgctacataacttagggaacccaagtgaccaatacatgatgttacaaaatcacgcaaaggtaaaagatgaattttagataatagagcagaaaaagttcatcaatatggtttcagattccattttgcaactaacctttaggacactaccatttggtatagtgtcttatccacacactacaccaagataatacttctctgttatctatactacagcagagaataaattatctgttttggtgtagtatcagagaagaaattatctagaaaggttattaaaatatttccttttcaaactacatagttatgtgatttttcttcatatacttcaatcaaaacaacatactgcagcagactgacacagaagtagatgtaagaatctggctgtcttaaactagacattaaagagatttggaaaactacaagacagtgccacccttctcagtaaattttttgttttgaaaaagttatttttcaaaaaatttattttaagttagcatgtaataggtttattattgtttttaagtgaattaaatgtttttaaattttcatttttaattcctaatataacaaagatataaacaacattagcaaaagttatttaacattctcaatatttttaagtgtgcagagagatcctcagacccaaaagtatgagaaatgctcttttacagttttacgagcacccttccatttattatttcaaactatccttgtaacaattacttaattatctgtcctccatagtttccctcaactggcaaatttttcagtggattaatgtggctagcttaccttgcactcacaatgtttccagcattcaattctaccatttcttcaaaaccaattgcaaatatatcagttggcttacttcttttatctaaaattaagcatccaagaaatacttttaaatatagcctcaggcaaatagcaaccccatccaacacaacataacaccaggtctcataaagactgatttctgtgttttgagtttaaccaaattcatattaaaggcaaacactcttgagtggaatgaaattattaaaatttactttctattagggtgtcctaagtttgcttctttaagacggttatccttgaagattcttaagccctttcagaattcactttgaaaaaactcttgctaaagtttttaccagggacagcacagaaacaaatcatttctcaaatcaaaatctcacataaaactggagagagaaattattcagaaaaggcacaaagaataaagtgactgagaaactacctcaaattgctggtaacagttgggaggaatttttcacattcatatttgaaaaacataatcttgatctttttgctattttctgggtgaaagaaatccaggaaaactaggagagatccagaaagtaagacacatcactctgtctagctgctggcactctggaaactacaaggactaacggagaacagagctgcctgagaaagcagcccagggagacttcgggtgccccaagtttctagaaatgaggacaaatagctagaaagagcctatatggccagatgctacagcccctgcctgtaatgccaaacactttggaaggctgaggtgagaggatcacttgaagccaggagtttgagaccagcctgggcaacatagtgagacccccatcactacaaaaaaataaaaataaaaaaattagcttagcatggtggcatgcctagctattcagaaggctgaggagggaggatctcttgagcccaggagtttgaggttatcgtgacctatgatatggagactgcaccactgcctgggcaacagagaaagaccctgtctcaaaaagaaaaaaaaaagaagagcctataaatagtctgaactaacactgaaattaaaaaaaaattattgactgctattatgtgcaagtctcatgcatacatcatcttatttaaactgccataaaaacatcttctaagaaagattatttttatcttttatttacaaacaggaagcttgcccaagttcacacataaaatgcagcctggcatacacactctaaagccaaactgcctgagttcaaatcctggctttgccactactgcacaaacatgggcaggttccttccctttcaatgtctcagtttcctcatctgtaaaattggaataatggtgtctatgaaataataggtcagctctgaggattaaatgaacacatgtaaggtacatagaattatagtgttagctgttattttattatcattactatcacaacttcaagttaggttcaattaagtaagaaagggcattttaggccaggtgcagtgcctcacgcttgtaatcacaacactttgggaagccgaggcgggtggatcacctgaggtcaggagtttgagaccagcctggccaacatggtgaaaccccatctctactaaaaatacaaaaaattagccgggcacggtggcagatgcctgtaatcccagctactcaggaggctgaggcaggagaatcgtttgaactcgggaggtagaggttgcagtgagccgagatcctgccactgcactccagcctgggcaacaagagctaaactcaatctcaaaaaaaaaaaaaaaaaaaaaaaaagaaaaagaaaaagaaaaagaaaagaaagaaaggtattttaataaaaagtttggggagaatcccagggtttaagatgaaactgatgaaaaataactaaaaaagaaaaattttatctcacaccatttcctatacacatcaccctcacatataaaacttggtaattatatactattttaaaaaggaattaaagttaatttttaaaaagaagaaaattaagttcatgattctaatcaaaatctttttctttctttctttttttttgtttttttgtttttttgagagtttcactcttgtcacccaggctggatgcagtggtgggatctccgctcactgcaacctctacctcctggattcaaacatttctcctgcctcagcctcccgagtagctgggattacaggcgcacaccaccacacccggctaatttttttatttttagtagagacggagtttcaccatgttggcgaggctgatctcaaactcctgtcctcaggtgatccacctgcctcggcctcccaaagtgctgggattacaggcgtgagccaccgtgcccagcccaaaaccttaacaaaagtatcctctgctaaatgtttggttctggctatttattaacagtttggtgcagagaacccaaactgaatgccaacaaagtttttcaaggataaaccagtgctcttaagttattacataagtaccaataaatatcacaagttttataaggctgctcaagacccactctgacatttcttatcttagtaactaaatagaggattaagaattgaaaaatgggacatagtaggtttgaaaaataaaactcaagtgatcaattatattttaattatgtaattttaattaaaattaataaatgatcaatgttaaatggacataatcttggtttatgtccataatcttggtttatgtccatttaaaataaaaacaaaactagattttcttatatgtgtggttgccttcaaagaaatctatgtgtgaattcctatttcctgagaatcaattatggaaaaaagattttttgttttaccatcatatatttttatgaagtagaaaataatggtctagaaattttaaaaagctgagattttaatagatgtgatctttaaagatgttgttggtcttcaaatgtatagctccaagtttctttcatcaattaatgcatcctctgaagtgctatatttgttttctagatcaatacaacacagtcaggatttattaactaaatccatattataaaaagccaaccttgaaactcctggatgccagctaacttgggtgcatcaagaagccagtcagtgagtgtctgattcttaaaagctatgctgcgaaattgcttcccaccattcacattccaggttccgacacatactcgaattttcttaggctttgaatatttgtagaaattctcacacatgctctttagtactttagaagatgctaatcaagagaagacacaatagaattttagctgcatcaaaccatttataaaaattgattttcataactgagatacgatgtccgctggaaagcacaattattatcacaagcacaaacaagcaaaagatacaggcacaggcacaaaaaaagatcagccttcaatgcaaagcctggtatgaggcaattaaccaacacatctttaaaaaaaaaaaaaagtcaacattaaatacaatagccaaagtaaaaaaaaaaatactacacatacagaattattgcagcaacatgcagaacaaatagttctgtttcaatgaaatggtacattaatgtacaaatccaatgaactatacatttttaggaatatagcaattaactttctacaattttcattaagagtctggtaaaaatataaattttatttttctccaaacaaaaacatttaagaacatttacatttaagattgtagctactgacaggcagcttgatgaataatggctccttgagaaaaatacaagctgatatttctgaaaatgaaatcactactaaatgcttcccatctcactcagagtggaagccaaagtgcttaaacaatggtccacaaggccctcaacaatttgtcttgtttttccaccctcatcttccactctccctggtgcactcactgctcagacactggccttcctgctgtttcaaaaacatatgaggcctgcttccaccacagggcctttgcactggctgtgcccacagcctgcaacactcttcccgcacatccttcaagtctttactttccaatgaggccttctctgaccactttatttaaactgcactctgcccttaactttccattatcccctccctgctttatttttctctatagcatttatcacatttataaactatgtattttatttatttatcctgtaactgtctcccctcatgagaatggaaaatccatgagggcagacatgttagtctgttttctttatgggaatactcctagtaactaaaagactacctggtacgcagtaagtgctcaataaataattgttaaatgaatgaatgttcaatacattttgaatcctcaatctctcccgtttttttttttttttggtctacaacccatcttttccctttctaaaccacattctatcctggttaaattctcagcatagaaccttaaaagcacctcaacctaaaaatctgtacttcattggtagctaaccggtaacaggaaaaggacatcaaaactactttcaccttttaccacatgatcttattttattatgatattctcttatgataccaagatatagcagtcttatgaggaaatgagagtgaaaaaggcgagtgatgtcttagtattcttgtaaagataattttgacctgtggaactgctgatttagataagtatatccccattgtttccaggggcagatatgcagatttctcaccacctagctgtttgctttgattgcttgtatagaggtgtctgggtggtaatgaaagcagattacttgtctggcctgttggtatggttaattcaaagctgactgtacctagataaaaataattctctataattatggtttatcattgctcttaaaaattgaagtcactgcttgttaccaatgcgaacatagtgtctataatccattctatatcaacacacaagttctataataattacacggcttaaaatattcagcaagacaatgaactgtgtgaataaaaacgtactgcctcactgtatgaactaataaagtcaagtcagtttttaaatgaaataaaaagataaaaaatagtcctagtttattcttaactggtgccaccttaatgtgcttaaagaaacagagagtcaaaaaaataaaataaaataaaaaattttaaaaaagaaatgagtctatgctcaaacaacagatgtccatccctaaataccatactatttcagaaaatggtgttcattatataactcaaaaatatatctaggtgctctcttcctctacccttctcgagaaaataatcaacagcttctcaaaacattcagaacaataactaagccaaacaattcttaagtgatagcaaatccttttcaactaaatttctggcaagagttaagctttcattccttttgccacagattcatgtttaaagacaagatcataaaccttgcccagagaatgaagacgtgagattcctaggaataaataggcaagaaaaataataaatagtctttaggtctcacacacttaactattctttgttagaaatcttggcactttttaaaattaaaagatttcagatcatattttagtgcaagtctatagttttgaaactatttcattcacaataaggaaatgcaacaatgccttcttaaatattatatgtgagaaacactgtttagtagttgtaaatatcacggatggcactcagaaattaattcaaagtagttacatctggatttttttccatcagcctattaagagtaaggcataacactaataatatttgttcaatgaaatgtaaaagtgaaattaaaactagctgaattatctttaactggaattaagcaattgctacaggaagacaaagagcactgcacattttcttcagaatgaagtacttaattttctcaagcttgaaattcttttctcagattaaaacaagatatcaatttatcctgttaggatctgatggcaaaatgagaaagtttccaattatatggctttatttgtttacaatatcgacttcagaaaaaataagaaaaaattgcttttatttatagattgattttctatactgtacctgactgtaatgtctgctcagaaactatggatgcaacaagaagaaaacaaagaatcattagtaaaaacaagttacaattaaaatgttgagtatagtgacaaaacattttgagaagacctcacttaagtcaatttgatgactttatttttttctgatagctatagaacaccaagtgttacaaataaacgacaatgattgatacaaaccttctgcacctaagaagaatcctacagtgactcagtgatatccaccgtttcaccatcagaagctcctaggcctgcgcttctggctgctcctgtgtgtatgttatgcatgcatgcgcacatgtttgagaatattatgaatataaatatgaaaacctaagaagatggaggatgttgaagatatggaagatactgccctaatacacaccttttagtattctttctgggacttagcagttgataagtataatcacttcagctataacaagaaaaatgcattctaaaaacatcaccatgctatgcaaattttgcaaattcccacagccacagggcttatgggaaaaatggggttggggtaccacgttcaaaaacttcaacaatgacacatcaaaaaagatgggaacctcataaaaatagtagcaagacattatacatgttaaatggttatgaaatgcatgaatataaccattaataaggcacttcatcttgaatgaagttggcttgtagaaatgggcatcaggcagagtgcagcttgtaatatgaataatggagaaagggatatctgaaattcaatgaaaagttgaaagaacagatgtgaatgtgtatggctcataacacacatagtgaactgaggcaggggaagatgtttgaggtgtgtgtgcatatgtgtatgtgtgttttatatgttgtacatatttctagccatcttagttctgctgggtgcacttttctgcatttacctagtgttgcttcccagcaaaatcatgcataagctcatgcaaaattggccttatgctcaaacagttccctaatatatcatattggaacaaattcccattctcagaacaagcgttacagcagaactgactgtacttttttttaaaggtatgattttacttatagtaaaatgcgcaggaaactaaaaacactaatgctgaagtttgaggattacataggtcccttgtttctcctcttctttccttcaaccacttactttcaattgttgcttattaatgcctccacatcaatgtaggcacaggtggaaagaggtgacaaaacacaaatcagtcaagtctctacttttggaagccaggaagaaagcctgaagttgaaagtagtagctaagatcagacattttttggagttttagtaggtctaagttccctagcccacttacaggtccctgaggaactgtccgtaattaactacctttaggcaccatgcaaattctaaaataatccataacttatttgaccaagtaattacccaagaatacattacttgatgcagaaacaattttctcccacttgaacagggaacattaaaaagtttggtttagggctaacagaaaaaaaatttctttttcagagtgctaaaaagttaaaatggaaaaaatttattttgtcaattatacctcaatacattttagagaaagaaaaagtaagtctaatctattaaattctacaatgaatgttgagttttcccgtcatgctacttttatgtgctcactgataggagaagtttttttttaaaagacacagtggaaggtgaaaacctattctgaaggtcatatatttatttcaaatattaaaattggtaatagcagttagtgcccaataattagcactactttaaattattaatatgatttaatgcttattcaaacaatagcaattaaaagttaagaccaagttacagaaacttttgggatagtgatttaaaaaataaccaatataggcattagttttcccagtaaagcatttttctgcataattagattattaaatgctgtattacaagtactagctgaatattctatgaaatactgccttgtacaaagttaacaatgcttaattatttacccctcaatcataatctatagaagaaaccatgcaagggcctcagtttacagcttagtaataccactgattgtacaaatattttaaaacagacaaacttcccttggagaatgtacttttcaaaaattacctttacagaaatcccttcaaaaactattttaaccaactaaaaattctgtgtaaataagtttacatttacctcttggacctttaggaatataaataacaaataaaatataaagtgcacataccacgcaaacttccagtagttaaaagtgctcgagctttgtcagctaaatcactattcagagtatttcccagtagcaaaacatcaatggcctcttgcttggagctgtcaaagaagttattctgaattgttcgggtaacagagcgagcaccatcttttaactttccagcctgttaagaaaggagcgcagattttcattttaaatattactgattttactcattaggttttttgaaattttaaatcagttttatatgattttagtataaaaaaggacctaatcgttctattttgaatatatagtcatgacaattaaaatgcctccaacatgtcactgtttcctttcttcttttggattaaagctctgcacaaagaaatgaaaaagctcagtgctacaacctcatccagtaattacatctagggcaacaaatgtttaaaattgcttattacaaaggaaataaactgaagtgaacttatttaaaacaagaaaattccttcttacaaggtaatttgtaaacttggggataaaatgggtaaggagaaatgggagataaaagaagatacactgagcttaactgcccctagaaaaacttcaaattactttggtagtagaaaaagaaaatggaaattgctcccaaatagcttacatgagttaaaattaaaactaaacctaagaatgaaggtctagtctcaaaagaaatttacaagtacagttcataaacgaatattacatgtaaactacagtttgtatattttgagtcattttattgcccatgcaaaaatacatcataagataataaacttattcctatagtgagatttgattataacttttaatgaatatatattttacttaggcatgttagttaccataatgatttattttgatcttacagattttgatgattgtcaaaacaaaaaacttgcgtcttttaggaaataacttcagtttgcaatatgtaatttttattctttaaagaaataacagtaactcaaggcttctttttagaataaagagccaattttcttaaatgccactaaatgaagaaccagttttcttcaatgccattaaatgaatgctactatatttaataagcaattaatgtttggcattaagtgttatttctttctatataatagcatatgcaaatgacattatttgaaaagacactcaccattcacattatcaggcaattaatcaaaaggaacccagagaaaaggaaaagaaagagcagttcagatgttagattttagttcaattcaggctagcatatttaatgtataaaattttatatctatatattatgttaaagataaaagaccactgaaaatatatgtaacctctgtacatatattgtagtcactgcagaaatgaaaaggtagaagtatataaaagaatattttaagcaatagtttgagaatcagcttttaatagcaagaattatgttgtttaaaaggaataaatcaaagtttaacaatttgatgtttacaaaaatagggaccacttaagaagtaaatatttgtaaaagtcaatacaaattatttctatgagttgaacaaaagaaactttgcaggtaaggccaatacctctgggcagaggcatggcatattatgagacacagaagaggaagacttggaaattaaaagaagacttggagaccatgaatggtctttaaagaatttcagttgctgtatggaagaagctgaatgagaactataaaagtgataaatgttctcatttctattcttgaaataatttgagaaattgtggagatttagaaagttgataaattcaagtgaggccaggatccttaaaaagttaaacaatatttaagaatataaaataatgaaaactatctcaagtattgttccaaactccctcaataagggacaaatacttgagaagaaagtagtctgtagataataccaggaaataaaaagtaatgatgaaacagacaattataattaagtccattcttttttttttttggaacagagtctcactctgtcactcaggctggatggagtgcagtggcgtgatcttggctcactgcaaccaccacctcctgggttcaagtgattctcatgcctcaaactcccgagtagctgggatttcaggtgtgcaccaccatgcccagctagtattttctattttcagtagagatgtggtttcgctatgttggccaggctagactagaactcctggtctcaagtgatccacctgcctcagcctcccaaagtgctgggattataggcgtcagccaccacacctggcccatatctcacacttcgttggcacatcttgatagccacctttctaaggtaagataagtaaagatcaattatgccctaatcttgggttcctagtaagcactgcataagctgttgatggacttacttgtccaagtggcatacgtcacacatctattaacagtaggcactgtgttaagtgcagggaacgcaaagccaaataagagagaaccctttattaagaggtctatggttttaaaaatcatatttgtaatcaaaacaaacaatacaaaaagtaaaacagatatacaagggaaatcatgaaaaaaagagcaatatatatcatcttagtggattgtcactaaatgactagatacgttatatatacatacttcccaaacttagggaaatacctatcttccatttattcactagtatccactgtgaaaggaagtatcaaagaaggcataaaagcacattaaacagaattctaagacacatctattaatttaaaccatctattaacttttaaaaggccatttaaaagctttatgaagagaggaaaaagaggatattctgtaatgttatgatagatctagatataccttcgctttcccttcaagagctccagttcctgcatatatcttactgattgaatcaccattcacggaccacattgaccgaaaaacttcttgaaagcgagtcaccaactgaggcttttcagctaaaccaagagcttccaactgtttagctagcatcttaaaaagcaaacaagaaatttttataagtacattaatatattaattgtaatatggcttttaagaactaccagaatcaaaccaaaaatttatcattatagcactatttgggactagcttctgaaaacataacagtttactaggctgagttatttcccatcatttcaatttttaaaacaaatactgtatcaatggaaactacaagtattgataaggacttctttctggttaaatgataaaatttatcttattaaagtatccctataaatcagagttgtttaccttgcccacctaaaagaattcatcaatcaacagcctgcattagaataaaaaaaagtttacttagtcctaaacataaataactaggtctctttaacttttggatttggctttataagtttaagtaattaaggtaaaaaaaatgaaaaaaaggagttgctcttaaattgtcacaaaataaagaaaataagtaaaacttctgaatgaagtcatgacagctttttatgcataaaatccacatcggtaatatatataagggaagaactagggggaagagcatgcaagaaattcaaggacctctcggcttccacaagtccttatcacatataacaataaaagtgttccaaaaagttattgatctttatatgcaagaattctagcctataaatctgacagagtcaatgttcgatctttatccaatctgtgtatttggaatctagtcatattctatgccttgcattttaacttaactctttccaatttacgttttattttatcatgtaagtatggtgatcatccataattatagaagaaccaaaagctaaaataagattaaaaaaaccttaaactgggttcatttaattacctagagacttacaccagagctgttctttgctagcatggagaataaaacaaaatgagccccagggcctcctttatcatttaaatctttcttcaaggaactgggcaaaactgatcttattcctctactagtttggctttgtctatcttggtgtcaaactttgtaacctgtcaaccaattgctatcctagggagttttctaattcctaactatcaacagtggagaatcagctaagtcagatcctgaaaactaacatctgttataattttgatgaagaggtccaagtacttcaataagcttattatcagaatccatgtacatttattcagccacttaaaacttgaaacaaatccaaggcatgtgataaactcttatctaaatgaccaacatgcttgctttcattttcttgtttctgtcaaattttctaaataaattacaaataaacatcaaaaacatactcaaaaaatccaaacagtaaaatttatttagttacatgaaaaatatattctgtagtagagaattttatacactgtactttcatttttgagataaagaacctcagctgcaaagtaactaattaaccaatactcaggtcaaatttaagatcattaactaaaggaaataagaacatgtaacttcctattgctgtttttttatagtatttgagaactatgttaagttctgatggaactaaacgaagtttagccacagccttataaccttaacttgcagaggagggaagacttagaaagctcagcattgctaaatagtttgtcaaagagttgagactatgtttatcttaggctgaatctgatggataagtagtaaagaaaaaaaaaaaagaaaaaacgttgcaaacagcgaccttatcagagaagttgaattgcattcattttcattctcactaactatggcattttcatctgatcctgtttttttatagctactaatttgaaaacaccaaacaaactggattggtatcagagaagttgaattgcattcattttcattctcactaactatggcattttcatctgatcctgtttttttatagctactaatttgaaaacaccaaacaaactggattgggttacaaattgtcaaaaatatagtcctatataattgtacatatgaaaatagacccttcttatcctaaaatagatttttaaaagacaacacagagaataaaaggccaaatacacacatacacccacacccacacatatatatttcctccaaaagacagggaaaaaattgttgaaatactataaacagcagattttaaaagggagaataaggaacaacagaagtagatagagagctacctaaagagaatatgaagatcaggtaaaggaaatatttaaatcaaaagaaagtttggccaaaaaaagagacagagattagaagtacaaaatgaagcataacattacatacactttctggaaggtaataagaaacataagtattcaaaaagcacttaaagaggcagatgatacaaggcacatacattttaatttattcttttacctctaagccaagaaatgcctgcacactatttgttctatcaagacaatccaagcagtttgttcgaactgtaccactctggcatctgtaaccaataaagttaaatatccagtttggaacaaaaataaagctaaaacaaacagtgaataattgaggtaattaaaatgtagcatccaccttccctctccaactttttattattacagtattcaaatatacaaaaaaaattatactgtgaacatccatatacccaccatttaaatttgacaactgttaacattttgtcacatatgcttcattacattatctatcacacacttatttttaattaggccaacaattagaaactaaatatacattcaggtttatgctcttacagttctttgcacataaaataaaaatatttatagaacaaaatttttttaaacctaagatctgttatctctaatgactgtgtctacagcattgatgctaaataaaatacaaattgaaaaattaaaaatttgagctttctgcactaaagtttcccttaacctatattctgaacttaactctcttaacatttacttttctcctctatttcacatacaaaaactgaatatttaaattatactaaagcagacagtaaacaaagcctttcacttctatttgcatttaataatctttactggcatcaagaaatattaaaacgtaagttttaaaagagaagcaaaacagtttcatatataacagcatgaagtatggagccagacgaatcccagttctaacacttgctaattatgagacttgcagcagatggaaatgggcataataatagagtctatccctataattgttattgatacatgttaagacttaagtacggccgggcgcggtggctcacgcctgtaatcccagcactttgggaggcggaggcgggtggatcacgaggtcaggagatcgagaccatcctggctaacacggtgaaaccccgtctctactaaaaatacaaaaaaaaaacagccgggagtggtggcgggcgcttgtagtcccagctactcaggaggctgaggcaggagactggcatgagcccgggaggcggagcttgcagtgagccaagatcgcaccactgcactccagcctgggcgacagagcgagactccgtctcaaaaaaaaaaaaaaaaaagacttaagtacactgcctgctccataaaatgcgctcactaatgtaacctctcattattatttggtgaattctaaagaaagaaaaacaagtttaaaatcaagtataggatgggtgagatggctcatgcctgtaaacctagcactttgggaggctgaggcaggtggatcacttgagcccaggagtttgagcccagccagggcaatacagggagacccccgtctctaccaaaaaaaaaaaaaaaaaaaaaaaataagccaggcatggtggcacacacctgtagtcccagctactcaggaggctgaggtgagaggatctcctgaaaccagaaggcagaggctgcagggagctgagactgcaccactgcacaccagcctgggcaacaaagtgaggccctatttcaaaataataaaaataaaaataaaatgaaatatttaaaagatatttaattataaactttaattttaaaaagaaaatttaagagttcaacgttaagaataatttttaattaatgttccaattcaaagaacagagaaacagaacagtcaaacctttgaacttcacttccattgaaataaaaaaatccataatctagaaacttctggacttgaggtttaagaacactatgtaatttttctgcctttcctcccttaaccatttgatgatagtcaaaattcaccatctggatatcagcagcatgttcagaagctttcaaatgactctgaaagtaaaaaggcaaatattcatctaaatgaaagtaaaaaggcaaatatccatctaaatattcatcacatttcattgacactggcaataaatcttttccctaaagcctcaaaaactatccctgagagatacggtgacacaattaacatcagtgtacttaaataatattctcatctggcttaggaaataaaaaattatttccaattgccagcattttatttttacaacacaaacttactatttagacctattatagaatctcaaagtcatctaagacaaagcctatcaaagactgaaagattcatattttataacttcattcaatacatacaaatattcttaaattttaccataaagtcactctgtaaagtataatctgtttattaacaatatttatttcaccagattaaaaaaatagctataaaatcaggatgcttttggacttaggagattgaactttagaaaatgttttctaacaatcttgtttaagtttataatcttatgtaacaacataatttatattaattcattattaattcaataagtgttcattaaaatattttttctttagaagtcaggcaattttggggttctttttgacatgaaattctcaagttttctctcatcagtacaagaaggtatagcgttgcatgtatataaatgcatcattcacaattccataggtgaaaaacaatgactatggttctaggaagcaggcaaagcaatcaacagatgaagaaggaaactgctatttctctactagtgacagataaacatttttggcaaggagggtatttttctgtttctctacaaaataaaaaagcagattagaaaacagtgtcatttgcattgaaagctttttagaatcccaatttcagcaacattagcctaaattgtttcttaatagacccaaagagttcaagtttccaacaagtacccaacctttttcttggaagtaatttacttcctggaagaatctgattactgtattattttattttttaataccattctaggtgtccatgggccagaatgaaataagaaatgaccatacttacctggaaagctttacttagcatatgttcaccttccttagatccaagcaaatttactattatttgtttaccatataagttcttaagtgttctaaaatgcctatttaagaaagaaaggaaataaatacatgtcaaataagaagcccaattttttcaataaacaataatccattattaaatataacttacatggcagtattttaaacacagaattggaaaactgggtgcgaattcattgtacatggtctcaaagccgaatttacgaaaactcatgaatgcaacttcctctctgacttatgggtactgagacttccacccctgttggagctgtggaggcatccagcttctgcccactctgtgaggctggcaccagacaagacagacaccagccataagcttgactggaaaggcagtaagggcagatggcaaagggctgctgctcacatgtgaggacatcacctactccgttgagtattcagagggacctccttactagctccagtcttcagaaaaatgggccccaaatacgagtcttttctctttccagcttctaaccattccagaaactatgtagagcaatgccacacaaagaaatgtaacataaaccacacctataatgttaaattttcaagaaggtgcatttataaacatgaaattaattatactttctttaactcaacatgtctaaaatatcatttcaacatgtaatcaatataaaacaactacagttaacctttcaacaacacaggtttgaactgtgcaagtccacttatatatggatttttttcaaccaaagaagaatcaaaactacagtattcctggcatgcaaaacccatgaatatgaatgatgacttttcataagcatgggttccacatggccgactgtgggacttgagtatgcacagattttggtatgtgagggtagaaccaatactctgagtataccgaacatgattttactaatgagataccttacattcttttttattttttaaggcagtctttgaaatctagtgtgcattttatacttgcagcacatctcaactgagactagtcacatttcaagtgcccagtagctacatgtggctagtggctgctatactggacaatgcgcccacagaggaagttttaaggtcaagagatcaagacccacacttccagcactaccacccccagaagtcgtaacactaggtgtcactgtctttcaattaaattaggagtcagaggaattttatttaaagccaaaaaagtttgaagtgaatcagtaaatacaagcagtcccactgcttagcaatatcaaaacttaaagcactatgtaaaaattgtcttacctgtcaaaagcaggtgcattggcttcaaatccccttgacatacggacacgatgagatcccaccttagacaagaaaaatatatttaatcaaaccaaaaaccaacatatagacgaaagaaatatcactgcttacaatatctaacaatttctttgctgaacacacagtcgttaatcaaataactgatttccattcatgatatgcttttaaaaaaacaagttccagggaatttccaccctccacctttatttttaaaaaaccaacctcatcaaaaaaagaagttacatcattatgaaatactcgtaaactagtaggaatttttattgatgaaaactatttttaaaggtgttttcatatatggtactttgttttaagttcaaactacatgccctgtgtaacagatactattaccatttgggtaattaaaaaaaccaaaataccaacaggtaaaataacttgctatctgagatcaacataaccaattccaaaagagattcagatgagactttatgtctctgacctaaattcctactcctccaagctgcctaccaatacaaatgtctatgtgttttcttctctactatgttgaatattctattcacaccaaagttccaccaaattgagaatatcattccttcctggaaaagcagactttccaagtcaaccttgccatcacccaattatagtatttgcacattttgcagaatcaggaattttgggttaagcaaattaaacaagatggaaaatatctacctattgtatattgttataatttttcttttcttacacaggagaatagcagagagatgaggcataattgagaaagatataacatgccaagaagaaatatataggtgagaccagattatttccctgaacttcaatttaaacatttctctctgagacgttggaatgaaggttgcccaatcacaacaaggatcactgagggggggcaaaaaagttgcccaaaattcattcttgctaacctgtgaacaaagtgcttttttttgtgggggacggagtctcactctgttgccaggctggagtgcattggcgtgatctcggctcactgcaacctctgcctcccgggttcaggcgattctcctgcctcagcctcccgagtggctgggactacaggcgcccgccaccacgcccagctaatttttgtatttttagtagagacagggtttcgccatgttggccaggatggtctcaatctcttgaccttgtgatctgcccgcctcagcctcccaaagtgctgggattacaggcatgagccaccgcgccccgcgcaaagtgcttttaaagagggtgtaaaaggggggttgtcaaatcagtcatgtaattggacaagtaaaaccagaaaataaactctaatatgctcatccaattccaaaactgaattaacagtacagtattatcattcattaagcattatccctcactgcactaagtcagataatctaatgagtattctgataaccaggggattctctctttaatttttaaataagaaatcaattagcctaatgtcacatctgtgttcaatttcattttatggtacttaataatattcataaaagtttaaaatttgaaagacgtatgtcccaggacattaagcattttagactgcagaaaactcacaagttgatactttttctttggagtaatcccagattaattgcctatcactccatacaagttcaaaacttagcatttttgtttactgattaacatttattttgcatagtactgcaacggtgcataaggtgaaaaaaatccagttttcatgtcttccaggtaatgcctatggttgttttccaccactctgttccccaacacatatatacattcagctatgtatcacagctctcatagcaatatactggctagactagattagatttctgtttttgtgttattagagacagggtctcactctgtaaccatgctggaatgcagtggtgcaaccatagctcactgcagcctcgacctcctgggctcaagggatcctcccacctcagcctgctgagtagctgagactacaggcacacgtcaccatgcccgaatgatttttatttttttatttttttgtagaaatatgggtctatgttgcccaggatggtcttgaactcctggtctcaagtaatcctcccatcatggcctcctagactaggttttattactcaatgttgaaagaaaagttttacaataacagagctattgccaatcgtgataaaagtagcactccagaaagtgttaaggctttaaataaccataactttacccaattaaaaaaaagttgcggccaggtgtggtggctcatgcctgtaatcccagtacttggggaggccgaggcagctggatcacctgaggtcaggagttcgagaccagcggatcacctgaggtcaggagtttgagaccggcctgaccaacatggtgaaaccttgtctctactaaaatacaaaaattagctgggcatggtggcacatgcctgtaatcccagctactcgggatgctgaggtaggagaatcacttgaagccgggaggcggaggttgcggtgagccaagactgtgccattgcactccaatgggcaacaagagctaaattccaacttgggggaaaaaaaaagcttgcattaaaggtatttttaaaaatcatttaattgtgtggtatggtatatcattttccatcaatattacttctttaccttcacatatttctgaaatttcaaccaaaaattgggggtagaccttacaatgtttaccattttttgactgattgatacggtttggatctgtgtaccccctaaatctcattctgaattgtaacccccaaggttgaaggtggggtctggtgggaggtgactgaatcatgggggtggagttctcatgaatggtttggcactatgcccccttgtattgttctcatactagtgagtgagttctcatgagatctggttacttaaaagtgtgtagcacctcgctcttatctttcttttgctcctgctcccaccatgtgagactcctcgctccccttttgccttttgccatgactggaagcttcctgaagcctccccagaagcagatgctgccattcttcctgtacaacctgcagaaccataagccaattaaacttctttcttcataaattactcagacttgggtatttctttacagcaatgtgagaatggactaataaactgatatatactgtaaatgtagtataataatatatgatctgagtattataagttataaatgctaaacaacttcagggaaaggaaatcataagtaaaaggaaaatcacaagtcaaaggaaatcataagtaagttgccagcactaaaaatgtcattcttacttgtgtaacaccttatgacaattcttataatgcctcaaacaaattcatcttggtatttatcttttccataaaaggcctgagtgcccaaatggcaacctctctatgaagcatcattatatctttgaatctctcatagcacctagcataaaataacatacacaggaagaactcaagtatttagtgaagagatctgagtggccactgaaggacaataaatcttaattttggaagtagaggattcctgctagaaaactgcaaggcctgaagttggacaggctgagtaaaccagatcataaggacataggtgcctagtaaatctgacacgcataacatatatatcaaaaataagaagacctgtcggagctagtaggaagcagggcctagagggacaagacagaaaactgtgagaatcttccaggctagaagaaattatgaaaaccttaactcagaggatagtagtgggaataaaaagaaagtcctactgcctagaacaatgctgagactaatggtaacagggctacttttcacttggtcaggactggctgcttcatagccattagagtaggatcttataaaatagaagttcttgactttgagtggtagagaacttggttaaaaatgaggattcctggccgggcacggtggctcatgcctgtaatcccagtcctttgggaggccaaggcaggtggatcacctgagatcaggagtgcaagaccagtctggtcaatatggtgaaaccccatttctactaaaaataaaaaaattagccaagtgtggtggcacgcgcctatagtcccagctctcgggaggctgaggtaggagaattgcttgaccctgggaggcggaggttgcagtaagctgagatcgcaccactgcactccagcctgggcgacagagcatcattccgtgccaaaaaaaaaatccataattttccacctatcaccacataacattagccaaccagaccgtataggaaggaaagcacacaggagaaggaaggcacaaggaagtcccactcaaggaagatccctcagtgtaactactcaggacgcaaccttattggatcatcaaaacactgtaattcagaacttattaaaataacacaggccaagtacagtggctcaggcctgtaatcctagcattttgggaggccaaggcaggagaactgtttgcccaggagttcaagaccatcctgggcaacaaggtgggaccctgtctctacaaaaaatagtggtatgtgcctgtagtcccagctacctggcaggctgaggtgggaggatcacttgagcctgggagatcgaggctgcagtgagccatgattgcaccagtgcactcaagcctgggtggcagagtgagaccctgtctcaaataaataaatatataaataaataaatataaataaattaaacaaagaaataaaataacataaaaacagtgtaccatagggctcataaactggttattagaatctctaacactagcctgtccctaaaacaaaagcattcacctcgcatcacatcagggtttcagcaatgttcttaaagcaaatactccaaacacccactgttgatcatgaaagcgtaggagaagtggggttctgttggcattctctcctaagggaaatttagggaaagatatatctatttacgttatccctacaaagataaaacaagtcaaatcgtcttgacaagaattcaagaatttttgcagagcagtagaagtgttaatccttgttaactcttagactgtcttaaataaaatgttactaaaaaggttcaagtagtctgtaatttttctctgcaataaccagtctaagatgtaagagatccagcagtcaaataaaggaagaaagatttttttttctttcccttttctcaatactataggctgaagcaccaaacttactagactatacatacccagatcctaaagtaaatatgatatacttcaaggactaataaattttgaataaaaataaaatgtcaacaatagttaacccttacatggtgctgactgggggccaggtgctattctaagtgcttttaatttaatccttacaacaaccctataaagtaggtactattaatattattcccattatacagataaggaaactgagacacacaagggttaaattatttgcccaagatcacacagctagtagtggtagagtaaagatcccaattaagaagtctggttcccaaggctttgttttatctactacattcttctgcctaaagagactaaatcattatatactaagataagaaggtaataaatatggaatcacattgcaaatcaatacactataaagacttcaaaatttttaacactaaatacagcagctcaatttcaatggctatttgaaagagcattaaaagaaaaaatatctaagataattccagaaactctgtactcgtctagacccttatttgcaaatccagctaacattattagatggaataatggaaccatcaatgaattaattaataaactatccagaaagtttagaaaatatgaaaattgttcaaaaaacaaaaataactgaatgtcaaacacatacttgcaaccctggttgctcccagaacaatggaacagatcctcggatttgtatgaaggaagaaactgagtcatctaagtacacaacctacagaaaaaaaaataatatgtaaactatttccacagaaaagttgttacacttacattagaaaaacaaatttactaaaatctattgcatactagttacattttatgatctaactctcatatacaattgtccaaaacaggccactatacaggtttgacttttttttctgttagcgatattaaccaaaaaaattagtaaaattataagcataagattcacaactttaaaaaataaattccttttaaatcttaatattttacatacatatctttatatttcattttgtttagctctttataacctaatttgaagatctgtgttgggctgggttcatggcctgaatttataatcatatagtttcatagccaaaaatatcataatttctgatttttagatggtacacatatttgccattaagagctgggtttaatttcacttcacaaaaaaacaagttgtctaactctacagctgaggattttaaaattcattaaaattcaataccaaaacacacaacactgactatgtcatgctgattagtgacatcttcttacctagatgaagagccacaccaaaataagttttttttagggaagcctttttttaaggcccataagtaaccaagaacaatcataaaacattatagatgttaaaataagctccgaatcaaataaaaatctgttattctagtattttctgtgcttctcctataataaattaattaagtaatataaaacactatatatacctgttctgtttctacaaaattggcaacatgaccatcatcatttgttccccggacattaaacctggtcccagctcgttcacagcttaatcttgaaatgaggcaagccttcgcctgtttatgagcagcataaattgttctgatttctactcctccacacataagacgtaataaccagtcatcacaattcacgccatagtgtttgagatgcaaatgcaaagactgattcctaataggaaaagaaataaatgattagcttatggaatactaagtaacaaagtatgacttttaaaataatctcctggaaaattaatttaatattattaaatttaaaggcacaaacaacaaatcaattcatttacatttactatgctagggatcagaagatagggctataaaacgagatccttcaacatgtgatctatgatccacagaaaaggagtatttttgtgtttttagtatctgtggcccatttctgttatgtctttatatataatgtgtttataacctaacttgttccaaaaaggaatacatatgcatgtccccaccccaatttatgaagctctactttttaaaaaaatatttatttatttatttatttatttatttatttatttatttatttttgagatggagtctcggaatgttgcccaggctggagtgcagtggcattatctcgtctcactgcaacctctgtctcccaggttcaagcgattcttctgcctcagcctcccacgtagctgggattacaggcatgcaccaccaagccgggctaattttttgttttgttttgtttttttttttcttttttgagacggagtctcgctctgtcgcccaggttggagtgcagtggcgggatcttggctcactgcaagctctgcctcccagttttatgtcattctcctgcctcagcctcctgagtagctgggaccacaggcgcccaccaccatgcttggctaattttttgtatttttggtagagacggggtttccccgtgttagtgttagccaggatggtcctgaactcctgaccttgtgatccacctgcctcggcctcccaaagtgctgggattacaggcgtgagccaccgcgcccgcccatgaagctctacttttaaggcttgacttttataaggctctattttaattaatttaaatttaaatagcaagatgtggctagtggctaccacattagatagtgcaggcatagggtttatcatcgctccaaatacttttagcattctaggtaacagatgtggcctggtttccaaacttttttcagagaaacaaattttattcaaacaaacatgcagaagcccaatgattatgatacagataaaagctgctatggctaaagtggggattgggactgaactttgctgggttggccttctcaccctgattacccctcagggatctctcctggaaccttagacctccacagaacatataaagaagctactaacaatataccactaaggaaaatacattgttaagtggaaaaactctatcaatttgaaaatgagttttctatattattgaagcttgactctttaggttttaagtggaattcttctacttaagtgctccgtactctctctctcttcctgtcttaaataaggtataaaagatgtaatagcattatcttgaagactcacagcaatagccccaactccctgccagcccctcagattacaggctgcaacagagataaaaagggtggtcagcagttctggaaaaccagctatgaccccaacccctcttatccatccaggaaatcacacgggaatataaatgagtgatgatattacaacagggataatgttaaatctgatgaccattacttattttaaaaatacactgacttaaacttccatactttactattacccacattgatctgaggcaaagttcaaactggttgtgacccagtatgtccaaccaccacagctgagacctacgccacagcaaagttataagaaacttacttgtcctcatttaaatagaccttaaatcctatgcattttgtgcaggcagagtttctctctctgctgtcagttttcatttttctttgctgtcagtgtgtcactgttttagcatttaaatttatacatgacttttgactggcagcagcttagaatttccaatggagtaaagctatctgggctttgtcacaggtatctgccactctttggctacaaaaattacatggttgtatcctggaaaatattgctactaagtgcaagggtatgcacaatgaattccaaaagttcccgtttttctatataaactgaagctcaagaatgccaatccttagcaaaattgtaaaatgagcaaaattcacctttggtgctctagctgtccctttgttcaacctgtctcctgctggacaaatctcaggctttcttttatctgactttgcccccatctctactcttaagtgaattaaaaaaaaaaaaaaaggaggccaagtacggtggctcatgcctataatcctagcactttgggaggctaaggtgggggggatcacttgaggtcaggagttggagaccagcctggccaacgtggtgaaaccccatccttattaaaaacacaaaaatattagcctgcgtggtggcgcacgcctgtggtcccagctacccaggaggctgaggcaggagaattgcttgaacccaggaggtgaaggttgcagtgagccaagatcgcgccactgcgctccagcctgggcgacagagtgacactcaaaaaaatcaatcaaccaaccatccaattaatcatgcctattgattaaacctaggcaatatatctgcatctgcttggacttctaattgttgtatgaaagcttttatctctcaatctaagaaactttgggtaaaaatgaggagggaaaaaaatgtaaggacagctgcaacacatttaccttttcaagggacttcaacatcttctactagaaaaaatgtagtgttggcatggttttaactcttggaagcctatttctcaatgcttcacaaaagtacatcccatcactgctagcttctttgggcaggcaggaactcatgtccattcatctgccctgttagtccctgcatcccctctctcctttcctctccctcatggtctcctcctctgctaaacccaagtctctaacacataatgctataaaccctgtttttattctgtccactcttctccctgatgccaccactctgggtcaaaacacttccatgtgagctacaacgtgaccaagctgttgctctaaagttaagtttcttatcctaagtttgttgttgactttgagtcttctgacagctagggcaaatgggtgacacccgaatgtgctactcaaggactatataagtgacagtgaaagtgtgagagagaaaaagtacacaagaggaaaccatcttgaatctgaactgttaagggaggccaagagcaaagagtcctgaactttggccttataacatatgtcaatataataatacataatttgcacatgatatcaagagaaaaagtcaacatcaatgctggctgtaaacaacagaaccactatactagaaatctggtctgctgcaatagaacaatgctaattatagtcccatgtgttctgctcaccatttgtgcctacttagaatacagcacagttatgcataatcatgaaatacatcacacttacctacataagtcctaacttattatagtactagattttgtcccagtatactacttcttcacaatctgttgctcttgaatcaagaccacctacttataaccttaaaatttagaataataagggaatgttggcttagaaagggaatgccgccagagacaagatctcaaaaccaagaataggaaacgtgagtaacacagttttgttacaattaaattcatttctaaatatacacaactattttaaatgtattttggaaatgaaagttcagtgtagactggggggagcacaggggttttatgtcacatgccaacttcaataaaccgacattggctgcctgccatgctctgctgaggactccagagaaggaaagatggatacactcaattagcaatgtctatcccttgttatctctagacataacaactgctgaactttttttctttgtaaagcaagcaaaagttttattgaggaagtacaagtacactccaagaaaggagtgggctgaccctgctggaaacacccccaagacattctgcattgtgatcttctattgtctcagttctttctttacccagttctcaccaaggtttgggggatcctcccttactgtgcttaatgcacatgcacgggaaccagtgatcaatatgaatcctatctaatggtggcactgcttattaccaccaccccaggaaggtatagccatcaattttgtactcattatgcctgctcagctctcaggaattcccctttgcctttttccttccttatcaggatctacttaacaacattctgacagttcgaccacggagtgagtactgagcatcctaagaggagttccggggcattctttccaacacgtataccaccccctcgtgcctgctcatatctgactgtctactcttacattgctccctcaaggcgttgggacccagaaatcttttgggagatgaggtagaggtcattctctgtagctacttgctgctgaaaaggggcatcgagggtcttcagggttcttcctcctttcttgctgtcacggtgaggaggtttttgatgactgaacaactgctgaacatattatgtcccaaatcaccaaaagggaaaaaatgaactcaccagaaaaatctattatcagttgtctgttcttgcatgctacgatgcgcattaagactcaaatctaaactgatgccagatgcagaccatgcaaaataaaagtttcctgaattcaaaactttccgcacttctgaaatgcgatcctcatctgaagaatcgattcgcagtgatataaactcagtggaagtaactcggaaaacttcagattcttgaatttttccaacagacatacatccagtgactaggaccagataatgtaacatagtatcacctgcaaaacccaaagattttactggatgaaaaatcccaacattttcaagctattccatttcttcttgcacctctattttttaaatctgacattgtgattattttaaacttatcatggatgtgttgaaattcactagacattttagttgaaaaaaatccttgtttaaatatattaagtataataaagcatttaaacattaacaggataatctcacacgaaattgttcctgaacttattctgaggctaaaaaaactttatcgaataattggctgggtgcggtggctcacgcctgtaatcccagcactttgggaggctgaggcaggtggatcacctgaggccgggaattaaagaccaccctgactaacatggagaaaccccatctctactaaaaatacaaaaactagctgggcgtggtggtgcatgcctgtgatcccagctactcaggaggctgaggcaggagaatcacttgaacctggaaggtggagtctgcagtgagccaagatcacaccattgcactccagcctgggcaacaggagctaaaactacgtctcaaaaaaaaccacacgaacaaacaaacaagaaaaaaactttatcaaataaaaaagtatgtgttaccttctctacttttgcttaatgattgtcagaaaattcaggtaagataatgaattcacactcattttaacaagttctttgtaaatagtaaagttgaaaaaatggtatactattatcagctgatgatgttgatgacaaatggacaaaagtctctggtaacaacttataaagcaatttggtttacaaaaactttcacagagatttttttcatgtaattatgacaaaaagcctatgaaattagtataaagttgaaattgagcaatggtatactgtgagcatgggctctgacacaggtagaagcggccctgaatcttggctccattacttattacctggaccaatttcagtatgtagcataacgaacctgagatatcatctcttataaaaagagattaaagcaaatacctcattatactgtgaggcttacccaggagtaatcagtaaagcacctaagcgcagtgctttatatgtgatagattcataacaaatgacaaatctccattttatagaccagtgctactcaaagtatggtccatgaactgttaccagctcacaatgagaaaggacacttacaccagaatggaaatcaactatattactaagttcaccctttagttgagctgacttttttttctagtaagactttatcaatgaaggaagccacatgttgatttgtatcatagtgcaagctccttatcttatcacggatcaataacaaaatgatttatggaccagtaccaatgttgaagaacactttgagctgcaaaattacagataaactagtaactgcaaaggttactctgcagctcacggtgacattacgtggcaaaaaaaaaaaaaaggctcaagcagacactttctgaattcaaaacagatgtcttttccaatacaaaccaagaaaaatcagtgtagttctcatgcagacactttttcctaaatgcactgaatcaacaaaaaggagaatgttctgattttctcttttgacaactgatacttatctcttcaagtggtcaaaccagagactgtctccgaacttccactcacatgagtttgagcatgtagcacgcctttttgggcaacaaacattatcacaatattagctacattaatgtttaaaagatgttagcacatgtgtagcttaaatatggagtctacaataattcatagctagtccctctcaaatccttagaattacaaaatagaaatgaaaaaatggatgaattctactgaatgataaacttaccaagatttaaccgcagaacacctaagagtccatatgcatccagtactttggagtatgtacccttgattgcctctttttctgcagatgctacaaaaaaaagttttagtttaagaaaaatgacctgaaacattggattctatttagctaagtataaatccagagtttcaatcaaaagtttctaaatctgatattcttaaaataaatgtactgcatattttcttaaactagtaacattagtattcttcccaaagagttaataaattattccaagaccatctattaattaatccatcctgtccactgatctgaactctgtcttcttacccttttattcttgacagaatagtgctcgacacttagaaactgacaaaacatttaaatgataaaagctaatggcaacacttgactacacaaatgtagggcaagaatagggaaatctgattctgaaaggacaaaagtctggtctttgccttgatttatttcttctgctataaagttaacgttaccttgttaatgaatataaaccacagaataattttcctaagacaggctattatgattattctattgagaagaaaaaacaacaaaaaaaaatcaaatcctgaaacgttaaagaaaaaaccttcctagcacttagcaattacacattaaaaatttcacaaagaaccaaagaaatattaacaaccagtatttcaaaggacaaatacaaataatacatcccacagtctacagttgatccttgagaaagataccttcctttccttccaggtttctttccttctttgcttttttcccttttccattatctacaccacactcaactcacctcctggctgactggttcataccttatttacttcttatctcttacacttatcccctttcctttatctacaaaataggatgtttggcaacactgacgtgttccacgttagaaaatcacgtaagtagatacttatgactgtctcatttcctgtccatctttattgccaacaaaagggctcttctcagcctactgctttgcctaatactcctttgtactttgcattagagatcttctactttgcctgaagctcttctccagagtcctatagaacatctcactttccctgcctgcttcacctcttttcagaccacgtaggcttaagccttcttcctagtgatctggcttctgccttctgatgagttttgctctgctagttgcagcacaggctaagactaactgactcagtcactcaattagctgatattttcacgattctctaacatgttcattattaagtgtgggccattatcaaaccacccagtatgaaattagggagtggagattcgccaacccgttaaagtgatggggatttatatttcattctgtattccttgagttcctattattattacatcttatgtttatccaacagttgatcctaacattccatgacaagcaacccaaatgtaaaacattacaatataaactttaattacattttataaagcaaaatagaattgccttctaaatactgcctcgttaagagtaccatatgtactgtaaacattagagagacttgttatacctctcaggacagaaggcatgacttccaggataaatattattctagaggtttacaagttatatgccatatacatttaaaatacaatcactaatatagtaatatagaaagtactagatatatccatttcagcagcaatcatcatttgggttcaaatgccaggaggcagtaggagttaagaagaaaatatagttttatttttatttttattttttttttttgagacagaggctggagttcagtgacacaatcacagctcaatgcagccttgacctccagggctcaagtaatcctcccacctcagcctcccaaggagctgggactacaggcatgtgccactatgtccagctaattttttttattttttatttttgtagagatacagtttctctacgttgcccaggctggttggaaactctcgggctcaagcaatcctcctgtctgagcctctcgaagtgctaggattacaggcatgggcaaaaaacatattcttaacattaagtcaccaccttcctttagaaaacagagaagtcattctataacttaaattaccatgtaacaaaatgttctctcttctaataatgcataataactatcttctcattaattacactccaaatacataaacgtatgtctctcaggactgatgaaggcccatctattagactatcatctaattcaaacatgcaaacaaatgccttgcagtttagttatttacatgtttgtattctattcggacactcaggaaacaggatacacacacacccacacacacaccttaaagtgcatactcttagagccaaaggtacttttaactccagacactccaaatttcttaagagaaaacagtatcttcttcataaatacatttgtatctgaaggacagtagatgtttccctactttacgatatatgcttcaaaggttttgagtagactggagggaggcccagtaatggccactaggagaaggatggcctgtgcaagaagctgaagctagaggcaggggaaaagggcgtccacttgtgggaggggccgcctggcatgagttcctgaagtctgactagggtgaggagaggactgtccacccatgggtgttaggggcaccccggcatggtaagttagagcttgagagggatgggaaaggcagggttttgaagtgccagtggggtaaggagggcacctatgcagtggaggaggctacactggcaataggagagtggttatctatggggtatgatcaaggataatgagagccaggtttctcactgtcagagaaggtactcacaaatgcaaacagagaaactagaatggacagtgttgattagaattggagttaccaggccgggtatggtggctcacgtctgtaatcccagcactttgggaggcccaggtgggcggattatgaggtcaagagattgagaccatcctggccaacatggtgaaaccctgtctctacgaaaaacacaaaaaattagccaggtgtggtggcaggcacatgtagtcccagctactcgggaagttgaggcaggagaatcacttgaacctgggaggcgtaggttgcagtaaaccgagattgcaccactgcactccagcctggtgacagagtgagactctgtctcaaaaaaaaaaaaaaagaattggagttaccagtgttttctagatagactaaagacagacaaaaagatagaaacacagatataagtatatatgtcatatacatatatagttacatatactccttagcactagccactgagcagacccaggatctacaatactctgacagcaatgcgcatacctagcatactttggcttctacataccattctccactaaaaggaactactagcattccttggagaaatggttgattccagggcaaaggcagggacaaaatgagcctaaaacatagtattgtgccaaaaagtaagcaagtgttcaaaggataattgagatatgtcacaaacatgcagaaggcagcttgaaggggcttctactggtgaaatccaggacaatttgagcatcaaaataaataataagagtaatgggttataagcctatgaattgaaagtctcatgaggaatgggcaaaacaattataaagggaaaaaaagtcttcccgacatgcctagcaaaccatcacctttatcaagtaatcaaagtgaacaccaacaggggcctggcacagtggctcacgcctgtaatcccagcacttcgggaagctgatgcagaaggaccccttgaacccaggagttcgagaccagcctgggcaacgtggcgagaccctgtctctacaaaaaaatataaaaattatccaggtgtggtggcatgcacctggggtcccaactactcaggaggctgtggcgggaaggttgattgagcctgggaagtcaaggctgcagtgagctgagatcatgccactgtactccagcctggccgacagagtgaaaccctgtctcaacaacaacagcaaaccaaagtgaacaccaacagtaagaggacaagtcaaaactgcgagccacttgtcaagacactatgaaaaaagcaccattgctgcaatactcctgccagaggtgaataacctgaatctacgcatgagccatcagacagacccaaagtgagggagaatctacaaagtaactggttttcactttcaacatttttaaggccacaaatgtcacagatcgagaaatttttccatttaaggagactaaagagacatgacaacaaaataaaatgtacacatctgaactggatccttttgctataaaagacattgttggggcaattggtaaaaattgaagagaggataaggattagatagccataatacatcactgttaattttatgatagttttacaagagaatgtctttctaggaaatacatagcaaagtatttgggggtgatgggtcatcatgtcagcaacctattcttaaaaagtccagagaatccactcagttctggggcaaaaaaaaaaaaaaagaagtccagaggaaaaaaagttatttgtactatacttcaacctttctttatgttttaaattgctgcaaaattaaaattttttcaatgtaaccagcaaaaataatttttaaaaatacatatacttattcccagataaagaagcttttatctctgacgttaataaggtaaactcttctaaataccttgttattccctccctgtacatttttttaatggggaaaaaagatttccttattttatgagactccataaacttcacaaaaatacatgatggaagggggatgaacctaattaaatttctgccccacttctctgataatttaattccagaaaattattttagaatcttctactataaagagattatttaaaataagaaaggctatatacaacattacataaaataatatgtataatctttagataaaatacagcacttggaaatattttacaatcatcaccatcattctttttcccttaataatctcccttgcatcccatgcttcagccaaaatgaataattttgttgcccacatgttccacattctcttccctttctcccttttttcatactgttgtttcatctggaccaacctttaatcatctttgtgtttccaaatattacctatccttcagttccaaattaaaacaccacttcccttcccaaagattttccctgatcactctagctggaggtaaatctttctcctattttatactatagttacatgtaaactagtaacaacagaaactaagtcttatttctttttcctttttttttttttttttttttgagacaggatctcactctatcacccaccctggagtacagtggcacaatcatgactcactgtaacctcaagctcctgggctcaagtgatcctcctgcctcagcctccttcctgagtagctaggactacaggcactaatactacaggactactactgagtagtattaggactacaggtacgtgccaccatacctggttaatttttattttttgtagagacagggtctttctatgttgcccaggctggtctgaaacttctggcttcaagtgatcctcctgccttggcctcgcaaagtactgggattacaggcatgagcaactgcacctagcctcatttccttatatctcaacacaatacctaacctaacacagagactctgaatggaacactgcaattgctgattaaatgttcatctaatagacaaaaacaaatggaaaggttgtgcattaaagaacatgttttgctaatataaaaataatatataaagtggatcacctgaggttgggagatcgaaaccagcctggccatcatggtgaaaccccgtctctattaaaaatacaaaaattaggtgggcgtgatgatgcatgtctgtaatcccagctacttgggaggctgaggcaggagaactgcttgagcctgggaggcggaggttgcagtgagccaagatgtgccaccgcactccagcctgggtgacacagtgagactccgtctcaaaaaagaggtaaaacattttactttatcattgaaagtatttgaatgccctcattactgagattcacattcaacaactcctcagttacgtctggaaactttcaaatgtgtatgcctgtggcagggagtagtaaggtgggggtgggaaatataggcattgttaaatggttgctaactagggtttaaaatactgaagtttatgaagtggcagggtgtgtggggagctcagaggaaacaaactgaaagaatgagcggaaatgaaagttcggaagataccgtgttagggaggaagttcaggtcactttcctgctagtgcagtctttcaaggcatccactgcactttcaacgaatggaataaactcccttttgtgaagaggtattttttttcccctcctattcatggtggttattaaacaaacgagatgctaggcaaaacaaacctttctttgtaagttactgatttctaaccataagtaggtaggaatgtcccagaagagaattgctttcggagtgattctgagcccatcaagatcgacagcagttcaggtgaggtaaggcggcctgcaccgcattagttcacatgctgaacacataagctaaagcaaattccaacttctaaagtttctgctataacacctcaggaataaatagtacctaactccctctatagcttattttaaaggaaaagactatttttcccatgtcatactcaacaccatctttcattcataccttttcttaggtaccttttttttttttcatttgataccagctctttattagaaaagaaaaacttctttgtgggcccaaaaagaatcattttgctgggtgtggtggctcacgcctgtaatcctaacactttaagaggccaagcaagtggattgcttgaacccaagagttcaacaccatcctaggcaagatagcaagaccccacctctaaaaaataaaaaataaaggtggaacaatatgtaacaggtgagggataaccaaaacttgccatataaagacaataagaagattttaacaattaacaagattcatttttcaatggcttgttaatcacagaacaattaaaaagctaaataaaaaccaatcttacttatgtattagaaatatatttcaattcacccatggatccaacacgcttttagacagtaaaatttttactgacttaagaaaaaacactgccggttgggcacagtggctcacacctataatcccagcactttgggaggcccaaggtgggtggctcactgaggtcaggagtttgaaaccagcatggtgaaaccctgtctctactaaaaatacaaaaattagcagggcgtggtggcgcacaactgtagtcccagctagtcaggaggctacggcaggagaatcacttgaagccggcaggcggaggtagtagtgagccaagatcacaccaccgcctttccaccctgggcgacacagcaagactctgtctcaaaaaaaaaaaaaaaaaaaaaaaagaaagagattttatggagtgtttttttttttttgagacagagtctcactcttgtcacctaggctagagtgcagtgacgcgatcttggctcactgtaaccttcgcctcctgggttcaagcaattctcctgcctcagcctctcgagtagctgggattacaggtgcccaccaacacgcccagctaatttttgtatttttagtagagatggggtttcaccattttggctaggctggtcttgaactcctgagctccggtgatcctcccaccttggcttcccaaagtgctgggattataggcgtaagccatggtgtccagccaaaaacactgcctattaaactcatgtacttatgttatgcttaaagagtattgacagaattctcactgccatgtgtttcatgtgaaagaaatggaaatcaggtggggtgtggtggctcatgcctgtaatcccagcactttgggaggccaaggtgggaggatcacttgaagtcaggagtttgagactagcctggccaacatggtaaaaaacccatctctactacaaaaaatacaaaaattagccgggcatggttgcagacacctgtaatcccagctacttggaaggctaaggcataaaagctcgaacccaggaggttgaggttgcagtgagccgagattacatcattgtactccagcctgagtgacagaacaagatgccttctcaaaataaataaataaaaacataaataaataaataaataaggagggagagatagtaggtagaaatatagaaaaacaaaagtgtccatgagttgatattatggaggctaggtgacatatgtaacagttacactatttctccaaataaaatgttaaaaaaattattacattctttgaactattggataaattcagaaaggagagagataactctggccaattatcttgagacagccagaagctactggaattctaagggatcagagaagaacttttctctaattaccctagaccaggagtgcattagccaaaagtttaacagacatttgaacttttttttttttcccaaacaggatctctcactctcacccaagcctgagtgcagtggcatgatcatagctcactgtaacctgaaacccctgggctcaagcgattctcccgcctcaacctcccaaagtgctgggattataagtgtgagccattgcacctgattgatttggacttttataaacttcaaagggacttgtaagtcctacaatctttagaatggccccatagcccacacttcccaaggctctcaaacactcatcaaatagtaaatatataataaattaagaaaggaaaagatttagtaattccagaatggaggccttaggaagggtaaatattgttataccctgccatcaatgttttccttatattcttcctaaataatttagttttaatattctaactgttgaaatggaaactatacttggaaaataataagtttgtttttgctcattatcacagaagttaggaaatatttaaaactatataaagccatgaggtagtaatatcctacaacttaattcagataactcaactccttccttattttagttttgtgcatgttttcaaacttcttttaactgaacaaattcatgcatgactgaagggagccccaacctacaacttttcctcgttaagctactggaaggtgacaaaaatagaaacggtagaggtggtctatttatagactacagaaaacactcagagtataaatatatcaattgttctctatcaaaatttaacatatcaattgtgctctatcatattatttgacatcctccacctttttcttttttctggagtgacttacttttttttttttttgagatggagtctcgttctgtcgccaggctggagtgcagtggtgtgatcttggctcactgcaacctccacctcctgtgttcaagcgattcttctgcctcagcctccagagtagctgggactacaggcgcgcgccaccatgcccagctaatttttgtatttttagtagaaacgggtttcaccatgttggccaggatggtctcgatctcttgacctcatgatctgcccacctcagcctcccagagtgctgggattacaggtgtgagccaccgcgcccagcaatgacttataatactatgtcatgtgacataactggcattattcagcattgttgtattacaacctcgtttctcaaattagaatttaaggcaaataatgaagtattaggatcaaatataaaaattcagatgaagacataatcatatacctatttcttgattttcatgagttgtggctctaaaagagaggcttgttaaacataacatagttgtcgcatgataatcacacctgcattgctaactccacatctgaacagaaaagaaacaaaattaacttcttatccaagagcaataggtaacttaaatgtcactttcattttactttaaaagtattttcaggattaaatttaaatgtaaatttctccaacttctgatggattataataatttaagctaaataataaagccatccaaatgaagggcctactatccaatgtcaacattctgctgtgggtcaaaccttgcagtctgagaatacactgttcttccccagctgatacagaagactaagctaaagaaggtcaataacaatgtaaaaataagactgcatgttagaatgatctctctagaaccacaatttgcctgtggttgcatgcactgcagtttgtggtgagcttatttgcatgcagacagcactttggtatagaaccagagaacctcctgtatgaggatcctagagatcatgtaatccaagcttctcattttcagaagaaaaagagtagagattagatcattcatccaagatcacataactagctggcagtaaagcttctttccatttcatcatatataaagagaaaaattattttaaaaggaaaaggtttctcttacaaaagtaattaaaattccagctgaaagatattaaactatctaaattaatgtcctatttaaacttcacattccaatcttggtgacatttaaggaaaaaaaaaaaactttcattcacgcaagaagtatttattgaatgcctaccatgcaccaggcccctggcaaggttctaggaataaaaacagtcagtaccgtgacaccttcttaggaatcagattaggaagacaggaattatataaccatacaaatgcaaaattataaattatagtaagtactataatggagttctaacagattacaatgggagaacctaattttaaattgtttgttggaggaggacaatgattagaataaacctcactgaggaagtgacctttatagtgagacaggaaggctagccaaataaacggtggagataaaaatgtttcaggcgacatacgtatatactgtgatccagcaattccattcctaagaatacagccaacagaaatgtgtacatatatgtaccaaaaaacatgtacaaggatgttcatacttgtgtcatttataatagcaaaattggaaataaagcaaatgtcaacaaaacagctaaatattttaatattcataaaatggactacactgcaacaaatatgagtaaactactgccacttgctacaacatggatgatttcccatatgtcaacatggatgatttcccatatgtcaacatggatgatttcccatatatcaacatggatgatttcccatatgtcaacatggatgatttcccatatgtcaacatggatgatttcccatatatcaacatggatgatttcccatatgtcaacatggatgatttcccatatatcaacatggatgatttcccatgtcaacatggatgatttcccatatgtcaacatggatgatttcccatatatcaacatggatgatttcccatatgtcaacatggatgatttcccatatgtcaacatggatgatttcccatatgtcaacatggatgatttcccatatgtcaacatggatgatttcccatatgtcaacatggatgatttcccatatatcaacatggatgatttcccatatatcaacatagatgatttcccatatgtcaacatggatgatttcccatatgtcaacatggatgatttcccatatgtcaacatggatgatttcccatatgtcaacatggatgatttcccatatatcaacatggatgatttcccatatatcaacatggatgatttcccatatatcaacatggatgatttcccatatatcaacatggatgatttcccatatgtcaacatggatgatttcccatatgtcaacatggatgatttcattgagtgaaaggagctagataccaaagaatacacagagaatgactccatttatgttaagctgaaaaacacttaaaactattccatgatgtaagaggtctgaatagtgattatctttgcagatcataataaagataactgggaaggagcatgaggggattattctctggaaagctctctggtatgctagtaataatattctatttctcaacccagttgtggtaataagggtatgttcattctataataatatatcaagctgtatgtttaagatttatatacttttctacatgtattataatttaaaaagcttattattttaaaaaaatacatttgagcagacggaacagcatatgtaaagaccctgacgccagaaagaatttggtacattcagaactgaaaggcggccaatgaggttagaacatagaaaccaagaggtaaagtggtaacaggttgaagagggaagcagaaactcgattttattgtaggtcatcttagagtttagattttaacttcagtggccaatcactgaagagtattaggcaggggattaataagatctaaaccatgttttttaaaagactggggtgtaggcgtggtaagtagaagcagagggaccagttaaggagggaattgtaatgatccatgaaagagacaacagtgtcttgattgaaacagagccagctaaatgcaggcagttgcatggaatctcaaggaaattaagaggaggaattgactagacttggtaatagagagaatgtgtgaaatgtgaggggaagaggtgttgaggatgattcttaagttgtttgaaacaacttggtagatggagtgcaatccattgacataagggagactgaaggaaagatcaggtttgaggatatgcagtggttggtaagaccatcaatacggtacctattccaactcttcctcatttggtagccaccaaacagtttgtgatactatggaaatcacagaaatttctaccttcttctgccaatgatctacctgatgcaaacagcacatgatatctcaacagtcatttttggttcaggaatacacaaacactcaatccggtgcaaggggaagtgcattttccttttgtgggttctaacccattatctgagtttcaaaaagctggatctcaattgtgtcatccaacataattattcaacccagctctcatcaatcctacgtcactttgccacaactaaaaatctgaaaactgtactttctactccattctctaagagaattgataaaactgggaacaagataggccaaagatatattcccaatgctaaccaaggaaagacaactaatgagcactaaggtacaaccagctagaaatttatttaattataagattctggaatttaaaaataaaaacaaaaagaggccgggcacggtggctcacgcctgtaaccccagcattttggggagctgaggcaggtggatcacttgatgtcaggagttcgagaccagcctggccagtaaggtgaaacctgtctctaataaagagatacaaaaatcagctgggcatggtggtgcacacccataatttcagctactcgggatgctgaggcaggagaatcacctgaacccaggaggctgaggttacagtgagccaagatcatgccactgcactccagcctgggcaacaaagtgagactctgtctcaaaaaaaaaaaaaattgaaaaaagaagattcattctacttatagttcacacatggtccacaggatattaaatgattttgtttatctatatttcagcaacacattcaagagattacagcaatcctatggtccactagtgaacagaatgaaacataactcataataaatatttattgctaagagctagttatataagtaaacacacctttatatataaaaagttaaataagactataatgaaatagaaacacaaaattttaataagtacatttaacatatagaaatatttaatgttttgagacaataaagtttttttttaatttttttcttttcactgactcagttggcccagaattatccaggaatttcaagggtctaaaattttttcattctgaactgaggaagtaatgagtatccaaccaagaagaatttatatatctctccaaatgccaaatttattttctccaagtgccaaatcattcatcatttggttcagtagctatgaaatgcaacccaatgtgaatgcatgtgctcacatacgtaacactactgatcagcaatggcttatatttataaactctatttaagctggaaaaagataaaatacaaattcttattaacaaccattaaaacactcaaagcaaattttaattgtcaccagtaaaaatcatgcacaatttttaaaactatacttccttttgatactctaacaaggctaaacaattgcactagcccattccactctttattgcttctttcactttgtatgcttctttcaaaatttcactgattcagactttataatctcaaaagttttgaaaatgttggtattggatactaagaaaggtaatactacaatattaaactgctagtcattataattagctcatattttttcaaccttcgaatgtctgaaaagtctttacatcttcatttgtggttgggtacaaaactctaggtgaatggtttggtttggtttcttccttccagtactttaaagatgttcccaatgtcctctggcttggattgcttgcaaagaaaagtctactatcattcttatcttcactcttctgtaaatgtgtgtcttttcttccttgggctacttttaagatcttctctgtatcactggtaaacagtaacttgatcatgtatttgggtatagtgttctgctttatgttcatttagcttcttggatatgtggattcatagctttcatgaaatttgcaaaagtgccagctattatttcttcaagtgtttttcttccctaccaacttctttctgggatccacatattcatgtatattgggtcaccggaagtcgtcctgcagttcactgatgctctgtgtatttatttattttagccttttttctctctgtattttattttggacagtttctattactatgtcttcaagtttgccaatcatttcttctacaatgtctaatatagtaatccctaccacatctagaagtctaatttgggtctttcactttttttttttttagagacggagtcttgctctgttgcccagactggaatgcaatggcatgctcttggctcactgcaacctccaactcctgggttcaagtaattctcctgcctcagcctctcgagtagctgggattacaggtgcctgccaccacgcccggctaattttgtatttttagtagagatgggatttcaccatgttggccaggctggtcttgaacacctgacctcaggtgatccgcccacctcggcctcccaaagtgctgggattaacagtgtaagccaccgtgcctggcctctttcacatttttcatatctcgtcttaacaggttcattttttcctctacttgttgaacatatggagtatatttacaatagctgttttaatgtccttgtctattacagcatctgtttctacatttgactttgctccttatgaggtatattttcctatattcctataaatattcttaaacttcgttctgggatacagttatttggaagttcggttacttggaaacagtggcatccctttgggtcttgcttttaagctttgttagggagggctggagtggaatttagtctaggactactttgcccctttactgaagcagtataccctttgcagtactcaacctaattctccatgcaggacttctccactctagttgttaaacatgaactattcccagccctgtgtgagctccagaaatttttctgcctactcctttttggtgattctttccctgcctcaaatggtttccttacacactggcaccgatcaacactgagctgaagtctcaaacggagtcctctacagatctctggagctctttgtgcaactgtctcatctctagtacacagccctgagattctggctgccttggcctccccatattccctactcaggaatcctgtcaagctttgcttgagtgactcttctgctgctgtggcctggaagctctccaggcagtaagctggagcattcataaaacccacctcatttgtttcccttctctcaggggtcagcatcttgtgctgccttttgttcaaggtctgcaaatcattccatgtattttgttcattttgttgttgttacttaaggtaggagggtaaatctagttcctgttactccactatggtcagaagctcccgttatagtcctgagttacgtatattttataggacaagttagaacatctgatagacctgagatgatgtaataaaaagccacagagtttttactattcagtgagagtggaagttctgcctttcctttttatttcctcatagcaaagttaagtggtgaagaaatgaaagcacttaagaactaactactggtttgaccctaggtcaatcctactaccaacccagaataaaaaagtttggttgattttctttttaaagagttgacatttaagttactttctattaaatacgtacattcctcagactacaggggcacataaaaaaagaaagaaaataaatatgcaccttccaaaggtatttataaaaagaaaatgaatttttgcaaccctaacataaagtgatatataacaagtctaaatttcatgatttctctgctgaaaaagtcaactataaaaagtcacttcttccctcaacttgcaaatttttctttaaaagagacaggacactgcaacttatctaaagggcaatcatgttgacagcgtttggcaattaaaaaaaaaaaacaaactacacacactgtttggcattaccacctactatatttatccaaaagtctagaacctgacatttaacttggcccaggaaagaaactttgtttttaatgactttactgtaaattaaaccatactttctcctctaatatattaatatgttaatagtttgtagggaaaaacacaagtgtacagttccctcattagaaaatgctaccaattacactcttaaccttaacgccttcccttatttttacacttcattccccacccctgaaaataatagccacacaatatatggtaatacaatagcctcacaacagcacaaacaataattacagtaaaaaaaaattaaatggtaggactatgtcattggggcagttatctttccaatcctcagtttccaaatctctgaaatgtggataaaagcacaatctgaactgaatgaaataaagtgtgtcaaatgccacatctcctgaactgtgtgctcagatgccccacggcactacagcaaactcccagggaagctgcatattttaaacagaaggaaacactgagattctcaacacatgctggaaaccagccaaactattaacctgaggtgcttgagttgtcatattagattgcagtgcattccttggatgatatatattagtgaaaccgggtttttgctggttgctgtgataaaagcaagtgtcacttgaaaatcaatgtggaacaggaaatgaggacggcagtgtactctgttccaaggtttgaaaagctatgcaggctgggagcagtggctcacgcccgtaatcccagcactttggaaggccatggtgggcagatcacctgaggtcaggagttcgagaccagcctggccaacatggtgaaaccccgtctctactaaaaatacaaacattagccaggtgtggtagcgggtgcctgcaatcccagctacttgagaggctgaggcaggagaattgcttgaacccgtaggcagaggttgcagtgagccgagaccgtgccattgcactccaacctgggtgacaagagtaaaactccatcttaaaaaaaaaaaaaaagaaagaaaaagaaaagctatttagtgctcagtgctcaacaagcacacacatctcattagtaaattgtggttacttatgaagaaaataaatgttctattttttctgcatttttttttttgaacagctacaaaagctgttgggacacaaatattttttggacctaactatttaataaacagaactattaagtattgtttgtggcctaggggtgttgtgaaaaacttaacgaggccaggcacagtggctcacacctgtaatcccaggactttggaaggccgaggtgggcagatcacctgaggtcaggagctcaagaccagcctgaccaacatggagaaaccccgtctctactaaaaatacaaaattagctgggcgtggtgccacatgcctgtaatcccagctacttgggaggctgaggcaggagaactgcttgaacccgggaggcagaggttgcagtgagccgagatcgcaccattgcactccagcttgggcaacaagagcgaaactctccctctcaaaaacaaaaacaaaaacaaaaacaacttaatgagataataaggtcaccataaaacaatgaagtttaaaaacctctggcttaatgttgtgactggcagaataagcttccagtaagtggtagccattatcatttcactacgattagtcctttacgcagttttatagaaaagagaggatatttcatattctgtaataaagatctcagaatatcatcctatagtattatgacttatattgagtattatatatagtattatgacttatgttgtaagaaaaaattaggtagacaaagaatctcataaggacaacttggaggaaaaccaggtgcagtgatatggccttgctatttataaaatgcatgatttgagtcctaatctgactcaaattatgctacttgaaaagcctgaaagtaatcttaccactagacagataaaagcaattcatccttactcccatgctagcatgtaatatggaaaagagcaaaagctttaattttaagagttaggaatccatggcgccacctcacctccccatcttttacgtagaggtccataacttctgtttttagagttatcctccatttcccatatgttgaccttttctttactccatcttctatttaggatataattatgaaatgaatcattcactttattgaagcctgagatgggctgtaaaatattgagattgtgaatttaatgcatgtatgtcagactgacagcttgtccttctcctgtgacagtctttgtgtatgtgtgtgtaaactggagaaagactaagaacaatgaattgtacacaaagctgagagacatcttttatctcttaataaattgtttccaggaaaaaaatatgtacctgtttataacttgctaaccatcacacaagctgcttaaactggtagatgcagcaaactagtcacagagctcacctgctacactgaaccactattccaaagacatcaaattgcaatttaatcaaacacttgctgtacaaatacttttcaaaactgagtaatgctaaaaatgggtacactcctaaaaaacatattaactgttatctaagggtaagaactttttagaaagtgttttaaataaatcaatgcaacagaagaaataataatgaaattattttctattttaaacaggtaattttgaaggccaggcgtggtggctcacgcctataatctcagcactttgggaagctgaggtgggtggatcacaaggtcaggagtttgagaccagcctggccaacatggtgaaaccctgtctctactaaaaataaggaaaaattagctaggtgtggtggggggcgcctgtggtcccagctactcaggaggctgaggcaggagaactccttgaacccaggaggcggaggctgtagtgagtcaagattgcaccactgcactccaacttgggtgacagagcaagactccatcttggaaaaaaaaaaaaagtaattttgaaacaaattaatagtacttatagaaataataagtaacatttatcatagacatttcaaattggcatttcagaagaaccttaataatgtggttaacagttatttccaataggatttgtcaataacaaatctaaataatgtgtaatatacatcttttatatcagcagttcagtcagataacaattctcaaaaacataggaaataggccaggtgcagtgacttatgcctgtaatcccagcactttgggaggccaaggcgggcggatcacctgaggtcgggagttcaagaccagcctgaccaacatggagaaaccctgtctctactaaaaatacaaaattagctaggtatgatggcgcatgcctgtaatcccagctacttgggaggctgatgcgggaaaatcacttgaacttgggaaggggaggttgcagtgagccgagatcgtgccattgcactctagcctgggcaacaagaatgaaactccatctcaaagaaaaaaaaaaaaaaaaatatatatatatatatatatatatataatgtatgcatgtatgtatatgaaataagttttatagggctgggcttggtggctcacgcctataatcccagcactttgggaggccaaggcaggtggatcacttgagttcacgagttcagatcagcctggccaacatggtgaagccccatctctactaaaaatacaaaaattagctgggcatgttggtgtgcgcctgtagtcccagctactcaggaagctgaggcacgagaatcacttgaacccaggaggcggaggttgcagtgcacggagatcataccactgcactccagcctcagtgacagaacaagactctgctcaaaaaacaacaacaaaaatttacggaaaaatatctcttattttcaaacataataactgcatgtttatcaactttgtaatctaggttagtctttcccttgctgtcattcatttaataatcacattttcttcaagtatgagtaaaacactacactaagcactaagactgcaaatattactaagacacacaggccttttcctcaaggagtgcggcatccagacacagaacctgagcagaattccatatgatatgaaggcactatactcaaagtgctacaagagtattagcacttggttcagcctgacagtttcaagaaaactacttagtagccccataaaagacaacagcaccaaaattctggaaacatggttattttggataaaatctgcaagccaaaaaaaagcaatcccctaatctatcatagaaaggcctaaatacactttgctcagaaatgagcatcacaatctaattatatcagaatatccagggggctagagcccagacagtagtatttgtaaaagctgcccaggtgactgtaacactgataatgtcataacatcatgactgatttaagcttagaatcctatcgacataaagacagagtcttgaggctgcattagtgaacacgtgggtccctaaggggatccattgtatgagactattttcattgtatttttacttgcaatcttttggtatgtgctaatagtatgaaagacaaaatttcatgttgggtatctcatggcacttcagcaaaggccaagaaaattaagtgattgctaatcctcaacactgtatgctgactaaaatgtctgtttaaaatttactttttaaagtaaagccagggcaagtagagacttgaaattaggaactttgtgtacataaagaccaagtcctgctaaggtcacttccaccacccctttccaagaaaaacacctacatatgagcatttagacaacaacaaaaccagcacataagaagtatgcgtcttggctgcgagcagtggctcacgcctgtaatcccaatactttgggagcctgaggcaggtggaaaccatgaacccaggagtctgagatcagcagggcaacatgaggaagccccctatctacaaaaaaatacgaaaaaaattatctgggcatagtcgtgtgcgcctgtagtcccagctactcaggaggctgaggcaggaggatcaattgagcccgggagttccagggagttcaattacagtgagctgtgatcatgccactgcactccagcctgggtgacagaacaagaccatgtctcaaaaaataaaagcaaaaaagaagtatgcaccttgtgatacagagtaagttctagagaaatgaagagaaggtagagataaaggtgagctggagtggttggggcagagtcttatgaaggaagaagacctgagtaggacctcggtgggactgacaggctcagattagagaagcagcactctagctgtcttggaggaagaaggtgtaaaaagcaacagtatgatgaagctgaaaaaagcatggtgcttgggaaggcactgaggaaacaccagatctccttaaaggagatcaacactggacaaatgacaggttgaggagtacaaacttaatcttggtgaaaaacagggttacactttgctttaatataaaaaatgattttagggctgggcgcggtggctcacgcctgtaatcccagcactttgggaggctgaggcaggcgaatcacctgaggtcaggagttcaagaccagcctggccaacatgatgaaaccctgtctctactaaaaatacaaaaattagcaaggcgtggtggcacacacctataattccagctacttgggaggccgaggcaggagaaccacttgaacccaggaggtggaggttgcagtgagccgagatcatgccactgcactccagcctgggcaacagagtgagaccctgtctcaaaaaacaaacaagcaaacaaacaaagaaaaaacatgattttagaagattcttcaggtagatgaatatgcagaatgcactgaaattcagggagctgggattattgaagatgaagagaacacattgatattttccaagcacagcttctgaatacaataggcatttttaaagtgtgaagattttaagtgaacactgtacagcacaatacaaaccttggtatcactccaaaatgaaggccaaattaattttaaaagtcaaatgacttaagaaggtttgttagctgcttaaatattaatatgttaagtattactgtaaagcttatagtaggaaagataatgacattccaagagattagacatccatttatgttagctttacagaaagagtcaatattccaacattttttttctgaattgctcacatagtctaaatctaatgaaaatagaatagcttagacaatattttaatattctttctccttagaatgcacattaatgccaaaataaatgttttagggccttttggtaaaaacaaaccattatttggcataaaagacggctgctggaggttttggaaatattattattcttaggtttcctaaccttggagtaaagtgtagcaataattctaaaaactataagtaatacacagtttgtagctgaacatttgacttgctattatgagtaatcataattaaagaaacatttagaatttatacaagattagtaagtcaggtaacgtcaccaaaaaacacaagcagctgaaaaatgcttcccatacaaaaacaaacattcgccccacccaacccccacaatattttaattcagaattcatcagtataagaattccacttgtagtaaaaaatatatgcaatggaaattaatactgtaccaaggtatagtttaaatacaaaaaacaacttgaagcaattaagtccatactgattgagtatagccaatattatttatacttatttcttggaagacctagagccccttctccttcattcaaaaaatatatgtaccaaatatatatttcttatatactgttctttgcttaagacttttcattatgtcactatctttttccccatcaagatgcaattatactatttagtcaagttaacactttaactgacattaatattctacatgcaaagagtgaggtcttatgctcttcatttattgaggctggagaaagcttagtagtttaagatatttaagggcttatatttgtaagtatgcctttcaaacactatttttaatttataaagatataatcagtaactaaactaatcccaacactaggattatttgcctaaatcatatatatgtgtatatataatcatatacttttttttctttttaatttttgaaacagggtctcactgtgttgcccaagctggagcgcagtggcgagatcaaggctcactgcagtctcgaccttccagactcaatcaatccgcccacctcagcctcccaagtagcggggactaaagggcacacgacggagccgaactactttttgtattttttgtacagaaagggtttcaccacgctgcccagactggtctcaaactccccgcctcaagcgatcagccccccttggcctcccaaagtgctgggactacaggcgtgagcccccacacctggcatatcttacattaagaaagacccagtatccaaattaattttaatttcatccatctgcccctaaaataactcaaacattactaatctatttttcttgtggtacaatagtccttttctttaaattagactatcaaaatacttttaaaaataatacaaaatcaatcatgtatctcacatgaaaatctagaggttgtttacaattcccttaatgaaaacacaacggccataacagaaatactccaacaatattggataatattagataatacctactactataactgacctaccagtaaatatgtcaagcaagacactgtatgggtttatgtgatacatgatacaaactgaaacaatatttctttggaaaaaacatttacttttagaagcagcagcagaacccaagaaagcaaaatcctgcaaccaaaacctgcatctccctgcaccccctcaacaaaaacctgttaacaaaaagtttgcaggaaaataagtttgattaaaaggaaatacaagcataatctgctagaggaaatacagtgaaagggttgtcgggctcttttctaaaaaatggttgcatctgaattgtttcaaatcaaaacagagaccatgacaaattgggctctaacagatgacttacagagcacagcgacagccccagactcgaacatgagacattcttccttatgcctagtttccactatgaggctgaaaggtgggggatccaatttgtgatagatccggaatcctttactgaacgccattctcctttcttcggaggcagccctgcgaaaaccaagcaaagcaaagcaaatgaagctgatgtttccttctgcagcaaggactgcaaagcatccaaaagtccctccccgccaggttttgatggggggttggggtgggaaaaaacagacagctctgggagaaaatggctttttccaaaagataagtcgtcacttaattttaccaaaaagcaagaggaaaagctatcaattctcataccaaggcaagacaaggttttagcactgtaagtcaatcaacggtctggttgagtttcccgtttaatttatgcttactgaaaggaaaaattttgagcgtatttcgtccggagctgtttatcagcttcctgcttcaagatctgtcactacgttgaaagggaacctatttggaaacttcaagcagttccttcgaggtgaaaggagcggaggtgggagggaagggtgacaaggctggttcaaagctccttagggggcaggagaaggaaaaggattatcccacgcgacaggctctcccgggggtggcgatgaagggcaagggaaaaggcacaggttaccgccgcctctcctgccccgggctaccgccggctggggggacggcaggcggggccgataaatacgaatggccacccgggaagagtcacgactcggggcaccgacccgactggggctcctcgggggtcccgggcagtcgactgcccgggaaagcggctccttctcggagagacggaagagccgagcagcccaaaccctccatttatgcgccagaagagataccccggcgcccaggcggattcggttcgttcccgcgggcgggctgacagccgctgtcaccacagcccccagcctgacgcggcaccccgcacaaccagtggtctgctcacaaccccgcccgtcctcccgcaccccggctgctcgcggtcgcccctcaccgctcccgctgacgctgcggaggcagagactggtcttggaggcgtccgcccgcccggctgcccgtgggtctggccgcagcagctccccgccccccgccggcttgctcacctcttcctccggctcctcctcctccttctcccgcagccgccgccacagccgccgggagcgtcacttccgctccagcaggcccatctcttccgcat

SEQ ID NO: 788 - DNA, 99283 bp, Homo sapiens; identical to SEQ ID NO: 787

SEQ ID NO: 789 - DNA, 13704 bp, Homo sapiens
ggcccactgcgcctgagcacgtagcggtgcatttcgggacctgtagttttccccggcaggacggtagaagtcgtggtttgtgcgcggccaggcgctggagcctccgctgccgggagcagtaagtgtgtgacgtcggggtagaagggagtgacccaaattccaaaagctctttgggatgctgcgatgtcgcggccggccccgcgctcgggttttccctcctagacaaaagtctgccggctcccggtcgcgccgggtcggggatccggaaggtgaaggccgccaggccccacctgcggggcgcccctgctggacctggccgtcgggcgccgtcaacccgttgagcagcgtgttccggctggcacgtggcccgggcggggcccaggattggttcaagcctacggtgttggtccccggagagtctagggagacaagcaatcccctggaatggtgggggaagcgatgacagcccctggtcctcatccgcagctctgggggaagtcggggggtggggagggcgggtgttgctccctgagtgttgggggaagggtatggggagaggaccctgaactagcccccaggttacccaggaggagctgaggcccagagaggttcagcgactcgcccagggttgcacagcgagcacaggcaccgacgtcgccctccgaggcctgggcttccagcagggagagacccggacacctgtcatcgcttctcggtggatccctgaaatgttgagttgtggagtctgggcagctgagatcgggcagggctggtttcttgtaggcccaggcttccgtgtagagggccaagtgatgcccaaggttcacctggcagccccctctctggacctacccctccttatgattgggtgaagggttgggtgaaaagggtagaggccgggaatgagaacagcttcagaaagctcagacaaagggcgcagcatgattcgtggctggaaggagacagcaagcgatagactgatccttgaatttgttagtgtgccaagaagaaaaagtattaatagattgtggacgacacattatccatattgctttagttggtctaaccaaaataagcgaatagcttttttgtttctaagagaaacctgacaaaggaagacagggtatttttgcggtgaaggaaatagaaatatttggagttgtatctaagccacttgttacttttgtgttttaagctaagatcatggataggtccagggaaagttaaaaatttcccgcacttcttagattttatgcccctcaaaaacatccccaccttgttggcttttgcagttcaaccttcagataccagctccctcgtttctaatattgcattaggtgtacatatggcagcagagcaaatagcttactgatacttttagcttttttcttctcatttgcaaaagactctatgaaaatggctggcttgggcatgtaattgaagggaggtggggaaaagtggtaattcagaggcagtgggtgggaatgagcaaagcatgtcagtgtggttcaccctcttgactcccacctcaccacagcccttctgctacaattgcagattgactctaaatatgtttctttcctaaagagcttgaattttatcactccaggtatgaagttgaggcagctgccagtatattttggcagtcaggttctgtgatatcagagaggatggtgaattgtgaattccagagttgcagaattgttctttagattctgattttttaaatgacagcactttggtttggagggttaatgacttaccccaggtcatatgccacaccatgggtaacaccaagagtagagctcagatctccagttgtcctggtcctcaggctactgatctttattccctgccctgctatcttggaatgactgcattttgccctggatgtcgctagcctgtatccttcaggttggcatgtccagtcatggaaggagagagatttaacataacaacaatggctgacattcagtgctttctgtgtgctggccatggtgcttagtgtttacagtctaatctgcaagagaatttacagatgggcaagttgaggctgagagaggccaagtaacttgtccaaggtcacactgctagtgaacatagcacatgttttccagagggccagaccactggatgttttttcattcatttcctcctgtaggatcgttggacctatttctcgttcttgactttgggaatcaatattctacgtacatcaattcactgggtatgcagttttgcctctgaaaattttgagggaacagccagactcatctactgtatttgtatacaactcaattaaagcaggaattgtaaaaataaaatttgtaagatctttaacattttaatatacaacattagctaatcactaagattactagagatactcaaagtgaaaattgtagcaacaggttataacatgttaggagcatatttctttagggcagtcagaatctgctgcttcttaaagacaagtgggccatttacacatgaaggtaacaagcacattcagccaccatcattatagttaaacagatctatgatttaaattcctatcgctaccttatctgactttgaaaaagtcatggggaaaacttggctaccttgtgccaactgctagcttgttttcaagatattataatcttgaatagatggaggatgaactttttatacttagatagctttgtaattgaaagtttgtataaaaacatcttgcctgaagttcatcttatccccattctatctaaaggcctttgaaattttcagccacttttcttaattatgacggtaagtacatttcaagagaagtgtttccctgacttttgaatgcaaagctctctgcctgtgtcaggatggtgccgaggttaaagccctggagccagactggatgggttcgaatcccaggcccacctgcgagaccctcgatgtgttacttaaattttatttcctcctctctaaagtggaggcagtaagctgttttatggggtagttgtgagggctaaatgtcttaactcatctaagcactttagccacttttttccatctgacacaaaaaagttaagctatgattattgtgctataaagcattggatttcagaagaagtaggggcactaaacaccatctgcttgacacctttcttcacttacagatgggactgaagctctagagggaagtcacttaccagagggtgtaggttcttcatccagagctgaagtcttcttgggggtatgtgtcatattctaagagtagggacctacaaggccttggagcgaatcccaaggctcgggctgccagccctgccttctcatttccatatgccatggtgtggcatatgacctggggtaatatcctctgaaccaaagtgctgtcatttaaaaaatcagaatctaaagaacaattctgcaactctggaattcacaattcaccatcctctctgatatcacttccttccctaccttctactaggtctccctcaagctttagagaaaattctgcctctgaattattgcatctgacaatttttctgccctgtcacttattcccttgctcccagataatcttcgaaaaaccaagatgagtttaattaacactcagaggacttgacaaagacactcactcccaaaccagcttgcgtttaggtctggaggcaggtggagggacagattttagacttgggcccttaggttcacagatgaatgggatgggagcccatgtcccctcagaagcggcgctgtgctgctggcggctacagacagctggtgaggagagctttctgcttagcaagggccaggcccgtctgggccctcgcccagcccatccacttcccaccagtctctcaatcgccttgtcaggacacagcccacctctctgtggagctcactttctgttcacattccctctctccatcaaagagacatctttctaaggtggtctgccctaggaactccaaattgacctgcttctttcttcctgcccagatcagaccttccagctgcctctcatgtacttgtctgttgggggcttgtgttgatcaggagtgaattcacagtctaccatgaattggaaggtgagtatcgttttaaatatttatggcttggggttttttcttcctcctgattgtgaaaattcagaataacagttctacaccagtagcttgattaaaaagaaaaagtaggtgaaagcataatatttatgtttcattttaagttaaaacataaatgtacatttattcgctggacttctggaagaaggccaggccttttcttcgagtgtgcattcactaacttcaaatcttcctcacttttcttacaaaaactatacctttaaagctttacctgcaattttgcattgtgctttctttttttacacattttttttgtagagatagggctccactatgttgcccaggctggtcttgaactcctgggctcaagcagtcctcctgcctgagcctcccaaagtgtcgggattacaagaatgaaccactgtgctcaggccgttttggttcctttaaagtagatgcagtggactgaatgtttgtgtttccccaagttcatatgttgcaaccgtagtgcccagtgtgatgatatttggagttggagcttgtaagaggtaattaggtgatgaggctggagccctaatgtttggaatagtgagcttattaaaagggctccagggagctctcttaccctctttctgccatgttgggggtacaacaagaagccagccgtcagcagcctggaagaggactccgctagaacccccctgtactgcgccctgatcctcagctttcagcctttcgaactgtgacaagtacctctttaataagtcacccagtctgtggtcctttgttctaggagctgaattgactaagacagtggattaagatcttatgagcagtgcatacacaaaatctttccagtgtttcatactctttcctaatcttttacagttgacttgccaacagcattttttttccaacgcaaacttgagtctttcaaagtattcaacttagttttcataaaaacttttgctttacacagtcatatttcacaagcgtaatgtttaaataagttatggaacatagtatcaagtacaacttaaataaactgcttggcgagtaaacacacctgacccctgtgaaacattagattcagctggtgggagcagaagttcaagggcagccagagagtaggtcagcaatcaggttccaccgagggaaaggagaatgtcatcttaagtcccggaagtcaataaggtgaggtggaggttgtttaagagagcagccactaaaatatattatagtcactttgcaaagtctaatatcaagcaaaaatcatacattgtctcaccatctagaaatggctactattaacaatctcggtatattcatctttttctgtatatatgtgtggcgtgttttcatgcataggatcttattttacgtgttttttcaattattataagcattttcttcaaaacatccagtggttttctattgcaaggagaaactggaaaggtctggaagcaggatcagggagccaggaaggtagctttcccatcttccccagctgtgtggggtgaggggctcggcaggccctgcaggagggctgagggcccaggaacttgtgtaagttaaagatggcagagtgagtgagctgtgaagggtgggaagatatagaacagtttgtttagcatgccttgaggatcagagctcacagtggaaaggttgggaaggaaagaagaggcagtgagaggatggagaggggaaggagcggaaagcagtgtggggtgaggtttagggaggtcattcgcccactgcagtggctaagtcagtagaggagagaggcagtaactggtactaagggccagggttcaaagcattaaacctcatgcctcaaggtggtgtttctcactcctgagcactagttaaggcaaggatttcgagccccactcccagagtttctgattgggtagatctggctggggcctgagaatttgcacttcttataagttccaggcggtgctggtgcacactggtcgaaggcaatgcgtgggaagttttcctctttaattgtagagtgacaccaacccatgtgaccactcgggccagtcttgcttgtgacagttttttctgccatcaggaacaaagtctgcccaaaccttcccagcttctgcaccagggaagtggctaccagggagcagcttcgtgtttaaacacagccccatctcgtgtagtgttagaaaggaatggccgcaggccgggcgtggtggctcatgcctgtaatcccagcactttgggaggccgaggcaggcagatcactttgagctcaggagtttgagaccagcctggacaatgtggcgaaaccccgtctctacaaaaaaatacaaagattagctgggcatggagatgcgtacgtgtagtcccagctactcgggaagctgaggctggagaattgcttgagcctgggaagtggaggttgcagtgagccgagatcatgcccctgcactccagcctgggcgacagagtgagaccctgtctcaaaagaaaaaaaaaagaaagacagtcatggccctgattgcagagagctgcagaaggtggaaggttcagtagcccccagtgcgtctggtggccttccccctctggctcagtgggccatggccggcagcgacagtcaacagtgctacctgtgcgttagcaacaagtatggcctcattatttaaaaacttagttattcccatttcacagatattggggttttgtttttaaaaattgatgtagatctaggccaggcatggtggctcacccctgtaatcctagcactttgggaggctgaggtgggcagatcacatgaacccaggagttcagcaccagcctgggcaacatagtgggaccccagctctacaaaaaatcagaaaaaattagctgggcgtggtgtcatgtgtctgtagtcccgtctactcgggaggctgaggtgggaggattgcttgagcctgggaggtcagggctgtgggaagccgtgatcatgccactgtactccagcctagttggagtctcaaaaaaatattcatatagatccagtccaccctggcagcattcattttcctccctgaaggtctgtatgtttcaagagatgtaaggggtttgttaaaaggaaattggaggaaggggttcataccactgaaggttagtgcctaagagaggggcaggaagggggccctggagctcttcgctttaccctgtgaatgttcttgacctctgctgcccttgtgctgcgtccttctcagtccacacttctgcctcttgccgtgcgtctccactgcctgtaaaacaaagtgaacactgaagcctcccactagggtccattggctgatgcgtttccatttccatgggttttctaacttctggatgagagagtacattcctgcaattgctaaagctaagtttcctatctggattgtagacagctatgggcagtaacatgggctttgttatattagtaatagggccccggccaggtgcagtggctcacacctgtaatcctagcactttgggaggccgaggtgggcggatcacgaggtcgggagttggagaccagccggccaacatggtgaaaccctgtctctactaaaaatacaaaaaattagctgggcatgatgccgcatgcctgtaatcccagctacttgggaggctgaggcaggagaattgcttgaacccaggaggtggaggttgcagtgagctgagatggtgccattgcactccagcctgggtgacagagcaagactctgtctcgagaaaaataataataataatagggccccataggtttattcagagagactgagaaagctggaagagattagcttttcccagtgtgagtcattgcctcaggtagcctggaaaatcctagcaaacaaaaagaagtttatacaacaacattcttttcatagctggtttgtatgcatggcgtcaaaccttcacctctaaaatgtgaaccttcaagaaaacaggatttcagggtttactggagggaggggattagcctaggtctgagggaagaagaacctggaaatgaagtcagtgtttaaagctccttatatttaccagagtaaaaagttgaaaagtttcacttttggaactttttagtcttttgtactgatgccagagtgatctttctgaagtgtatgtgttgtgcttattctttactgttaaaacgatatcatggttgaaaactattagctaattactgagtgttcttgtgttcttactgttttagtaaaattaaaacgatttaagtatttgcgtccctgcctcctcccatgattttcattgtatttctatcatatcatgctatatccttctgcaaatatccatacataaccagttaaatgatttcagaggtagcgagtctagttgcctctggaaaattcagtagccaagccatagtgtatttgcatattgtaaatgtgaagtggatgggtgtgaggaatgaatcatatatagtacaggacagcgtgatgctacagagttgggctttggagcatttggagctgggtcagccctgcctcgctgactgctggcctccccgcctctgcattttctcggctccaccgcagtcagggcgagccatctgctcatggaggtggctaagggcagaagggaaagccgcataaggcactttgcatgccgtgagttcccagtctacagcagctgatgctacagcttctaagcgtgaaatccacatctagttctgagtcataaagagtttcgatacaatcataggaacattcatctacatacactgtgatttcatgaatttcagtttgttgaaaatcaggcatcagtggaagggagactggccccggggttagaatgtccttccaactggctcctcatgagggagctgtgggaccttcaacctctcaacctccaggagctcttctttccttgctcatataaccagggggttgagtaggtccccttgaaagttatttccagccccccggttctgtgagcatattgtacacactaactaggttcagatcaacttcggttagactattagagggaggtgcacatgtatcccccacagtggaatctcattggtatttcatataataagtgattgacagaaataaggatttcattgggataaaatcctacctggtcctctaaaataatgattgctcaaccagagcataccttttcactatttgggagggaatttttaatcacacaaaaagcacatacatatcattcaggtcatgctaaccatgtgtatggaactaatattgctttgaagtactatttgcaatatatagaatttcacacaaaaaacctactagtgcaaagagtgagtaattcaaatgcatagtgtttccctagactttattttagtgaatggggttgcaagagcagttagtaagtagccatgttttaatgttttgagttctgtcgtgttttattttaccagcaagtgccagtgctagtgagtctctagaaacaagagaaaatcccagagtactaaagctgcagtttccagaagcaaggtctgattcacccttactttgtagatgaaggggcaggagctcagaaagaaaggagctcattgcctgacccaggtcacacggtcagtcggtggtaaagtagagctctgacccaggcctccgggctccagctcctttcactggatctggctgctgcctcagaagcaagggcctgggtgatcagcaggttgcacggttgagctgtgagagaccagagtccccacgcctgtggatgaccggtggtcccctccatgaagccagccgcaagcaagcagcaaagagcagagctgtaacttgactgttggccccatggggatagagaccttttctgcttggtctccagtgtagctccagccccctatcctcgtgcctgttgcagaataggtgctaagtaaatatttgttgactgaaggatcataaaagaaacctcccatatcggtgatggaacatttagttagcatggcttctttcttcttgaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtgagtccacagtacccaaccttgcaaatgggagctggccagtgggttggggtgaccaatcaatgaacaagagaggtctgagacctccctgtccgtcgggtctgaagggctgcgtgggggcatgtggcctcacctgttctctaaggtagaactgctccataaagggccaggtgtgcagatcctggtcctgggatgtgagtgctgctgagccaaggtgcacggagcattagttcatccttcttgaaacctgcggtggcaatggttcttgacaggtattgggttaagaattgaggactcagtgacagctgtggaccttcttcccagagaagcacacatactgaaaccatctgcatttgtgtgtggggagaagtttgcagatgtggggagtcacaggtcatttgaaattccaagattaagaaaccctgttacctttaagataaagtctgactccatggtatgacaaataaatcccttcccagtctggtcttaacccagacctcatttgccacatgtgcccactccccatccccctgcaggccattcctcagccaccatggcctttggccttgcttattaggttcttcccaaggacctcctcaccaggcctgagggtacactcatcgttgtcacccagtgcctatcacagtgcacactggtgggcttagaacacacttggggagttacaatacatcaaggcaccagaaagttcctgttaagcccctgttacagatttaacacatgacaattcacagttaccttgattccagtgtgttgatgcagtttcttcactttgcaggttgagttctgtactttaaaaatcaggggattcagccaggtgtggtgactcatgcctgtaatcccagtgctttgggaggcaaaggtgggaggatcacttgagccaatgagttcaagaccagcctgggcaacatagtgaaaccctgtctctacaaaaattaaaaaaaaaaaacaaaaaaaaccaaaaaaaaaaaccaaaaaaaaacttagctgcacacttactgggtgtgtagtcccaactactcaggagactgaggtggaggattgcttgaggcccagaagttcaaggctgcagtgaggcatgatcacaccactgcactccagcctgagtgacagagcgagaccctgtctaaaaaaaaaaaaggattcaaatatggtggcggtggggttctagatctgtggttcccaaacctagctaatgatcagaattgcccaggtgtttgtttaaatgaagattcccagcttcagcccagagagattccataatggctctggttaggtttgggtgttggtttttgttgttgtttttaagataggggatcctactctgtcatctaggctagagcggtgcagtggcacaatctcggctcactgcagcctcagcctcctgggctcaagcagtcctcccaactcagcctcccgagtaggtaggactacaggagcacgccaccacacccggctaggtttttaaaacaatttttagtagagaaggggtcttgctgtgttgcccaggctggtcttgtactcctgggctcaagcgatactttcgcctcagcctcctgaagtgctgaggttacaggtgtgagccactgtgcccagcctctgttcttttgaaaacccattagataatccttaggttgtcttctcagcaacaggtcattgtaggaaccactgggctaggtggcctcccaaacccagcccactctgagattccatgctgaattcccttgcagtgccgtcaggcttgttgaggctaaagacctactgatgaggaatagtagcaacacctactaagtggttattctgtgctggggactttgctaagcattcatgcacaactgtgttattcagccctgatgactctgtgaggcatgttcagattgaaagaatggctctctctacatggtgaagaacagagtcagaaattgatcccaggtcaaatgcattcgatcagcatggccaagcccaagctgtgctaccttcctgaatacaggcaagtgagctcgtagggatgcttcactctgttactcaccacttccggcagctgcccactcgctggtccccagtgaactgtaggcttttgctagatagaagaagttactttctttctttctttctttctttctttttttttttttttttaaggtgtttgattgactgaaatttaggagtaggcattacgatggggaggagagaaattaaaaagggtgagggaaggcagtttaaattaaaatgttgctgattgaatttatattcctgacaatcccattttgtgtgctaaactgatcaaaggaagaaaagatgagatggaagatcataaaggctttgttcctcccacaaacatcagcagagacctgcatttaagtcaggcctggatggcttagaagcaactcagggagttggtcttcctctctaggctggcagcttcttaaagactagagacttgcttcaaacaaaaagcgttttcaggccgggcgcggtggctcacgcctgtaatcccagcactttgggaggccgaggcgggtggatcacttgaggtcaggagttcaaggccagcctggccaacatggcgaaaccccatctctactaaaaatacaaaacttagctgggcgtggtggcacgtgccagtaatcccagttacttgggaggccgaggcacgagaatcacttgaacctgggaaacagaggttgcagtgagctgagattgtgccactgcactccaggctgggtgacagagtgagactgtttcaaaaaataaataaataaataaaaggggggtggggtgtttcagatggaagggaaactgatgctaaaaatacattggttaataaatagacttgagtgatagacttgagtggtgtccgcttgttaagtttaaatggctgagcatacgtctttatgctgagcagtaaacatcgggtatactcttatcaaacatttcctactcatccctttggtattcccttctagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaagga

SEQ ID NO: 790 - DNA, 9122 bp, Homo sapiens
gatcatagtaaatggctttaattttttagcgaaatctcactactgcaaatgcattgttgtcctagctaatgaatgcatagagtattgcctgcaaaataataattgagattctatttttaagaagcttagaacagtacatggtgcatagcaaagactctgtgtatgtgaagccagattttaaaatatggtaacaagtgtctgaaaatatgtggctcaatttgtctcccggttacttttccctctccccctttaaaatgtagaggaaggagaagaagagataagaggtttgtgagtgaagacaagggccctttaaggcctgggaagactaacgccatagggatctccctctgccttaaaaggcacaggaatcttagtggggaaaaagaagtggtgataaatagccagtccgtgtgcctggaatatcaaagtcagtgcgtgccagggatcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaagatcacagctctcactagactttcagaggactttgtaacccaaagaaccactcatctcaaggactgtggtaactcaggggctgagccatgccagtgtttattatgtgaaacaaggactggaacctcacaagaccaagtctgtccatttgaggatggcccaagatgcacacgggctgcttttatcttatgcgcaggttttaaaaaaatatgtttcatttaaatattccatactcttcaggaatgcccaggcagctgagctttcaggatgtcgcattgcagaggactccaatgctacatatggcagctggagaccctttcaaggcaggtggcagaacggaggccctctctatctgctggggcagccctccgggtgccccgctggaaggcagagcagctccatctctgggtgggtgagaggtgctgcatgggctcactatagtatcccaatactgtatggcagtaggctgccagagtatcctaagctgggtggcttcaacaacaggtactgactcacagttctggaggccaaaagtttgaattcaagcagggctgtgcttcctctgaaacctgtgggagaggagccttcctggcttcttcccgacttcttgggatggggatgcgcatccatcctcggccttccttggtttgtggctgtgtcactgcaccctctgcctctgtcacggcatggtgtcctccctatgcatctgtgtctgaatttccctcttccgataaggactccagtcatattgggtgagggcccaccccaatgacctcatctcaactagatcatctgcaaagactctatttcccaattaggtcacattgaaggtacctgtctttttgggggatacaattcatctcacaaaaccggcccatcacctcaaaaggacctgccaccccagtgctatgtgtccctctctgcccagagccactccttcccctggctctcggggagtgggggcacctttccctgctcccacagtgaccgagcaccttccccttggtatgcattctgaagggggcatttttttctcctccatctcagccctgtacaaagcaagttctttctagattgaggtgtgtatgtgtgtctatgtatatgagtgtatgtgcctgtgtgttttcagggagatgtgtgcaggatgggtgcaagggaggagtggaaggcggaagggcaggaggaggatagagccacaagagtgagcacagaagtgacaagggcagaatcagtgtgtgcttgtgacaagtatggaaatgtcatgcctttaggttcagtcctataaggtaggtgtatcagtaagggcattgattctgcgaccttaacagagatcagaataacagtggcttaaggaagagtggagtggatttctctctcctgtaaatctggcctggtgggtggtaaggaggatccacgtcgcccaggcccagatgtgtgtggctctttgagtgccccgttctttcccagtctcataactgctctccacctcctccacatccagccactgggaagcaggacaaagttagttaagggcacgttcttttctttccaaggattacttggacattacagtcttcacttccatgcctactggccagggcttagtcacacaaccttgctagctgcaagggagtctgggaaatgcagctgctattctcagaggccatgtcctcagggattctgctaaatttagcaaggcagggacagatatgggggaaccactgacagtctatcacaaaagaacgtgattttagagaaacagtgaaacagtgtcattaatccacccctcaccccttacaacagccaaaaagaaatccagtggtatccatcacaataaagagtatgagaggaatgtgattagaaaatcaggttgccaggcaggatgtgtccagttttagccagtggtggggttcatggggaaggcttcgtctcaggaaggtgtgtgttgggttgttctatggccagatggttttcaacgacatagcacgacctgtagctctccaggacccgggcctggacataggccttgtccttctcttgccaggcatcggactcgatgtagacgttgaatgggtcgttcgagtgctccagcttcttggagcggatgtagctcagcatgatgcccagggtgaagaagccgaagaatcccagtaccatgaggacgtagagggcctccagcttgccgtcactgctgcggggggacctgcgggccaggcccgacatgttgccaccctgctgaactgtctcctgccacagcttggtcagaaagggcgtcaccgctgtggtgttagacaggatcatcctgggcattaaggttccactgctgcagctcaaacttcccaggcacacctcttaaaggaaaaatgcaaccccaaatcaaaaagtacgtattggccaaaacccacacgtacgcacacacacgtatacaattttaaaatctcaggtgagaggggtgagctgacactccacaggccatggcatgtgccatcttgggtctgtgcaatgccttctcttgatagatgaatggatacattgattcccttctatttccatccaccactccaatctccacccctataggtgaccatcagaatgagcttctttaatatgcattgctgcatattgtggcgtatggggttgcatgtgtgcattttggtttacctaaatggtatcaggtcatccaactcattcagtctccttctttttcctcatgactgtgcttttgtggctcacttgcggtgctgggtgtgtgcattcccttgcttccaatgtttgtatacaacccatggtgaacacccacttcttttctctgccttctcccccagagatggacactgctgtggctgctgactccataaacaagggggagacaaatatccccatccttgacctcctatggacctaaaaaaaatcacgcatctcatacaactagttcctggcagcttatgcaagactagtcagactggttgcccttggaagcaacgtgcaattggtggtctgtttcaccacagagcatctctctatgaacagttacattcatctgaatgaaaaatctatgctgtcacgtggtggacttcagaatgtctagggagatttcacagagagctcccctcgaagaggccagtgttgtagcttgtgctatgtttttccctccctgcccacacacaggcacacacacgtacacaatcttaaaacctcaggtgagaggggtgagctcacatgctccctagtccatggtatgtgccgtcttgggtctacacaatgccctctcttgattgagcaatggtacatggattgccttttatttccattcactactctctggctatgcagaaagtgacattttccctatcgtttaatcttgatatcactgtccctgtatactcagagtgggcctgggaattggaaaaattgtctccaagtagctgtaagattctgtcaggggtttggtttgctgtggaaaccccatctaggtgaccttgagatcattggtaagctgaaaaaaaacaggtcttgtttttatttatttatttatttatttatttaggtttgagcaaatgccagcctctacccccagttcctgctgggaaacaaaagctccgaggccaagttgttgatgtcacattccaaactcaagccagagggggccactgggagcttatcacacgtaagtgctcccactcagttctttctttttctgttttattgagacagggtctcactcttgtcactcaggctggagtacagtggcacaatcttggctcactgcagcctcaacctcctggactcaggtgatcctcctaccctaccctccagagtagatgggactataggtatgcaccaccatgactggctaattttcgtattttttgcagaggtgaggttgccctatgttgccgaggctggtcttgaactcctgggcttacaggatccgcccacctcggccccccaaattgctgggattacaggcatgagccaccctgcttgtcccctgctcacttcttaggagcttaaagtagctgagtagaacatggcctggagtagaacatggcctcggggggactgttgtaactacaggtgaaggatgtatttgggaagacagtttatggccagaatcgctatggaaagacaaattccaacacttgccgggacggcgctgtctttcccagccaggatggggactgtgacattgcacatcatcttgtgtaggacaaataacctcagaaacctagctcctctccagcttagacccagagctatttcttcattgaattggtttaattgtaaaacataccctgaacccagcaccagctgaagacatctggcacctttccgaggcccctcttcctctacccatctctgaactctggctgtgtctcagagttctgttacctgctctcttctcttcctactctcctctctcccagggtgactgcacctgctccaggctcacctgcatggccatgacccagggctctctttaagctccagagccatgcgtccagtgacctgctaaggagatggttccctttggccatccccaggctccttaaagttaacactccaccctgtcctgtcagagactggcccctgcctcattgagctgagtggcaacaccactcactccaaaatctgcatcactctcactgatgactgcaatctcatcatggcagttcccatcttgaaggccttccttggctcctccctgccttcagggtgaaactcctggtcttctgcatggatacaggccctaaatttgagagtctatgcatccctctccaattccactgttgccactgtgcccagaccctatgctccatggtccctgctggccccggagcctctacacattgtgcgtctccagctcagactgcgccttcttcttggcccatgaaacttctcagcaatgcctactcatgcttaaaattcagcccagctctcacctccttcccgaagcctgctctgatacatggggctggatcagcactgtgcacaccatgacccctgctaacctcatcatggtcaggatctccaggccccttatcccatccctgccctgccatccagcctggtgctgggcacgcaaccacacaggagctgcccatgaatgtttatcgaatagatgccaccagaacttaataccttttgaccagtggggcttgactctttataacctgcttactccaatgaacagatgccaatgagctgtctccgaagctctaactgactcccttttccagaagggcagtcatctcccaccctgaaccacagtctcagaaggcaggagtgaggagcagaaagagctcagattttgggattccactgccgccacaggtttggattctagctttgctacttcctggccacatgatcctggacagtttccttagaattgttcagtcaagttttttttttttttctttccaaagtagcgagaaacaccactgacatttgcgggctgttgaatcactgagcaggtgtgtagagtggctgacagcatgtggcacatggcaggtgcacactcagtggtcctgggtaggagtttattggtttttctacctcattaagaaattgctgcccaaggatttggggctttgggggtttaggcttggctttcctgtggctgaccatggcagctgtcttctctacgttgtggagagatcagacatgaatgagaatcaaagattgtttgtggcctttcctggtttctaggcttttgagtctgtgcagagatctgtcaggggttaagctgcctgggctcaagagattcaggtccttgttcttgtacaaaactagcatttagccccattctaaccatcggggtaggcaggaattgtttggtaacagatccaaactcaacgctcaaccatttctttttaaatgacccgaaaccacttatgaatgcataaaaccctgccccagaaaacagacagacctggacctgatactatgatgtaatttccaaaaacccagaatgatcacaattggcaaataattctgccaccaatcactgttagagagtctttccaacttcatgaccatgtgaaggtagaattatggcaggcgacatttgaagatccacaagttaattggtttaaaactgataaatccatacagcaaattaagagttacatctgcaattaattcataatagtgagttcactgagaaggcttgttacttagatccagatggactttcttatgtccaaagaagcaaccaaaaacatctgctttgaaaacctcccaagcccaaaccatcctcagccttgttctttagaatgctttagaatgaccttgttaaaatgcagattgctcctgtaatcccagcactttgggaggccaaagcaggtggatcacttgatgtcaggagtttgacaccagcctggccaacatactgaaaccccgtctctactaaaaatacaaaaataagacaggcgtggtggcgggcacctgtattcccagctatttgggaggctgaggcaggagaatcacttgaacccaggaggtggaggttgcagtgagccaagattgtgccattgcactcctgcctgggtgacacagcgagactctgtctcaaaaaaaaatgcagattgctgggctctattttcagagtttctgatttggtagaactggagcgggcctgggaatctgcattcctaacacattcccacgtggtgctaatactgctggtctggaggccctgcttggtgatctattggaatcaccgggggagcttttagaaaataatggttcctggatctcacccctagagattttaatgtctttggtctgggttcctgcctgactcagagactttttagaaacctcccaaatgatcctaatttgtagccaagattgagaaccactgggctgtggtgtgggaccctaggaaaatgaccaatggccttttgtgctgcagggtacctggaagaattttgcaaaaatatagaaatatgatctcactgactgtttttcaaatcttgtttgttttttacattttcttttttggccttgtttgcctctgatacagtctgaaaagaaattgcagaaagaaactctccagtcttcagtgtaacctcagctgtccccagtctcacacacgctggtgccttcaattacaattctcctgtcagagcttaagtccagctaattaactgcctttcaaatgacaaccctatatttttaaagaatttttttaaaacttcacatgtaatttattgcattgcttttgctaaatgtcctccacacccccaatgcctgctaggctgggtcgccatggtatttttgtgtaacgagtctcaaaatgagtttggcaatgtctccgtaatagtcagcatggtgtaaatgacagtctggatctgcatgtcatttgggattttatatcagattctctaggttcatttctatgatacgtgatgccaaagcacccacatgccccgtggctgcactttcagacagttggactcaaacagagtgggagagcaactgatccaacaatctgaattttcagaaaacggggctccttagagatgagatggcttgccaaaagtaatctctcctatcagaagtacatatcctcagcaaactaacgcaggagcagaaaaccaaacaccgcatattctcacttataagtgggagctgaacagtgagaacacatggacacagggaggggaacaacacacactggggcttgtcggggaaaggtgggtggggaagagcattagggaaaagagctaatgcacgctgggcttaacacctagatgatgggttgacaggtgccgcaaaccatcatggcacatatttatgtctgtaacaaacctgcacatcctgcacatgttccctggaacttaaaaaaaaaaaaaaagaaacaaaaacaaccaaccaaaaatatatctaaaatgtcatctgttagcaattgactcacatattattagtatagaaaagagcaattcccaggaccttgtacagaggaagcaggctcaaaacagctgaggaataggccacttttatcagatagcattggatccatgcacatgggggttggcttcttacctaaatatgccatcagaaatcatccttgttcctgtcccctcagcttttgtagcttgcacagtgagtaaagggatggtggaggcagaaatggtaggagccagagatgttcaaaatccatctgatgcttggcctgtgctgaacgttctcaaactgtggccttgtcaggcccagaaagtggggtggattcctggccgtttctgcttctgcctgggtgtgagatgtgaatgctgcccctactgaagggtagtgcaattttttttttttcttaaaagcttagacccagagctgctaatctactggaaatcactcaggacacagggctctgggcagctgcgctgagcgagacacctgcaaatggagaccaacggggcctccagcaccctggagttccgtaaggcccccagctgaacccaggggagaagag

SEQ ID NO: 791 - DNA, 12917 bp, Homo sapiens
gatcatagtaaatggctttaattttttagcgaaatctcactactgcaaatgcattgttgtcctagctaatgaatgcatagagtattgcctgcaaaataataattgagattctatttttaagaagcttagaacagtacatggtgcatagcaaagactctgtgtatgtgaagccagattttaaaatatggtaacaagtgtctgaaaatatgtggctcaatttgtctcccggttacttttccctctccccctttaaaatgtagaggaaggagaagaagagataagaggtttgtgagtgaagacaagggccctttaaggcctgggaagactaacgccatagggatctccctctgccttaaaaggcacaggaatcttagtggggaaaaagaagtggtgataaatagccagtccgtgtgcctggaatatcaaagtcagtgcgtgccagggatcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaagatcacagctctcactagactttcagaggactttgtaacccaaagaaccactcatctcaaggactgtggtaactcaggggctgagccatgccagtgtttattatgtgaaacaaggactggaacctcacaagaccaagtctgtccatttgaggatggcccaagatgcacacgggctgcttttatcttatgcgcaggttttaaaaaaatatgtttcatttaaatattccatactcttcaggaatgcccaggcagctgagctttcaggatgtcgcattgcagaggactccaatgctacatatggcagctggagaccctttcaaggcaggtggcagaacggaggccctctctatctgctggggcagccctccgggtgccccgctggaaggcagagcagctccatctctgggtgggtgagaggtgctgcatgggctcactatagtatcccaatactgtatggcagtaggctgccagagtatcctaagctgggtggcttcaacaacaggtactgactcacagttctggaggccaaaagtttgaattcaagcagggctgtgcttcctctgaaacctgtgggagaggagccttcctggcttcttcccgacttcttgggatggggatgcgcatccatcctcggccttccttggtttgtggctgtgtcactgcaccctctgcctctgtcacggcatggtgtcctccctatgcatctgtgtctgaatttccctcttccgataaggactccagtcatattgggtgagggcccaccccaatgacctcatctcaactagatcatctgcaaagactctatttcccaattaggtcacattgaaggtacctgtctttttgggggatacaattcatctcacaaaaccggcccatcacctcaaaaggacctgccaccccagtgctatgtgtccctctctgcccagagccactccttcccctggctctcggggagtgggggcacctttccctgctcccacagtgaccgagcaccttccccttggtatgcattctgaagggggcatttttttctcctccatctcagccctgtacaaagcaagttctttctagattgaggtgtgtatgtgtgtctatgtatatgagtgtatgtgcctgtgtgttttcagggagatgtgtgcaggatgggtgcaagggaggagtggaaggcggaagggcaggaggaggatagagccacaagagtgagcacagaagtgacaagggcagaatcagtgtgtgcttgtgacaagtatggaaatgtcatgcctttaggttcagtcctataaggtaggtgtatcagtaagggcattgattctgcgaccttaacagagatcagaataacagtggcttaaggaagagtggagtggatttctctctcctgtaaatctggcctggtgggtggtaaggaggatccacgtcgcccaggcccagatgtgtgtggctctttgagtgccccgttctttcccagtctcataactgctctccacctcctccacatccagccactgggaagcaggacaaagttagttaagggcacgttcttttctttccaaggattacttggacattacagtcttcacttccatgcctactggccagggcttagtcacacaaccttgctagctgcaagggagtctgggaaatgcagctgctattctcagaggccatgtcctcagggattctgctaaatttagcaaggcagggacagatatgggggaaccactgacagtctatcacaaaagaacgtgattttagagaaacagtgaaacagtgtcattaatccacccctcaccccttacaacagccaaaaagaaatccagtggtatccatcacaataaagagtatgagaggaatgtgattagaaaatcaggttgccaggcaggatgtgtccagttttagccagtggtggggttcatggggaaggcttcgtctcaggaaggtgtgtgttgggttgttctatggccagatggttttcaacgacatagcacgacctgtagctctccaggacccgggcctggacataggccttgtccttctcttgccaggcatcggactcgatgtagacgttgaatgggtcgttcgagtgctccagcttcttggagcggatgtagctcagcatgatgcccagggtgaagaagccgaagaatcccagtaccatgaggacgtagagggcctccagcttgccgtcactgctgcggggggacctgcgggccaggcccgacatgttgccaccctgctgaactgtctcctgccacagcttggtcagaaagggcgtcaccgctgtggtgttagacaggatcatcctgggcattaaggttccactgctgcagctcaaacttcccaggcacacctcttaaaggaaaaatgcaaccccaaatcaaaaagtacgtattggccaaaacccacacgtacgcacacacacgtatacaattttaaaatctcaggtgagaggggtgagctgacactccacaggccatggcatgtgccatcttgggtctgtgcaatgccttctcttgatagatgaatggatacattgattcccttctatttccatccaccactccaatctccacccctataggtgaccatcagaatgagcttctttaatatgcattgctgcatattgtggcgtatggggttgcatgtgtgcattttggtttacctaaatggtatcaggtcatccaactcattcagtctccttctttttcctcatgactgtgcttttgtggctcacttgcggtgctgggtgtgtgcattcccttgcttccaatgtttgtatacaacccatggtgaacacccacttcttttctctgccttctcccccagagatggacactgctgtggctgctgactccataaacaagggggagacaaatatccccatccttgacctcctatggacctaaaaaaaatcacgcatctcatacaactagttcctggcagcttatgcaagactagtcagactggttgcccttggaagcaacgtgcaattggtggtctgtttcaccacagagcatctctctatgaacagttacattcatctgaatgaaaaatctatgctgtcacgtggtggacttcagaatgtctagggagatttcacagagagctcccctcgaagaggccagtgttgtagcttgtgctatgtttttccctccctgcccacacacaggcacacacacgtacacaatcttaaaacctcaggtgagaggggtgagctcacatgctccctagtccatggtatgtgccgtcttgggtctacacaatgccctctcttgattgagcaatggtacatggattgccttttatttccattcactactctctggctatgcagaaagtgacattttccctatcgtttaatcttgatatcactgtccctgtatactcagagtgggcctgggaattggaaaaattgtctccaagtagctgtaagattctgtcaggggtttggtttgctgtggaaaccccatctaggtgaccttgagatcattggtaagctgaaaaaaaacaggtcttgtttttatttatttatttatttatttatttaggtttgagcaaatgccagcctctacccccagttcctgctgggaaacaaaagctccgaggccaagttgttgatgtcacattccaaactcaagccagagggggccactgggagcttatcacacgtaagtgctcccactcagttctttctttttctgttttattgagacagggtctcactcttgtcactcaggctggagtacagtggcacaatcttggctcactgcagcctcaacctcctggactcaggtgatcctcctaccctaccctccagagtagatgggactataggtatgcaccaccatgactggctaattttcgtattttttgcagaggtgaggttgccctatgttgccgaggctggtcttgaactcctgggcttacaggatccgcccacctcggccccccaaattgctgggattacaggcatgagccaccctgcttgtcccctgctcacttcttaggagcttaaagtagctgagtagaacatggcctggagtagaacatggcctcggggggactgttgtaactacaggtgaaggatgtatttgggaagacagtttatggccagaatcgctatggaaagacaaattccaacacttgccgggacggcgctgtctttcccagccaggatggggactgtgacattgcacatcatcttgtgtaggacaaataacctcagaaacctagctcctctccagcttagacccagagctatttcttcattgaattggtttaattgtaaaacataccctgaacccagcaccagctgaagacatctggcacctttccgaggcccctcttcctctacccatctctgaactctggctgtgtctcagagttctgttacctgctctcttctcttcctactctcctctctcccagggtgactgcacctgctccaggctcacctgcatggccatgacccagggctctctttaagctccagagccatgcgtccagtgacctgctaaggagatggttccctttggccatccccaggctccttaaagttaacactccaccctgtcctgtcagagactggcccctgcctcattgagctgagtggcaacaccactcactccaaaatctgcatcactctcactgatgactgcaatctcatcatggcagttcccatcttgaaggccttccttggctcctccctgccttcagggtgaaactcctggtcttctgcatggatacaggccctaaatttgagagtctatgcatccctctccaattccactgttgccactgtgcccagaccctatgctccatggtccctgctggccccggagcctctacacattgtgcgtctccagctcagactgcgccttcttcttggcccatgaaacttctcagcaatgcctactcatgcttaaaattcagcccagctctcacctccttcccgaagcctgctctgatacatggggctggatcagcactgtgcacaccatgacccctgctaacctcatcatggtcaggatctccaggccccttatcccatccctgccctgccatccagcctggtgctgggcacgcaaccacacaggagctgcccatgaatgtttatcgaatagatgccaccagaacttaataccttttgaccagtggggcttgactctttataacctgcttactccaatgaacagatgccaatgagctgtctccgaagctctaactgactcccttttccagaagggcagtcatctcccaccctgaaccacagtctcagaaggcaggagtgaggagcagaaagagctcagattttgggattccactgccgccacaggtttggattctagctttgctacttcctggccacatgatcctggacagtttccttagaattgttcagtcaagttttttttttttttctttccaaagtagcgagaaacaccactgacatttgcgggctgttgaatcactgagcaggtgtgtagagtggctgacagcatgtggcacatggcaggtgcacactcagtggtcctgggtaggagtttattggtttttctacctcattaagaaattgctgcccaaggatttggggctttgggggtttaggcttggctttcctgtggctgaccatggcagctgtcttctctacgttgtggagagatcagacatgaatgagaatcaaagattgtttgtggcctttcctggtttctaggcttttgagtctgtgcagagatctgtcaggggttaagctgcctgggctcaagagattcaggtccttgttcttgtacaaaactagcatttagccccattctaaccatcggggtaggcaggaattgtttggtaacagatccaaactcaacgctcaaccatttctttttaaatgacccgaaaccacttatgaatgcataaaaccctgccccagaaaacagacagacctggacctgatactatgatgtaatttccaaaaacccagaatgatcacaattggcaaataattctgccaccaatcactgttagagagtctttccaacttcatgaccatgtgaaggtagaattatggcaggcgacatttgaagatccacaagttaattggtttaaaactgataaatccatacagcaaattaagagttacatctgcaattaattcataatagtgagttcactgagaaggcttgttacttagatccagatggactttcttatgtccaaagaagcaaccaaaaacatctgctttgaaaacctcccaagcccaaaccatcctcagccttgttctttagaatgctttagaatgaccttgttaaaatgcagattgctcctgtaatcccagcactttgggaggccaaagcaggtggatcacttgatgtcaggagtttgacaccagcctggccaacatactgaaaccccgtctctactaaaaatacaaaaataagacaggcgtggtggcgggcacctgtattcccagctatttgggaggctgaggcaggagaatcacttgaacccaggaggtggaggttgcagtgagccaagattgtgccattgcactcctgcctgggtgacacagcgagactctgtctcaaaaaaaaatgcagattgctgggctctattttcagagtttctgatttggtagaactggagcgggcctgggaatctgcattcctaacacattcccacgtggtgctaatactgctggtctggaggccctgcttggtgatctattggaatcaccgggggagcttttagaaaataatggttcctggatctcacccctagagattttaatgtctttggtctgggttcctgcctgactcagagactttttagaaacctcccaaatgatcctaatttgtagccaagattgagaaccactgggctgtggtgtgggaccctaggaaaatgaccaatggccttttgtgctgcagggtacctggaagaattttgcaaaaatatagaaatatgatctcactgactgtttttcaaatcttgtttgttttttacattttcttttttggccttgtttgcctctgatacagtctgaaaagaaattgcagaaagaaactctccagtcttcagtgtaacctcagctgtccccagtctcacacacgctggtgccttcaattacaattctcctgtcagagcttaagtccagctaattaactgcctttcaaatgacaaccctatatttttaaagaatttttttaaaacttcacatgtaatttattgcattgcttttgctaaatgtcctccacacccccaatgcctgctaggctgggtcgccatggtatttttgtgtaacgagtctcaaaatgagtttggcaatgtctccgtaatagtcagcatggtgtaaatgacagtctggatctgcatgtcatttgggattttatatcagattctctaggttcatttctatgatacgtgatgccaaagcacccacatgccccgtggctgcactttcagacagttggactcaaacagagtgggagagcaactgatccaacaatctgaattttcagaaaacggggctccttagagatgagatggcttgccaaaagtaatctctcctatcagaagtacatatcctcagcaaactaacgcaggagcagaaaaccaaacaccgcatattctcacttataagtgggagctgaacagtgagaacacatggacacagggaggggaacaacacacactggggcttgtcggggaaaggtgggtggggaagagcattagggaaaagagctaatgcacgctgggcttaacacctagatgatgggttgacaggtgccgcaaaccatcatggcacatatttatgtctgtaacaaacctgcacatcctgcacatgttccctggaacttaaaaaaaaaaaaaaagaaacaaaaacaaccaaccaaaaatatatctaaaatgtcatctgttagcaattgactcacatattattagtatagaaaagagcaattcccaggaccttgtacagaggaagcaggctcaaaacagctgaggaataggccacttttatcagatagcattggatccatgcacatgggggttggcttcttacctaaatatgccatcagaaatcatccttgttcctgtcccctcagcttttgtagcttgcacagtgagtaaagggatggtggaggcagaaatggtaggagccagagatgttcaaaatccatctgatgcttggcctgtgctgaacgttctcaaactgtggccttgtcaggcccagaaagtggggtggattcctggccgtttctgcttctgcctgggtgtgagatgtgaatgctgcccctactgaagggtagtgcaattttttttttttcttaaaagcttagacccagagctgctaatctactggaaatcactcaggacacagggctctgggcagctgcgctgagcgagacacctgcaaatggagaccaacggggcctccagcaccctggagttccgtaaggcccccagctgaacccaggggagaagagggcagtgggtggcgcctcgctgctctgggcacacaccacctcttctgacttctcccacgtgctccggctgtgtcgcctatcagcactgataacagcctggaagctttcagaacagaagctttcccagcatgggaaactctcattctttcttttttttaattttccaaagcctttatttctaagaccaactgtggcctacccgtgcataaactgggcaggctgtagacagcaggcttgccaagtaaatactacagccttcctcccaatattgagccctgtcccattgatcctgcaggggagatgtgtagggcatttgttcacggggaggccacaagtttgggcctctcatcactgtgacctcacacccctgttgagtgtgtcgtaaacagaggagccgttcttcaagccccctgccctgagtgcacccctctcattcttttgttattattagcaaattcccccagttcctgatcattctttcttaagcctttagtgactgggtaaggttcttgtggctgactccaagctttcttctaaaaggaatagattctaggggtgagtagaggagacaggaatgtcggagtcagagctcaggaatctgggttccagccccaggtcaatcctagataaactagagggctccttaacttacttccctaggttgactctgggtttttttatcacgctcgacaggactccttatgcatttcttcgaaagagcatccagtcttaacatcatcatttggcctcatttggtttaagaagcagaattagggtaaaagcaatgatggataagcctcattttggtgaatatgatcttattgagacaagaattctgagtcaattgtccttggaaccaactgtctattgttttcatctttatcacaacactatgtccaaattttggaaacatgtttccctcctagcagaaaagaagccacccagggccaccagatgcttcccgacacttggctggctttgtctggtcttctatccttcccctatccccagagtcagtgggtactaaggtggccagggtcgctcaaggaatcagaatgcaaccgtccagaggcccagaatcagactgtcctctctgattaggaaagtgtttcctgccacctcccagggggatgtggggtgtggcttgagtctggtgcttttaccaggagcttcccagacctctctatgggtgatggagagagagtctggggtgtgaaggatggaaatataaacactgaatactcagagagtcaggccagcgagctggtgaggagactccatcaaactcaatatgaaaacatgggtgggcgtttggggatggataatgaatgacagctgaagtcacacatcaggagggaaggaaggactctcatcttcagcaaatgacataaatctggggagcctcagtttcctcacctgaacagtgagaatgatggaatctaccctgagtatatatcccaggtctttgtgcagcatggaatcagcccccagccttcctagctcttgctttattttattttattttagagaccaagcctcgctctgtcactcaggctggagtgcagtggcgcgatcttgacttactacaacctcctccgcctcctgggttcaagtgattctcctgcctcagcctcctaagtagttgggtttacaggtgcatgccactatgcctggttaatttttgtatttttagtagagacggggtttcaccatgttgcccaggctcaacatgcctgggctgaagcgatccacctgccttggcctcccaaagtgctaggattacaggcgtgagccaccgtgcctggcctcttgttttatgtttgctgttctcgctgtaggtgaggcattcccaccatattcccttgttaaaatcctactggcccttcaaatgccagctcatatccacactgtgtctgaccctgatccagaatcctctccccttctttgaccccttgtatatatctttcctacagtgctggtcatattctaacttctaatcatttgtagacttatctgggcattttctcccaggaggtcccaaaggacagagaccatcttgctcacctttgtccccactccagcacccagaatgtttcaataaggttttcctgaattaagtgggaagcaaagtattagattcaataccactacaatgggaaagtgagtgaataattgataaagtatactatgctctggaaatagattattgagtaatcagaggaaaacctcttgcaatgtagtatgtttttatatattaaattttatattatttatttatatttatattattaacatatttttgttattcattttgtttattaagatttactctatatatatatgtgtgtgtgtgtgcgcgtgtgtgtgtgtgtaacccaccttatttctaaaaaaaaattttggcagtcagtgactattaatagtagagcacaaactcttaacctttttttcctcccgctttcccagagtccttatcaccttctaatataataaagttttcttaactgtgatgttgattgttcaacgtttgtctttcccaccaaaatgtaagctattgcgggcagggatctttgcatgggttgttcttcattgcatcccaggccactagaacagtgtgtggcatatggcaggagtgcaataaacattcagcgaatgcaggcaggcatgcgtgaacgcatgaataataagtgttcctttcaactaccagaaagagcgaaaccacacaggagctgtctcaccctcagagatttaagacgacagcaatgagtccctctgatgtcttctaagtgagctttattttcaaaacaaatcattttccaataacctatcaaaagcaggtcctacctgaatatccttggctatttcctctggatacagataatgccttcctccaatggatcctcggctcacctgatgattgtgtgaaactggccagagaaagcagagggatttttcctggtgattggaaatcagagtcacggctgaatttaagcaactgtgtgaactcagcaaagtccccaccacctggaccatacatgacagctatggttattgacaaggtccttccttaatggagctggaacctccttcttaatctaaatgtggactcaaatgaactgtcaattcacatagagcaatgtgacaaatccggggggcaaagcattatgcaatagattgggcacatgcgcacgtctctgctacttagtcaactttcttctaaagtttcccacttttcccattaccacaatcaagatcagatatcagtaatattctccgcgtcccatgccctttcctcagggagatgccaaggcccaagagctggtccccccaaaaagctgaaggtctttgaaaaaaagtggggactcaggtcccgtgagtggttttgattttcttttcttttgaaagttgcatgtaagtgttttccaaatactatacaagaatgtctataacttaataatggaggaatgttttcgttgttctgtgttggtgagatgctttcctatgcgtttgttgtataagtaagtgagaatggcagaaggaaaggaggggagaggctgatcatcctatcccgtctcccactctgggggtctcggcgcttccagcctgaagcgcgcccgctgcgcgtccggagacgcaggttccaggagccccccggggttgcccgactaggccacttgcgccccggaagagggccgcggaggtgggagaccctaacttacccgggtctgagatgccgagagagccgggtgtggagctgagtgcgcgcctgccgagcgctgaggccacagacagccc

SEQ ID NO: 792 - DNA, 12917 bp, Homo sapiens; identical to SEQ ID NO: 791

SEQ ID NO: 793 - DNA, 13251 bp, Homo sapiens
gatcatagtaaatggctttaattttttagcgaaatctcactactgcaaatgcattgttgtcctagctaatgaatgcatagagtattgcctgcaaaataataattgagattctatttttaagaagcttagaacagtacatggtgcatagcaaagactctgtgtatgtgaagccagattttaaaatatggtaacaagtgtctgaaaatatgtggctcaatttgtctcccggttacttttccctctccccctttaaaatgtagaggaaggagaagaagagataagaggtttgtgagtgaagacaagggccctttaaggcctgggaagactaacgccatagggatctccctctgccttaaaaggcacaggaatcttagtggggaaaaagaagtggtgataaatagccagtccgtgtgcctggaatatcaaagtcagtgcgtgccagggatcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaagatcacagctctcactagactttcagaggactttgtaacccaaagaaccactcatctcaaggactgtggtaactcaggggctgagccatgccagtgtttattatgtgaaacaaggactggaacctcacaagaccaagtctgtccatttgaggatggcccaagatgcacacgggctgcttttatcttatgcgcaggttttaaaaaaatatgtttcatttaaatattccatactcttcaggaatgcccaggcagctgagctttcaggatgtcgcattgcagaggactccaatgctacatatggcagctggagaccctttcaaggcaggtggcagaacggaggccctctctatctgctggggcagccctccgggtgccccgctggaaggcagagcagctccatctctgggtgggtgagaggtgctgcatgggctcactatagtatcccaatactgtatggcagtaggctgccagagtatcctaagctgggtggcttcaacaacaggtactgactcacagttctggaggccaaaagtttgaattcaagcagggctgtgcttcctctgaaacctgtgggagaggagccttcctggcttcttcccgacttcttgggatggggatgcgcatccatcctcggccttccttggtttgtggctgtgtcactgcaccctctgcctctgtcacggcatggtgtcctccctatgcatctgtgtctgaatttccctcttccgataaggactccagtcatattgggtgagggcccaccccaatgacctcatctcaactagatcatctgcaaagactctatttcccaattaggtcacattgaaggtacctgtctttttgggggatacaattcatctcacaaaaccggcccatcacctcaaaaggacctgccaccccagtgctatgtgtccctctctgcccagagccactccttcccctggctctcggggagtgggggcacctttccctgctcccacagtgaccgagcaccttccccttggtatgcattctgaagggggcatttttttctcctccatctcagccctgtacaaagcaagttctttctagattgaggtgtgtatgtgtgtctatgtatatgagtgtatgtgcctgtgtgttttcagggagatgtgtgcaggatgggtgcaagggaggagtggaaggcggaagggcaggaggaggatagagccacaagagtgagcacagaagtgacaagggcagaatcagtgtgtgcttgtgacaagtatggaaatgtcatgcctttaggttcagtcctataaggtaggtgtatcagtaagggcattgattctgcgaccttaacagagatcagaataacagtggcttaaggaagagtggagtggatttctctctcctgtaaatctggcctggtgggtggtaaggaggatccacgtcgcccaggcccagatgtgtgtggctctttgagtgccccgttctttcccagtctcataactgctctccacctcctccacatccagccactgggaagcaggacaaagttagttaagggcacgttcttttctttccaaggattacttggacattacagtcttcacttccatgcctactggccagggcttagtcacacaaccttgctagctgcaagggagtctgggaaatgcagctgctattctcagaggccatgtcctcagggattctgctaaatttagcaaggcagggacagatatgggggaaccactgacagtctatcacaaaagaacgtgattttagagaaacagtgaaacagtgtcattaatccacccctcaccccttacaacagccaaaaagaaatccagtggtatccatcacaataaagagtatgagaggaatgtgattagaaaatcaggttgccaggcaggatgtgtccagttttagccagtggtggggttcatggggaaggcttcgtctcaggaaggtgtgtgttgggttgttctatggccagatggttttcaacgacatagcacgacctgtagctctccaggacccgggcctggacataggccttgtccttctcttgccaggcatcggactcgatgtagacgttgaatgggtcgttcgagtgctccagcttcttggagcggatgtagctcagcatgatgcccagggtgaagaagccgaagaatcccagtaccatgaggacgtagagggcctccagcttgccgtcactgctgcggggggacctgcgggccaggcccgacatgttgccaccctgctgaactgtctcctgccacagcttggtcagaaagggcgtcaccgctgtggtgttagacaggatcatcctgggcattaaggttccactgctgcagctcaaacttcccaggcacacctcttaaaggaaaaatgcaaccccaaatcaaaaagtacgtattggccaaaacccacacgtacgcacacacacgtatacaattttaaaatctcaggtgagaggggtgagctgacactccacaggccatggcatgtgccatcttgggtctgtgcaatgccttctcttgatagatgaatggatacattgattcccttctatttccatccaccactccaatctccacccctataggtgaccatcagaatgagcttctttaatatgcattgctgcatattgtggcgtatggggttgcatgtgtgcattttggtttacctaaatggtatcaggtcatccaactcattcagtctccttctttttcctcatgactgtgcttttgtggctcacttgcggtgctgggtgtgtgcattcccttgcttccaatgtttgtatacaacccatggtgaacacccacttcttttctctgccttctcccccagagatggacactgctgtggctgctgactccataaacaagggggagacaaatatccccatccttgacctcctatggacctaaaaaaaatcacgcatctcatacaactagttcctggcagcttatgcaagactagtcagactggttgcccttggaagcaacgtgcaattggtggtctgtttcaccacagagcatctctctatgaacagttacattcatctgaatgaaaaatctatgctgtcacgtggtggacttcagaatgtctagggagatttcacagagagctcccctcgaagaggccagtgttgtagcttgtgctatgtttttccctccctgcccacacacaggcacacacacgtacacaatcttaaaacctcaggtgagaggggtgagctcacatgctccctagtccatggtatgtgccgtcttgggtctacacaatgccctctcttgattgagcaatggtacatggattgccttttatttccattcactactctctggctatgcagaaagtgacattttccctatcgtttaatcttgatatcactgtccctgtatactcagagtgggcctgggaattggaaaaattgtctccaagtagctgtaagattctgtcaggggtttggtttgctgtggaaaccccatctaggtgaccttgagatcattggtaagctgaaaaaaaacaggtcttgtttttatttatttatttatttatttatttaggtttgagcaaatgccagcctctacccccagttcctgctgggaaacaaaagctccgaggccaagttgttgatgtcacattccaaactcaagccagagggggccactgggagcttatcacacgtaagtgctcccactcagttctttctttttctgttttattgagacagggtctcactcttgtcactcaggctggagtacagtggcacaatcttggctcactgcagcctcaacctcctggactcaggtgatcctcctaccctaccctccagagtagatgggactataggtatgcaccaccatgactggctaattttcgtattttttgcagaggtgaggttgccctatgttgccgaggctggtcttgaactcctgggcttacaggatccgcccacctcggccccccaaattgctgggattacaggcatgagccaccctgcttgtcccctgctcacttcttaggagcttaaagtagctgagtagaacatggcctggagtagaacatggcctcggggggactgttgtaactacaggtgaaggatgtatttgggaagacagtttatggccagaatcgctatggaaagacaaattccaacacttgccgggacggcgctgtctttcccagccaggatggggactgtgacattgcacatcatcttgtgtaggacaaataacctcagaaacctagctcctctccagcttagacccagagctatttcttcattgaattggtttaattgtaaaacataccctgaacccagcaccagctgaagacatctggcacctttccgaggcccctcttcctctacccatctctgaactctggctgtgtctcagagttctgttacctgctctcttctcttcctactctcctctctcccagggtgactgcacctgctccaggctcacctgcatggccatgacccagggctctctttaagctccagagccatgcgtccagtgacctgctaaggagatggttccctttggccatccccaggctccttaaagttaacactccaccctgtcctgtcagagactggcccctgcctcattgagctgagtggcaacaccactcactccaaaatctgcatcactctcactgatgactgcaatctcatcatggcagttcccatcttgaaggccttccttggctcctccctgccttcagggtgaaactcctggtcttctgcatggatacaggccctaaatttgagagtctatgcatccctctccaattccactgttgccactgtgcccagaccctatgctccatggtccctgctggccccggagcctctacacattgtgcgtctccagctcagactgcgccttcttcttggcccatgaaacttctcagcaatgcctactcatgcttaaaattcagcccagctctcacctccttcccgaagcctgctctgatacatggggctggatcagcactgtgcacaccatgacccctgctaacctcatcatggtcaggatctccaggccccttatcccatccctgccctgccatccagcctggtgctgggcacgcaaccacacaggagctgcccatgaatgtttatcgaatagatgccaccagaacttaataccttttgaccagtggggcttgactctttataacctgcttactccaatgaacagatgccaatgagctgtctccgaagctctaactgactcccttttccagaagggcagtcatctcccaccctgaaccacagtctcagaaggcaggagtgaggagcagaaagagctcagattttgggattccactgccgccacaggtttggattctagctttgctacttcctggccacatgatcctggacagtttccttagaattgttcagtcaagttttttttttttttctttccaaagtagcgagaaacaccactgacatttgcgggctgttgaatcactgagcaggtgtgtagagtggctgacagcatgtggcacatggcaggtgcacactcagtggtcctgggtaggagtttattggtttttctacctcattaagaaattgctgcccaaggatttggggctttgggggtttaggcttggctttcctgtggctgaccatggcagctgtcttctctacgttgtggagagatcagacatgaatgagaatcaaagattgtttgtggcctttcctggtttctaggcttttgagtctgtgcagagatctgtcaggggttaagctgcctgggctcaagagattcaggtccttgttcttgtacaaaactagcatttagccccattctaaccatcggggtaggcaggaattgtttggtaacagatccaaactcaacgctcaaccatttctttttaaatgacccgaaaccacttatgaatgcataaaaccctgccccagaaaacagacagacctggacctgatactatgatgtaatttccaaaaacccagaatgatcacaattggcaaataattctgccaccaatcactgttagagagtctttccaacttcatgaccatgtgaaggtagaattatggcaggcgacatttgaagatccacaagttaattggtttaaaactgataaatccatacagcaaattaagagttacatctgcaattaattcataatagtgagttcactgagaaggcttgttacttagatccagatggactttcttatgtccaaagaagcaaccaaaaacatctgctttgaaaacctcccaagcccaaaccatcctcagccttgttctttagaatgctttagaatgaccttgttaaaatgcagattgctcctgtaatcccagcactttgggaggccaaagcaggtggatcacttgatgtcaggagtttgacaccagcctggccaacatactgaaaccccgtctctactaaaaatacaaaaataagacaggcgtggtggcgggcacctgtattcccagctatttgggaggctgaggcaggagaatcacttgaacccaggaggtggaggttgcagtgagccaagattgtgccattgcactcctgcctgggtgacacagcgagactctgtctcaaaaaaaaatgcagattgctgggctctattttcagagtttctgatttggtagaactggagcgggcctgggaatctgcattcctaacacattcccacgtggtgctaatactgctggtctggaggccctgcttggtgatctattggaatcaccgggggagcttttagaaaataatggttcctggatctcacccctagagattttaatgtctttggtctgggttcctgcctgactcagagactttttagaaacctcccaaatgatcctaatttgtagccaagattgagaaccactgggctgtggtgtgggaccctaggaaaatgaccaatggccttttgtgctgcagggtacctggaagaattttgcaaaaatatagaaatatgatctcactgactgtttttcaaatcttgtttgttttttacattttcttttttggccttgtttgcctctgatacagtctgaaaagaaattgcagaaagaaactctccagtcttcagtgtaacctcagctgtccccagtctcacacacgctggtgccttcaattacaattctcctgtcagagcttaagtccagctaattaactgcctttcaaatgacaaccctatatttttaaagaatttttttaaaacttcacatgtaatttattgcattgcttttgctaaatgtcctccacacccccaatgcctgctaggctgggtcgccatggtatttttgtgtaacgagtctcaaaatgagtttggcaatgtctccgtaatagtcagcatggtgtaaatgacagtctggatctgcatgtcatttgggattttatatcagattctctaggttcatttctatgatacgtgatgccaaagcacccacatgccccgtggctgcactttcagacagttggactcaaacagagtgggagagcaactgatccaacaatctgaattttcagaaaacggggctccttagagatgagatggcttgccaaaagtaatctctcctatcagaagtacatatcctcagcaaactaacgcaggagcagaaaaccaaacaccgcatattctcacttataagtgggagctgaacagtgagaacacatggacacagggaggggaacaacacacactggggcttgtcggggaaaggtgggtggggaagagcattagggaaaagagctaatgcacgctgggcttaacacctagatgatgggttgacaggtgccgcaaaccatcatggcacatatttatgtctgtaacaaacctgcacatcctgcacatgttccctggaacttaaaaaaaaaaaaaaagaaacaaaaacaaccaaccaaaaatatatctaaaatgtcatctgttagcaattgactcacatattattagtatagaaaagagcaattcccaggaccttgtacagaggaagcaggctcaaaacagctgaggaataggccacttttatcagatagcattggatccatgcacatgggggttggcttcttacctaaatatgccatcagaaatcatccttgttcctgtcccctcagcttttgtagcttgcacagtgagtaaagggatggtggaggcagaaatggtaggagccagagatgttcaaaatccatctgatgcttggcctgtgctgaacgttctcaaactgtggccttgtcaggcccagaaagtggggtggattcctggccgtttctgcttctgcctgggtgtgagatgtgaatgctgcccctactgaagggtagtgcaattttttttttttcttaaaagcttagacccagagctgctaatctactggaaatcactcaggacacagggctctgggcagctgcgctgagcgagacacctgcaaatggagaccaacggggcctccagcaccctggagttccgtaaggcccccagctgaacccaggggagaagagggcagtgggtggcgcctcgctgctctgggcacacaccacctcttctgacttctcccacgtgctccggctgtgtcgcctatcagcactgataacagcctggaagctttcagaacagaagctttcccagcatgggaaactctcattctttcttttttttaattttccaaagcctttatttctaagaccaactgtggcctacccgtgcataaactgggcaggctgtagacagcaggcttgccaagtaaatactacagccttcctcccaatattgagccctgtcccattgatcctgcaggggagatgtgtagggcatttgttcacggggaggccacaagtttgggcctctcatcactgtgacctcacacccctgttgagtgtgtcgtaaacagaggagccgttcttcaagccccctgccctgagtgcacccctctcattcttttgttattattagcaaattcccccagttcctgatcattctttcttaagcctttagtgactgggtaaggttcttgtggctgactccaagctttcttctaaaaggaatagattctaggggtgagtagaggagacaggaatgtcggagtcagagctcaggaatctgggttccagccccaggtcaatcctagataaactagagggctccttaacttacttccctaggttgactctgggtttttttatcacgctcgacaggactccttatgcatttcttcgaaagagcatccagtcttaacatcatcatttggcctcatttggtttaagaagcagaattagggtaaaagcaatgatggataagcctcattttggtgaatatgatcttattgagacaagaattctgagtcaattgtccttggaaccaactgtctattgttttcatctttatcacaacactatgtccaaattttggaaacatgtttccctcctagcagaaaagaagccacccagggccaccagatgcttcccgacacttggctggctttgtctggtcttctatccttcccctatccccagagtcagtgggtactaaggtggccagggtcgctcaaggaatcagaatgcaaccgtccagaggcccagaatcagactgtcctctctgattaggaaagtgtttcctgccacctcccagggggatgtggggtgtggcttgagtctggtgcttttaccaggagcttcccagacctctctatgggtgatggagagagagtctggggtgtgaaggatggaaatataaacactgaatactcagagagtcaggccagcgagctggtgaggagactccatcaaactcaatatgaaaacatgggtgggcgtttggggatggataatgaatgacagctgaagtcacacatcaggagggaaggaaggactctcatcttcagcaaatgacataaatctggggagcctcagtttcctcacctgaacagtgagaatgatggaatctaccctgagtatatatcccaggtctttgtgcagcatggaatcagcccccagccttcctagctcttgctttattttattttattttagagaccaagcctcgctctgtcactcaggctggagtgcagtggcgcgatcttgacttactacaacctcctccgcctcctgggttcaagtgattctcctgcctcagcctcctaagtagttgggtttacaggtgcatgccactatgcctggttaatttttgtatttttagtagagacggggtttcaccatgttgcccaggctcaacatgcctgggctgaagcgatccacctgccttggcctcccaaagtgctaggattacaggcgtgagccaccgtgcctggcctcttgttttatgtttgctgttctcgctgtaggtgaggcattcccaccatattcccttgttaaaatcctactggcccttcaaatgccagctcatatccacactgtgtctgaccctgatccagaatcctctccccttctttgaccccttgtatatatctttcctacagtgctggtcatattctaacttctaatcatttgtagacttatctgggcattttctcccaggaggtcccaaaggacagagaccatcttgctcacctttgtccccactccagcacccagaatgtttcaataaggttttcctgaattaagtgggaagcaaagtattagattcaataccactacaatgggaaagtgagtgaataattgataaagtatactatgctctggaaatagattattgagtaatcagaggaaaacctcttgcaatgtagtatgtttttatatattaaattttatattatttatttatatttatattattaacatatttttgttattcattttgtttattaagatttactctatatatatatgtgtgtgtgtgtgcgcgtgtgtgtgtgtgtaacccaccttatttctaaaaaaaaattttggcagtcagtgactattaatagtagagcacaaactcttaacctttttttcctcccgctttcccagagtccttatcaccttctaatataataaagttttcttaactgtgatgttgattgttcaacgtttgtctttcccaccaaaatgtaagctattgcgggcagggatctttgcatgggttgttcttcattgcatcccaggccactagaacagtgtgtggcatatggcaggagtgcaataaacattcagcgaatgcaggcaggcatgcgtgaacgcatgaataataagtgttcctttcaactaccagaaagagcgaaaccacacaggagctgtctcaccctcagagatttaagacgacagcaatgagtccctctgatgtcttctaagtgagctttattttcaaaacaaatcattttccaataacctatcaaaagcaggtcctacctgaatatccttggctatttcctctggatacagataatgccttcctccaatggatcctcggctcacctgatgattgtgtgaaactggccagagaaagcagagggatttttcctggtgattggaaatcagagtcacggctgaatttaagcaactgtgtgaactcagcaaagtccccaccacctggaccatacatgacagctatggttattgacaaggtccttccttaatggagctggaacctccttcttaatctaaatgtggactcaaatgaactgtcaattcacatagagcaatgtgacaaatccggggggcaaagcattatgcaatagattgggcacatgcgcacgtctctgctacttagtcaactttcttctaaagtttcccacttttcccattaccacaatcaagatcagatatcagtaatattctccgcgtcccatgccctttcctcagggagatgccaaggcccaagagctggtccccccaaaaagctgaaggtctttgaaaaaaagtggggactcaggtcccgtgagtggttttgattttcttttcttttgaaagttgcatgtaagtgttttccaaatactatacaagaatgtctataacttaataatggaggaatgttttcgttgttctgtgttggtgagatgctttcctatgcgtttgttgtataagtaagtgagaatggcagaaggaaaggaggggagaggctgatcatcctatcccgtctcccactctgggggtctcggcgcttccagcctgaagcgcgcccgctgcgcgtccggagacgcaggttccaggagccccccggggttgcccgactaggccacttgcgccccggaagagggccgcggaggtgggagaccctaacttacccgggtctgagatgccgagagagccgggtgtggagctgagtgcgcgcctgccgagcgctgaggccacagacagccccgccccggggcggcaccttctaagggcctgagcgctgcacagggatgggggcgggcggggcctcccagagccgccaggcgtcccgccccactccgcccacacgcacggcccagcccagggttccccgggaccaccccagaccagccccggcccccccgggtcctccacactctgcaccccagaccaacaccaacgcgcgtagggaagcgttttagatcctgtcggagaggctcaaggccggcagaaggtttgcattaggatcgagaaagccgaccaacggacagatctacctaccttcctgcgggagtttgaggttgccaggggggaagccact

SEQ ID NO: 794 - DNA, 64628 bp, Homo sapiens
gatcatagtaaatggctttaattttttagcgaaatctcactactgcaaatgcattgttgtcctagctaatgaatgcatagagtattgcctgcaaaataataattgagattctatttttaagaagcttagaacagtacatggtgcatagcaaagactctgtgtatgtgaagccagattttaaaatatggtaacaagtgtctgaaaatatgtggctcaatttgtctcccggttacttttccctctccccctttaaaatgtagaggaaggagaagaagagataagaggtttgtgagtgaagacaagggccctttaaggcctgggaagactaacgccatagggatctccctctgccttaaaaggcacaggaatcttagtggggaaaaagaagtggtgataaatagccagtccgtgtgcctggaatatcaaagtcagtgcgtgccagggatcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaagatcacagctctcactagactttcagaggactttgtaacccaaagaaccactcatctcaaggactgtggtaactcaggggctgagccatgccagtgtttattatgtgaaacaaggactggaacctcacaagaccaagtctgtccatttgaggatggcccaagatgcacacgggctgcttttatcttatgcgcaggttttaaaaaaatatgtttcatttaaatattccatactcttcaggaatgcccaggcagctgagctttcaggatgtcgcattgcagaggactccaatgctacatatggcagctggagaccctttcaaggcaggtggcagaacggaggccctctctatctgctggggcagccctccgggtgccccgctggaaggcagagcagctccatctctgggtgggtgagaggtgctgcatgggctcactatagtatcccaatactgtatggcagtaggctgccagagtatcctaagctgggtggcttcaacaacaggtactgactcacagttctggaggccaaaagtttgaattcaagcagggctgtgcttcctctgaaacctgtgggagaggagccttcctggcttcttcccgacttcttgggatggggatgcgcatccatcctcggccttccttggtttgtggctgtgtcactgcaccctctgcctctgtcacggcatggtgtcctccctatgcatctgtgtctgaatttccctcttccgataaggactccagtcatattgggtgagggcccaccccaatgacctcatctcaactagatcatctgcaaagactctatttcccaattaggtcacattgaaggtacctgtctttttgggggatacaattcatctcacaaaaccggcccatcacctcaaaaggacctgccaccccagtgctatgtgtccctctctgcccagagccactccttcccctggctctcggggagtgggggcacctttccctgctcccacagtgaccgagcaccttccccttggtatgcattctgaagggggcatttttttctcctccatctcagccctgtacaaagcaagttctttctagattgaggtgtgtatgtgtgtctatgtatatgagtgtatgtgcctgtgtgttttcagggagatgtgtgcaggatgggtgcaagggaggagtggaaggcggaagggcaggaggaggatagagccacaagagtgagcacagaagtgacaagggcagaatcagtgtgtgcttgtgacaagtatggaaatgtcatgcctttaggttcagtcctataaggtaggtgtatcagtaagggcattgattctgcgaccttaacagagatcagaataacagtggcttaaggaagagtggagtggatttctctctcctgtaaatctggcctggtgggtggtaaggaggatccacgtcgcccaggcccagatgtgtgtggctctttgagtgccccgttctttcccagtctcataactgctctccacctcctccacatccagccactgggaagcaggacaaagttagttaagggcacgttcttttctttccaaggattacttggacattacagtcttcacttccatgcctactggccagggcttagtcacacaaccttgctagctgcaagggagtctgggaaatgcagctgctattctcagaggccatgtcctcagggattctgctaaatttagcaaggcagggacagatatgggggaaccactgacagtctatcacaaaagaacgtgattttagagaaacagtgaaacagtgtcattaatccacccctcaccccttacaacagccaaaaagaaatccagtggtatccatcacaataaagagtatgagaggaatgtgattagaaaatcaggttgccaggcaggatgtgtccagttttagccagtggtggggttcatggggaaggcttcgtctcaggaaggtgtgtgttgggttgttctatggccagatggttttcaacgacatagcacgacctgtagctctccaggacccgggcctggacataggccttgtccttctcttgccaggcatcggactcgatgtagacgttgaatgggtcgttcgagtgctccagcttcttggagcggatgtagctcagcatgatgcccagggtgaagaagccgaagaatcccagtaccatgaggacgtagagggcctccagcttgccgtcactgctgcggggggacctgcgggccaggcccgacatgttgccaccctgctgaactgtctcctgccacagcttggtcagaaagggcgtcaccgctgtggtgttagacaggatcatcctgggcattaaggttccactgctgcagctcaaacttcccaggcacacctcttaaaggaaaaatgcaaccccaaatcaaaaagtacgtattggccaaaacccacacgtacgcacacacacgtatacaattttaaaatctcaggtgagaggggtgagctgacactccacaggccatggcatgtgccatcttgggtctgtgcaatgccttctcttgatagatgaatggatacattgattcccttctatttccatccaccactccaatctccacccctataggtgaccatcagaatgagcttctttaatatgcattgctgcatattgtggcgtatggggttgcatgtgtgcattttggtttacctaaatggtatcaggtcatccaactcattcagtctccttctttttcctcatgactgtgcttttgtggctcacttgcggtgctgggtgtgtgcattcccttgcttccaatgtttgtatacaacccatggtgaacacccacttcttttctctgccttctcccccagagatggacactgctgtggctgctgactccataaacaagggggagacaaatatccccatccttgacctcctatggacctaaaaaaaatcacgcatctcatacaactagttcctggcagcttatgcaagactagtcagactggttgcccttggaagcaacgtgcaattggtggtctgtttcaccacagagcatctctctatgaacagttacattcatctgaatgaaaaatctatgctgtcacgtggtggacttcagaatgtctagggagatttcacagagagctcccctcgaagaggccagtgttgtagcttgtgctatgtttttccctccctgcccacacacaggcacacacacgtacacaatcttaaaacctcaggtgagaggggtgagctcacatgctccctagtccatggtatgtgccgtcttgggtctacacaatgccctctcttgattgagcaatggtacatggattgccttttatttccattcactactctctggctatgcagaaagtgacattttccctatcgtttaatcttgatatcactgtccctgtatactcagagtgggcctgggaattggaaaaattgtctccaagtagctgtaagattctgtcaggggtttggtttgctgtggaaaccccatctaggtgaccttgagatcattggtaagctgaaaaaaaacaggtcttgtttttatttatttatttatttatttatttaggtttgagcaaatgccagcctctacccccagttcctgctgggaaacaaaagctccgaggccaagttgttgatgtcacattccaaactcaagccagagggggccactgggagcttatcacacgtaagtgctcccactcagttctttctttttctgttttattgagacagggtctcactcttgtcactcaggctggagtacagtggcacaatcttggctcactgcagcctcaacctcctggactcaggtgatcctcctaccctaccctccagagtagatgggactataggtatgcaccaccatgactggctaattttcgtattttttgcagaggtgaggttgccctatgttgccgaggctggtcttgaactcctgggcttacaggatccgcccacctcggccccccaaattgctgggattacaggcatgagccaccctgcttgtcccctgctcacttcttaggagcttaaagtagctgagtagaacatggcctggagtagaacatggcctcggggggactgttgtaactacaggtgaaggatgtatttgggaagacagtttatggccagaatcgctatggaaagacaaattccaacacttgccgggacggcgctgtctttcccagccaggatggggactgtgacattgcacatcatcttgtgtaggacaaataacctcagaaacctagctcctctccagcttagacccagagctatttcttcattgaattggtttaattgtaaaacataccctgaacccagcaccagctgaagacatctggcacctttccgaggcccctcttcctctacccatctctgaactctggctgtgtctcagagttctgttacctgctctcttctcttcctactctcctctctcccagggtgactgcacctgctccaggctcacctgcatggccatgacccagggctctctttaagctccagagccatgcgtccagtgacctgctaaggagatggttccctttggccatccccaggctccttaaagttaacactccaccctgtcctgtcagagactggcccctgcctcattgagctgagtggcaacaccactcactccaaaatctgcatcactctcactgatgactgcaatctcatcatggcagttcccatcttgaaggccttccttggctcctccctgccttcagggtgaaactcctggtcttctgcatggatacaggccctaaatttgagagtctatgcatccctctccaattccactgttgccactgtgcccagaccctatgctccatggtccctgctggccccggagcctctacacattgtgcgtctccagctcagactgcgccttcttcttggcccatgaaacttctcagcaatgcctactcatgcttaaaattcagcccagctctcacctccttcccgaagcctgctctgatacatggggctggatcagcactgtgcacaccatgacccctgctaacctcatcatggtcaggatctccaggccccttatcccatccctgccctgccatccagcctggtgctgggcacgcaaccacacaggagctgcccatgaatgtttatcgaatagatgccaccagaacttaataccttttgaccagtggggcttgactctttataacctgcttactccaatgaacagatgccaatgagctgtctccgaagctctaactgactcccttttccagaagggcagtcatctcccaccctgaaccacagtctcagaaggcaggagtgaggagcagaaagagctcagattttgggattccactgccgccacaggtttggattctagctttgctacttcctggccacatgatcctggacagtttccttagaattgttcagtcaagttttttttttttttctttccaaagtagcgagaaacaccactgacatttgcgggctgttgaatcactgagcaggtgtgtagagtggctgacagcatgtggcacatggcaggtgcacactcagtggtcctgggtaggagtttattggtttttctacctcattaagaaattgctgcccaaggatttggggctttgggggtttaggcttggctttcctgtggctgaccatggcagctgtcttctctacgttgtggagagatcagacatgaatgagaatcaaagattgtttgtggcctttcctggtttctaggcttttgagtctgtgcagagatctgtcaggggttaagctgcctgggctcaagagattcaggtccttgttcttgtacaaaactagcatttagccccattctaaccatcggggtaggcaggaattgtttggtaacagatccaaactcaacgctcaaccatttctttttaaatgacccgaaaccacttatgaatgcataaaaccctgccccagaaaacagacagacctggacctgatactatgatgtaatttccaaaaacccagaatgatcacaattggcaaataattctgccaccaatcactgttagagagtctttccaacttcatgaccatgtgaaggtagaattatggcaggcgacatttgaagatccacaagttaattggtttaaaactgataaatccatacagcaaattaagagttacatctgcaattaattcataatagtgagttcactgagaaggcttgttacttagatccagatggactttcttatgtccaaagaagcaaccaaaaacatctgctttgaaaacctcccaagcccaaaccatcctcagccttgttctttagaatgctttagaatgaccttgttaaaatgcagattgctcctgtaatcccagcactttgggaggccaaagcaggtggatcacttgatgtcaggagtttgacaccagcctggccaacatactgaaaccccgtctctactaaaaatacaaaaataagacaggcgtggtggcgggcacctgtattcccagctatttgggaggctgaggcaggagaatcacttgaacccaggaggtggaggttgcagtgagccaagattgtgccattgcactcctgcctgggtgacacagcgagactctgtctcaaaaaaaaatgcagattgctgggctctattttcagagtttctgatttggtagaactggagcgggcctgggaatctgcattcctaacacattcccacgtggtgctaatactgctggtctggaggccctgcttggtgatctattggaatcaccgggggagcttttagaaaataatggttcctggatctcacccctagagattttaatgtctttggtctgggttcctgcctgactcagagactttttagaaacctcccaaatgatcctaatttgtagccaagattgagaaccactgggctgtggtgtgggaccctaggaaaatgaccaatggccttttgtgctgcagggtacctggaagaattttgcaaaaatatagaaatatgatctcactgactgtttttcaaatcttgtttgttttttacattttcttttttggccttgtttgcctctgatacagtctgaaaagaaattgcagaaagaaactctccagtcttcagtgtaacctcagctgtccccagtctcacacacgctggtgccttcaattacaattctcctgtcagagcttaagtccagctaattaactgcctttcaaatgacaaccctatatttttaaagaatttttttaaaacttcacatgtaatttattgcattgcttttgctaaatgtcctccacacccccaatgcctgctaggctgggtcgccatggtatttttgtgtaacgagtctcaaaatgagtttggcaatgtctccgtaatagtcagcatggtgtaaatgacagtctggatctgcatgtcatttgggattttatatcagattctctaggttcatttctatgatacgtgatgccaaagcacccacatgccccgtggctgcactttcagacagttggactcaaacagagtgggagagcaactgatccaacaatctgaattttcagaaaacggggctccttagagatgagatggcttgccaaaagtaatctctcctatcagaagtacatatcctcagcaaactaacgcaggagcagaaaaccaaacaccgcatattctcacttataagtgggagctgaacagtgagaacacatggacacagggaggggaacaacacacactggggcttgtcggggaaaggtgggtggggaagagcattagggaaaagagctaatgcacgctgggcttaacacctagatgatgggttgacaggtgccgcaaaccatcatggcacatatttatgtctgtaacaaacctgcacatcctgcacatgttccctggaacttaaaaaaaaaaaaaaagaaacaaaaacaaccaaccaaaaatatatctaaaatgtcatctgttagcaattgactcacatattattagtatagaaaagagcaattcccaggaccttgtacagaggaagcaggctcaaaacagctgaggaataggccacttttatcagatagcattggatccatgcacatgggggttggcttcttacctaaatatgccatcagaaatcatccttgttcctgtcccctcagcttttgtagcttgcacagtgagtaaagggatggtggaggcagaaatggtaggagccagagatgttcaaaatccatctgatgcttggcctgtgctgaacgttctcaaactgtggccttgtcaggcccagaaagtggggtggattcctggccgtttctgcttctgcctgggtgtgagatgtgaatgctgcccctactgaagggtagtgcaattttttttttttcttaaaagcttagacccagagctgctaatctactggaaatcactcaggacacagggctctgggcagctgcgctgagcgagacacctgcaaatggagaccaacggggcctccagcaccctggagttccgtaaggcccccagctgaacccaggggagaagagggcagtgggtggcgcctcgctgctctgggcacacaccacctcttctgacttctcccacgtgctccggctgtgtcgcctatcagcactgataacagcctggaagctttcagaacagaagctttcccagcatgggaaactctcattctttcttttttttaattttccaaagcctttatttctaagaccaactgtggcctacccgtgcataaactgggcaggctgtagacagcaggcttgccaagtaaatactacagccttcctcccaatattgagccctgtcccattgatcctgcaggggagatgtgtagggcatttgttcacggggaggccacaagtttgggcctctcatcactgtgacctcacacccctgttgagtgtgtcgtaaacagaggagccgttcttcaagccccctgccctgagtgcacccctctcattcttttgttattattagcaaattcccccagttcctgatcattctttcttaagcctttagtgactgggtaaggttcttgtggctgactccaagctttcttctaaaaggaatagattctaggggtgagtagaggagacaggaatgtcggagtcagagctcaggaatctgggttccagccccaggtcaatcctagataaactagagggctccttaacttacttccctaggttgactctgggtttttttatcacgctcgacaggactccttatgcatttcttcgaaagagcatccagtcttaacatcatcatttggcctcatttggtttaagaagcagaattagggtaaaagcaatgatggataagcctcattttggtgaatatgatcttattgagacaagaattctgagtcaattgtccttggaaccaactgtctattgttttcatctttatcacaacactatgtccaaattttggaaacatgtttccctcctagcagaaaagaagccacccagggccaccagatgcttcccgacacttggctggctttgtctggtcttctatccttcccctatccccagagtcagtgggtactaaggtggccagggtcgctcaaggaatcagaatgcaaccgtccagaggcccagaatcagactgtcctctctgattaggaaagtgtttcctgccacctcccagggggatgtggggtgtggcttgagtctggtgcttttaccaggagcttcccagacctctctatgggtgatggagagagagtctggggtgtgaaggatggaaatataaacactgaatactcagagagtcaggccagcgagctggtgaggagactccatcaaactcaatatgaaaacatgggtgggcgtttggggatggataatgaatgacagctgaagtcacacatcaggagggaaggaaggactctcatcttcagcaaatgacataaatctggggagcctcagtttcctcacctgaacagtgagaatgatggaatctaccctgagtatatatcccaggtctttgtgcagcatggaatcagcccccagccttcctagctcttgctttattttattttattttagagaccaagcctcgctctgtcactcaggctggagtgcagtggcgcgatcttgacttactacaacctcctccgcctcctgggttcaagtgattctcctgcctcagcctcctaagtagttgggtttacaggtgcatgccactatgcctggttaatttttgtatttttagtagagacggggtttcaccatgttgcccaggctcaacatgcctgggctgaagcgatccacctgccttggcctcccaaagtgctaggattacaggcgtgagccaccgtgcctggcctcttgttttatgtttgctgttctcgctgtaggtgaggcattcccaccatattcccttgttaaaatcctactggcccttcaaatgccagctcatatccacactgtgtctgaccctgatccagaatcctctccccttctttgaccccttgtatatatctttcctacagtgctggtcatattctaacttctaatcatttgtagacttatctgggcattttctcccaggaggtcccaaaggacagagaccatcttgctcacctttgtccccactccagcacccagaatgtttcaataaggttttcctgaattaagtgggaagcaaagtattagattcaataccactacaatgggaaagtgagtgaataattgataaagtatactatgctctggaaatagattattgagtaatcagaggaaaacctcttgcaatgtagtatgtttttatatattaaattttatattatttatttatatttatattattaacatatttttgttattcattttgtttattaagatttactctatatatatatgtgtgtgtgtgtgcgcgtgtgtgtgtgtgtaacccaccttatttctaaaaaaaaattttggcagtcagtgactattaatagtagagcacaaactcttaacctttttttcctcccgctttcccagagtccttatcaccttctaatataataaagttttcttaactgtgatgttgattgttcaacgtttgtctttcccaccaaaatgtaagctattgcgggcagggatctttgcatgggttgttcttcattgcatcccaggccactagaacagtgtgtggcatatggcaggagtgcaataaacattcagcgaatgcaggcaggcatgcgtgaacgcatgaataataagtgttcctttcaactaccagaaagagcgaaaccacacaggagctgtctcaccctcagagatttaagacgacagcaatgagtccctctgatgtcttctaagtgagctttattttcaaaacaaatcattttccaataacctatcaaaagcaggtcctacctgaatatccttggctatttcctctggatacagataatgccttcctccaatggatcctcggctcacctgatgattgtgtgaaactggccagagaaagcagagggatttttcctggtgattggaaatcagagtcacggctgaatttaagcaactgtgtgaactcagcaaagtccccaccacctggaccatacatgacagctatggttattgacaaggtccttccttaatggagctggaacctccttcttaatctaaatgtggactcaaatgaactgtcaattcacatagagcaatgtgacaaatccggggggcaaagcattatgcaatagattgggcacatgcgcacgtctctgctacttagtcaactttcttctaaagtttcccacttttcccattaccacaatcaagatcagatatcagtaatattctccgcgtcccatgccctttcctcagggagatgccaaggcccaagagctggtccccccaaaaagctgaaggtctttgaaaaaaagtggggactcaggtcccgtgagtggttttgattttcttttcttttgaaagttgcatgtaagtgttttccaaatactatacaagaatgtctataacttaataatggaggaatgttttcgttgttctgtgttggtgagatgctttcctatgcgtttgttgtataagtaagtgagaatggcagaaggaaaggaggggagaggctgatcatcctatcccgtctcccactctgggggtctcggcgcttccagcctgaagcgcgcccgctgcgcgtccggagacgcaggttccaggagccccccggggttgcccgactaggccacttgcgccccggaagagggccgcggaggtgggagaccctaacttacccgggtctgagatgccgagagagccgggtgtggagctgagtgcgcgcctgccgagcgctgaggccacagacagccccgccccggggcggcaccttctaagggcctgagcgctgcacagggatgggggcgggcggggcctcccagagccgccaggcgtcccgccccactccgcccacacgcacggcccagcccagggttccccgggaccaccccagaccagccccggcccccccgggtcctccacactctgcaccccagaccaacaccaacgcgcgtagggaagcgttttagatcctgtcggagaggctcaaggccggcagaaggtttgcattaggatcgagaaagccgaccaacggacagatctacctaccttcctgcgggagtttgaggttgccaggggggaagccactgcagccaggagaaaggccgtctgggaaccaccccaccctcggacgtgcgggccttcaaatatctctgaacataatcctccaaagaccgctcaacctccgctcccgacgactctttctagcctcgtcccgcaccccagctgtggccacacacctattaggcaaacatttatgaagcacccacttactgggtgtgcagccctgagctgggggtgcagctgtggaccagacaggagggggcccggagcggcagacagtcgctggaggcacccgagccttggcgagcacaccctaacgtccttggggcctttcagcccgagccgtccttgtccagagagcaaaccatgcaatgatgcaggtgacttcccagcaaatttcatagcgttgctcaccagcttggcaggcaagaggagaaggggcagtccccaaaagacaatcccatgaaccttctagggaatgacgtccaggctccaggctcctgctctgcaggcgggtcgcagaggcaggttcctgacctaggactagaagacattctctagggtcactgcctccatggtcttccttggcaggtcacttcttcctgggcttcgacctcggtgttctcatggggacgagggtgattggaggccctccaaggggtgcaccgatgtgtcctgtgcaccaggcagaaccagcattgccctacagtgtgggtgcaaaatgaacccacatggccacgttggaaagtcctgaaatgttcatagcctatgacatgaaattgcactgtgtgaaatctatttattctttttttttttttcttttttttctgagacggagtctcaccctgtcgccccggctggagtgcaatggcacgatctcggctcactgcaacctccacctccctggttcaagcgattctcctgcctcagcctcccgagttgctgggattacaggcaccggccaccataccctgctgattttttgttatttttagtagagacggagtttcgccatgttggccaggctggtctcgaactcctgacttcaggtgatccacccgcctcggcctcccaaagtgctgggattacaggtgtgagtcagcgtgcccagactgaaatctatttattctatggaaaggatcagagctgtagaaaaatccttatgcatgtaaaagttctttgtgtttttacttgcaataactagaatctaaacatccaaaaatagaaaatataggtaattaaattgtagtacatatgatattattctacatagtagaatattatgtggagtccttaaaatgtttacaaataatttataacaacatggggccgggcacagtggcttacacctgtaattccagcactttgggaggccaaggtgggtgggtcacctgaggttaggagttcaagaccagcctggccaacatggtgaaacctgtctctactaaaaacacaaaaatttagctgggcgtggtggtgggcacctgtaatcccagctacttgggagtctgaggcaagagattcacttgaacccaggaggcggaggttgcagtgagccaaggtcacgccactgcactccagcctgggcgacaagagtgaagctctgactcaaaacaaacaaacaaacaaaaacccaacaggggagatctttatattatcatgttacgtgaaaaatacaaaaacagaaaacaaaacaaaaaccccacaaaactcaaggccttaaattgtaaatatgagatgccaggcattattcccaaaatctataaggaagcacaccaaccaccatgttaacattgtctattagtggtaggcctattggagatttattatcttatttatgctacttcatgttttccttccttttttgttttgcaacaactctgtattagtctgttctcacactgttataaagaactgcctgaaactgggtaatttataaaggaaaaagtcttaattgattcacagttcagcatggctgaggcctcaggaacttacaatcatggccgaaggggaagcaaacatgtccttctttacatggcagcaggagagagaagtgcagagcaaagtggaaggaaaagccccgtataaaaccatcagatctcgtgagaactcactcattatcatgaaaacagcatggaagaaccgcctccatgatccaatcacttcccacaaagtccctcctgcaacatgtggggattacaatttggattacaattcaagatgagatttgggtggggacacagccaaaccatatcaaactctatgtactttaatatttaaggaaaattacataaactttatctgaaaattccctggattcttctcctcaaggtcatgctgtacatatgcaggatcctcctgcctacatctccaaatggataatggattgaagcaaaatgtttgtcccaccaaacattgatgtgtaacccttttagtaacaattcatagaccaggtaaacatgtgtggagcagcccagatcagctggagggagcattattctcatcagagtgtggaacaatgcctacccatctgtcagctggttatggtgaagacagtataaatggaagcactgtcagaaactaaaggcttatgtaagtgatgctgttcttatgtctcctcttcctctctatcccacatatgatgaattattttattatgatgatgctgtagttgttattttctatttgaaatgaaaagacatgattacagatgagaaagagtgtattttgttatccttgatgcacttgaaatggtttcctcttttttttttcctgttttcttcttcttccttctctcttcactctttcattcttgcctctctccattttataggtatgattgatcttgaaataatgatgataacagaatgatagcccatatagtccttgggtcacttctgtctctatttctctttcttccctcctctttttttcttggtccttttgctagatgggttgcgagcatggctccctgcccctctcagtgggtttatcttcattttccatgagctcccacctcactgcatgtgacatcaaagccaaagctccagccacttctcatcctttcttaggaaaatctcaagtcttaacttgaaagttgaatgtcctgcttttgttcctaactctgctcacaggatagtggaagaagaaaggctcagcctgttaccagaaagaacagatctgcagtgtaacccatctaggatgaagggtcatgtggacagttcttcactcttccctctggctgcccttcagttggtgtccagatgcccctgtgttagcctgggggcattccttgccctttggcccctcttttgttgcctttttttttcttagacaaggtctaactccgctgcccaggctggagtgcagtggtgcgaccattgctcattgcaacctcgaactcctggctcaagacattctccccgctcagcctcgtgagtagctggaactacagttgtacaccaccatgccttggctaatttaaaaagtctttttgtagggatgggagtctcaggctggtcttgaacttctggcctccagtgatcctcctgccttggcctcccaaagttttgggattacaggcgtgagccattgtgccctgccctttgttgctttttcactcctttaccctgtggtttctactatcctcagggacaactctcattgccctggggcttctggatcttcagcaagacacacccctaaaggcaaacaatctttctttagcagcagcagagcacaaacggagtgttgctgtatgctaaaagcatactatttcccccccatgagaaagtctaaggggtccaggggtcctgaagtccctatcctgcccccgccagtgacaggtgatggggaacagaatgctgaaagagaccccacccaaccatctggtgtgtcaacacccgcccctgccggtgctgtccacaggttgatccccatcccacatgggtggcttaacacattcatgtcttctgagagccatttgttgctccccagtctcttctgtcctccttctttgaccaacatttccctgtctgatttgcttggtcacaggtagcctgtgtcagtttcctcccaggactctctttgcctgggaataagtgctatacatgagaagcatccctcccaagcgctgtgtgtggcctcctggcattctcctaagacttcctagaggattgctctggttccaaaaagaaaccagccacaacctgtttggagccctgcaggatgttccagctcaccgacttcattccccactacttgcccctctaacagagcttctagaccagcagccaaggtgcctccattcactgtacatgactcacctttcccccttctagacacttcttcacgggtctagcctctgtttccagctttacacagcacaggctgatgcctgccactgaacgggatccaggactttttcaaatctcagatccccagcaaaggtatgacaatgggcaccctgaccagctctgagcctctaagcatagggtctatttgtttaattttgaattcacttttaagatttaaaaattgagagctctcatcttcaacaaaattcaggggatctagaaacatcatgcccacttgtggcagagtagccaactggcagaaactgatgctgatgctgtctgtttcctacacaaaatgcaaaccagagtttaccacaggccccgctactccacattctcctccacaaggacactcagcaggctcctgtgctgaacggcttgcctggttctgtaggtgtagggtttgttactctgttccaggacctattttccgcaaagccccttacctggctgtttcttcccttggcatacgtgagaactcctttcctcactgaattgctttgaccttgctaattagttgtgttgcaagtgctttttggctgtgtcagacatgtatgttctgtttatcattttagagcaatggttattaatttttttcagattcttcttgggaattagagaaaaacttatggctctcctccaccatcctgcccccacctaccccaatgcacacatgtgcaacatttgttctacaattcaagagctctctagacccctgatatgctaggcaattcgtggctgccacattaggaacccctgatttaggggaaggactgttttctccattagacaaactcaactgtgtagcatcaatttcatgggtctactgtgtactgtgcccaaaaaatgccactgaatgctgcctgactggtggatagcaagactgtccattaatgtggtcatttaggttgcctctgcccaggtcttgaggtcattggcactaattcacaacaccctcaagtcacccagggaagatgagacacagttggctgtagacccacagtttgggcattacagctgcccttgaagttgacaaataaccacaaccttcaaattgttatgaaaagagcacaaatccaattaagaaagcttttccaaaagaaataacagtgttcctaccccctctgtcactctccaccccctttttgtcccagaataatgttgtgctgataggaacatggataaattaattacagtctggaatgttattcatgggtaggaaagaacactaaatctactcgcacaatgtttgatatttaaagataaacattgcctttatgttttttttttaaacctcagtcagcctagtttacgaagacataggtataatccttttaaatgctgtggattttttaatcgcaaaggtaacaatatgctgggtgttttacccagccagagaaccaggagatgcaggaatgagattagcatctctttagttccttgcatatttgatattattttggtgtacctccaattcctgataacatagaagaactcttgtggttgaagtccctgaaatggaaggatattggtaaccctgaatttaaaacaagcacaggcagcctttgtgggaatgtgtgtgaaggtcaccttctagaaacaggactgtccatagccattgccatggtttctgtgtcatttcaaccagaaccttaggcctggaagtctggatggatgtgggttggcatggtcctctatgggcattaaatgaataaatggatatagcagagggagtatccagcatgactcaaagaaggatgagaggaaacatattcaaataaaatctttagaaaagcaaatttcaaaaaaaaatgcttaagtataaaatattttgatgacaaccatgattttcaaattgaattcttattctaagtaatggtctaatctgaacttagacctctttccttaatttttttctcaataagcctttggtgtctagtcagttcaattcagtatttactgagtctctatacagacagggtataaggcattaatcaaatgtatgtccaaaattgcccaccatgcagggcagagctaaaatgcctaacacccctcctctcaccaacacatcccccacccacatctccaaagacttcctggcagaggtgatctctgcctgctgggacagatgtataggctccaacagcagcagggtggcccctctgaccaccaccttgggacccacattgctcttagaactattcctcttttttcatccttgaagcccccagcaaagctcagcctgaatcaactttttctaggaatctgacaagtttccaggctgatttcctgacccagtcagatcctcttccatctttctttgggtgttcaattttctacgtcattttccacctcacatattggccgttgatgaccacatcagctcttctatgctgtaagctcccaaggaacaaattctatcaaatgattggcctttcagctctctactgtgaccagaaagttgcccagtacataaaaaggggttcacaggtatttctcacgtggataactggtgactcatctatccatgattttggggatcccccacttcctggactaattgtaaaccaccttctaccacctgggggtgcctgagcacaacagagctaagtgaacatttcatcagtctaattgaattcagtggaatgttgggggcctggaaatttggactaggaaggtaagcaggaggaataagtgtgaatgacagtatctaaattaaaatctgttgccacgaaagaagatcagaccttttctcctctgatttgtccttctagaagtcacaagatgcccaaagaatcataagcaatgggtaactaggcaagggaattatctctgacaaatgccatgattgctcagtgtcccatttctcttggcagcaagagtggcccaaagactaaactgagatgggggtctgcacccctgcatgggactcaggctctgcagctagccttccaaccactaaacctgagctgaggtacttttagctctttatttcttgtttttctcatttgtcactcagatgagaagaatgcccgctctgtttgactcagtgtcagcgtgatgaagtaaaacagcttctttaaatccctctgcaacaaggcagtgaattgaaaataagaaagatagggaagaacattctgggcaagacagctcaatgagttcatgctttgatcgatctctcagctctgaacacaaagccatgacaggtaggtataaaaatagaaagctaaaaagagatgtctggctcaacagaagcagaagagacactgccagaagcctctgacctactgggctctttgtctaaaatcagcagggagtttggcctctgctgggcaaatccaagacgccccacccaagatggcagacaggaaccaagtacttgcttaaagtcaggaactagggtggggccccgaaagaaagacagtgcctcactgctgcctagggaccaaggttttagaaaaataaggttgaggggccaagatggccgattagctgctgctgcagtccgcggctctcatggagaggaatgaaaacagccagtgaattcagcaccttcaactaaaatatccagattctcggccccactcggactagtcagacaactagacctatggagaatgaagaaaagcaggctgggaaaatggtccacccgagagcggcacggagccaaaggaagccccaccccagcaaagggaagaggtgagtgagtgtgcgacaccacccggaaaaccatgcttctcccatggatcttcgcaacccgcagatcgggagatcccttcatgagcccatgccaccggggccttgggtccgacacacagagctgtgcagagtcgtggcagagcggccactcaggcacacacaaagacccaggaattttacatactccagcccaaggaatcccagcaaggcaggagatccattcatctattcccccaggaagggggctgaacccagggagccaaccagcattgctttgcaggccccgtttacacagcacctcacaggttaaggcccactgtaatttttgccagccagtggtgacagcctggagtcagcctgagatggactgagctctcgtgggtagaggcagccaccatctctgcggttcagttgactcagccattctagcctgccagctccggggagtccagacagtctggacaaggaggagtctcccacaacgtgtagcacaggtgctgtgccagatcgtggccagactgcttctttaagtgggaccccgatccaatcctcctcactgggtggggcctccctgtgggaatttcagcagctccagccagggttatatggaaaatactctgctctctcctgggacggagacccccatgagaaggggtggccgacgtcgctgcagttcagtggactcagtctttccagcctgctggctctggagagttcaggcggtctggaggaagggtcccctcaatgcagcacacccgctacacctgctctaacaaaaagcagccagactgcttctttaagtgggcccctgatcccgttcctcctgactgggtgagacctcccaacaggggtctccagagacctcccacaggagcgatcaggcaggcaacatgtcagtacattcctgggatggagaaaaatgagcaggctgccatcttgctgttttgcagacttcactggtgatacctccgggtatgggaaaaaccaaggcaactagggtctggagcagaccctgagcaaaccacagcagccctgcggaagagtgacctgactgataaaagaaaaacaaacaaacaaacagaaagcaccaccgacaacatcaaccaggaaaaccccattcaaaggtgagcaacctcgaaaatcaaaggttgataagcccacacagatcagaatcaatacaaaaacgctgaaaactcaaaaagccagagtgcctcttctcctccaaatgactgcaacacctttccagcaagggcatggaactaggctgaggctgagatggctgaaatgacagaagtaggcttcagaaggtggctaataatgaacgtcactgagctaaaggagcattttgtaacattaaaaagtggggaaacgacatgaacagacacttctcaaaagaagacattcatgcagccaacaaacaaatgaaaaaaagctcaacatcaccgatcattagagaaatgcaaatgaaaaccaccatcagctaccatctcactcccatcagaatggctattattaaaaagtcaagaaacaacagatgctggtgagattgcagataaaaatgaatgcttttaccctattggtgggaatataaattagttcaaccattatggaggacagtgtggcgatttctcaaagatctagaggcagaaataccatttggcccagcaatccctttactgggtatatatatcattctattatatatacataaaataggaatacaaaacatgctattcctattatatgtgtaataggaatacaaatcattgtattctaaagacatgcatatgttcattgcagcatgattcataatagtaaagacatggaatcaacctaaatgctagactggataaagaaaatgtggtacatatacaccatggaatactatgcagccataaaaaggaaagagattatgtcctttgcagggacaccgatggagctggaagccgttatcctcagcaaactaatgcaggaacagaaaaccaaacactgcatgatctcatttataagtgggagctgaatgacaagaacacatggccacgtgaggggaataacacacactggggcctgtcagggaagggggagagagagcatcaggaagaatagctaatggatgctgggcttaatacctacgtgatgggttgatctgtgcattttgtaaccaaatgtacctgtaatttatgatccaattcaagttgaattttttataaaagataaaggaaagattaggattatgtttttacatagaaatgcacaattgtttcagtacaaactaaagagattttcagaatttcatagatgaaaacaattcacatttgctaaaatgtatcctattaatactaacggttgtacttcagccataagaaaagaggacagaagggaatgtgtgaaagtcagtattaaatggtagtcaattaaaaataaaataaaaattttgaaaggtaaaataataattactgaaactgataaacaatattaataattttaatagccattaaattaacaaaataataataattagatttggaattttttaaagaataagatgagttaaatgggtgaaagtccacagaaagaaagttttctgggtccttgatgtgatcgggaagaaaacagaaatatttaacaacagaaattttgtaggaaattcatagtttactaagtatgctaaaattttatagataattacaaaaaggatataagtaatctataagttgcaaagcaacaaaatatattcttttgtgtaaataaaagggaaaatagaatggtttctcacaccaatgagaaataggagggaaaaatactttaagagaaaaagttgtgaaataaaaatcaaaatgtaacatggtaaaaatatatgcaggtacatcaataatcataatatctttaaatagaataagcacacaaaagactacaatgattacattgaataacaaaataaaatctaattatatgctgcttacaagatatacatttgaagtaaaaccaaattgaaaagttgaaaattaagtaataaaaaaatactaagcaaaggctaacacacagaaatctaaggtagcaatattaacacaagacaaagtaaaaattcaggtgattaatagtatacaaagatcacccaatttaataaaaggaaacagtctgctaggaaaatattacaattatgggtatgtagttaactatacagactcagcaaatataaagcaatcctggcagatttataagacattgatatatctatctatcttatcaattcccttaaggggaactgagttgtagggagccatttaacacacttctctcagcaactggtagatctgccctccccaacatagtaagcatatagaatatttgagtgatgaaattaacaaagttcattaaatatatatatagagagagcactacacccaaccaataaacaatatgcatttttttaacaagtgttcacggaactttttttaccatttggccatgtactagatcatgaaagaagtctcaagaacattttaaatattagttttacatacgtgcttggctctatgatcaaaatgcagttaggttataaatcagcagtaaatttatggtcaataaatcttcacatatctgaaaaccaaaaaccaagtacatgtctacttaacccattggttagagaagaaaacattttagaaacaataaaatactaaatgccatagaaaatactatatatgaaagtttctgggatgcagctaatgtggttcttagaggtaaattgacagcattaaatgaatttttgaaaagaaaaatgatagaaaataagtttaactaaaaaaaggagacatatgaaataaactaaagaaagtagattaaacaaaattttaaaaacaaaaattagcaaaaatgaaaatgaaaaaggagagaagagctactagatgaaaagctactcaaggaacacaatttgaagatttaaataagatatatatttttctagaaaaaaaacatgaacttccaaagtcaatttatgaatagagcttcatcataaaactggaatctataaaaagtatcagttcaatagatggatttactaacatattagacacagctgaagaaattatttatgaattagaatgtaagtcagttaaaaatattcagggtgaaacacaagagaaaaataatgaaaaatacaaaaaaagagtataagagatgtaaggaaaaggattaagagaagtgcagttagaggctgagaagtacagaagaaagtgaacagagcagaagtgatatttgaagagatagggactgagaattttccaaaaactgattttaaaaatgaagccatgggtgaaagaagtatttaaaacttcaagaaaaattactttaaggaaaatcagaatttcttagtgcatcatattaaaatgctgaaaacaaaaaataaagagaaaatcttacaatcagacagaggggaaaaagatatacaggaatcaccaataagatagatactgtatctcatttctcaaaaggaagattgaatactatagaaaattaaatggcatctttaaagtgctgaaagaaaataactacccacctagaattctatacctaatgaaaatgtcctttaaaaatgaaggcaaaataaaggctctaataattcaaggagcgttctgtaatctctaatgttttaactaaaataatgaaagaatgtataaataataatggggaaatatgaaacaaagaaaaatacttcattaatctaaaaagcataagaaataataagtccatagacaagtgtaacaaacagaaacattacagagttggtaaaacttgaggagaaatagatgaatccactattcaacactactttaacagaaacagacagatacagcatgctaaaaatcagtgcgaacatagttgaattcagcagcaccatcaatcaactggatctgattcatctaaaacgtcatccaacaacagcagaatacacattcttctcaagctcatatggaacactcaccaagatagaccacattctgcgtcataaaatacacttggcaaatttagaagaatcaaaatcatcctatgtctgccctcagaccacaatggaatgaaaactagaaatcaatgacagaaagataacaggaaaaatccccaactacttggaggttgaacaatatacctaataacacatgagtcaaagaagaaatctcaaggtaaactttaaaatattttgaactaaatgaaaataaaaatacgtgttgtcaaaatttgtgagatgcagcaaaagcagtgtttagaggaaaagttgtagcattaaatgcatatgttagaaatgaggaaagatctaaaattaacaatcagctttcagcatggaaaactgaagaagaacaacttaagcctaaagcaaatagaaaaaaaaagaaataagaaaaattaattaaaaataggaaataagtgaagaaaatcgacaaagacaaaagctggttctttgaaaacatcaataaaattgacaaacttctagtcaggctaagaacaaaaaacgggagacacaaattaccaacattagatatgaaagagagtcatcactactgatcacatgaacaacaaaatgatcatttaaaaatactgaaaacaacattatgctcacaattttgaagaactttgatgaaatggaccaattctttgaaagacccaaactaccaaaactcacacaaggaaaaatagatctgaataggcccatatttattagataaattgaatcaataattaatagacttccaaaaagaaagcaccaagctaacctggtttccctggtaaattctatctaacacttttaaaataagtgatattaattctctgtagtctctttcagaaaatagaagcagaggaaacacttcctaattcattatatgaggctaacattatcctaataccaagagcagacattacaataaagggaaactacagactaatatctctcatgaatgtggatgcaaaaattcacaacaaaatattaacaaatcaaatacaataatgtacaaaaagaattatacatcacaaatgagtgagatttatttcaggtatggaaggctggtttaacatttgagagtcagttaatggaacccaccacaccaacaggctgaagaaaaaaatcatatgattatatcaattgatgaagaaaaagcatgacaaaatccaaacccattcatgatgaaaactctcagcaaactaggaattcaacttcataaagcacatctacaaaaacctacagctaacatcatccttgatggtgagaaactgaatgttttctccttaagatcaggaattagaccaagatgtccctctcacaactcctattcaacattatactggaagttctagcttgtgttaaaaaacaagaaaaggaaataaaagacatacaagttgggaaggaaaaaataaaactgtctttttcacaaatgacatgattgtctatttagaaaatcccaagaattaactaaaatttcttggaactaataagtgattttattagtttactaagactgccaataacaaaatacaacagactgggtgagttaaatgacttaaatttattttctcatagttttggaggctagaagttcaaggtcagggtgtcagcaggtttgatttctcctgaggcctctctcctcctcttgcagatggccacatttttgctgtgtcctcacatggccttttctctgtgtatgaaaatccctggtgtctctttctgtttgtctcatcttcttagagggacaccagtcagattgaattagggtccaccctagaggccttattttaacttaatcactttttaaagtccacatctccaaatgcagtcacattctagggtactggggattagggtttcaacatatgaaatttgtggagggacaaattcagtccataatagtgattatattatagcaaggttgcagaatacaaggttgatacaggaaagccaatggctttcttatatactatcaatgaacaattaaaaatacaaatttaaaagcacaatatcatttacaatagtaccaaagaaagaaggaaagacattaattctcaggtagaaatctacaaaaacatatacaggatctatatgcagaaaactataaaactctgatgaaagaaatcaaatcaaatgaaaacaaatggagagatatttcatgtccttggattggaagactcaatgttatttaaaagacaattcactgtaacttgatctatagattcaacataatctccccaaattccagcaagctactttgtgcatatcaacaaactgattctgaagtttatataaaaaagcaaaagacataaaatagccaatacagtattgaagaacagagttgaaggctgacactactgacttcaagacttaatataaagctccagcaaggaagacaccacagtactggtgaaagaatagacacttaggtcagtggaacagaatagacaggccagaagaggactctcacaaatatactatagtcaattctctttgataaagaaccaaagacaattcaatggagtaagggcagtgttttcaacaaatggtgcataacaattggacagccacgtataagaaaacaaatctagactcagatcttacacctttcacaaaaactaactgaaatagatcatggatctcaatgtaaaatacaatattttcagatttccagaaaaaaaaaagcagaaaatcaatgtaaccttgaatttagtgatgagttttaaaatacaagccaaaaagcatgattcatgaaaaaaatttataaattatacttgattaaaattaaaatactatgttctgtgaaaaatactgttaagggaatcaaaagacaaggcacagattgggagaaaatatttgcaaaccacctatgtgatacgggaacttgtatccaaaatacacaagaaactcttaaaaaaacaagaaagcaagtaatgcaattttaaagtgggctaaagatctgaagagacagatcaccaaggaagattcatagaatggcagatagaaagatgcccatcataatttacggctgggcacagcagcaccagctcctcagaaggctgaggcaggagggccccttgaaaccaggagtttgaagctattgtaggctatgatgtgcctgtgaacggccactgcactccagactgggcaacatagtgagagctcatctttaaaataaataaacaaatgaataaataattaatttgtcattagagagttccaagttaaaacaatagcaagatgccactacacacctatgagaatggttaaaatccaaaagcctgacaataccaaatgatgacagagaggcagagcaacaggaactcttgctcatcgctggtgggaatgcagaatggtgcagccactttgaaagacagtttggctgcctcttacagaactaaatatagtcttagtacagaatccatctgctgtgctcctagatacttatccaattgatttgaaaacttatgttcgcataaaaaaatctgcatgtaaatgtttaaagcagatttattcataattgccaaaaactggaagcaactaagattctgttcaacagctgaatgaataaacaagttgtggtacatctatatagtggaatacggaatataattctgcaataaaaagaaatgagtattgagctatgaaaagttgtggaggaatcttaaatgcatactgctaagtgaaagaagccagtatgtttatagcagcatgatttatattcctttgggtatatacccagtaaactatgcaaccataaaaatgatgagttcatgtcctttgtagggtcatggatgaagctggaaaccatcattctcggcaaactatcgcaaggacagaaaaacaaacactgcatgttctcactcataggtgggaattgaacaatgagaacacttggacacaggaaggggaacatcacacaccggggcctgttgtggggtggagggggggagggatagcattaggagatatacctaatgtaaatgacgagttaatgggtgcagcacaccaacatggcacatgtatacatatgtaacaaacctgcacgttgtgcacatgtaccctagaacttaaagtgtaataaaatacatatatatatataaagaagccagtatgcaaaggctacatattatatgattccaattacataatagtctggaaaatgcaaaactgtagagactcgaaagtgatcagtgagttccagggttaaggtggagggtagagggtgaataggtgaactgcaggtaatttttagggcagtaagattattgtaatgtaaaattttagggcagtagaattatttaaatggtggatataagatattgcgttgcattgcctatgcaaccaaaggtgaaccttaatgaatgcaaattttgaaaaattatttaagaggttgggggatcccaagagagaatgcagaccatgagaagagaatctaactgtattacaaatataggaaacactctcactgaagggatgggtcggggaggggaagagaagaatactgaagtattttggaaataagtgaggcttataagattaaaggcaaagggaactgcatgtgagcactgtactctagttgaaaaaattgtttcccatagaggtactggttaacaattctgttattgctatgtatttatactggaatggaacaattacatgaatggatggcagatggtagaagccaggtttctcaccactggagtggctgtttatcaaaaagcaggaggagaaagaatcattcatgcagtgatggatttgagttggagagagcagtgtggactcatatttagctcaatagagaggctgatggttatctatagaagtatttatagatatgcatatatacatgatatagtataaacatgtgtgtttcttgctctgtccctgaaacagcctgaaagaaatgacatcccagtaacagcaaacgtgcacagcaccgtatcttggtttctaatactattctccatttaaacgaaccaggattctttggagaagtggctgtttctaagactgggacaggaaatatccaagatgagcctaaagcatctggtagtgccagaaagtaaggaggtgctcaagaacaaaacaggaccaaacaaaacattgatcagggtctgtcaaaggagcacagatgccagctaaaagagttcccaatggccaaagctggaacactttgcggtaataaagtagtattggattataacctacagtataaagtaaatatgcatggtataaatacatggttaaatatattaataaatgaggaagcagagacaaatctctcttacaaaagaattccatatattttacacaggtactctgtcttcaagaagaaggaatcaaactccccattccttcagtgtgagctgtacataatgacttcctcccaaagtgtacaatatagaaaaggggagaaaaagagtaaatttacagtggaggaccctgacaagcgccactcaggcaggcgaccaaggctaccttccgcactcataaatcatgctgacagtaggtacgcttgatatcacgggatgaaaatagcacttcacctctgtgattttctttccaataacttacaaccccagttttctaatgagaaaaatatcaggcaaattccaaaagtgggacattctacaaaatacctaagcagtcctcagaaccctcaatgcatctaaagaaggaaagtcggagaaactgccacagacagcaggtgcctaaagagacatgacaactaaatctaatgtgggattctggaacagaaggaaaagacattaagtaaagactgaaagaacaaaattatgaacttttgttaataacaggtcattatttgtttcattgtaacaaatgtaagatatcgataataggggaaactggatgtgaagtatattgaaagaattgaacaatgaaaacacttggacacaggaaggggaacatcacataaccagggcctgttgttggcgggggggatggggggagggatagcattaggggatacacctaatgtaaatgaagagttaatggatgcagcacaccaacatggcacatgtatacatatataacaaacctgcacattgtgcacatgtaccctagaacttaaagtataataataataaaaaagaaactctctgtgccatcttctcaacgtttctaaaaatctgaaactgctgtagaaaataaaatctattttaaaaaatttaaataagcaaactgctcactactacacaaaaaaagcaaagattagtctcttgagtataaaattgagcagaagaagccagacacagcctgcaagctccaactccattcataaagagtttgcaaactggcagcgatggcgcgagagcttaggaaattgtttcactgggggaagtggaacagacgttgactggatgatgtcacatgaggggcttctggggtactattaacattcgatctcaaatccaattggtggttatatttttgtttccttaaattaataagtattaatttatgaaaattaattgaaatgacactcataatctgtgcacttttctgtacaattcaataaacttaatgataaaaacaagaatgaatcagaactgtgtatatcaacatggatcaatctaaaaagcaatgttgattaaaaaaatttaaaaatatgtccgggtgcagtggctcatgcctgtcatcccatcactttgggaggccgaggtgggcggatcacctgaggtcaagagtttgagaccagcctgaccaacacggtgaaaccccatctctactaaaaattacaaaaattatcatgcctgtaatcccagcactttgggaggccgaggtgggcggatcacctgaggtcaggagtttgagaccagcctgaccaacatggtgaaaccccgtctctattaaaaaatacaaaaattatcatgcctgtaatcctggcactttgggaggccgaggcgggcagagcacgaggtcaggagtttgagaccagcctggccaacatggtgaaaccctgtccctactaaaaatacaaaaattagccaggcgtggtggcatgggcctgtaatcccagctactcaggaggctgaggcaggtgaattgcttgaacccaagaggcagaggttgcagtgagccaagatctcaccattgcacttcagctctgggcaacagagtaagactctgtctcaaaaaaaaaatacaaaaattagccaggcatggtggcgggcgcctgtaatcccagctactcaggaggctgaggcaggagaatcgcttgaacccgggaggcacagattgcagtgagccaagatcgtgccattgcacttcagcctgggtgacagagcaagactccatctcaaaataaataaatgaacaaataaataaacaaagcaatgttgaatgttaaaaaagtaatttgtcaaataataactaaaatagactactttttttatacgtaccttctgtaaaacaaactatgttcttatttatgggcttacaaaatttagcctaagtatcaaaacacacttgagattataaataccaaattcatgatagcagttatctctgcaaagagaggaaagaaaatgaaattgaggagggggactcacttttttttttttttttgagacagagtctcactctattgcccaggctggagtgcggtcgcatgattgcgactcactgcaagctctgcctcccagattcaagtgattctcctgcctcagcctcccgagtagctgagactacaggcgcacaccaccacacctgtattttttgtagagatggagttttgccttgttagccaagctggtctcgaactcctgacctcaggtgatccacctgctttggtctcccaaagtgctgggattataggcatgagccaccatgcctgaccaacttctacctatactgttgcatgtatatatatttaaaaatccaaaaaacatattgcaaaatgttaagttgtgatacagttgggttcagctacaagggtaaccatgacatttctctataactgcttctagttttgaaatacatatatatgtatacacacacacgagtgtgtgctctataagaacatgtaactaatattgtatagtgcaataacagcctaggagaattaacaagcattttgccatcaatacttatcctttgtgttgctgaggatgaatgaacccatagatcattagtctttgaagccgttggcttcttttaaaagtggttctaactcgaagactaatgacctttgcatttcaccagccccaccttgttaatctcatatctttcaagacatgtacactttgggaggccgaggcgggtggatcatgaggtcaggagatcgagaccatcctggctaacaaggtgaaaccccgtctctactaaaaatacaaaaaattagctgggcgcggtggcgggtgcctgtagtcccagctacttgggaggctgaggcaggagaatggcgtgaacccgggaagcggagcttgcagtgagccgagattacgccactgcagtccgcagtccggcctgggtgacagagagagactccgtctcaaaaaaaaaaaaaaaaaaaaaaaagacatgtaatcccaaagtttccttgaagataaattacatttgctgacaggactctttagaaccactgagaacagtcagatattggaggtcaatgaggaaacaaccccactgctgattcactccatagcatgcactgagcacccacatggtccacatgagatgtgatggggcttgaaccagtctggctgtagaggggaaagaaggagagaaacagatctgagaagcattttgaggcagagctgtcagaagtcaccaaatggctctgaataacatggcggagtccaagaggccagaagaagaatcaagaacagccagggccggtttgagcagctgtgtgaaggctggcaccattaactagggtagaaagcatggtggagaaatggggctggctaagcaaagttgcgggttcaatcaagaagtttgcctttggaatgtgtcatggttgagatgcctttcacaatccaagtctaggcctggtgaggtggctcatgcctgtaattccagcacttcgggaggctgagatgagaggatcgcatcagtccaagaatttgagaccagcctgggcatcatagtgggacctcatctctacaaaaaaacatttaaaaattagctggctgtaatggtaaatgcctgtagtcccagctacttgggaggttgaggtgggaggatggcttgagcctgggaggttgaggctgtagcaagctatgattatgccactgcactccagccatggtgacagagcaagacctcatttcaaaaaaaaaaaaaaaaatccaagtctagatgtgaccaggtatgtggaatctggagctcaaagaggagtcagactggaaagatatacacttggatgtcaccagcatattgatgttgcttcatgccatgggacccaatggggcccccccaccctggaggagggtagttagagaagagaggtctgaggatcaagtcctgggatggttagagtttcatagaggagcaggaacataaataataaaggccaaccacataaggaaaacaaaagctatatattcagggtatactgtaacaagggagtcgtcaccatcacttacattttggtagagactccaaggcaagagtgggaaagtttgacagtgatgttaaccaaaaactgacagaggcaggtgtctcaattgatagcggtttatttcgccaaggctgagaatgtgcctgggaaaaactcgagtcacaggaacatctatgacctgtgctttccaaagagggttttgggaattcagtgtcgaaaaggcaaagaacagacaggagggaaaaaagcgagggagggtgggcagtgaggcaaatggtaacattattgtgaggttctgattaacgctcagtaaattggcattttacataaaataaagcaaacacgtgaaaagaggaagtatggggaaaagtcaatgatgcatttatctcagggtggatgaagggatgatttctggtcttgtccttgtcctcttacctgtgaagataaacttgtaattgacattgttagggtgagattgaacagaactcagtttcggggctagcttataggggggatatgtatcctataagatttagggctcacacagaatttccttgtgagcaatttgtgaagaaggccatctggggagatatgtggcctcctatctttgtgggaacctggcttatgtatgacgttatgacacagggttttgaaattacagctatttgagaacaaaagaaaggcagtattgcatgactcagttcccaagcttaactttccctttggcatagtgagtttagggtcctgcgattttgttttctttcacagtggaaaggaagggaaggctgcaggtgcaccctgatgggagtctgttggcatggcgaagccctaggtgagctaattaggggcagggtgtcccatggaattggctagggatgcatatttggttttctctggttggtcctaaaattaaagtgaagacaaaaattaggggagctgtcagttattaatcaagtcctggtcattgtgggccaactgttatggatattattatttaacttcctgaattgttactagagatagcagtccggctttctatgagtctgacttatagcaggctggcttccggttgtttattgtagataaaggggttgggttcctggcaggtagctgcaagctgtgagtcatagttctatttatatatcatgtggccattgtccatttgtatatttagtctcttgggagaaaaaagccgaaaaggagattgaaaggagcagctagagagaggagggaaactaagacaatatcatcatcccagaacttaggaagataaagtcccaacaagaaaggggtggttcactgaagcaaatgctgctaaaatgtctgataagatgaggatgtcaaagtaggtgaagcttttccaggtgaaaaagagacgtagccatcattgttgctgaattctcagacacaggaaacattttcctgtggcttcaggcaatggtgaaataggaactaacagggtcagctaggaagagaaacttttaatgcctctagggggcacagcatatcatacctaacaactgagcagcaaataccgtcccctactctccagacgcattttccagcccaacatgggattcttagattggttagatggcagcatctgagaccacaattaacctgaaatccaagctcaggcacttgcagctccaaagcctcacactcgatgctccgagtttagggacttctatcaagtaaattgggaaatgggtcgttctcctttgaagactgttaggaaagagggacaaaaacggaaaaaaaaaaaaatcaatccctgagtttaatctccagtattccttcccagaaactttaagttagctacaagaatgttaatcatgagcagaaattgtttaataatcaaattatcataaatttgcttttcttttaccttagtaaggtaactatgtgacaaacatttgtgaagttgagaatagataaaagtacccatcatatgatctagccatcccactgttggacatatacccaaaagaaaggaaatcaatatcttgaggagatatctgcacttccatgttttttgcagcactgtttacgatagttaagatttggaagcaacctaagtgtccatcaacagatgaatggataaagaaaatgtgatacatccacacaatgcagtactattcaccccttaaaaagactgagatcctgtcatttacaacaacatggatggacatggaagacatcatgttaagtgaaataagccaggcacagaaagacaaacattgcatgttctcacttatttgtgagatctaaaaatcaaaataattgaacacatggatatagagagtagaaggatagttatcagaggctgggaaagctattcgggggctggtgggtgggtggggagagatggggatggttaatgcatgcaaaaaataactagaaagaatgaagaagacctactgtttgagaacacaacagggtgcctatagtcaataagaagttaattgtacacttaaaataactaaaagagtatacttggattgtttgcgacacaaaggataaatgcttgagggggtgaatacccctttcttatgatgtgcttatttcacattgcatgcttgcatcaaaacatctcaggttctccataaatatatacacctattatgtacaaaaattaaaattatttttaaaaagtgccaagaaactctgtaccctaacatagccctgttagaattacttagcactaatagttgcctttgctgagtgatgcaagcagatgtctctggccctcaaagatgaggagacactgctgctctgcttggtgtgaacataaactccagttcttctgggaactgccttaaagacagcagaaactggagagcagagaaaagtggaaagtggccaggcacggtggctcacacctgtaatcccagtactttggtaggccgaggcaggcagatcatgaggtcaggagttcgagaccagcctgaccaacatggtgaaaccccgtctctactaaaaatacaaacattagccagatgtggtggtaggtgcctctaatcccagctacttgagaggctgaggcaggagaattgcttgaacctggaaggctgaggtcagtgagccgagatcttgccactgcactccagcttgggcaacaagagcaaaactccttttcaaaaaaaaaaaaaagtggaaagcataaccttgcttgatggtgaggttgaatccccaccttcgcctttctcagatttattcccatcttcctactcctccaacccctatgttggctcaagcccagatggctctcacctgcattaacctaaccatctcgtaacccatctcctctctttgttcctttcctatgcaccctccacatggccagctgccagaggatctttcaaaatgactaatcttactattcttctcctctacaaagcttcagaggcttccagtctggactccttaacaacacataaaaaattcctcttctgttcttcctctggctggtggctctcaaccttggctgcacttgaggatcctggggagctttaaaaactgccctgctctggtttagtcagtctgggctgggtcccaggtgtctagagttttagttttgtttcccaggacctggtgactccttgaactatttgcagattcctgaacccctgtcggagagtaagctgtgttctaatctcatcagatctaaggagagatgtaggaacttgccttgaggcttgaattctttctcctactctccacttgtggtagtcagtcttttgcatttaagggtcaaaaataagaaggcctattgtgtttccaaggctggggtccatagtgcatacgataggtttcagagggagagatggcagtggagatggggaaagaaaatgtggaaacctgagtctaggatgttgcttgctaagtgtactagaatatgccaccccaaatatgcctctttggcatataattattttgagctgaaggctattgagaaccagcagatgcacgaaaggtctaaaaacagagtctaagttttccttttgtaaaggattgtagaggtgtctccttctcccaggaagaagactcttaactactcatcagaggagaaagggcagacttaattctgcacaacaaatcttactaaacacctcttgtttaccatccttttcctggttaacttctcataagttgcctcccctacacagaagccccaaccccttcttttttgttttagcctaagatggtatttaacccccagtctaaccacccctttgggttactcacctcttagtgttcctgtgtgtacacagacaacgaacttgtaagtagacttgtttttctcttgttaatcagtctttggccagtctaacttataaggtttcagttggaaaacctaagatgggtagaggaaaagattcccctgcaacacacttatattatgaaaccaaactggataccaagcaaggaggatcgggcatctaacacttaactcctgacctccacaatagcttgcaggtaagggtttttttttttttaatatatatatgtatttttatttaagttctagggtacatgtgcacaatgggcaggtttgttacatatgtatacatgtgccatgttggtgtgctgcacccattaactcgtcattttttttgttttgctttttgttttgttctgttttttttgagacggagtctcgctctgtcgccaaggctggagggcagtggcacaatcttggctcactttaagctccacctcctgggttcaagtgattcttctgcctcagcctcctgaatagctgggacttcaggtgcctgccaccacacccggctaatttttgtatttttagtagagacggggtttaaccatgttggccaggatggtctcaaactcctgacctcaggcaatccacccgcctcggcctcccaaagtgctgtgattataggcataagccactgtgcccggccacaggtaagggttttaaaggcaggaggcagaggttacaggcaaaataagaaatcatggaggttatacattggtttaacctagaaaggtggaacatcttgaagtgggcccacaggtcataggtgaggcaaagctttgtctaaaactgtgggatcagtagaaaagaatgtcagctctggctcatgggtgtgacttcctccaggctccccagggagaaatttagaacaaagaatggcagtcagaattcagtcctcaattcctctttatctgaagtctatgtgtcagtggatccatttggtggatccattggtgggggtccaggtttctgaaacaactctgggacatatgttaatggcacaggacttttttggggtgccacttcaccagccagagacctctgcagctggctgcacccctgcctgggcctcactcagctctgagctggcctctggccttgctccatccagttggcccagcaggctgcacccagctcaccctaccagccaccacaggtgagccaggtgtggagtggcaagtttgcagggtccagttactgtgcacagtcaggtgcatcagctgctgcaatggaatgagcagctccaggtgctggcatccagactaggggaacacagtggcacccaaaaacttggagatgccagcacctgtgaagccccaaagggggtgttacatcatgtcacagcactggctccagaagctctgaggtctagatgtccagaagggttgcagctcttttctccttcccgccactcacagtgcagaaaatgggggtatgttaacagctcattcagtcctgctgccctgctctagcttgtggctcctgggaaggcccggccctgctgccatttcccatcacgtgggacggatgcccagcactggcggagggtgggagggctacagtgttacagcagctacttttgcacccactgtttggtgggtcctgggttcttgtcccatgtccatgaagaatgagattatgctgacaactggagagtgagcaaggcagagaagagctttattgagcaacaaaacagctctcagcagagaggggagctgaaggtaggtagtctcaatgtgtggctgagtctctccagtttttatgggctcagaatgtgggaggtgtcagctatccatagccttggaaaaggcaacacttgattggttaaaaagcattattcagaaagaaccaattgggaaagagcaggcaaatgaaaatagaagttctcattctggtcatggactccatccagaactgacagcctggttttcaggcttcaggctgtctttggcttggaggttgggtttcatgggggacccaccccaatctgcctgggaatttgtctgtctcctgctgctatctttaagatgctatctttggctgggcatggtggcttacgactgtaatctcaatactttgggagactgtggtaggcagattgctcgagcctagtagtttgaccagtgtgggcaacatgacgaaaccctgcctctacaaaaaaaaaaaaaaatacaaaaattaacaagttgtggtggcatgtgcctgtggtcccagctactgacagagctgagatgggaggattgcttgagccctcagatcaaggatgcagtgagtcatgattgcaccactgcactccagcctgggcaacagagtgagaccctgtctcaaaacaaaacaaaatcaaacaaacaaaaaaagatgttatctttagtttttacagggagccaaacatcccatgattctcacttccatgattattgttttaagctactattactctcttgcttatcaagttgttcatttacttctcaggctagctaggtgcctggaatttccctttaagaaactcaagattttttaattcctctgtttggtgctggggagaccaggcccctaagaggggtccctgctccatctcatttgtaagagcttatgagacagccgctccagggctggccagtagctcaggaggaggaagagtcagtggcagggaaagggaggtccagctcgcctgggagataggagctcttccagcactgggctgggaaaccattctctggcagccctgccactcagtggaccctcaacttctccttaatttcctaggcagtataagggtaagtacaagtaaaaagaaattgaattttccctggtgccaaaaggcaaagagaagtccctccctcccttttcttagagtatttcctttataatcctttctctgtctctttgggaggtatataaacctttctgaaagctaaacaagccctttgccactttggcttcccaggaatgtgcttctcgggggcctcggagccatctctttgaaatgtgaacattaagatggatggtgccctgtctcctgtctctctgggagctttgcctaggagtctggctacaagttgtagcatatgagagttttcttcttcctttggatgagtgcaattaacacatatgtaatagattctatctgcctggctatgtaagagggtgatacattttttctgtctttgcaatttctttagtggattgcttttgatgtgtgttgcaatctggtttaatgcatatgtaataataacactttttttcatttcgtatatttttggacaggttttctagattggcagattttattttaaatttccgcaacagcagcaagtcctagcatacctcaacatcatcccaggaacaccccacccttggggaggaaatatgccagagataggaagggccacttctaaatacaagagagtcatcaggcacctgtcaggagggagagtatccagtctctagagatggaaatgtcaacctaaaaggaagaagcaaaggcagaattaatatagagagtttatttgggccaaggttgagagctgcagccatggatgcacttccaagttgccttggggagtgctctggaggacaaagaagagcctcaagtttttaaagaaaaaaggaagaatcatgagagaagcaattacgaaagctgctcatcaggaattttcattagtttacagaaataacattggttagtgattggctatacattgttgcaacttggcattcatctgcagcccacatagcaagtggcttcaagaggtcattattcagttccagggagagtgagacctgattgtggtcacattttaaatgcctttctgggcctgatgatttaaagggctcacattcctcagataaaggttttttttctttctcagattgaagtattctggtgcactcagcctttggacagaaaggagtggagattctcattacatatgggtgcttgccttagttgttttaaatttatgtgcaaccaggctgtttctcccatataaaagcacccctaaacggctgggcgcggtggctcactcctgtaatcccagcactttgggaggctgaggtgggtggatcacaaggtcaggagttcgagaccagcctggccaacatagtgtaaccccgtctctgctaaaaacacacacacacacacacacataaaaattagctgggagtggtggtgggtgcctgtaatcccagctactacggaggctgaggcaggcgaattgcttgaacctgtgaggtggaggttgcagggagccgagactgtgccactgcactccagccagggcaatagtccgagactccatcttaaaaaaaaaaaaaaaaaaaaaaaaaaggcacccctaacaagagccaacagtctctgttgagaccttcctacccttcaagagaacaccaaattggttgatgaacatagtggagaggaacggggatctccatcattgggaccaagagaggctgtgaaacatgataaacgctggtctagaacagtatggagaggcacatgtagtagcgggttcaactagcaaagagaagacagcgtcctttgcaattttatgtgagtccttccaatcagatgaccttacagaggttttaagtttaggttttgttttttttttgaatttgtgatgactttttggagtttggctcaactgtcttgtagaacatccctcattctagctttgtcagacagcttcgtcagggcctccttgacttgtccttctctcctctgtatttcctgtaactggatgtggatctaaaggctgaactgggctcatgagaagaatccttcacaggtgtgatggttaatactgagtgtcaacccgattggattgaaggatacaaagtattgatcctgggtttgtttgtgaggttgttgccaaaggagattaacgtctgagtcagaagggtgggaaaggcagacccactcttaatctgggtgggcaccattagctgctagtgcagctagaatataagcaggcagaaaatgtgaaaagagactgtcccagcctcccagcctacatctttgtctcgtgctggatgcttcctgccctcaaacatcggactacaagttcttcagtttggatctccctgctctcagagactggctctccttgctcctcagcctgcagatagcttattgtgggaccttgtgattatgtgagttaatacttaataaactcatatatatatattcattccattagttctgcccctctagagaaccctaactaatacaacagatggatcccatcaggacacatgatgacagcccatccctgctggcattgctcactttgataatttagggaaggtgacagtcaccgtatctttcatagtaaacgtgcattttccttctcaaaattagtaaatactgtaatttgttgaattatactttgacatcctgttcctcaacaacctttcacccaataaggtttggcatccactgaaggtgcttccctgaatctatttcttctttgagggttgcaataaatgtatatcttttttctacatttattggaggaagtcttccctaaagaagagttctcttttctctctctgttcctttttctttttttttgagtatcactgtgaattcatggatttctttataactcaatgtcaactgccatcattattatttctgatacttaatctcaatttggccggtgggaccctcttcaagctgcctctgctgttcgtttgacatgatcccattagtccgtgatttccttattttctggtacaataaggtgtcctaggctcaacttgtaatttacctgcttttgacttgtaatcagccggttcaatgaggatccctggttccctttcctggggaatggtacttagataccaagttcaaggcatgaggtgtgcccattgctattacaatgttatgacttctaggctctttgactgaaattaattacagacacacacatacatacgtgtacttatgaattcacactgacatttcttgtttttttttatttcaatagtttttggggaactggtcatgtttggttacttggataagttctttagtggtgatttctgatgttttggtgaacctgtcacccaagcagtgtacactgtacccaatgtgtagcctttttttccctcaaccccctcccacccttccccctgagtccccaaagtccattatatcattcttatgcctttgcgtcctcatagcttagctcccacttataagtgagaacatacaatgtttggttttctattcttgagttacttcactttgaataatggtctccaactccatccaggttactgttgctgtgaatgccattattttgttccttcttaaggctgagtggtattccatggtgtatatatgccacattttctttgtccactcattggttgatgggcatttaggctggttccatatttttgtaattgtgaattttgctgctataaacatgcatgtgtaagtgtcttttttgtataatgacttcttttcctctgagtaggtccccagtagtggaactgttggatcaaatggtagttctacttttagtttttaaaggaatttccgcactgttttccatagtggttgcagtagtttgcattcctaccagcagtgtaagtgttccttttcaccacatctatgccaacatctgttatttttttattttttaattatggccattcttgcaggagtaacgtggttctcattgtggtttcgatttgcatttccctgataattagcgatgtcaagctttttttatatgtttattggccatttgtatttcttcttttgagaattgtgtattcatttcctttgcccacttttttgagggtattattttttgttttgttttgttttgttgctgatttgagttccttgtagattctggatattagttctttgttggatgaatagtttatgaagattttctccccctctgtgggttgtctgtttactctgctgattgtttcttttgttgtgcagaagctatttagtttaattaggtcccatatatttatctttgtctttgttacatttgcttttgggttcttggtcatgaacactttgcctaagccaatgtctagaagagttttgccaatgttatcttctagaattgttatggtttcaggtcttagttttaagtctttgatccatcttgagttgatttttgtataaggagacagatgaggatccagtttcattcttttacatgtggcttgccaattatcccagcaccatttgttgaacagggtgtcctttccccactttatgtttttgtttgctttgtcgaagatccataggctgtaaatatttggctttatttctgggttctctattctgttctactggtctacatgactatttttatacaagtaccatgctgttttggtaactatacccttatagtatagtttgaagtcaggtaatatgatacctccagatttgttctttttgcttagtcttgtttcagctatgtgggctctttttttgttccatatgaattttaggatttttttttctagttctgtgaagaatgatgatggtattttgatgggaattgcattgaatttgtagattgcttttggcagtctggtcatttgcacaatattgattctacccatccatcaacatgagatgtgttttcatttgtttgtgttgtctaagatttctttcagcagtgttttgtagttttccttgtagagatctttcacctccttggttaggtatattcctaagtactttattattattattattgcagcttttgtaaaaggggttgagttcttgatttgattctcagcttggtcattgttggtatatagcagtgttactgatttgtgtacattgattttgtattccgaaactttactgaattcatttatcagatctagaagctttctggatgagtctttagggttttctaggtatacaatcatatcactggtgaacagcagtttgacttcctctttattgatttagatgccctttatttctttttcttgtcttactgctctgtctaggacttccagtactatgttgaatagaagtggtgaaagtaggcatccttgtcttgttccaattctcagggggaatgatttcaacttttccctattcagtataatgttggctgtgggtttgtcatagacggcttttattaccttaaggtgtgtcccttctatgccaattttgctgagggttttaatcataaaaagatgctggattttgtcaaatgcttttcctgcatctattgagatgatcacatgattttagtttttaattctgtttatgtgatgtatcacatttattgactcatgtatgttaaaccatccttgcatcccttgtatgaaacccacttgatcatggtgtttatctttatacatgatgatatatctttatatcttaatacactacttgatcatggtgtattatcttttttgatatgctgttggattcggttagctaatattttgttgaggatttttgcacctatgttcatcagggatattggtctgtagtttttctttttgttatgtcctttcctagttttggcattaggatgatactggtttcacagaatgatttaaggatgagtccctctttctctatcttttggaatagtttcagtaagattggtaccaattctttgaatagctgatagaatttagctgtgaatccatctggtcctggacttttttttttgttgggaatttttgtattattgtttttatcttgctacttgttattggtctgttcaaagtttctgtttattcctgatttaatataggagggttgtatatttccaggaatttatccattcttctacattttctagtttgtgtgtgtaaaggtattcatagtagccttgcatgatcttttgtatttctgtggtgtcagttgtaatagcttctgttttgtttctaattgagcttatttggatcttctctctccttttcttggttaatctcgctaatggtctatcaattttgtttatcttttcaaagaatcatcttttttgtttcacttatctttttgttaatgttgttgtttacatttcatttagttctgctatgatctttgttatttcttttcttctgctgggtttgagtttagtttgttcttgtttctctagttccttgagggtgtgaccttagattgtctatttgtgctctttcagacattttcatgtaggcatttaatgctatgaaatttttcttagcactgctttttctgtatcccagaggttcagctcaaatacttttttttttcttttttagatggagtctcactctgtggcccaggctggagtgcagtggctcatctcggctcagtgcaagctccgcctcccaggttcacaccattctcctgcctcagcttcctgagtagctgagactacaggcgcctgccaccactcccgtctaattttttctatttttagtagagacagggtttcaccgtgttagccaggatggtcttgatctcctgacctcgtgatccacccgccttggcctcccaaagtgctgggattacaggagtgagccaccacacctgacccagttcaaatactgtttaaatttctgtcttgatttcatggttgacccaaaggtcattcaggagcagattacttaatttccatgtatttgtgtagttttgagggttccttttggagttcatttccagttttattccacacggtctgaaagggtagttggtataatttcagttttcttaaatttattgagatgttttttgtggcctatcatatggtctatcttggagaatattccatgtgctgacgaaaagaatgtttattctgcagttgttgagtagaatgttctgtaaatatctgttaagtccatttgttctagggtatagtttaagttcattgtttctttgttgacttcctgtcttgatgatccatctagtgctgtcagtggagtattgaaatcccccactattatcatgttgccatctatctaatttcttaggtctggtaataattgttttagaaatttgagagctccagtgttgggtgcatatatatttaggattgtgatattttcctgttgcagcaatccttttatcattatataatgtccccctttgtctttttaaattgttgttgtgttaaagtctgttttgtctgatataagaatagctactcctgcttgcttttggtgtccatttgcatggagtatctgtttccattcctttaccttaagtttatgtgagtccttatgtgtctggtgagtctcttgaagatggcagatacttggttgatggatttttatctattcttccattctgtatcttttaagtggagcatttaagccatttacattcaactttagtgctgagatgtgaggtactgttctattcattgtgctagttgttgcctgaataacttttctgttgttgttgttgtttgttttttctatttgtattgttttataggccctgtgagatttatgctttaaggaagttctatcttggtgtattttgaggtttcgtttaaagatttagaactccttttagcatttcttgtggtgctggcttgggagtggcaaattatctcagcatttatttgtctgaaaaagactttatctctctttcatttatgaagcttaattttcctggatacaaaattcttggttaacaattattttgtttgaggaggctaaagataagaccccaattccttcttgcttatagggtttctgctgagaaatctgctgttaatctgataggttttcctttataggttacttgatgcttttgcctcacagctcttaagagtctttccttcatcttgactttagataatctgatgactacatgcctagatgatgatctatttgcaatgaatttcccaggtattctttgagcttgtttgatatctaggtctctagcaaggccagggaagttttcctcaattgttccctcaaataagttccacacttttagatttctctttttactcaagaacaccaattattcttaggtttggcagtttaacataatcccaaatttcttgggggctttgttcattttttaaattctttttttttcttttttttggtttttatctgattgggttcattcaaaagtcttgccttcgagctctgaagttctttcgtctgcttgttctaatctattgttgacactttccagtgcattttatctttctctaagtgtgtcttccatttccagaaattatgactgttttttctttatgatatctatttatctggagaattttcatccatatcctgtattgtctttttaatttctttaagttcattttcacctttttctggtatctccttgagtagcttaataaccaaccttctgaattctttatctggcaatttagatttcttctgggtttggatgcattgctgggaagctagtgtgatctttcaggggtgttatagaaccttgttttgtcatattaccagaattaattttcagattccttctcatttggtcagctttgagctcaccaaagagaatatttcaatggaaagatctggaactcaagggctgctgttcacattcttttgtcccacaggtgacccttgatgtggtgctctcccccttcccctagggatggggcttcctgggagccagactgcagtaattgtaattgttcttctgggtctagccacccagtggggttaccaggctctgggctggtgctgcggaatgtctgcaaagagtcctgtgacgtgatccattttcaggtctcctagccatagctaccagcacctgctctcgtggaggtggccagggaatgaagtagactctctgagagcctttggttgtagatatctttagtgtgacggctttctcaaatgcttgttatgttaacagtgaagttgtcacatggacagattcaagacctctggttagccaggatgttgcaggcagtggaattagctgttgttttctctttccttgaagcagggttattccgtcatgagttgttgtaatgtcctgagctgcttggcctccagccaagagatggtgctttcaagagaacaccagctgcagtagtagtagagggatctaagcttgcccgaatttggccaggattagtatttgggtttctcaggtgatgggtggggccataaagctccccaaaatttatgtcttttgtgatcaactaccagggcaggtagagaaatatccatcatgtgggggcagagtttggcatgtctgggctcagactctccttgagcaaggcttgccacagccactgtcgggggtgagaatgtggttctcaggccaatggggctatgttccaaggggtattatggctgcgtctgttgcattatataggtcaccagggaagtaggggaaagcaataggcctcacccagctcccacacagttggtggggccgatcttgctccttctgtatcccactaacagcaccaagtttatctctgggcagcttatgctctggactcagaccttgccccaggctataagcttccctgctgagaaagcaagcacagctttcgggccttgcccttccctgtctgcccatcctgttggccacagctttgcactcctatctgtagcagttcccttttgccctccggattctgttcaagagaatttgcacccagttgaaattattacaaagctcacttggaagcttctttcaccctgtggcccctgctaattctactggctgcctctctcaaggacccctgtgagatagagtcagagatggcttccccgggctaaagctggagcatgggaatgtctacaaggctcttcccactgctgcttctacttttatagaaaatattttgtactaaatccatttcagctgtagatacggttaaatccttctcctgtaatctggattttcaggttccccattggggatatgtgcttggaggcaggttttctccctctcacactttgggaatgcacagttttttgcctgtcttgtggaatttgcagcggtgtgccacttctttaaaaggatcagtgaattattttggttttcctggtacgttcctgtggtcgttcttagaacaaaagttcatgctttgtgtctccacatactcctctgtctgtccattcaagtgggagctgaacagtagccctgtctcctatctgtcatcttcctcttaaaacctggcaatttatttttattttttatagagacaaggtctcacaatgttgcccaggttggtcttgaactcctgggctcaagcttcccaaagacaccgatatttataatttaaatttaacattactgaattattatttaactttattttatttaataattgtatctattttccccttcaaaggaaattatgtttcctaaaaacatgtttgtataacatacatatatatacacatacatatgattaatatatatacacacagtactttcttgttctatccaaaaacattcacatagcagtctcaaaatgataataatagctttgttacaaacaataaatccagtaagggcaaagcttatttgtaacactttctgttcccagagagtatccaactaaggctgtgcagcccaagtgccacgtttgacagtttcttaaaatgattctttttgccatgttatcagtttgatatatagttggcctcatttctttgtgtgtacaattttggactgctttctctgatcttttttatttcatttatgttttgcataatgtaaaacacttacatggttcaaaagtcaaaactatttttgaaagtacagagaattctttcttccagccctatccctctacaccattcctacccacttgtatggttaatcatttttattggtttttggcttatctttccagtgtttctttacaataagcaaatatgtatatgtacacacatatataatcttatttttcaaaaaataacaccatatatgcactgtctgtatttggccttttctactaacaatatatcttggatattattccatagtggttaatggcaggcattttttattcttctttcttatggctgcatagcacttcactatgtgactctaccataattcactcaaattcatttcaaccagtttcccattggtggacacctgaaaaactcctatctctcgatatttggttagttgcctcaactgcatgccaacttctgctttggagtggataaggaaggtaagacctttggggacaagactcaagactcagccacttttgtcccaaagctacaggacttgttctgcctgccaatgctgtctctttcttcagcaaaagtgggattaagcgtgtgtataatgccaggtatgaagctgcactgctatgcaagttggacttctcaatcagcataaaagagctgaccattggaaccatccgaaatctcatgaagagggttgagggactctacttatgtacattttacagcagagagtaggaccgggtaagtcaaggttatccactatagtaagttactgctcaaaggaaaactgatagaaaaagggtctccaccttcttaaacacagaagcagtctgcttcaggcagaagatgacaggcaactcttctagtagaacttgaggtatacattcatggctccattgagaatggagatggggtttcaagcatggaagtggggacagtgacccatcagtctgagaagacacttttatgcccacatctcaagcattgctattattttagaagtagatgctcagttgtctgataaagagtatgatatcatccctattggttttaggacctagaaatagatttgcaggaccctaagggcaggatagaggtggatgagaaggtttatagtttttgggtccaagaggtggtggttggttagcgtatgggagaagaaccagcagaacctgagggtgtaagggttgatagacaaaacaaagctctaagtacatgggccccaggccagcgcccagaaacaagcccagacacaagaacccagccccatactatgatctcacccctagcaggcccccattcactctgcagctgaatgtccaggacttctgcaggttaaagaatgacatctgctaatctccagtcaaggtgcacctcagctacactctggactgtagtaacaatgtgcaccattgtctgtatgccctggggaatcactagactccaaggtgggctttgaacttggtgttgtcaccaaccagtgggtggggacctgggagtcccataccttagtgtaggaatgttgatgtcatgggtattggggacagaggagatggactgcattcatgcatgcttttgctgttgtgccagctctctaaaataccttgccttttttggtctatgtatcagagacctttccatctgtcaacaatcaacattagcatcaccttgctaatagagcttttcttgggccccctttggtagaagggtagtctactccttccttttggttcctaatccagtcctgactggattataaggacttcaattcatctctataactagtatttagcactgtgtcaggcacctagctggtactcagtaactgttcagagaatgagtgaataaatgaatgaatgattccaacagatgaaggaactggcctgaaaatgacttgcctatttgccaaattcacccagctttttagtttctcaccttctgacaccaatcaggaataaaagccaaaacctagattggcttttcatcccaagacatgtcctgtcctttatatgggtgtggacttacgttagagcccttgtcattcctaataattccctcttgtgcctacctggatggagctcaccttgggctatgattaggagagcctatctccagcacctgcactcactcacctgactccacctgatgacttgacctatttgttcctccatcagtcaacatgagtgcattggagacttactgtccgttgttctctgtggacacatgtgaagtgcaaagacatgctaaggcaactggcctgagcctgtaattcagccaaggctggtaatgacacatgatcagaggtcacaacactctttttaagtcacagcagtttcccttaagcatggctttagagtctctgagctcaccatgacttctattagagatagcataagcctacagtgctttccctactctttgttctcattcaccactcagcaccacacttttggcaccagatagatggggatttttcccacacgtatcagtaaagcaattctgcagcacacaccaatgaggtgtcctgcaattcaattcaattctgatgctaactacccaaagatgtcatcaaatcccacagggtgagggcttagtcctataagactctccccaaccttgcacaccaattgcaagccctaggatgtgacctgtgcctttgaccaaccagctacaaattgaggttcctacaaccccctccttgggttcaattaatttgttagagcagctcacagaattcagggaaacactttgcttatgtttatcccttatgataagggacattacaaagggtaaaataaacagccagctgaaagggaggcacaggatgaggtatgtgggaagggctgagaagctcccatgccctcctagggaccaccctccaggaagctccacatgttcagctgtccagagctcccaaaactcagcccttttgggtttttatggaagcttcattatataggcatgactgactacatcatgggccattggtgatcagcttaactttcagcctctctccccaccctggagtttggaagtggggctgtaagtcctaaccctctaatcatgccttggtctatggacgaccagttcccatcctgaagttacctagaggactcatccacccattactcattagcatacaaaagacactcatcactctggagacttcaactgtatatcaggaaacatggatgaagaccaaatatgtatttcacaatattatagctgccatcagccatgggtgagtttctcatcattcaaagtttccttcttttttagaaaccacctgttttactctaaacaaagtagattcttatgaaaggtaggctgtttgggggtccagaatttcaacatatgccaccaaacccttttcttccctctgaatttttggaggcgcacctcaccttgtgaatttgtagcaccccaaaccagtaagcacacacattcaaatacatgtacatgcccacagctacccactagtaagcaccatcccccatgtccggtcacacagatgtgagaagatggagaaatgttcacctaaacagctggtgtgtgaagtcctgcctctgtcagctgagctcacatgggaaagatccccagtccctaggccccacatcaatgggcacagggccttcggaggaaaggacaaccactccgtcgtggagggagaacactttggactcgggtgtgtgtttgagggattccagagggtagaggttgaggaagaggagttgggagagtgagaaggtaggatgttgcacaggatgagacccttcctctcaaaccaaacctaatagccaataagtacaggaaaagatccttgacatctctagtgatcagggaaatgcaaatccaaaccccaataagaaaccacttcatactctccagggtggccagaatacaaaaggctgagaacaagtattgggaggatgtggagagatcagaacactcctacgctgctggtggcaatgtaaaacggtacagctgccttggaaaacaggtccccaaatgttaaacacagagctatcacaggactcagcaattccactcctacatatataccctgagagaaatgaaagtacatgtccacatggacacttggacacaaatgtgcatagcagcattattcatagtagccaaaacccaaatgttcatcaactgatgaatgaactgacacaatgtggtctatccagacaatggaatattagtcatgaaaagggatgaagtacttatacttgatataccatggatgaacctcaagtatgttaggctaagtgaaagaagccagtcacaaaagacctcctgttatgtgattcattcatatgaaagtccagaatagggaaatctatagaaacagaaagaagattagtgggaacttagggctcagcttgcgaggtgggggcaggggcaggaagatgggaggtgacagctaaagggtttggagttttgtttggaggtgatgaaaatgttctaaaactgaccgaagtgatggttgcacatatctgtgaatagaccaaaaaccattgatcatacacattaaatgggcgaattgtatacatgcaagttatatctcagttaaggcattaagaactaaacaaaaactaagaacacagatcttctgtctttcctatttatttatttattttgagacagagtcttgctctgtcacccaggctggagtgcaatggcgtgatctcggctcactgcaacctccgcctcctgggttcaagcaattcttctgcctcagcctcccaagtagctgggattacaggcacccgacaccacacccgactaatcttttgtatttttagtagagatggggtttcaccatgttggccaggctggtctggaactcctgacctcaggtgatccacttgcctcggcctcccaaagaactgagattacaggcgcgagccaccacgcctgaccaccttgatcacctttttttttttggaaagcaatgagggagcaacactttgttacctgggaggcgtggaccaaaagagaggcagaggctggagggagagtgtgaggcagggatcaatgggcatcatgccaggcttagggcatccccaaagctgtgggattggggcttgaagcccaggtcttagagacctgagcaggcccagctgacacaggctgcaaacaaatgtcctctcatcctcaccgcaatccctacaagctgctcacctcctgttgccatgtggatgtgtcctgagtggcccacgcagatttctacacttgatcccctcgcttgaaataaaaggagataaagtgagtacaaacacccttatgcattactgtagctcaaacgaggccagactagatcctaaagaagacctggcgtgggccatcttctagagtcatcccacctcccaggacaagcaaaggtcctgcctccaagtcattgcaacttatatgacacagcaaggcaatatagactctgggggaaaaagttttttaactacagtatttttaaaatagaacattattttgaaattacttcgacatctactgtcaggtgacttgtaaaagcgcttgtatgttaaatgctctacattaggagattattttgttcttgagtccctacagagaattccttgggaatgaagtgctattgtgcattcagaattatgtggctatagccatattgcaggccgggaactcaggaatgtcccctctgtcccagctcttcaagttgggccctacagatcccacggggacaagcttttggaaaattgctgggtttctagaccaatcacgtctttgaaatgtcttcttgtcactccgtggtttcttgcttcagcttaaccccactggccccatagatcaggcagctcacaatttgaacacagccagggggcatggaggatgagaaccaatctatcctgacaatcctggcagcacgtggggaaagccaggcccaagtttccatatgtgaacacattacattgtctccaccaagaaaagagcccctgtgaaatattcatgtgcgtcacccactttgccttaggttccattacctaagggacagacctggtgttgctcaacagtgccaggcttagcactgccaggggagatctgcagctacaaagagttaaagaagaaggaattgaattgagttataagcaatacatctaataaatatttattgagtgactatttcattccaagcattctgctaggtgctgagaaatcagaaacaaatacattgaactcattggcaaactagctggggagatgggcagggaagccaactgttgcagtctggtgagagttgtgctggggaatgcagtggctttgcaggagcccggagcagagacatgtagttctgcttggtgggattgagcagatgtcaggcaaagcttcccaaaggacacgatgctcaagaagggtcctgaagaatgatttgaagctggaaagtcagaggaaagcatcgaaggtgaaggcacagaggtaggggacgcatggcacacccagagaactgcagacgccctgtcatgcctgcagtcttcacgggaggtgagaaagaatttccagggtacatggatgcatgttaggaggctgagactggtcttcgaagatgatcagacataggcttgaagacttgatgctttcaaaagctcgctctgacagtagcgtagagaaggaatgggggaagctttgcttataataaagtgagaaatgatgggggctgaattaagagaatggctctgggggtggagtatgagagtatttcctaaagatagaagagagaatggccaggacttgagagtggctgaagtcgggtacagggagacaggagacaccttttatggccatagcttgagtcactgtgtggacaggcgtgctcatcattgagaccaggaagcttggaggggaaaacgctcatatgcaattctgaagttcctaagagacaactggataacacacaaggatgaatgtgaaacaaacaaggggctaggtcccgtaagctcatcagaacttctttctgaaagaagtaaagcacatctctaatgacaacagaaataaccacaaacctgcgagtcagcctcaaatatctttcctgggggattaaatgatggctgagggacggggtaccccagaatgtcccttgcacaggaaaggacctagagaagagagactgttttttgagcaggtcacattcagcttactgcaatgtctttgctttaaacggtcccctgcattataagaatggagtttatatgagaggtgagagggtcccagtgacttagcaaccgtggcatgcttctgcaaacatttcaaagacctctactctggcttttagaatgctttctagagcaagtagcatgcataacgacaccactacctggaattatacactgtctttcttcagaggcacacaaagagcttaacacattaccttagttctaggttagctgctttgtttcatgcatgcttgctggtgtttctggaagaacatttatgaggtgattgctcttgaaagacttcagaacaatcaagatggtttgttgctgttgggttctttttttttttgagacagggtcttgctctgtggtccacgctggagtgcagtggtgcaatctcagctcaacacaaactctgcctcctgggctcaagcaattctcccacctcagcctccagattagctgggactataggtgcatgccaccactcctagcttttttttttttttttctgtagaggcaaggtttcaccatgttgcctaggctggtctccaactcctgggctcaagcaatctgcccgcctcggctttccaaagtgctgggattataggcgtgagccactgcactggctgggttttatattttattttatttatttatttatttagactgagtcttgctctgtcacccaggctggagtgcaatggcgccatctcagctcactgcaaactccacctcctggattcaagcaattctcctgtctcagcttccggagtagctgggattacaggcgcacaccatcacactcggctaatttttgtatttttagtacagacggggttttgccacattggccaggctggtcttgaactcctgacctcaggtgatccaccctcctcggcctcccaaagtgctggaattacaggcatgagccaccgcgcccagactggggttttttaattttcactattattttttaatagaaagcatgcaaaaagagacgacacagtcattggacagtattacaaaaaatagtcatagaagtgaatataaatgatgcaaaatgcaatacagctagagtcccttcttcaccctttttattgatatgttcacccaagtgttctcacacatagaagcaggtggttttctttactacagtagtatagtttggagtgtttatgcttcactaatggtacaaaattagctgagaaaagatttaaattggtgttttaattatccagtgtgataacaaaccacctaaaaatgtagtggtataaaacaactactgtgtattttctcacactactttgtggaggtttaaaaacaccacaaattcatcaccttggtttctgtgggtcaaaacaacccaaattcatcatctcggtttccatgggtcagaactgcaggtacgggttggctggggcctctgctcagggtctcaccaggttgaaatcaaggtgacagccagagctgtggtctcatctgaactaatgcagaactcaccagagcacatgtagtgttggtagaatccatttccttgtggttggaggacggaggtgtcctcttccttgctggctgctggccgggggccatcctcagctcctagaggctgccctcaagtcctggccacatggcaccccagtctcaccttgtggcagctccaggccagcaggggacaccactgctccctccagtgtcctctcagggttcacctgattgagtcaggcccatcaggataatcttccttcttttttttttttaactttttttttgtttttgagacagagtctcgctctgtcacccaggctggagtgtagtggcccagtctcagctcactgcaagctccgcctcccaggttcatgacattctcctgcctcagcctccccagtagctgggactacaggtgcctgccaccatgcctggctaattttttgtaattttagtagagacagggtttcaccacattagccaggatggtctcgatctcctgacctcgtgatccgcccgcctcggcctctcccaaagtgctgggattacaggcgtgagccaccacgcctggcccctttttcaacttttattttaggttcaggagtacatgtgcaggttcattattggggtaaacttgtgtcatgggggtttgttgtacagattatttcgtcacccaggtactaaacctagtacccagtagttatttttttctgatcctctttctcctcccaccctccactctcaagtagccactgtgtctgtcaatcatccttcttgataaactcaaagtcaaacgagtccagatcttacctacatctgcaaaatcaatttttcctataaaggaacgtaatcacagaagcactgtcccacagtagtacgagtgctgagccgttgtaggcagagagggttgtcctgcccacactcaaggggagagagtgcagggccagttcacccctcacgcggaagtggcagtgctgggggctcacttcgtgctctgctcaccacaactccaaactcacaactttattcccaccaatcccatcccctccagtccagggggcacacactccagcaggacttcagctgagcccagggaacgctttgctgactggtgatgagggacctacctcttcacacccatgacacccacccgctgagcccctcaccggggctccgaaggccctggtcaggtcacctctggtctcactttccattctcccctccttcctcccctccagccacagggtccttctcgatgtgcccagacatggtgggtgcacacttgtctgacagcctctcttcttttccctttgcttggaatgctctcttcccagttaccaaagatactcaggctctctccccaatttccttcaggcccttgctccaaaagctccttccgggtgaagcctcccctcccatcctccttaaagcttcagcctctacctgggacacttcctcccccactgcctgcctccttgaaactctccttagtcctcttgcagcccacacagctgaacacaggcaggagggggcgctgctgccctggctggtgtgcagccaccagaggctgaagctcactgacgtctgtctggggcccaggatcaccttccttgattccagctctctcaggctgtcaggacctggcgctgggaggcactaggccatgccctggcctgaggccttctctctccctctttgccctgtgtctctgcagggaagcccggccctgcccctgggagggtgggggcagacgtgtggagagtgggtgtacaaggccagggtttgccaggcccaggacagcctggcacctgtcaatggatgagcgcctctcccttagcctgatgtcagggtgggcatgagggtgggagcagagggtgcctaactgaggaaagggtctgtgcaacccccttctcctaccagttctcgtttctgaagtctcctcaagcacactgcggtgtccacaccattggcagcaggctccttctcttcaggtggtcttaggaacttctcagaactttttgagttatccttctggtctcttcctcctgagcacggttctcctggttgagctccaggccatgccattcaacgccctccaggacaggccgaagggcttgtctgtttggtggttg

SEQ ID NO: 795 - DNA, 64652 bp, Homo sapiens
gatcatagtaaatggctttaattttttagcgaaatctcactactgcaaatgcattgttgtcctagctaatgaatgcatagagtattgcctgcaaaataataattgagattctatttttaagaagcttagaacagtacatggtgcatagcaaagactctgtgtatgtgaagccagattttaaaatatggtaacaagtgtctgaaaatatgtggctcaatttgtctcccggttacttttccctctccccctttaaaatgtagaggaaggagaagaagagataagaggtttgtgagtgaagacaagggccctttaaggcctgggaagactaacgccatagggatctccctctgccttaaaaggcacaggaatcttagtggggaaaaagaagtggtgataaatagccagtccgtgtgcctggaatatcaaagtcagtgcgtgccagggatcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaagatcacagctctcactagactttcagaggactttgtaacccaaagaaccactcatctcaaggactgtggtaactcaggggctgagccatgccagtgtttattatgtgaaacaaggactggaacctcacaagaccaagtctgtccatttgaggatggcccaagatgcacacgggctgcttttatcttatgcgcaggttttaaaaaaatatgtttcatttaaatattccatactcttcaggaatgcccaggcagctgagctttcaggatgtcgcattgcagaggactccaatgctacatatggcagctggagaccctttcaaggcaggtggcagaacggaggccctctctatctgctggggcagccctccgggtgccccgctggaaggcagagcagctccatctctgggtgggtgagaggtgctgcatgggctcactatagtatcccaatactgtatggcagtaggctgccagagtatcctaagctgggtggcttcaacaacaggtactgactcacagttctggaggccaaaagtttgaattcaagcagggctgtgcttcctctgaaacctgtgggagaggagccttcctggcttcttcccgacttcttgggatggggatgcgcatccatcctcggccttccttggtttgtggctgtgtcactgcaccctctgcctctgtcacggcatggtgtcctccctatgcatctgtgtctgaatttccctcttccgataaggactccagtcatattgggtgagggcccaccccaatgacctcatctcaactagatcatctgcaaagactctatttcccaattaggtcacattgaaggtacctgtctttttgggggatacaattcatctcacaaaaccggcccatcacctcaaaaggacctgccaccccagtgctatgtgtccctctctgcccagagccactccttcccctggctctcggggagtgggggcacctttccctgctcccacagtgaccgagcaccttccccttggtatgcattctgaagggggcatttttttctcctccatctcagccctgtacaaagcaagttctttctagattgaggtgtgtatgtgtgtctatgtatatgagtgtatgtgcctgtgtgttttcagggagatgtgtgcaggatgggtgcaagggaggagtggaaggcggaagggcaggaggaggatagagccacaagagtgagcacagaagtgacaagggcagaatcagtgtgtgcttgtgacaagtatggaaatgtcatgcctttaggttcagtcctataaggtaggtgtatcagtaagggcattgattctgcgaccttaacagagatcagaataacagtggcttaaggaagagtggagtggatttctctctcctgtaaatctggcctggtgggtggtaaggaggatccacgtcgcccaggcccagatgtgtgtggctctttgagtgccccgttctttcccagtctcataactgctctccacctcctccacatccagccactgggaagcaggacaaagttagttaagggcacgttcttttctttccaaggattacttggacattacagtcttcacttccatgcctactggccagggcttagtcacacaaccttgctagctgcaagggagtctgggaaatgcagctgctattctcagaggccatgtcctcagggattctgctaaatttagcaaggcagggacagatatgggggaaccactgacagtctatcacaaaagaacgtgattttagagaaacagtgaaacagtgtcattaatccacccctcaccccttacaacagccaaaaagaaatccagtggtatccatcacaataaagagtatgagaggaatgtgattagaaaatcaggttgccaggcaggatgtgtccagttttagccagtggtggggttcatggggaaggcttcgtctcaggaaggtgtgtgttgggttgttctatggccagatggttttcaacgacatagcacgacctgtagctctccaggacccgggcctggacataggccttgtccttctcttgccaggcatcggactcgatgtagacgttgaatgggtcgttcgagtgctccagcttcttggagcggatgtagctcagcatgatgcccagggtgaagaagccgaagaatcccagtaccatgaggacgtagagggcctccagcttgccgtcactgctgcggggggacctgcgggccaggcccgacatgttgccaccctgctgaactgtctcctgccacagcttggtcagaaagggcgtcaccgctgtggtgttagacaggatcatcctgggcattaaggttccactgctgcagctcaaacttcccaggcacacctcttaaaggaaaaatgcaaccccaaatcaaaaagtacgtattggccaaaacccacacgtacgcacacacacgtatacaattttaaaatctcaggtgagaggggtgagctgacactccacaggccatggcatgtgccatcttgggtctgtgcaatgccttctcttgatagatgaatggatacattgattcccttctatttccatccaccactccaatctccacccctataggtgaccatcagaatgagcttctttaatatgcattgctgcatattgtggcgtatggggttgcatgtgtgcattttggtttacctaaatggtatcaggtcatccaactcattcagtctccttctttttcctcatgactgtgcttttgtggctcacttgcggtgctgggtgtgtgcattcccttgcttccaatgtttgtatacaacccatggtgaacacccacttcttttctctgccttctcccccagagatggacactgctgtggctgctgactccataaacaagggggagacaaatatccccatccttgacctcctatggacctaaaaaaaatcacgcatctcatacaactagttcctggcagcttatgcaagactagtcagactggttgcccttggaagcaacgtgcaattggtggtctgtttcaccacagagcatctctctatgaacagttacattcatctgaatgaaaaatctatgctgtcacgtggtggacttcagaatgtctagggagatttcacagagagctcccctcgaagaggccagtgttgtagcttgtgctatgtttttccctccctgcccacacacaggcacacacacgtacacaatcttaaaacctcaggtgagaggggtgagctcacatgctccctagtccatggtatgtgccgtcttgggtctacacaatgccctctcttgattgagcaatggtacatggattgccttttatttccattcactactctctggctatgcagaaagtgacattttccctatcgtttaatcttgatatcactgtccctgtatactcagagtgggcctgggaattggaaaaattgtctccaagtagctgtaagattctgtcaggggtttggtttgctgtggaaaccccatctaggtgaccttgagatcattggtaagctgaaaaaaaacaggtcttgtttttatttatttatttatttatttatttaggtttgagcaaatgccagcctctacccccagttcctgctgggaaacaaaagctccgaggccaagttgttgatgtcacattccaaactcaagccagagggggccactgggagcttatcacacgtaagtgctcccactcagttctttctttttctgttttattgagacagggtctcactcttgtcactcaggctggagtacagtggcacaatcttggctcactgcagcctcaacctcctggactcaggtgatcctcctaccctaccctccagagtagatgggactataggtatgcaccaccatgactggctaattttcgtattttttgcagaggtgaggttgccctatgttgccgaggctggtcttgaactcctgggcttacaggatccgcccacctcggccccccaaattgctgggattacaggcatgagccaccctgcttgtcccctgctcacttcttaggagcttaaagtagctgagtagaacatggcctggagtagaacatggcctcggggggactgttgtaactacaggtgaaggatgtatttgggaagacagtttatggccagaatcgctatggaaagacaaattccaacacttgccgggacggcgctgtctttcccagccaggatggggactgtgacattgcacatcatcttgtgtaggacaaataacctcagaaacctagctcctctccagcttagacccagagctatttcttcattgaattggtttaattgtaaaacataccctgaacccagcaccagctgaagacatctggcacctttccgaggcccctcttcctctacccatctctgaactctggctgtgtctcagagttctgttacctgctctcttctcttcctactctcctctctcccagggtgactgcacctgctccaggctcacctgcatggccatgacccagggctctctttaagctccagagccatgcgtccagtgacctgctaaggagatggttccctttggccatccccaggctccttaaagttaacactccaccctgtcctgtcagagactggcccctgcctcattgagctgagtggcaacaccactcactccaaaatctgcatcactctcactgatgactgcaatctcatcatggcagttcccatcttgaaggccttccttggctcctccctgccttcagggtgaaactcctggtcttctgcatggatacaggccctaaatttgagagtctatgcatccctctccaattccactgttgccactgtgcccagaccctatgctccatggtccctgctggccccggagcctctacacattgtgcgtctccagctcagactgcgccttcttcttggcccatgaaacttctcagcaatgcctactcatgcttaaaattcagcccagctctcacctccttcccgaagcctgctctgatacatggggctggatcagcactgtgcacaccatgacccctgctaacctcatcatggtcaggatctccaggccccttatcccatccctgccctgccatccagcctggtgctgggcacgcaaccacacaggagctgcccatgaatgtttatcgaatagatgccaccagaacttaataccttttgaccagtggggcttgactctttataacctgcttactccaatgaacagatgccaatgagctgtctccgaagctctaactgactcccttttccagaagggcagtcatctcccaccctgaaccacagtctcagaaggcaggagtgaggagcagaaagagctcagattttgggattccactgccgccacaggtttggattctagctttgctacttcctggccacatgatcctggacagtttccttagaattgttcagtcaagttttttttttttttctttccaaagtagcgagaaacaccactgacatttgcgggctgttgaatcactgagcaggtgtgtagagtggctgacagcatgtggcacatggcaggtgcacactcagtggtcctgggtaggagtttattggtttttctacctcattaagaaattgctgcccaaggatttggggctttgggggtttaggcttggctttcctgtggctgaccatggcagctgtcttctctacgttgtggagagatcagacatgaatgagaatcaaagattgtttgtggcctttcctggtttctaggcttttgagtctgtgcagagatctgtcaggggttaagctgcctgggctcaagagattcaggtccttgttcttgtacaaaactagcatttagccccattctaaccatcggggtaggcaggaattgtttggtaacagatccaaactcaacgctcaaccatttctttttaaatgacccgaaaccacttatgaatgcataaaaccctgccccagaaaacagacagacctggacctgatactatgatgtaatttccaaaaacccagaatgatcacaattggcaaataattctgccaccaatcactgttagagagtctttccaacttcatgaccatgtgaaggtagaattatggcaggcgacatttgaagatccacaagttaattggtttaaaactgataaatccatacagcaaattaagagttacatctgcaattaattcataatagtgagttcactgagaaggcttgttacttagatccagatggactttcttatgtccaaagaagcaaccaaaaacatctgctttgaaaacctcccaagcccaaaccatcctcagccttgttctttagaatgctttagaatgaccttgttaaaatgcagattgctcctgtaatcccagcactttgggaggccaaagcaggtggatcacttgatgtcaggagtttgacaccagcctggccaacatactgaaaccccgtctctactaaaaatacaaaaataagacaggcgtggtggcgggcacctgtattcccagctatttgggaggctgaggcaggagaatcacttgaacccaggaggtggaggttgcagtgagccaagattgtgccattgcactcctgcctgggtgacacagcgagactctgtctcaaaaaaaaatgcagattgctgggctctattttcagagtttctgatttggtagaactggagcgggcctgggaatctgcattcctaacacattcccacgtggtgctaatactgctggtctggaggccctgcttggtgatctattggaatcaccgggggagcttttagaaaataatggttcctggatctcacccctagagattttaatgtctttggtctgggttcctgcctgactcagagactttttagaaacctcccaaatgatcctaatttgtagccaagattgagaaccactgggctgtggtgtgggaccctaggaaaatgaccaatggccttttgtgctgcagggtacctggaagaattttgcaaaaatatagaaatatgatctcactgactgtttttcaaatcttgtttgttttttacattttcttttttggccttgtttgcctctgatacagtctgaaaagaaattgcagaaagaaactctccagtcttcagtgtaacctcagctgtccccagtctcacacacgctggtgccttcaattacaattctcctgtcagagcttaagtccagctaattaactgcctttcaaatgacaaccctatatttttaaagaatttttttaaaacttcacatgtaatttattgcattgcttttgctaaatgtcctccacacccccaatgcctgctaggctgggtcgccatggtatttttgtgtaacgagtctcaaaatgagtttggcaatgtctccgtaatagtcagcatggtgtaaatgacagtctggatctgcatgtcatttgggattttatatcagattctctaggttcatttctatgatacgtgatgccaaagcacccacatgccccgtggctgcactttcagacagttggactcaaacagagtgggagagcaactgatccaacaatctgaattttcagaaaacggggctccttagagatgagatggcttgccaaaagtaatctctcctatcagaagtacatatcctcagcaaactaacgcaggagcagaaaaccaaacaccgcatattctcacttataagtgggagctgaacagtgagaacacatggacacagggaggggaacaacacacactggggcttgtcggggaaaggtgggtggggaagagcattagggaaaagagctaatgcacgctgggcttaacacctagatgatgggttgacaggtgccgcaaaccatcatggcacatatttatgtctgtaacaaacctgcacatcctgcacatgttccctggaacttaaaaaaaaaaaaaaagaaacaaaaacaaccaaccaaaaatatatctaaaatgtcatctgttagcaattgactcacatattattagtatagaaaagagcaattcccaggaccttgtacagaggaagcaggctcaaaacagctgaggaataggccacttttatcagatagcattggatccatgcacatgggggttggcttcttacctaaatatgccatcagaaatcatccttgttcctgtcccctcagcttttgtagcttgcacagtgagtaaagggatggtggaggcagaaatggtaggagccagagatgttcaaaatccatctgatgcttggcctgtgctgaacgttctcaaactgtggccttgtcaggcccagaaagtggggtggattcctggccgtttctgcttctgcctgggtgtgagatgtgaatgctgcccctactgaagggtagtgcaattttttttttttcttaaaagcttagacccagagctgctaatctactggaaatcactcaggacacagggctctgggcagctgcgctgagcgagacacctgcaaatggagaccaacggggcctccagcaccctggagttccgtaaggcccccagctgaacccaggggagaagagggcagtgggtggcgcctcgctgctctgggcacacaccacctcttctgacttctcccacgtgctccggctgtgtcgcctatcagcactgataacagcctggaagctttcagaacagaagctttcccagcatgggaaactctcattctttcttttttttaattttccaaagcctttatttctaagaccaactgtggcctacccgtgcataaactgggcaggctgtagacagcaggcttgccaagtaaatactacagccttcctcccaatattgagccctgtcccattgatcctgcaggggagatgtgtagggcatttgttcacggggaggccacaagtttgggcctctcatcactgtgacctcacacccctgttgagtgtgtcgtaaacagaggagccgttcttcaagccccctgccctgagtgcacccctctcattcttttgttattattagcaaattcccccagttcctgatcattctttcttaagcctttagtgactgggtaaggttcttgtggctgactccaagctttcttctaaaaggaatagattctaggggtgagtagaggagacaggaatgtcggagtcagagctcaggaatctgggttccagccccaggtcaatcctagataaactagagggctccttaacttacttccctaggttgactctgggtttttttatcacgctcgacaggactccttatgcatttcttcgaaagagcatccagtcttaacatcatcatttggcctcatttggtttaagaagcagaattagggtaaaagcaatgatggataagcctcattttggtgaatatgatcttattgagacaagaattctgagtcaattgtccttggaaccaactgtctattgttttcatctttatcacaacactatgtccaaattttggaaacatgtttccctcctagcagaaaagaagccacccagggccaccagatgcttcccgacacttggctggctttgtctggtcttctatccttcccctatccccagagtcagtgggtactaaggtggccagggtcgctcaaggaatcagaatgcaaccgtccagaggcccagaatcagactgtcctctctgattaggaaagtgtttcctgccacctcccagggggatgtggggtgtggcttgagtctggtgcttttaccaggagcttcccagacctctctatgggtgatggagagagagtctggggtgtgaaggatggaaatataaacactgaatactcagagagtcaggccagcgagctggtgaggagactccatcaaactcaatatgaaaacatgggtgggcgtttggggatggataatgaatgacagctgaagtcacacatcaggagggaaggaaggactctcatcttcagcaaatgacataaatctggggagcctcagtttcctcacctgaacagtgagaatgatggaatctaccctgagtatatatcccaggtctttgtgcagcatggaatcagcccccagccttcctagctcttgctttattttattttattttagagaccaagcctcgctctgtcactcaggctggagtgcagtggcgcgatcttgacttactacaacctcctccgcctcctgggttcaagtgattctcctgcctcagcctcctaagtagttgggtttacaggtgcatgccactatgcctggttaatttttgtatttttagtagagacggggtttcaccatgttgcccaggctcaacatgcctgggctgaagcgatccacctgccttggcctcccaaagtgctaggattacaggcgtgagccaccgtgcctggcctcttgttttatgtttgctgttctcgctgtaggtgaggcattcccaccatattcccttgttaaaatcctactggcccttcaaatgccagctcatatccacactgtgtctgaccctgatccagaatcctctccccttctttgaccccttgtatatatctttcctacagtgctggtcatattctaacttctaatcatttgtagacttatctgggcattttctcccaggaggtcccaaaggacagagaccatcttgctcacctttgtccccactccagcacccagaatgtttcaataaggttttcctgaattaagtgggaagcaaagtattagattcaataccactacaatgggaaagtgagtgaataattgataaagtatactatgctctggaaatagattattgagtaatcagaggaaaacctcttgcaatgtagtatgtttttatatattaaattttatattatttatttatatttatattattaacatatttttgttattcattttgtttattaagatttactctatatatatatgtgtgtgtgtgtgcgcgtgtgtgtgtgtgtaacccaccttatttctaaaaaaaaattttggcagtcagtgactattaatagtagagcacaaactcttaacctttttttcctcccgctttcccagagtccttatcaccttctaatataataaagttttcttaactgtgatgttgattgttcaacgtttgtctttcccaccaaaatgtaagctattgcgggcagggatctttgcatgggttgttcttcattgcatcccaggccactagaacagtgtgtggcatatggcaggagtgcaataaacattcagcgaatgcaggcaggcatgcgtgaacgcatgaataataagtgttcctttcaactaccagaaagagcgaaaccacacaggagctgtctcaccctcagagatttaagacgacagcaatgagtccctctgatgtcttctaagtgagctttattttcaaaacaaatcattttccaataacctatcaaaagcaggtcctacctgaatatccttggctatttcctctggatacagataatgccttcctccaatggatcctcggctcacctgatgattgtgtgaaactggccagagaaagcagagggatttttcctggtgattggaaatcagagtcacggctgaatttaagcaactgtgtgaactcagcaaagtccccaccacctggaccatacatgacagctatggttattgacaaggtccttccttaatggagctggaacctccttcttaatctaaatgtggactcaaatgaactgtcaattcacatagagcaatgtgacaaatccggggggcaaagcattatgcaatagattgggcacatgcgcacgtctctgctacttagtcaactttcttctaaagtttcccacttttcccattaccacaatcaagatcagatatcagtaatattctccgcgtcccatgccctttcctcagggagatgccaaggcccaagagctggtccccccaaaaagctgaaggtctttgaaaaaaagtggggactcaggtcccgtgagtggttttgattttcttttcttttgaaagttgcatgtaagtgttttccaaatactatacaagaatgtctataacttaataatggaggaatgttttcgttgttctgtgttggtgagatgctttcctatgcgtttgttgtataagtaagtgagaatggcagaaggaaaggaggggagaggctgatcatcctatcccgtctcccactctgggggtctcggcgcttccagcctgaagcgcgcccgctgcgcgtccggagacgcaggttccaggagccccccggggttgcccgactaggccacttgcgccccggaagagggccgcggaggtgggagaccctaacttacccgggtctgagatgccgagagagccgggtgtggagctgagtgcgcgcctgccgagcgctgaggccacagacagccccgccccggggcggcaccttctaagggcctgagcgctgcacagggatgggggcgggcggggcctcccagagccgccaggcgtcccgccccactccgcccacacgcacggcccagcccagggttccccgggaccaccccagaccagccccggcccccccgggtcctccacactctgcaccccagaccaacaccaacgcgcgtagggaagcgttttagatcctgtcggagaggctcaaggccggcagaaggtttgcattaggatcgagaaagccgaccaacggacagatctacctaccttcctgcgggagtttgaggttgccaggggggaagccactgcagccaggagaaaggccgtctgggaaccaccccaccctcggacgtgcgggccttcaaatatctctgaacataatcctccaaagaccgctcaacctccgctcccgacgactctttctagcctcgtcccgcaccccagctgtggccacacacctattaggcaaacatttatgaagcacccacttactgggtgtgcagccctgagctgggggtgcagctgtggaccagacaggagggggcccggagcggcagacagtcgctggaggcacccgagccttggcgagcacaccctaacgtccttggggcctttcagcccgagccgtccttgtccagagagcaaaccatgcaatgatgcaggtgacttcccagcaaatttcatagcgttgctcaccagcttggcaggcaagaggagaaggggcagtccccaaaagacaatcccatgaaccttctagggaatgacgtccaggctccaggctcctgctctgcaggcgggtcgcagaggcaggttcctgacctaggactagaagacattctctagggtcactgcctccatggtcttccttggcaggtcacttcttcctgggcttcgacctcggtgttctcatggggacgagggtgattggaggccctccaaggggtgcaccgatgtgtcctgtgcaccaggcagaaccagcattgccctacagtgtgggtgcaaaatgaacccacatggccacgttggaaagtcctgaaatgttcatagcctatgacatgaaattgcactgtgtgaaatctatttattctttttttttttttcttttttttctgagacggagtctcaccctgtcgccccggctggagtgcaatggcacgatctcggctcactgcaacctccacctccctggttcaagcgattctcctgcctcagcctcccgagttgctgggattacaggcaccggccaccataccctgctgattttttgttatttttagtagagacggagtttcgccatgttggccaggctggtctcgaactcctgacttcaggtgatccacccgcctcggcctcccaaagtgctgggattacaggtgtgagtcagcgtgcccagactgaaatctatttattctatggaaaggatcagagctgtagaaaaatccttatgcatgtaaaagttctttgtgtttttacttgcaataactagaatctaaacatccaaaaatagaaaatataggtaattaaattgtagtacatatgatattattctacatagtagaatattatgtggagtccttaaaatgtttacaaataatttataacaacatggggccgggcacagtggcttacacctgtaattccagcactttgggaggccaaggtgggtgggtcacctgaggttaggagttcaagaccagcctggccaacatggtgaaacctgtctctactaaaaacacaaaaatttagctgggcgtggtggtgggcacctgtaatcccagctacttgggagtctgaggcaagagattcacttgaacccaggaggcggaggttgcagtgagccaaggtcacgccactgcactccagcctgggcgacaagagtgaagctctgactcaaaacaaacaaacaaacaaaaacccaacaggggagatctttatattatcatgttacgtgaaaaatacaaaaacagaaaacaaaacaaaaaccccacaaaactcaaggccttaaattgtaaatatgagatgccaggcattattcccaaaatctataaggaagcacaccaaccaccatgttaacattgtctattagtggtaggcctattggagatttattatcttatttatgctacttcatgttttccttccttttttgttttgcaacaactctgtattagtctgttctcacactgttataaagaactgcctgaaactgggtaatttataaaggaaaaagtcttaattgattcacagttcagcatggctgaggcctcaggaacttacaatcatggccgaaggggaagcaaacatgtccttctttacatggcagcaggagagagaagtgcagagcaaagtggaaggaaaagccccgtataaaaccatcagatctcgtgagaactcactcattatcatgaaaacagcatggaagaaccgcctccatgatccaatcacttcccacaaagtccctcctgcaacatgtggggattacaatttggattacaattcaagatgagatttgggtggggacacagccaaaccatatcaaactctatgtactttaatatttaaggaaaattacataaactttatctgaaaattccctggattcttctcctcaaggtcatgctgtacatatgcaggatcctcctgcctacatctccaaatggataatggattgaagcaaaatgtttgtcccaccaaacattgatgtgtaacccttttagtaacaattcatagaccaggtaaacatgtgtggagcagcccagatcagctggagggagcattattctcatcagagtgtggaacaatgcctacccatctgtcagctggttatggtgaagacagtataaatggaagcactgtcagaaactaaaggcttatgtaagtgatgctgttcttatgtctcctcttcctctctatcccacatatgatgaattattttattatgatgatgctgtagttgttattttctatttgaaatgaaaagacatgattacagatgagaaagagtgtattttgttatccttgatgcacttgaaatggtttcctcttttttttttcctgttttcttcttcttccttctctcttcactctttcattcttgcctctctccattttataggtatgattgatcttgaaataatgatgataacagaatgatagcccatatagtccttgggtcacttctgtctctatttctctttcttccctcctctttttttcttggtccttttgctagatgggttgcgagcatggctccctgcccctctcagtgggtttatcttcattttccatgagctcccacctcactgcatgtgacatcaaagccaaagctccagccacttctcatcctttcttaggaaaatctcaagtcttaacttgaaagttgaatgtcctgcttttgttcctaactctgctcacaggatagtggaagaagaaaggctcagcctgttaccagaaagaacagatctgcagtgtaacccatctaggatgaagggtcatgtggacagttcttcactcttccctctggctgcccttcagttggtgtccagatgcccctgtgttagcctgggggcattccttgccctttggcccctcttttgttgcctttttttttcttagacaaggtctaactccgctgcccaggctggagtgcagtggtgcgaccattgctcattgcaacctcgaactcctggctcaagacattctccccgctcagcctcgtgagtagctggaactacagttgtacaccaccatgccttggctaatttaaaaagtctttttgtagggatgggagtctcaggctggtcttgaacttctggcctccagtgatcctcctgccttggcctcccaaagttttgggattacaggcgtgagccattgtgccctgccctttgttgctttttcactcctttaccctgtggtttctactatcctcagggacaactctcattgccctggggcttctggatcttcagcaagacacacccctaaaggcaaacaatctttctttagcagcagcagagcacaaacggagtgttgctgtatgctaaaagcatactatttcccccccatgagaaagtctaaggggtccaggggtcctgaagtccctatcctgcccccgccagtgacaggtgatggggaacagaatgctgaaagagaccccacccaaccatctggtgtgtcaacacccgcccctgccggtgctgtccacaggttgatccccatcccacatgggtggcttaacacattcatgtcttctgagagccatttgttgctccccagtctcttctgtcctccttctttgaccaacatttccctgtctgatttgcttggtcacaggtagcctgtgtcagtttcctcccaggactctctttgcctgggaataagtgctatacatgagaagcatccctcccaagcgctgtgtgtggcctcctggcattctcctaagacttcctagaggattgctctggttccaaaaagaaaccagccacaacctgtttggagccctgcaggatgttccagctcaccgacttcattccccactacttgcccctctaacagagcttctagaccagcagccaaggtgcctccattcactgtacatgactcacctttcccccttctagacacttcttcacgggtctagcctctgtttccagctttacacagcacaggctgatgcctgccactgaacgggatccaggactttttcaaatctcagatccccagcaaaggtatgacaatgggcaccctgaccagctctgagcctctaagcatagggtctatttgtttaattttgaattcacttttaagatttaaaaattgagagctctcatcttcaacaaaattcaggggatctagaaacatcatgcccacttgtggcagagtagccaactggcagaaactgatgctgatgctgtctgtttcctacacaaaatgcaaaccagagtttaccacaggccccgctactccacattctcctccacaaggacactcagcaggctcctgtgctgaacggcttgcctggttctgtaggtgtagggtttgttactctgttccaggacctattttccgcaaagccccttacctggctgtttcttcccttggcatacgtgagaactcctttcctcactgaattgctttgaccttgctaattagttgtgttgcaagtgctttttggctgtgtcagacatgtatgttctgtttatcattttagagcaatggttattaatttttttcagattcttcttgggaattagagaaaaacttatggctctcctccaccatcctgcccccacctaccccaatgcacacatgtgcaacatttgttctacaattcaagagctctctagacccctgatatgctaggcaattcgtggctgccacattaggaacccctgatttaggggaaggactgttttctccattagacaaactcaactgtgtagcatcaatttcatgggtctactgtgtactgtgcccaaaaaatgccactgaatgctgcctgactggtggatagcaagactgtccattaatgtggtcatttaggttgcctctgcccaggtcttgaggtcattggcactaattcacaacaccctcaagtcacccagggaagatgagacacagttggctgtagacccacagtttgggcattacagctgcccttgaagttgacaaataaccacaaccttcaaattgttatgaaaagagcacaaatccaattaagaaagcttttccaaaagaaataacagtgttcctaccccctctgtcactctccaccccctttttgtcccagaataatgttgtgctgataggaacatggataaattaattacagtctggaatgttattcatgggtaggaaagaacactaaatctactcgcacaatgtttgatatttaaagataaacattgcctttatgttttttttttaaacctcagtcagcctagtttacgaagacataggtataatccttttaaatgctgtggattttttaatcgcaaaggtaacaatatgctgggtgttttacccagccagagaaccaggagatgcaggaatgagattagcatctctttagttccttgcatatttgatattattttggtgtacctccaattcctgataacatagaagaactcttgtggttgaagtccctgaaatggaaggatattggtaaccctgaatttaaaacaagcacaggcagcctttgtgggaatgtgtgtgaaggtcaccttctagaaacaggactgtccatagccattgccatggtttctgtgtcatttcaaccagaaccttaggcctggaagtctggatggatgtgggttggcatggtcctctatgggcattaaatgaataaatggatatagcagagggagtatccagcatgactcaaagaaggatgagaggaaacatattcaaataaaatctttagaaaagcaaatttcaaaaaaaaatgcttaagtataaaatattttgatgacaaccatgattttcaaattgaattcttattctaagtaatggtctaatctgaacttagacctctttccttaatttttttctcaataagcctttggtgtctagtcagttcaattcagtatttactgagtctctatacagacagggtataaggcattaatcaaatgtatgtccaaaattgcccaccatgcagggcagagctaaaatgcctaacacccctcctctcaccaacacatcccccacccacatctccaaagacttcctggcagaggtgatctctgcctgctgggacagatgtataggctccaacagcagcagggtggcccctctgaccaccaccttgggacccacattgctcttagaactattcctcttttttcatccttgaagcccccagcaaagctcagcctgaatcaactttttctaggaatctgacaagtttccaggctgatttcctgacccagtcagatcctcttccatctttctttgggtgttcaattttctacgtcattttccacctcacatattggccgttgatgaccacatcagctcttctatgctgtaagctcccaaggaacaaattctatcaaatgattggcctttcagctctctactgtgaccagaaagttgcccagtacataaaaaggggttcacaggtatttctcacgtggataactggtgactcatctatccatgattttggggatcccccacttcctggactaattgtaaaccaccttctaccacctgggggtgcctgagcacaacagagctaagtgaacatttcatcagtctaattgaattcagtggaatgttgggggcctggaaatttggactaggaaggtaagcaggaggaataagtgtgaatgacagtatctaaattaaaatctgttgccacgaaagaagatcagaccttttctcctctgatttgtccttctagaagtcacaagatgcccaaagaatcataagcaatgggtaactaggcaagggaattatctctgacaaatgccatgattgctcagtgtcccatttctcttggcagcaagagtggcccaaagactaaactgagatgggggtctgcacccctgcatgggactcaggctctgcagctagccttccaaccactaaacctgagctgaggtacttttagctctttatttcttgtttttctcatttgtcactcagatgagaagaatgcccgctctgtttgactcagtgtcagcgtgatgaagtaaaacagcttctttaaatccctctgcaacaaggcagtgaattgaaaataagaaagatagggaagaacattctgggcaagacagctcaatgagttcatgctttgatcgatctctcagctctgaacacaaagccatgacaggtaggtataaaaatagaaagctaaaaagagatgtctggctcaacagaagcagaagagacactgccagaagcctctgacctactgggctctttgtctaaaatcagcagggagtttggcctctgctgggcaaatccaagacgccccacccaagatggcagacaggaaccaagtacttgcttaaagtcaggaactagggtggggccccgaaagaaagacagtgcctcactgctgcctagggaccaaggttttagaaaaataaggttgaggggccaagatggccgattagctgctgctgcagtccgcggctctcatggagaggaatgaaaacagccagtgaattcagcaccttcaactaaaatatccagattctcggccccactcggactagtcagacaactagacctatggagaatgaagaaaagcaggctgggaaaatggtccacccgagagcggcacggagccaaaggaagccccaccccagcaaagggaagaggtgagtgagtgtgcgacaccacccggaaaaccatgcttctcccatggatcttcgcaacccgcagatcgggagatcccttcatgagcccatgccaccggggccttgggtccgacacacagagctgtgcagagtcgtggcagagcggccactcaggcacacacaaagacccaggaattttacatactccagcccaaggaatcccagcaaggcaggagatccattcatctattcccccaggaagggggctgaacccagggagccaaccagcattgctttgcaggccccgtttacacagcacctcacaggttaaggcccactgtaatttttgccagccagtggtgacagcctggagtcagcctgagatggactgagctctcgtgggtagaggcagccaccatctctgcggttcagttgactcagccattctagcctgccagctccggggagtccagacagtctggacaaggaggagtctcccacaacgtgtagcacaggtgctgtgccagatcgtggccagactgcttctttaagtgggaccccgatccaatcctcctcactgggtggggcctccctgtgggaatttcagcagctccagccagggttatatggaaaatactctgctctctcctgggacggagacccccatgagaaggggtggccgacgtcgctgcagttcagtggactcagtctttccagcctgctggctctggagagttcaggcggtctggaggaagggtcccctcaatgcagcacacccgctacacctgctctaacaaaaagcagccagactgcttctttaagtgggcccctgatcccgttcctcctgactgggtgagacctcccaacaggggtctccagagacctcccacaggagcgatcaggcaggcaacatgtcagtacattcctgggatggagaaaaatgagcaggctgccatcttgctgttttgcagacttcactggtgatacctccgggtatgggaaaaaccaaggcaactagggtctggagcagaccctgagcaaaccacagcagccctgcggaagagtgacctgactgataaaagaaaaacaaacaaacaaacagaaagcaccaccgacaacatcaaccaggaaaaccccattcaaaggtgagcaacctcgaaaatcaaaggttgataagcccacacagatcagaatcaatacaaaaacgctgaaaactcaaaaagccagagtgcctcttctcctccaaatgactgcaacacctttccagcaagggcatggaactaggctgaggctgagatggctgaaatgacagaagtaggcttcagaaggtggctaataatgaacgtcactgagctaaaggagcattttgtaacattaaaaagtggggaaacgacatgaacagacacttctcaaaagaagacattcatgcagccaacaaacaaatgaaaaaaagctcaacatcaccgatcattagagaaatgcaaatgaaaaccaccatcagctaccatctcactcccatcagaatggctattattaaaaagtcaagaaacaacagatgctggtgagattgcagataaaaatgaatgcttttaccctattggtgggaatataaattagttcaaccattatggaggacagtgtggcgatttctcaaagatctagaggcagaaataccatttggcccagcaatccctttactgggtatatatatcattctattatatatacataaaataggaatacaaaacatgctattcctattatatgtgtaataggaatacaaatcattgtattctaaagacatgcatatgttcattgcagcatgattcataatagtaaagacatggaatcaacctaaatgctagactggataaagaaaatgtggtacatatacaccatggaatactatgcagccataaaaaggaaagagattatgtcctttgcagggacaccgatggagctggaagccgttatcctcagcaaactaatgcaggaacagaaaaccaaacactgcatgatctcatttataagtgggagctgaatgacaagaacacatggccacgtgaggggaataacacacactggggcctgtcagggaagggggagagagagcatcaggaagaatagctaatggatgctgggcttaatacctacgtgatgggttgatctgtgcattttgtaaccaaatgtacctgtaatttatgatccaattcaagttgaattttttataaaagataaaggaaagattaggattatgtttttacatagaaatgcacaattgtttcagtacaaactaaagagattttcagaatttcatagatgaaaacaattcacatttgctaaaatgtatcctattaatactaacggttgtacttcagccataagaaaagaggacagaagggaatgtgtgaaagtcagtattaaatggtagtcaattaaaaataaaataaaaattttgaaaggtaaaataataattactgaaactgataaacaatattaataattttaatagccattaaattaacaaaataataataattagatttggaattttttaaagaataagatgagttaaatgggtgaaagtccacagaaagaaagttttctgggtccttgatgtgatcgggaagaaaacagaaatatttaacaacagaaattttgtaggaaattcatagtttactaagtatgctaaaattttatagataattacaaaaaggatataagtaatctataagttgcaaagcaacaaaatatattcttttgtgtaaataaaagggaaaatagaatggtttctcacaccaatgagaaataggagggaaaaatactttaagagaaaaagttgtgaaataaaaatcaaaatgtaacatggtaaaaatatatgcaggtacatcaataatcataatatctttaaatagaataagcacacaaaagactacaatgattacattgaataacaaaataaaatctaattatatgctgcttacaagatatacatttgaagtaaaaccaaattgaaaagttgaaaattaagtaataaaaaaatactaagcaaaggctaacacacagaaatctaaggtagcaatattaacacaagacaaagtaaaaattcaggtgattaatagtatacaaagatcacccaatttaataaaaggaaacagtctgctaggaaaatattacaattatgggtatgtagttaactatacagactcagcaaatataaagcaatcctggcagatttataagacattgatatatctatctatcttatcaattcccttaaggggaactgagttgtagggagccatttaacacacttctctcagcaactggtagatctgccctccccaacatagtaagcatatagaatatttgagtgatgaaattaacaaagttcattaaatatatatatagagagagcactacacccaaccaataaacaatatgcatttttttaacaagtgttcacggaactttttttaccatttggccatgtactagatcatgaaagaagtctcaagaacattttaaatattagttttacatacgtgcttggctctatgatcaaaatgcagttaggttataaatcagcagtaaatttatggtcaataaatcttcacatatctgaaaaccaaaaaccaagtacatgtctacttaacccattggttagagaagaaaacattttagaaacaataaaatactaaatgccatagaaaatactatatatgaaagtttctgggatgcagctaatgtggttcttagaggtaaattgacagcattaaatgaatttttgaaaagaaaaatgatagaaaataagtttaactaaaaaaaggagacatatgaaataaactaaagaaagtagattaaacaaaattttaaaaacaaaaattagcaaaaatgaaaatgaaaaaggagagaagagctactagatgaaaagctactcaaggaacacaatttgaagatttaaataagatatatatttttctagaaaaaaaacatgaacttccaaagtcaatttatgaatagagcttcatcataaaactggaatctataaaaagtatcagttcaatagatggatttactaacatattagacacagctgaagaaattatttatgaattagaatgtaagtcagttaaaaatattcagggtgaaacacaagagaaaaataatgaaaaatacaaaaaaagagtataagagatgtaaggaaaaggattaagagaagtgcagttagaggctgagaagtacagaagaaagtgaacagagcagaagtgatatttgaagagatagggactgagaattttccaaaaactgattttaaaaatgaagccatgggtgaaagaagtatttaaaacttcaagaaaaattactttaaggaaaatcagaatttcttagtgcatcatattaaaatgctgaaaacaaaaaataaagagaaaatcttacaatcagacagaggggaaaaagatatacaggaatcaccaataagatagatactgtatctcatttctcaaaaggaagattgaatactatagaaaattaaatggcatctttaaagtgctgaaagaaaataactacccacctagaattctatacctaatgaaaatgtcctttaaaaatgaaggcaaaataaaggctctaataattcaaggagcgttctgtaatctctaatgttttaactaaaataatgaaagaatgtataaataataatggggaaatatgaaacaaagaaaaatacttcattaatctaaaaagcataagaaataataagtccatagacaagtgtaacaaacagaaacattacagagttggtaaaacttgaggagaaatagatgaatccactattcaacactactttaacagaaacagacagatacagcatgctaaaaatcagtgcgaacatagttgaattcagcagcaccatcaatcaactggatctgattcatctaaaacgtcatccaacaacagcagaatacacattcttctcaagctcatatggaacactcaccaagatagaccacattctgcgtcataaaatacacttggcaaatttagaagaatcaaaatcatcctatgtctgccctcagaccacaatggaatgaaaactagaaatcaatgacagaaagataacaggaaaaatccccaactacttggaggttgaacaatatacctaataacacatgagtcaaagaagaaatctcaaggtaaactttaaaatattttgaactaaatgaaaataaaaatacgtgttgtcaaaatttgtgagatgcagcaaaagcagtgtttagaggaaaagttgtagcattaaatgcatatgttagaaatgaggaaagatctaaaattaacaatcagctttcagcatggaaaactgaagaagaacaacttaagcctaaagcaaatagaaaaaaaaagaaataagaaaaattaattaaaaataggaaataagtgaagaaaatcgacaaagacaaaagctggttctttgaaaacatcaataaaattgacaaacttctagtcaggctaagaacaaaaaacgggagacacaaattaccaacattagatatgaaagagagtcatcactactgatcacatgaacaacaaaatgatcatttaaaaatactgaaaacaacattatgctcacaattttgaagaactttgatgaaatggaccaattctttgaaagacccaaactaccaaaactcacacaaggaaaaatagatctgaataggcccatatttattagataaattgaatcaataattaatagacttccaaaaagaaagcaccaagctaacctggtttccctggtaaattctatctaacacttttaaaataagtgatattaattctctgtagtctctttcagaaaatagaagcagaggaaacacttcctaattcattatatgaggctaacattatcctaataccaagagcagacattacaataaagggaaactacagactaatatctctcatgaatgtggatgcaaaaattcacaacaaaatattaacaaatcaaatacaataatgtacaaaaagaattatacatcacaaatgagtgagatttatttcaggtatggaaggctggtttaacatttgagagtcagttaatggaacccaccacaccaacaggctgaagaaaaaaatcatatgattatatcaattgatgaagaaaaagcatgacaaaatccaaacccattcatgatgaaaactctcagcaaactaggaattcaacttcataaagcacatctacaaaaacctacagctaacatcatccttgatggtgagaaactgaatgttttctccttaagatcaggaattagaccaagatgtccctctcacaactcctattcaacattatactggaagttctagcttgtgttaaaaaacaagaaaaggaaataaaagacatacaagttgggaaggaaaaaataaaactgtctttttcacaaatgacatgattgtctatttagaaaatcccaagaattaactaaaatttcttggaactaataagtgattttattagtttactaagactgccaataacaaaatacaacagactgggtgagttaaatgacttaaatttattttctcatagttttggaggctagaagttcaaggtcagggtgtcagcaggtttgatttctcctgaggcctctctcctcctcttgcagatggccacatttttgctgtgtcctcacatggccttttctctgtgtatgaaaatccctggtgtctctttctgtttgtctcatcttcttagagggacaccagtcagattgaattagggtccaccctagaggccttattttaacttaatcactttttaaagtccacatctccaaatgcagtcacattctagggtactggggattagggtttcaacatatgaaatttgtggagggacaaattcagtccataatagtgattatattatagcaaggttgcagaatacaaggttgatacaggaaagccaatggctttcttatatactatcaatgaacaattaaaaatacaaatttaaaagcacaatatcatttacaatagtaccaaagaaagaaggaaagacattaattctcaggtagaaatctacaaaaacatatacaggatctatatgcagaaaactataaaactctgatgaaagaaatcaaatcaaatgaaaacaaatggagagatatttcatgtccttggattggaagactcaatgttatttaaaagacaattcactgtaacttgatctatagattcaacataatctccccaaattccagcaagctactttgtgcatatcaacaaactgattctgaagtttatataaaaaagcaaaagacataaaatagccaatacagtattgaagaacagagttgaaggctgacactactgacttcaagacttaatataaagctccagcaaggaagacaccacagtactggtgaaagaatagacacttaggtcagtggaacagaatagacaggccagaagaggactctcacaaatatactatagtcaattctctttgataaagaaccaaagacaattcaatggagtaagggcagtgttttcaacaaatggtgcataacaattggacagccacgtataagaaaacaaatctagactcagatcttacacctttcacaaaaactaactgaaatagatcatggatctcaatgtaaaatacaatattttcagatttccagaaaaaaaaaagcagaaaatcaatgtaaccttgaatttagtgatgagttttaaaatacaagccaaaaagcatgattcatgaaaaaaatttataaattatacttgattaaaattaaaatactatgttctgtgaaaaatactgttaagggaatcaaaagacaaggcacagattgggagaaaatatttgcaaaccacctatgtgatacgggaacttgtatccaaaatacacaagaaactcttaaaaaaacaagaaagcaagtaatgcaattttaaagtgggctaaagatctgaagagacagatcaccaaggaagattcatagaatggcagatagaaagatgcccatcataatttacggctgggcacagcagcaccagctcctcagaaggctgaggcaggagggccccttgaaaccaggagtttgaagctattgtaggctatgatgtgcctgtgaacggccactgcactccagactgggcaacatagtgagagctcatctttaaaataaataaacaaatgaataaataattaatttgtcattagagagttccaagttaaaacaatagcaagatgccactacacacctatgagaatggttaaaatccaaaagcctgacaataccaaatgatgacagagaggcagagcaacaggaactcttgctcatcgctggtgggaatgcagaatggtgcagccactttgaaagacagtttggctgcctcttacagaactaaatatagtcttagtacagaatccatctgctgtgctcctagatacttatccaattgatttgaaaacttatgttcgcataaaaaaatctgcatgtaaatgtttaaagcagatttattcataattgccaaaaactggaagcaactaagattctgttcaacagctgaatgaataaacaagttgtggtacatctatatagtggaatacggaatataattctgcaataaaaagaaatgagtattgagctatgaaaagttgtggaggaatcttaaatgcatactgctaagtgaaagaagccagtatgtttatagcagcatgatttatattcctttgggtatatacccagtaaactatgcaaccataaaaatgatgagttcatgtcctttgtagggtcatggatgaagctggaaaccatcattctcggcaaactatcgcaaggacagaaaaacaaacactgcatgttctcactcataggtgggaattgaacaatgagaacacttggacacaggaaggggaacatcacacaccggggcctgttgtggggtggagggggggagggatagcattaggagatatacctaatgtaaatgacgagttaatgggtgcagcacaccaacatggcacatgtatacatatgtaacaaacctgcacgttgtgcacatgtaccctagaacttaaagtgtaataaaatacatatatatatataaagaagccagtatgcaaaggctacatattatatgattccaattacataatagtctggaaaatgcaaaactgtagagactcgaaagtgatcagtgagttccagggttaaggtggagggtagagggtgaataggtgaactgcaggtaatttttagggcagtaagattattgtaatgtaaaattttagggcagtagaattatttaaatggtggatataagatattgcgttgcattgcctatgcaaccaaaggtgaaccttaatgaatgcaaattttgaaaaattatttaagaggttgggggatcccaagagagaatgcagaccatgagaagagaatctaactgtattacaaatataggaaacactctcactgaagggatgggtcggggaggggaagagaagaatactgaagtattttggaaataagtgaggcttataagattaaaggcaaagggaactgcatgtgagcactgtactctagttgaaaaaattgtttcccatagaggtactggttaacaattctgttattgctatgtatttatactggaatggaacaattacatgaatggatggcagatggtagaagccaggtttctcaccactggagtggctgtttatcaaaaagcaggaggagaaagaatcattcatgcagtgatggatttgagttggagagagcagtgtggactcatatttagctcaatagagaggctgatggttatctatagaagtatttatagatatgcatatatacatgatatagtataaacatgtgtgtttcttgctctgtccctgaaacagcctgaaagaaatgacatcccagtaacagcaaacgtgcacagcaccgtatcttggtttctaatactattctccatttaaacgaaccaggattctttggagaagtggctgtttctaagactgggacaggaaatatccaagatgagcctaaagcatctggtagtgccagaaagtaaggaggtgctcaagaacaaaacaggaccaaacaaaacattgatcagggtctgtcaaaggagcacagatgccagctaaaagagttcccaatggccaaagctggaacactttgcggtaataaagtagtattggattataacctacagtataaagtaaatatgcatggtataaatacatggttaaatatattaataaatgaggaagcagagacaaatctctcttacaaaagaattccatatattttacacaggtactctgtcttcaagaagaaggaatcaaactccccattccttcagtgtgagctgtacataatgacttcctcccaaagtgtacaatatagaaaaggggagaaaaagagtaaatttacagtggaggaccctgacaagcgccactcaggcaggcgaccaaggctaccttccgcactcataaatcatgctgacagtaggtacgcttgatatcacgggatgaaaatagcacttcacctctgtgattttctttccaataacttacaaccccagttttctaatgagaaaaatatcaggcaaattccaaaagtgggacattctacaaaatacctaagcagtcctcagaaccctcaatgcatctaaagaaggaaagtcggagaaactgccacagacagcaggtgcctaaagagacatgacaactaaatctaatgtgggattctggaacagaaggaaaagacattaagtaaagactgaaagaacaaaattatgaacttttgttaataacaggtcattatttgtttcattgtaacaaatgtaagatatcgataataggggaaactggatgtgaagtatattgaaagaattgaacaatgaaaacacttggacacaggaaggggaacatcacataaccagggcctgttgttggcgggggggatggggggagggatagcattaggggatacacctaatgtaaatgaagagttaatggatgcagcacaccaacatggcacatgtatacatatataacaaacctgcacattgtgcacatgtaccctagaacttaaagtataataataataaaaaagaaactctctgtgccatcttctcaacgtttctaaaaatctgaaactgctgtagaaaataaaatctattttaaaaaatttaaataagcaaactgctcactactacacaaaaaaagcaaagattagtctcttgagtataaaattgagcagaagaagccagacacagcctgcaagctccaactccattcataaagagtttgcaaactggcagcgatggcgcgagagcttaggaaattgtttcactgggggaagtggaacagacgttgactggatgatgtcacatgaggggcttctggggtactattaacattcgatctcaaatccaattggtggttatatttttgtttccttaaattaataagtattaatttatgaaaattaattgaaatgacactcataatctgtgcacttttctgtacaattcaataaacttaatgataaaaacaagaatgaatcagaactgtgtatatcaacatggatcaatctaaaaagcaatgttgattaaaaaaatttaaaaatatgtccgggtgcagtggctcatgcctgtcatcccatcactttgggaggccgaggtgggcggatcacctgaggtcaagagtttgagaccagcctgaccaacacggtgaaaccccatctctactaaaaattacaaaaattatcatgcctgtaatcccagcactttgggaggccgaggtgggcggatcacctgaggtcaggagtttgagaccagcctgaccaacatggtgaaaccccgtctctattaaaaaatacaaaaattatcatgcctgtaatcctggcactttgggaggccgaggcgggcagagcacgaggtcaggagtttgagaccagcctggccaacatggtgaaaccctgtccctactaaaaatacaaaaattagccaggcgtggtggcatgggcctgtaatcccagctactcaggaggctgaggcaggtgaattgcttgaacccaagaggcagaggttgcagtgagccaagatctcaccattgcacttcagctctgggcaacagagtaagactctgtctcaaaaaaaaaatacaaaaattagccaggcatggtggcgggcgcctgtaatcccagctactcaggaggctgaggcaggagaatcgcttgaacccgggaggcacagattgcagtgagccaagatcgtgccattgcacttcagcctgggtgacagagcaagactccatctcaaaataaataaatgaacaaataaataaacaaagcaatgttgaatgttaaaaaagtaatttgtcaaataataactaaaatagactactttttttatacgtaccttctgtaaaacaaactatgttcttatttatgggcttacaaaatttagcctaagtatcaaaacacacttgagattataaataccaaattcatgatagcagttatctctgcaaagagaggaaagaaaatgaaattgaggagggggactcacttttttttttttttttgagacagagtctcactctattgcccaggctggagtgcggtcgcatgattgcgactcactgcaagctctgcctcccagattcaagtgattctcctgcctcagcctcccgagtagctgagactacaggcgcacaccaccacacctgtattttttgtagagatggagttttgccttgttagccaagctggtctcgaactcctgacctcaggtgatccacctgctttggtctcccaaagtgctgggattataggcatgagccaccatgcctgaccaacttctacctatactgttgcatgtatatatatttaaaaatccaaaaaacatattgcaaaatgttaagttgtgatacagttgggttcagctacaagggtaaccatgacatttctctataactgcttctagttttgaaatacatatatatgtatacacacacacgagtgtgtgctctataagaacatgtaactaatattgtatagtgcaataacagcctaggagaattaacaagcattttgccatcaatacttatcctttgtgttgctgaggatgaatgaacccatagatcattagtctttgaagccgttggcttcttttaaaagtggttctaactcgaagactaatgacctttgcatttcaccagccccaccttgttaatctcatatctttcaagacatgtacactttgggaggccgaggcgggtggatcatgaggtcaggagatcgagaccatcctggctaacaaggtgaaaccccgtctctactaaaaatacaaaaaattagctgggcgcggtggcgggtgcctgtagtcccagctacttgggaggctgaggcaggagaatggcgtgaacccgggaagcggagcttgcagtgagccgagattacgccactgcagtccgcagtccggcctgggtgacagagagagactccgtctcaaaaaaaaaaaaaaaaaaaaaaaagacatgtaatcccaaagtttccttgaagataaattacatttgctgacaggactctttagaaccactgagaacagtcagatattggaggtcaatgaggaaacaaccccactgctgattcactccatagcatgcactgagcacccacatggtccacatgagatgtgatggggcttgaaccagtctggctgtagaggggaaagaaggagagaaacagatctgagaagcattttgaggcagagctgtcagaagtcaccaaatggctctgaataacatggcggagtccaagaggccagaagaagaatcaagaacagccagggccggtttgagcagctgtgtgaaggctggcaccattaactagggtagaaagcatggtggagaaatggggctggctaagcaaagttgcgggttcaatcaagaagtttgcctttggaatgtgtcatggttgagatgcctttcacaatccaagtctaggcctggtgaggtggctcatgcctgtaattccagcacttcgggaggctgagatgagaggatcgcatcagtccaagaatttgagaccagcctgggcatcatagtgggacctcatctctacaaaaaaacatttaaaaattagctggctgtaatggtaaatgcctgtagtcccagctacttgggaggttgaggtgggaggatggcttgagcctgggaggttgaggctgtagcaagctatgattatgccactgcactccagccatggtgacagagcaagacctcatttcaaaaaaaaaaaaaaaaatccaagtctagatgtgaccaggtatgtggaatctggagctcaaagaggagtcagactggaaagatatacacttggatgtcaccagcatattgatgttgcttcatgccatgggacccaatggggcccccccaccctggaggagggtagttagagaagagaggtctgaggatcaagtcctgggatggttagagtttcatagaggagcaggaacataaataataaaggccaaccacataaggaaaacaaaagctatatattcagggtatactgtaacaagggagtcgtcaccatcacttacattttggtagagactccaaggcaagagtgggaaagtttgacagtgatgttaaccaaaaactgacagaggcaggtgtctcaattgatagcggtttatttcgccaaggctgagaatgtgcctgggaaaaactcgagtcacaggaacatctatgacctgtgctttccaaagagggttttgggaattcagtgtcgaaaaggcaaagaacagacaggagggaaaaaagcgagggagggtgggcagtgaggcaaatggtaacattattgtgaggttctgattaacgctcagtaaattggcattttacataaaataaagcaaacacgtgaaaagaggaagtatggggaaaagtcaatgatgcatttatctcagggtggatgaagggatgatttctggtcttgtccttgtcctcttacctgtgaagataaacttgtaattgacattgttagggtgagattgaacagaactcagtttcggggctagcttataggggggatatgtatcctataagatttagggctcacacagaatttccttgtgagcaatttgtgaagaaggccatctggggagatatgtggcctcctatctttgtgggaacctggcttatgtatgacgttatgacacagggttttgaaattacagctatttgagaacaaaagaaaggcagtattgcatgactcagttcccaagcttaactttccctttggcatagtgagtttagggtcctgcgattttgttttctttcacagtggaaaggaagggaaggctgcaggtgcaccctgatgggagtctgttggcatggcgaagccctaggtgagctaattaggggcagggtgtcccatggaattggctagggatgcatatttggttttctctggttggtcctaaaattaaagtgaagacaaaaattaggggagctgtcagttattaatcaagtcctggtcattgtgggccaactgttatggatattattatttaacttcctgaattgttactagagatagcagtccggctttctatgagtctgacttatagcaggctggcttccggttgtttattgtagataaaggggttgggttcctggcaggtagctgcaagctgtgagtcatagttctatttatatatcatgtggccattgtccatttgtatatttagtctcttgggagaaaaaagccgaaaaggagattgaaaggagcagctagagagaggagggaaactaagacaatatcatcatcccagaacttaggaagataaagtcccaacaagaaaggggtggttcactgaagcaaatgctgctaaaatgtctgataagatgaggatgtcaaagtaggtgaagcttttccaggtgaaaaagagacgtagccatcattgttgctgaattctcagacacaggaaacattttcctgtggcttcaggcaatggtgaaataggaactaacagggtcagctaggaagagaaacttttaatgcctctagggggcacagcatatcatacctaacaactgagcagcaaataccgtcccctactctccagacgcattttccagcccaacatgggattcttagattggttagatggcagcatctgagaccacaattaacctgaaatccaagctcaggcacttgcagctccaaagcctcacactcgatgctccgagtttagggacttctatcaagtaaattgggaaatgggtcgttctcctttgaagactgttaggaaagagggacaaaaacggaaaaaaaaaaaaatcaatccctgagtttaatctccagtattccttcccagaaactttaagttagctacaagaatgttaatcatgagcagaaattgtttaataatcaaattatcataaatttgcttttcttttaccttagtaaggtaactatgtgacaaacatttgtgaagttgagaatagataaaagtacccatcatatgatctagccatcccactgttggacatatacccaaaagaaaggaaatcaatatcttgaggagatatctgcacttccatgttttttgcagcactgtttacgatagttaagatttggaagcaacctaagtgtccatcaacagatgaatggataaagaaaatgtgatacatccacacaatgcagtactattcaccccttaaaaagactgagatcctgtcatttacaacaacatggatggacatggaagacatcatgttaagtgaaataagccaggcacagaaagacaaacattgcatgttctcacttatttgtgagatctaaaaatcaaaataattgaacacatggatatagagagtagaaggatagttatcagaggctgggaaagctattcgggggctggtgggtgggtggggagagatggggatggttaatgcatgcaaaaaataactagaaagaatgaagaagacctactgtttgagaacacaacagggtgcctatagtcaataagaagttaattgtacacttaaaataactaaaagagtatacttggattgtttgcgacacaaaggataaatgcttgagggggtgaatacccctttcttatgatgtgcttatttcacattgcatgcttgcatcaaaacatctcaggttctccataaatatatacacctattatgtacaaaaattaaaattatttttaaaaagtgccaagaaactctgtaccctaacatagccctgttagaattacttagcactaatagttgcctttgctgagtgatgcaagcagatgtctctggccctcaaagatgaggagacactgctgctctgcttggtgtgaacataaactccagttcttctgggaactgccttaaagacagcagaaactggagagcagagaaaagtggaaagtggccaggcacggtggctcacacctgtaatcccagtactttggtaggccgaggcaggcagatcatgaggtcaggagttcgagaccagcctgaccaacatggtgaaaccccgtctctactaaaaatacaaacattagccagatgtggtggtaggtgcctctaatcccagctacttgagaggctgaggcaggagaattgcttgaacctggaaggctgaggtcagtgagccgagatcttgccactgcactccagcttgggcaacaagagcaaaactccttttcaaaaaaaaaaaaaagtggaaagcataaccttgcttgatggtgaggttgaatccccaccttcgcctttctcagatttattcccatcttcctactcctccaacccctatgttggctcaagcccagatggctctcacctgcattaacctaaccatctcgtaacccatctcctctctttgttcctttcctatgcaccctccacatggccagctgccagaggatctttcaaaatgactaatcttactattcttctcctctacaaagcttcagaggcttccagtctggactccttaacaacacataaaaaattcctcttctgttcttcctctggctggtggctctcaaccttggctgcacttgaggatcctggggagctttaaaaactgccctgctctggtttagtcagtctgggctgggtcccaggtgtctagagttttagttttgtttcccaggacctggtgactccttgaactatttgcagattcctgaacccctgtcggagagtaagctgtgttctaatctcatcagatctaaggagagatgtaggaacttgccttgaggcttgaattctttctcctactctccacttgtggtagtcagtcttttgcatttaagggtcaaaaataagaaggcctattgtgtttccaaggctggggtccatagtgcatacgataggtttcagagggagagatggcagtggagatggggaaagaaaatgtggaaacctgagtctaggatgttgcttgctaagtgtactagaatatgccaccccaaatatgcctctttggcatataattattttgagctgaaggctattgagaaccagcagatgcacgaaaggtctaaaaacagagtctaagttttccttttgtaaaggattgtagaggtgtctccttctcccaggaagaagactcttaactactcatcagaggagaaagggcagacttaattctgcacaacaaatcttactaaacacctcttgtttaccatccttttcctggttaacttctcataagttgcctcccctacacagaagccccaaccccttcttttttgttttagcctaagatggtatttaacccccagtctaaccacccctttgggttactcacctcttagtgttcctgtgtgtacacagacaacgaacttgtaagtagacttgtttttctcttgttaatcagtctttggccagtctaacttataaggtttcagttggaaaacctaagatgggtagaggaaaagattcccctgcaacacacttatattatgaaaccaaactggataccaagcaaggaggatcgggcatctaacacttaactcctgacctccacaatagcttgcaggtaagggtttttttttttttaatatatatatgtatttttatttaagttctagggtacatgtgcacaatgggcaggtttgttacatatgtatacatgtgccatgttggtgtgctgcacccattaactcgtcattttttttgttttgctttttgttttgttctgttttttttgagacggagtctcgctctgtcgccaaggctggagggcagtggcacaatcttggctcactttaagctccacctcctgggttcaagtgattcttctgcctcagcctcctgaatagctgggacttcaggtgcctgccaccacacccggctaatttttgtatttttagtagagacggggtttaaccatgttggccaggatggtctcaaactcctgacctcaggcaatccacccgcctcggcctcccaaagtgctgtgattataggcataagccactgtgcccggccacaggtaagggttttaaaggcaggaggcagaggttacaggcaaaataagaaatcatggaggttatacattggtttaacctagaaaggtggaacatcttgaagtgggcccacaggtcataggtgaggcaaagctttgtctaaaactgtgggatcagtagaaaagaatgtcagctctggctcatgggtgtgacttcctccaggctccccagggagaaatttagaacaaagaatggcagtcagaattcagtcctcaattcctctttatctgaagtctatgtgtcagtggatccatttggtggatccattggtgggggtccaggtttctgaaacaactctgggacatatgttaatggcacaggacttttttggggtgccacttcaccagccagagacctctgcagctggctgcacccctgcctgggcctcactcagctctgagctggcctctggccttgctccatccagttggcccagcaggctgcacccagctcaccctaccagccaccacaggtgagccaggtgtggagtggcaagtttgcagggtccagttactgtgcacagtcaggtgcatcagctgctgcaatggaatgagcagctccaggtgctggcatccagactaggggaacacagtggcacccaaaaacttggagatgccagcacctgtgaagccccaaagggggtgttacatcatgtcacagcactggctccagaagctctgaggtctagatgtccagaagggttgcagctcttttctccttcccgccactcacagtgcagaaaatgggggtatgttaacagctcattcagtcctgctgccctgctctagcttgtggctcctgggaaggcccggccctgctgccatttcccatcacgtgggacggatgcccagcactggcggagggtgggagggctacagtgttacagcagctacttttgcacccactgtttggtgggtcctgggttcttgtcccatgtccatgaagaatgagattatgctgacaactggagagtgagcaaggcagagaagagctttattgagcaacaaaacagctctcagcagagaggggagctgaaggtaggtagtctcaatgtgtggctgagtctctccagtttttatgggctcagaatgtgggaggtgtcagctatccatagccttggaaaaggcaacacttgattggttaaaaagcattattcagaaagaaccaattgggaaagagcaggcaaatgaaaatagaagttctcattctggtcatggactccatccagaactgacagcctggttttcaggcttcaggctgtctttggcttggaggttgggtttcatgggggacccaccccaatctgcctgggaatttgtctgtctcctgctgctatctttaagatgctatctttggctgggcatggtggcttacgactgtaatctcaatactttgggagactgtggtaggcagattgctcgagcctagtagtttgaccagtgtgggcaacatgacgaaaccctgcctctacaaaaaaaaaaaaaaatacaaaaattaacaagttgtggtggcatgtgcctgtggtcccagctactgacagagctgagatgggaggattgcttgagccctcagatcaaggatgcagtgagtcatgattgcaccactgcactccagcctgggcaacagagtgagaccctgtctcaaaacaaaacaaaatcaaacaaacaaaaaaagatgttatctttagtttttacagggagccaaacatcccatgattctcacttccatgattattgttttaagctactattactctcttgcttatcaagttgttcatttacttctcaggctagctaggtgcctggaatttccctttaagaaactcaagattttttaattcctctgtttggtgctggggagaccaggcccctaagaggggtccctgctccatctcatttgtaagagcttatgagacagccgctccagggctggccagtagctcaggaggaggaagagtcagtggcagggaaagggaggtccagctcgcctgggagataggagctcttccagcactgggctgggaaaccattctctggcagccctgccactcagtggaccctcaacttctccttaatttcctaggcagtataagggtaagtacaagtaaaaagaaattgaattttccctggtgccaaaaggcaaagagaagtccctccctcccttttcttagagtatttcctttataatcctttctctgtctctttgggaggtatataaacctttctgaaagctaaacaagccctttgccactttggcttcccaggaatgtgcttctcgggggcctcggagccatctctttgaaatgtgaacattaagatggatggtgccctgtctcctgtctctctgggagctttgcctaggagtctggctacaagttgtagcatatgagagttttcttcttcctttggatgagtgcaattaacacatatgtaatagattctatctgcctggctatgtaagagggtgatacattttttctgtctttgcaatttctttagtggattgcttttgatgtgtgttgcaatctggtttaatgcatatgtaataataacactttttttcatttcgtatatttttggacaggttttctagattggcagattttattttaaatttccgcaacagcagcaagtcctagcatacctcaacatcatcccaggaacaccccacccttggggaggaaatatgccagagataggaagggccacttctaaatacaagagagtcatcaggcacctgtcaggagggagagtatccagtctctagagatggaaatgtcaacctaaaaggaagaagcaaaggcagaattaatatagagagtttatttgggccaaggttgagagctgcagccatggatgcacttccaagttgccttggggagtgctctggaggacaaagaagagcctcaagtttttaaagaaaaaaggaagaatcatgagagaagcaattacgaaagctgctcatcaggaattttcattagtttacagaaataacattggttagtgattggctatacattgttgcaacttggcattcatctgcagcccacatagcaagtggcttcaagaggtcattattcagttccagggagagtgagacctgattgtggtcacattttaaatgcctttctgggcctgatgatttaaagggctcacattcctcagataaaggttttttttctttctcagattgaagtattctggtgcactcagcctttggacagaaaggagtggagattctcattacatatgggtgcttgccttagttgttttaaatttatgtgcaaccaggctgtttctcccatataaaagcacccctaaacggctgggcgcggtggctcactcctgtaatcccagcactttgggaggctgaggtgggtggatcacaaggtcaggagttcgagaccagcctggccaacatagtgtaaccccgtctctgctaaaaacacacacacacacacacacataaaaattagctgggagtggtggtgggtgcctgtaatcccagctactacggaggctgaggcaggcgaattgcttgaacctgtgaggtggaggttgcagggagccgagactgtgccactgcactccagccagggcaatagtccgagactccatcttaaaaaaaaaaaaaaaaaaaaaaaaaaggcacccctaacaagagccaacagtctctgttgagaccttcctacccttcaagagaacaccaaattggttgatgaacatagtggagaggaacggggatctccatcattgggaccaagagaggctgtgaaacatgataaacgctggtctagaacagtatggagaggcacatgtagtagcgggttcaactagcaaagagaagacagcgtcctttgcaattttatgtgagtccttccaatcagatgaccttacagaggttttaagtttaggttttgttttttttttgaatttgtgatgactttttggagtttggctcaactgtcttgtagaacatccctcattctagctttgtcagacagcttcgtcagggcctccttgacttgtccttctctcctctgtatttcctgtaactggatgtggatctaaaggctgaactgggctcatgagaagaatccttcacaggtgtgatggttaatactgagtgtcaacccgattggattgaaggatacaaagtattgatcctgggtttgtttgtgaggttgttgccaaaggagattaacgtctgagtcagaagggtgggaaaggcagacccactcttaatctgggtgggcaccattagctgctagtgcagctagaatataagcaggcagaaaatgtgaaaagagactgtcccagcctcccagcctacatctttgtctcgtgctggatgcttcctgccctcaaacatcggactacaagttcttcagtttggatctccctgctctcagagactggctctccttgctcctcagcctgcagatagcttattgtgggaccttgtgattatgtgagttaatacttaataaactcatatatatatattcattccattagttctgcccctctagagaaccctaactaatacaacagatggatcccatcaggacacatgatgacagcccatccctgctggcattgctcactttgataatttagggaaggtgacagtcaccgtatctttcatagtaaacgtgcattttccttctcaaaattagtaaatactgtaatttgttgaattatactttgacatcctgttcctcaacaacctttcacccaataaggtttggcatccactgaaggtgcttccctgaatctatttcttctttgagggttgcaataaatgtatatcttttttctacatttattggaggaagtcttccctaaagaagagttctcttttctctctctgttcctttttctttttttttgagtatcactgtgaattcatggatttctttataactcaatgtcaactgccatcattattatttctgatacttaatctcaatttggccggtgggaccctcttcaagctgcctctgctgttcgtttgacatgatcccattagtccgtgatttccttattttctggtacaataaggtgtcctaggctcaacttgtaatttacctgcttttgacttgtaatcagccggttcaatgaggatccctggttccctttcctggggaatggtacttagataccaagttcaaggcatgaggtgtgcccattgctattacaatgttatgacttctaggctctttgactgaaattaattacagacacacacatacatacgtgtacttatgaattcacactgacatttcttgtttttttttatttcaatagtttttggggaactggtcatgtttggttacttggataagttctttagtggtgatttctgatgttttggtgaacctgtcacccaagcagtgtacactgtacccaatgtgtagcctttttttccctcaaccccctcccacccttccccctgagtccccaaagtccattatatcattcttatgcctttgcgtcctcatagcttagctcccacttataagtgagaacatacaatgtttggttttctattcttgagttacttcactttgaataatggtctccaactccatccaggttactgttgctgtgaatgccattattttgttccttcttaaggctgagtggtattccatggtgtatatatgccacattttctttgtccactcattggttgatgggcatttaggctggttccatatttttgtaattgtgaattttgctgctataaacatgcatgtgtaagtgtcttttttgtataatgacttcttttcctctgagtaggtccccagtagtggaactgttggatcaaatggtagttctacttttagtttttaaaggaatttccgcactgttttccatagtggttgcagtagtttgcattcctaccagcagtgtaagtgttccttttcaccacatctatgccaacatctgttatttttttattttttaattatggccattcttgcaggagtaacgtggttctcattgtggtttcgatttgcatttccctgataattagcgatgtcaagctttttttatatgtttattggccatttgtatttcttcttttgagaattgtgtattcatttcctttgcccacttttttgagggtattattttttgttttgttttgttttgttgctgatttgagttccttgtagattctggatattagttctttgttggatgaatagtttatgaagattttctccccctctgtgggttgtctgtttactctgctgattgtttcttttgttgtgcagaagctatttagtttaattaggtcccatatatttatctttgtctttgttacatttgcttttgggttcttggtcatgaacactttgcctaagccaatgtctagaagagttttgccaatgttatcttctagaattgttatggtttcaggtcttagttttaagtctttgatccatcttgagttgatttttgtataaggagacagatgaggatccagtttcattcttttacatgtggcttgccaattatcccagcaccatttgttgaacagggtgtcctttccccactttatgtttttgtttgctttgtcgaagatccataggctgtaaatatttggctttatttctgggttctctattctgttctactggtctacatgactatttttatacaagtaccatgctgttttggtaactatacccttatagtatagtttgaagtcaggtaatatgatacctccagatttgttctttttgcttagtcttgtttcagctatgtgggctctttttttgttccatatgaattttaggatttttttttctagttctgtgaagaatgatgatggtattttgatgggaattgcattgaatttgtagattgcttttggcagtctggtcatttgcacaatattgattctacccatccatcaacatgagatgtgttttcatttgtttgtgttgtctaagatttctttcagcagtgttttgtagttttccttgtagagatctttcacctccttggttaggtatattcctaagtactttattattattattattgcagcttttgtaaaaggggttgagttcttgatttgattctcagcttggtcattgttggtatatagcagtgttactgatttgtgtacattgattttgtattccgaaactttactgaattcatttatcagatctagaagctttctggatgagtctttagggttttctaggtatacaatcatatcactggtgaacagcagtttgacttcctctttattgatttagatgccctttatttctttttcttgtcttactgctctgtctaggacttccagtactatgttgaatagaagtggtgaaagtaggcatccttgtcttgttccaattctcagggggaatgatttcaacttttccctattcagtataatgttggctgtgggtttgtcatagacggcttttattaccttaaggtgtgtcccttctatgccaattttgctgagggttttaatcataaaaagatgctggattttgtcaaatgcttttcctgcatctattgagatgatcacatgattttagtttttaattctgtttatgtgatgtatcacatttattgactcatgtatgttaaaccatccttgcatcccttgtatgaaacccacttgatcatggtgtttatctttatacatgatgatatatctttatatcttaatacactacttgatcatggtgtattatcttttttgatatgctgttggattcggttagctaatattttgttgaggatttttgcacctatgttcatcagggatattggtctgtagtttttctttttgttatgtcctttcctagttttggcattaggatgatactggtttcacagaatgatttaaggatgagtccctctttctctatcttttggaatagtttcagtaagattggtaccaattctttgaatagctgatagaatttagctgtgaatccatctggtcctggacttttttttttgttgggaatttttgtattattgtttttatcttgctacttgttattggtctgttcaaagtttctgtttattcctgatttaatataggagggttgtatatttccaggaatttatccattcttctacattttctagtttgtgtgtgtaaaggtattcatagtagccttgcatgatcttttgtatttctgtggtgtcagttgtaatagcttctgttttgtttctaattgagcttatttggatcttctctctccttttcttggttaatctcgctaatggtctatcaattttgtttatcttttcaaagaatcatcttttttgtttcacttatctttttgttaatgttgttgtttacatttcatttagttctgctatgatctttgttatttcttttcttctgctgggtttgagtttagtttgttcttgtttctctagttccttgagggtgtgaccttagattgtctatttgtgctctttcagacattttcatgtaggcatttaatgctatgaaatttttcttagcactgctttttctgtatcccagaggttcagctcaaatacttttttttttcttttttagatggagtctcactctgtggcccaggctggagtgcagtggctcatctcggctcagtgcaagctccgcctcccaggttcacaccattctcctgcctcagcttcctgagtagctgagactacaggcgcctgccaccactcccgtctaattttttctatttttagtagagacagggtttcaccgtgttagccaggatggtcttgatctcctgacctcgtgatccacccgccttggcctcccaaagtgctgggattacaggagtgagccaccacacctgacccagttcaaatactgtttaaatttctgtcttgatttcatggttgacccaaaggtcattcaggagcagattacttaatttccatgtatttgtgtagttttgagggttccttttggagttcatttccagttttattccacacggtctgaaagggtagttggtataatttcagttttcttaaatttattgagatgttttttgtggcctatcatatggtctatcttggagaatattccatgtgctgacgaaaagaatgtttattctgcagttgttgagtagaatgttctgtaaatatctgttaagtccatttgttctagggtatagtttaagttcattgtttctttgttgacttcctgtcttgatgatccatctagtgctgtcagtggagtattgaaatcccccactattatcatgttgccatctatctaatttcttaggtctggtaataattgttttagaaatttgagagctccagtgttgggtgcatatatatttaggattgtgatattttcctgttgcagcaatccttttatcattatataatgtccccctttgtctttttaaattgttgttgtgttaaagtctgttttgtctgatataagaatagctactcctgcttgcttttggtgtccatttgcatggagtatctgtttccattcctttaccttaagtttatgtgagtccttatgtgtctggtgagtctcttgaagatggcagatacttggttgatggatttttatctattcttccattctgtatcttttaagtggagcatttaagccatttacattcaactttagtgctgagatgtgaggtactgttctattcattgtgctagttgttgcctgaataacttttctgttgttgttgttgtttgttttttctatttgtattgttttataggccctgtgagatttatgctttaaggaagttctatcttggtgtattttgaggtttcgtttaaagatttagaactccttttagcatttcttgtggtgctggcttgggagtggcaaattatctcagcatttatttgtctgaaaaagactttatctctctttcatttatgaagcttaattttcctggatacaaaattcttggttaacaattattttgtttgaggaggctaaagataagaccccaattccttcttgcttatagggtttctgctgagaaatctgctgttaatctgataggttttcctttataggttacttgatgcttttgcctcacagctcttaagagtctttccttcatcttgactttagataatctgatgactacatgcctagatgatgatctatttgcaatgaatttcccaggtattctttgagcttgtttgatatctaggtctctagcaaggccagggaagttttcctcaattgttccctcaaataagttccacacttttagatttctctttttactcaagaacaccaattattcttaggtttggcagtttaacataatcccaaatttcttgggggctttgttcattttttaaattctttttttttcttttttttggtttttatctgattgggttcattcaaaagtcttgccttcgagctctgaagttctttcgtctgcttgttctaatctattgttgacactttccagtgcattttatctttctctaagtgtgtcttccatttccagaaattatgactgttttttctttatgatatctatttatctggagaattttcatccatatcctgtattgtctttttaatttctttaagttcattttcacctttttctggtatctccttgagtagcttaataaccaaccttctgaattctttatctggcaatttagatttcttctgggtttggatgcattgctgggaagctagtgtgatctttcaggggtgttatagaaccttgttttgtcatattaccagaattaattttcagattccttctcatttggtcagctttgagctcaccaaagagaatatttcaatggaaagatctggaactcaagggctgctgttcacattcttttgtcccacaggtgacccttgatgtggtgctctcccccttcccctagggatggggcttcctgggagccagactgcagtaattgtaattgttcttctgggtctagccacccagtggggttaccaggctctgggctggtgctgcggaatgtctgcaaagagtcctgtgacgtgatccattttcaggtctcctagccatagctaccagcacctgctctcgtggaggtggccagggaatgaagtagactctctgagagcctttggttgtagatatctttagtgtgacggctttctcaaatgcttgttatgttaacagtgaagttgtcacatggacagattcaagacctctggttagccaggatgttgcaggcagtggaattagctgttgttttctctttccttgaagcagggttattccgtcatgagttgttgtaatgtcctgagctgcttggcctccagccaagagatggtgctttcaagagaacaccagctgcagtagtagtagagggatctaagcttgcccgaatttggccaggattagtatttgggtttctcaggtgatgggtggggccataaagctccccaaaatttatgtcttttgtgatcaactaccagggcaggtagagaaatatccatcatgtgggggcagagtttggcatgtctgggctcagactctccttgagcaaggcttgccacagccactgtcgggggtgagaatgtggttctcaggccaatggggctatgttccaaggggtattatggctgcgtctgttgcattatataggtcaccagggaagtaggggaaagcaataggcctcacccagctcccacacagttggtggggccgatcttgctccttctgtatcccactaacagcaccaagtttatctctgggcagcttatgctctggactcagaccttgccccaggctataagcttccctgctgagaaagcaagcacagctttcgggccttgcccttccctgtctgcccatcctgttggccacagctttgcactcctatctgtagcagttcccttttgccctccggattctgttcaagagaatttgcacccagttgaaattattacaaagctcacttggaagcttctttcaccctgtggcccctgctaattctactggctgcctctctcaaggacccctgtgagatagagtcagagatggcttccccgggctaaagctggagcatgggaatgtctacaaggctcttcccactgctgcttctacttttatagaaaatattttgtactaaatccatttcagctgtagatacggttaaatccttctcctgtaatctggattttcaggttccccattggggatatgtgcttggaggcaggttttctccctctcacactttgggaatgcacagttttttgcctgtcttgtggaatttgcagcggtgtgccacttctttaaaaggatcagtgaattattttggttttcctggtacgttcctgtggtcgttcttagaacaaaagttcatgctttgtgtctccacatactcctctgtctgtccattcaagtgggagctgaacagtagccctgtctcctatctgtcatcttcctcttaaaacctggcaatttatttttattttttatagagacaaggtctcacaatgttgcccaggttggtcttgaactcctgggctcaagcttcccaaagacaccgatatttataatttaaatttaacattactgaattattatttaactttattttatttaataattgtatctattttccccttcaaaggaaattatgtttcctaaaaacatgtttgtataacatacatatatatacacatacatatgattaatatatatacacacagtactttcttgttctatccaaaaacattcacatagcagtctcaaaatgataataatagctttgttacaaacaataaatccagtaagggcaaagcttatttgtaacactttctgttcccagagagtatccaactaaggctgtgcagcccaagtgccacgtttgacagtttcttaaaatgattctttttgccatgttatcagtttgatatatagttggcctcatttctttgtgtgtacaattttggactgctttctctgatcttttttatttcatttatgttttgcataatgtaaaacacttacatggttcaaaagtcaaaactatttttgaaagtacagagaattctttcttccagccctatccctctacaccattcctacccacttgtatggttaatcatttttattggtttttggcttatctttccagtgtttctttacaataagcaaatatgtatatgtacacacatatataatcttatttttcaaaaaataacaccatatatgcactgtctgtatttggccttttctactaacaatatatcttggatattattccatagtggttaatggcaggcattttttattcttctttcttatggctgcatagcacttcactatgtgactctaccataattcactcaaattcatttcaaccagtttcccattggtggacacctgaaaaactcctatctctcgatatttggttagttgcctcaactgcatgccaacttctgctttggagtggataaggaaggtaagacctttggggacaagactcaagactcagccacttttgtcccaaagctacaggacttgttctgcctgccaatgctgtctctttcttcagcaaaagtgggattaagcgtgtgtataatgccaggtatgaagctgcactgctatgcaagttggacttctcaatcagcataaaagagctgaccattggaaccatccgaaatctcatgaagagggttgagggactctacttatgtacattttacagcagagagtaggaccgggtaagtcaaggttatccactatagtaagttactgctcaaaggaaaactgatagaaaaagggtctccaccttcttaaacacagaagcagtctgcttcaggcagaagatgacaggcaactcttctagtagaacttgaggtatacattcatggctccattgagaatggagatggggtttcaagcatggaagtggggacagtgacccatcagtctgagaagacacttttatgcccacatctcaagcattgctattattttagaagtagatgctcagttgtctgataaagagtatgatatcatccctattggttttaggacctagaaatagatttgcaggaccctaagggcaggatagaggtggatgagaaggtttatagtttttgggtccaagaggtggtggttggttagcgtatgggagaagaaccagcagaacctgagggtgtaagggttgatagacaaaacaaagctctaagtacatgggccccaggccagcgcccagaaacaagcccagacacaagaacccagccccatactatgatctcacccctagcaggcccccattcactctgcagctgaatgtccaggacttctgcaggttaaagaatgacatctgctaatctccagtcaaggtgcacctcagctacactctggactgtagtaacaatgtgcaccattgtctgtatgccctggggaatcactagactccaaggtgggctttgaacttggtgttgtcaccaaccagtgggtggggacctgggagtcccataccttagtgtaggaatgttgatgtcatgggtattggggacagaggagatggactgcattcatgcatgcttttgctgttgtgccagctctctaaaataccttgccttttttggtctatgtatcagagacctttccatctgtcaacaatcaacattagcatcaccttgctaatagagcttttcttgggccccctttggtagaagggtagtctactccttccttttggttcctaatccagtcctgactggattataaggacttcaattcatctctataactagtatttagcactgtgtcaggcacctagctggtactcagtaactgttcagagaatgagtgaataaatgaatgaatgattccaacagatgaaggaactggcctgaaaatgacttgcctatttgccaaattcacccagctttttagtttctcaccttctgacaccaatcaggaataaaagccaaaacctagattggcttttcatcccaagacatgtcctgtcctttatatgggtgtggacttacgttagagcccttgtcattcctaataattccctcttgtgcctacctggatggagctcaccttgggctatgattaggagagcctatctccagcacctgcactcactcacctgactccacctgatgacttgacctatttgttcctccatcagtcaacatgagtgcattggagacttactgtccgttgttctctgtggacacatgtgaagtgcaaagacatgctaaggcaactggcctgagcctgtaattcagccaaggctggtaatgacacatgatcagaggtcacaacactctttttaagtcacagcagtttcccttaagcatggctttagagtctctgagctcaccatgacttctattagagatagcataagcctacagtgctttccctactctttgttctcattcaccactcagcaccacacttttggcaccagatagatggggatttttcccacacgtatcagtaaagcaattctgcagcacacaccaatgaggtgtcctgcaattcaattcaattctgatgctaactacccaaagatgtcatcaaatcccacagggtgagggcttagtcctataagactctccccaaccttgcacaccaattgcaagccctaggatgtgacctgtgcctttgaccaaccagctacaaattgaggttcctacaaccccctccttgggttcaattaatttgttagagcagctcacagaattcagggaaacactttgcttatgtttatcccttatgataagggacattacaaagggtaaaataaacagccagctgaaagggaggcacaggatgaggtatgtgggaagggctgagaagctcccatgccctcctagggaccaccctccaggaagctccacatgttcagctgtccagagctcccaaaactcagcccttttgggtttttatggaagcttcattatataggcatgactgactacatcatgggccattggtgatcagcttaactttcagcctctctccccaccctggagtttggaagtggggctgtaagtcctaaccctctaatcatgccttggtctatggacgaccagttcccatcctgaagttacctagaggactcatccacccattactcattagcatacaaaagacactcatcactctggagacttcaactgtatatcaggaaacatggatgaagaccaaatatgtatttcacaatattatagctgccatcagccatgggtgagtttctcatcattcaaagtttccttcttttttagaaaccacctgttttactctaaacaaagtagattcttatgaaaggtaggctgtttgggggtccagaatttcaacatatgccaccaaacccttttcttccctctgaatttttggaggcgcacctcaccttgtgaatttgtagcaccccaaaccagtaagcacacacattcaaatacatgtacatgcccacagctacccactagtaagcaccatcccccatgtccggtcacacagatgtgagaagatggagaaatgttcacctaaacagctggtgtgtgaagtcctgcctctgtcagctgagctcacatgggaaagatccccagtccctaggccccacatcaatgggcacagggccttcggaggaaaggacaaccactccgtcgtggagggagaacactttggactcgggtgtgtgtttgagggattccagagggtagaggttgaggaagaggagttgggagagtgagaaggtaggatgttgcacaggatgagacccttcctctcaaaccaaacctaatagccaataagtacaggaaaagatccttgacatctctagtgatcagggaaatgcaaatccaaaccccaataagaaaccacttcatactctccagggtggccagaatacaaaaggctgagaacaagtattgggaggatgtggagagatcagaacactcctacgctgctggtggcaatgtaaaacggtacagctgccttggaaaacaggtccccaaatgttaaacacagagctatcacaggactcagcaattccactcctacatatataccctgagagaaatgaaagtacatgtccacatggacacttggacacaaatgtgcatagcagcattattcatagtagccaaaacccaaatgttcatcaactgatgaatgaactgacacaatgtggtctatccagacaatggaatattagtcatgaaaagggatgaagtacttatacttgatataccatggatgaacctcaagtatgttaggctaagtgaaagaagccagtcacaaaagacctcctgttatgtgattcattcatatgaaagtccagaatagggaaatctatagaaacagaaagaagattagtgggaacttagggctcagcttgcgaggtgggggcaggggcaggaagatgggaggtgacagctaaagggtttggagttttgtttggaggtgatgaaaatgttctaaaactgaccgaagtgatggttgcacatatctgtgaatagaccaaaaaccattgatcatacacattaaatgggcgaattgtatacatgcaagttatatctcagttaaggcattaagaactaaacaaaaactaagaacacagatcttctgtctttcctatttatttatttattttgagacagagtcttgctctgtcacccaggctggagtgcaatggcgtgatctcggctcactgcaacctccgcctcctgggttcaagcaattcttctgcctcagcctcccaagtagctgggattacaggcacccgacaccacacccgactaatcttttgtatttttagtagagatggggtttcaccatgttggccaggctggtctggaactcctgacctcaggtgatccacttgcctcggcctcccaaagaactgagattacaggcgcgagccaccacgcctgaccaccttgatcacctttttttttttggaaagcaatgagggagcaacactttgttacctgggaggcgtggaccaaaagagaggcagaggctggagggagagtgtgaggcagggatcaatgggcatcatgccaggcttagggcatccccaaagctgtgggattggggcttgaagcccaggtcttagagacctgagcaggcccagctgacacaggctgcaaacaaatgtcctctcatcctcaccgcaatccctacaagctgctcacctcctgttgccatgtggatgtgtcctgagtggcccacgcagatttctacacttgatcccctcgcttgaaataaaaggagataaagtgagtacaaacacccttatgcattactgtagctcaaacgaggccagactagatcctaaagaagacctggcgtgggccatcttctagagtcatcccacctcccaggacaagcaaaggtcctgcctccaagtcattgcaacttatatgacacagcaaggcaatatagactctgggggaaaaagttttttaactacagtatttttaaaatagaacattattttgaaattacttcgacatctactgtcaggtgacttgtaaaagcgcttgtatgttaaatgctctacattaggagattattttgttcttgagtccctacagagaattccttgggaatgaagtgctattgtgcattcagaattatgtggctatagccatattgcaggccgggaactcaggaatgtcccctctgtcccagctcttcaagttgggccctacagatcccacggggacaagcttttggaaaattgctgggtttctagaccaatcacgtctttgaaatgtcttcttgtcactccgtggtttcttgcttcagcttaaccccactggccccatagatcaggcagctcacaatttgaacacagccagggggcatggaggatgagaaccaatctatcctgacaatcctggcagcacgtggggaaagccaggcccaagtttccatatgtgaacacattacattgtctccaccaagaaaagagcccctgtgaaatattcatgtgcgtcacccactttgccttaggttccattacctaagggacagacctggtgttgctcaacagtgccaggcttagcactgccaggggagatctgcagctacaaagagttaaagaagaaggaattgaattgagttataagcaatacatctaataaatatttattgagtgactatttcattccaagcattctgctaggtgctgagaaatcagaaacaaatacattgaactcattggcaaactagctggggagatgggcagggaagccaactgttgcagtctggtgagagttgtgctggggaatgcagtggctttgcaggagcccggagcagagacatgtagttctgcttggtgggattgagcagatgtcaggcaaagcttcccaaaggacacgatgctcaagaagggtcctgaagaatgatttgaagctggaaagtcagaggaaagcatcgaaggtgaaggcacagaggtaggggacgcatggcacacccagagaactgcagacgccctgtcatgcctgcagtcttcacgggaggtgagaaagaatttccagggtacatggatgcatgttaggaggctgagactggtcttcgaagatgatcagacataggcttgaagacttgatgctttcaaaagctcgctctgacagtagcgtagagaaggaatgggggaagctttgcttataataaagtgagaaatgatgggggctgaattaagagaatggctctgggggtggagtatgagagtatttcctaaagatagaagagagaatggccaggacttgagagtggctgaagtcgggtacagggagacaggagacaccttttatggccatagcttgagtcactgtgtggacaggcgtgctcatcattgagaccaggaagcttggaggggaaaacgctcatatgcaattctgaagttcctaagagacaactggataacacacaaggatgaatgtgaaacaaacaaggggctaggtcccgtaagctcatcagaacttctttctgaaagaagtaaagcacatctctaatgacaacagaaataaccacaaacctgcgagtcagcctcaaatatctttcctgggggattaaatgatggctgagggacggggtaccccagaatgtcccttgcacaggaaaggacctagagaagagagactgttttttgagcaggtcacattcagcttactgcaatgtctttgctttaaacggtcccctgcattataagaatggagtttatatgagaggtgagagggtcccagtgacttagcaaccgtggcatgcttctgcaaacatttcaaagacctctactctggcttttagaatgctttctagagcaagtagcatgcataacgacaccactacctggaattatacactgtctttcttcagaggcacacaaagagcttaacacattaccttagttctaggttagctgctttgtttcatgcatgcttgctggtgtttctggaagaacatttatgaggtgattgctcttgaaagacttcagaacaatcaagatggtttgttgctgttgggttctttttttttttgagacagggtcttgctctgtggtccacgctggagtgcagtggtgcaatctcagctcaacacaaactctgcctcctgggctcaagcaattctcccacctcagcctccagattagctgggactataggtgcatgccaccactcctagcttttttttttttttttctgtagaggcaaggtttcaccatgttgcctaggctggtctccaactcctgggctcaagcaatctgcccgcctcggctttccaaagtgctgggattataggcgtgagccactgcactggctgggttttatattttattttatttatttatttatttagactgagtcttgctctgtcacccaggctggagtgcaatggcgccatctcagctcactgcaaactccacctcctggattcaagcaattctcctgtctcagcttccggagtagctgggattacaggcgcacaccatcacactcggctaatttttgtatttttagtacagacggggttttgccacattggccaggctggtcttgaactcctgacctcaggtgatccaccctcctcggcctcccaaagtgctggaattacaggcatgagccaccgcgcccagactggggttttttaattttcactattattttttaatagaaagcatgcaaaaagagacgacacagtcattggacagtattacaaaaaatagtcatagaagtgaatataaatgatgcaaaatgcaatacagctagagtcccttcttcaccctttttattgatatgttcacccaagtgttctcacacatagaagcaggtggttttctttactacagtagtatagtttggagtgtttatgcttcactaatggtacaaaattagctgagaaaagatttaaattggtgttttaattatccagtgtgataacaaaccacctaaaaatgtagtggtataaaacaactactgtgtattttctcacactactttgtggaggtttaaaaacaccacaaattcatcaccttggtttctgtgggtcaaaacaacccaaattcatcatctcggtttccatgggtcagaactgcaggtacgggttggctggggcctctgctcagggtctcaccaggttgaaatcaaggtgacagccagagctgtggtctcatctgaactaatgcagaactcaccagagcacatgtagtgttggtagaatccatttccttgtggttggaggacggaggtgtcctcttccttgctggctgctggccgggggccatcctcagctcctagaggctgccctcaagtcctggccacatggcaccccagtctcaccttgtggcagctccaggccagcaggggacaccactgctccctccagtgtcctctcagggttcacctgattgagtcaggcccatcaggataatcttccttcttttttttttttaactttttttttgtttttgagacagagtctcgctctgtcacccaggctggagtgtagtggcccagtctcagctcactgcaagctccgcctcccaggttcatgacattctcctgcctcagcctccccagtagctgggactacaggtgcctgccaccatgcctggctaattttttgtaattttagtagagacagggtttcaccacattagccaggatggtctcgatctcctgacctcgtgatccgcccgcctcggcctctcccaaagtgctgggattacaggcgtgagccaccacgcctggcccctttttcaacttttattttaggttcaggagtacatgtgcaggttcattattggggtaaacttgtgtcatgggggtttgttgtacagattatttcgtcacccaggtactaaacctagtacccagtagttatttttttctgatcctctttctcctcccaccctccactctcaagtagccactgtgtctgtcaatcatccttcttgataaactcaaagtcaaacgagtccagatcttacctacatctgcaaaatcaatttttcctataaaggaacgtaatcacagaagcactgtcccacagtagtacgagtgctgagccgttgtaggcagagagggttgtcctgcccacactcaaggggagagagtgcagggccagttcacccctcacgcggaagtggcagtgctgggggctcacttcgtgctctgctcaccacaactccaaactcacaactttattcccaccaatcccatcccctccagtccagggggcacacactccagcaggacttcagctgagcccagggaacgctttgctgactggtgatgagggacctacctcttcacacccatgacacccacccgctgagcccctcaccggggctccgaaggccctggtcaggtcacctctggtctcactttccattctcccctccttcctcccctccagccacagggtccttctcgatgtgcccagacatggtgggtgcacacttgtctgacagcctctcttcttttccctttgcttggaatgctctcttcccagttaccaaagatactcaggctctctccccaatttccttcaggcccttgctccaaaagctccttccgggtgaagcctcccctcccatcctccttaaagcttcagcctctacctgggacacttcctcccccactgcctgcctccttgaaactctccttagtcctcttgcagcccacacagctgaacacaggcaggagggggcgctgctgccctggctggtgtgcagccaccagaggctgaagctcactgacgtctgtctggggcccaggatcaccttccttgattccagctctctcaggctgtcaggacctggcgctgggaggcactaggccatgccctggcctgaggccttctctctccctctttgccctgtgtctctgcagggaagcccggccctgcccctgggagggtgggggcagacgtgtggagagtgggtgtacaaggccagggtttgccaggcccaggacagcctggcacctgtcaatggatgagcgcctctcccttagcctgatgtcagggtgggcatgagggtgggagcagagggtgcctaactgaggaaagggtctgtgcaacccccttctcctaccagttctcgtttctgaagtctcctcaagcacactgcggtgtccacaccattggcagcaggctccttctcttcaggtggtcttaggaacttctcagaactttttgagttatccttctggtctcttcctcctgagcacggttctcctggttgagctccaggccatgccattcaacgccctccaggacaggccgaagggcttgtctgtttggtggttgctaaggtttgaaaaaagccagctg

SEQ ID NO: 796 - DNA, 64652 bp, Homo sapiens; identical to SEQ ID NO: 795

SEQ ID NO: 797 - DNA, 65588 bp, Homo sapiens
gatcatagtaaatggctttaattttttagcgaaatctcactactgcaaatgcattgttgtcctagctaatgaatgcatagagtattgcctgcaaaataataattgagattctatttttaagaagcttagaacagtacatggtgcatagcaaagactctgtgtatgtgaagccagattttaaaatatggtaacaagtgtctgaaaatatgtggctcaatttgtctcccggttacttttccctctccccctttaaaatgtagaggaaggagaagaagagataagaggtttgtgagtgaagacaagggccctttaaggcctgggaagactaacgccatagggatctccctctgccttaaaaggcacaggaatcttagtggggaaaaagaagtggtgataaatagccagtccgtgtgcctggaatatcaaagtcagtgcgtgccagggatcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaagatcacagctctcactagactttcagaggactttgtaacccaaagaaccactcatctcaaggactgtggtaactcaggggctgagccatgccagtgtttattatgtgaaacaaggactggaacctcacaagaccaagtctgtccatttgaggatggcccaagatgcacacgggctgcttttatcttatgcgcaggttttaaaaaaatatgtttcatttaaatattccatactcttcaggaatgcccaggcagctgagctttcaggatgtcgcattgcagaggactccaatgctacatatggcagctggagaccctttcaaggcaggtggcagaacggaggccctctctatctgctggggcagccctccgggtgccccgctggaaggcagagcagctccatctctgggtgggtgagaggtgctgcatgggctcactatagtatcccaatactgtatggcagtaggctgccagagtatcctaagctgggtggcttcaacaacaggtactgactcacagttctggaggccaaaagtttgaattcaagcagggctgtgcttcctctgaaacctgtgggagaggagccttcctggcttcttcccgacttcttgggatggggatgcgcatccatcctcggccttccttggtttgtggctgtgtcactgcaccctctgcctctgtcacggcatggtgtcctccctatgcatctgtgtctgaatttccctcttccgataaggactccagtcatattgggtgagggcccaccccaatgacctcatctcaactagatcatctgcaaagactctatttcccaattaggtcacattgaaggtacctgtctttttgggggatacaattcatctcacaaaaccggcccatcacctcaaaaggacctgccaccccagtgctatgtgtccctctctgcccagagccactccttcccctggctctcggggagtgggggcacctttccctgctcccacagtgaccgagcaccttccccttggtatgcattctgaagggggcatttttttctcctccatctcagccctgtacaaagcaagttctttctagattgaggtgtgtatgtgtgtctatgtatatgagtgtatgtgcctgtgtgttttcagggagatgtgtgcaggatgggtgcaagggaggagtggaaggcggaagggcaggaggaggatagagccacaagagtgagcacagaagtgacaagggcagaatcagtgtgtgcttgtgacaagtatggaaatgtcatgcctttaggttcagtcctataaggtaggtgtatcagtaagggcattgattctgcgaccttaacagagatcagaataacagtggcttaaggaagagtggagtggatttctctctcctgtaaatctggcctggtgggtggtaaggaggatccacgtcgcccaggcccagatgtgtgtggctctttgagtgccccgttctttcccagtctcataactgctctccacctcctccacatccagccactgggaagcaggacaaagttagttaagggcacgttcttttctttccaaggattacttggacattacagtcttcacttccatgcctactggccagggcttagtcacacaaccttgctagctgcaagggagtctgggaaatgcagctgctattctcagaggccatgtcctcagggattctgctaaatttagcaaggcagggacagatatgggggaaccactgacagtctatcacaaaagaacgtgattttagagaaacagtgaaacagtgtcattaatccacccctcaccccttacaacagccaaaaagaaatccagtggtatccatcacaataaagagtatgagaggaatgtgattagaaaatcaggttgccaggcaggatgtgtccagttttagccagtggtggggttcatggggaaggcttcgtctcaggaaggtgtgtgttgggttgttctatggccagatggttttcaacgacatagcacgacctgtagctctccaggacccgggcctggacataggccttgtccttctcttgccaggcatcggactcgatgtagacgttgaatgggtcgttcgagtgctccagcttcttggagcggatgtagctcagcatgatgcccagggtgaagaagccgaagaatcccagtaccatgaggacgtagagggcctccagcttgccgtcactgctgcggggggacctgcgggccaggcccgacatgttgccaccctgctgaactgtctcctgccacagcttggtcagaaagggcgtcaccgctgtggtgttagacaggatcatcctgggcattaaggttccactgctgcagctcaaacttcccaggcacacctcttaaaggaaaaatgcaaccccaaatcaaaaagtacgtattggccaaaacccacacgtacgcacacacacgtatacaattttaaaatctcaggtgagaggggtgagctgacactccacaggccatggcatgtgccatcttgggtctgtgcaatgccttctcttgatagatgaatggatacattgattcccttctatttccatccaccactccaatctccacccctataggtgaccatcagaatgagcttctttaatatgcattgctgcatattgtggcgtatggggttgcatgtgtgcattttggtttacctaaatggtatcaggtcatccaactcattcagtctccttctttttcctcatgactgtgcttttgtggctcacttgcggtgctgggtgtgtgcattcccttgcttccaatgtttgtatacaacccatggtgaacacccacttcttttctctgccttctcccccagagatggacactgctgtggctgctgactccataaacaagggggagacaaatatccccatccttgacctcctatggacctaaaaaaaatcacgcatctcatacaactagttcctggcagcttatgcaagactagtcagactggttgcccttggaagcaacgtgcaattggtggtctgtttcaccacagagcatctctctatgaacagttacattcatctgaatgaaaaatctatgctgtcacgtggtggacttcagaatgtctagggagatttcacagagagctcccctcgaagaggccagtgttgtagcttgtgctatgtttttccctccctgcccacacacaggcacacacacgtacacaatcttaaaacctcaggtgagaggggtgagctcacatgctccctagtccatggtatgtgccgtcttgggtctacacaatgccctctcttgattgagcaatggtacatggattgccttttatttccattcactactctctggctatgcagaaagtgacattttccctatcgtttaatcttgatatcactgtccctgtatactcagagtgggcctgggaattggaaaaattgtctccaagtagctgtaagattctgtcaggggtttggtttgctgtggaaaccccatctaggtgaccttgagatcattggtaagctgaaaaaaaacaggtcttgtttttatttatttatttatttatttatttaggtttgagcaaatgccagcctctacccccagttcctgctgggaaacaaaagctccgaggccaagttgttgatgtcacattccaaactcaagccagagggggccactgggagcttatcacacgtaagtgctcccactcagttctttctttttctgttttattgagacagggtctcactcttgtcactcaggctggagtacagtggcacaatcttggctcactgcagcctcaacctcctggactcaggtgatcctcctaccctaccctccagagtagatgggactataggtatgcaccaccatgactggctaattttcgtattttttgcagaggtgaggttgccctatgttgccgaggctggtcttgaactcctgggcttacaggatccgcccacctcggccccccaaattgctgggattacaggcatgagccaccctgcttgtcccctgctcacttcttaggagcttaaagtagctgagtagaacatggcctggagtagaacatggcctcggggggactgttgtaactacaggtgaaggatgtatttgggaagacagtttatggccagaatcgctatggaaagacaaattccaacacttgccgggacggcgctgtctttcccagccaggatggggactgtgacattgcacatcatcttgtgtaggacaaataacctcagaaacctagctcctctccagcttagacccagagctatttcttcattgaattggtttaattgtaaaacataccctgaacccagcaccagctgaagacatctggcacctttccgaggcccctcttcctctacccatctctgaactctggctgtgtctcagagttctgttacctgctctcttctcttcctactctcctctctcccagggtgactgcacctgctccaggctcacctgcatggccatgacccagggctctctttaagctccagagccatgcgtccagtgacctgctaaggagatggttccctttggccatccccaggctccttaaagttaacactccaccctgtcctgtcagagactggcccctgcctcattgagctgagtggcaacaccactcactccaaaatctgcatcactctcactgatgactgcaatctcatcatggcagttcccatcttgaaggccttccttggctcctccctgccttcagggtgaaactcctggtcttctgcatggatacaggccctaaatttgagagtctatgcatccctctccaattccactgttgccactgtgcccagaccctatgctccatggtccctgctggccccggagcctctacacattgtgcgtctccagctcagactgcgccttcttcttggcccatgaaacttctcagcaatgcctactcatgcttaaaattcagcccagctctcacctccttcccgaagcctgctctgatacatggggctggatcagcactgtgcacaccatgacccctgctaacctcatcatggtcaggatctccaggccccttatcccatccctgccctgccatccagcctggtgctgggcacgcaaccacacaggagctgcccatgaatgtttatcgaatagatgccaccagaacttaataccttttgaccagtggggcttgactctttataacctgcttactccaatgaacagatgccaatgagctgtctccgaagctctaactgactcccttttccagaagggcagtcatctcccaccctgaaccacagtctcagaaggcaggagtgaggagcagaaagagctcagattttgggattccactgccgccacaggtttggattctagctttgctacttcctggccacatgatcctggacagtttccttagaattgttcagtcaagttttttttttttttctttccaaagtagcgagaaacaccactgacatttgcgggctgttgaatcactgagcaggtgtgtagagtggctgacagcatgtggcacatggcaggtgcacactcagtggtcctgggtaggagtttattggtttttctacctcattaagaaattgctgcccaaggatttggggctttgggggtttaggcttggctttcctgtggctgaccatggcagctgtcttctctacgttgtggagagatcagacatgaatgagaatcaaagattgtttgtggcctttcctggtttctaggcttttgagtctgtgcagagatctgtcaggggttaagctgcctgggctcaagagattcaggtccttgttcttgtacaaaactagcatttagccccattctaaccatcggggtaggcaggaattgtttggtaacagatccaaactcaacgctcaaccatttctttttaaatgacccgaaaccacttatgaatgcataaaaccctgccccagaaaacagacagacctggacctgatactatgatgtaatttccaaaaacccagaatgatcacaattggcaaataattctgccaccaatcactgttagagagtctttccaacttcatgaccatgtgaaggtagaattatggcaggcgacatttgaagatccacaagttaattggtttaaaactgataaatccatacagcaaattaagagttacatctgcaattaattcataatagtgagttcactgagaaggcttgttacttagatccagatggactttcttatgtccaaagaagcaaccaaaaacatctgctttgaaaacctcccaagcccaaaccatcctcagccttgttctttagaatgctttagaatgaccttgttaaaatgcagattgctcctgtaatcccagcactttgggaggccaaagcaggtggatcacttgatgtcaggagtttgacaccagcctggccaacatactgaaaccccgtctctactaaaaatacaaaaataagacaggcgtggtggcgggcacctgtattcccagctatttgggaggctgaggcaggagaatcacttgaacccaggaggtggaggttgcagtgagccaagattgtgccattgcactcctgcctgggtgacacagcgagactctgtctcaaaaaaaaatgcagattgctgggctctattttcagagtttctgatttggtagaactggagcgggcctgggaatctgcattcctaacacattcccacgtggtgctaatactgctggtctggaggccctgcttggtgatctattggaatcaccgggggagcttttagaaaataatggttcctggatctcacccctagagattttaatgtctttggtctgggttcctgcctgactcagagactttttagaaacctcccaaatgatcctaatttgtagccaagattgagaaccactgggctgtggtgtgggaccctaggaaaatgaccaatggccttttgtgctgcagggtacctggaagaattttgcaaaaatatagaaatatgatctcactgactgtttttcaaatcttgtttgttttttacattttcttttttggccttgtttgcctctgatacagtctgaaaagaaattgcagaaagaaactctccagtcttcagtgtaacctcagctgtccccagtctcacacacgctggtgccttcaattacaattctcctgtcagagcttaagtccagctaattaactgcctttcaaatgacaaccctatatttttaaagaatttttttaaaacttcacatgtaatttattgcattgcttttgctaaatgtcctccacacccccaatgcctgctaggctgggtcgccatggtatttttgtgtaacgagtctcaaaatgagtttggcaatgtctccgtaatagtcagcatggtgtaaatgacagtctggatctgcatgtcatttgggattttatatcagattctctaggttcatttctatgatacgtgatgccaaagcacccacatgccccgtggctgcactttcagacagttggactcaaacagagtgggagagcaactgatccaacaatctgaattttcagaaaacggggctccttagagatgagatggcttgccaaaagtaatctctcctatcagaagtacatatcctcagcaaactaacgcaggagcagaaaaccaaacaccgcatattctcacttataagtgggagctgaacagtgagaacacatggacacagggaggggaacaacacacactggggcttgtcggggaaaggtgggtggggaagagcattagggaaaagagctaatgcacgctgggcttaacacctagatgatgggttgacaggtgccgcaaaccatcatggcacatatttatgtctgtaacaaacctgcacatcctgcacatgttccctggaacttaaaaaaaaaaaaaaagaaacaaaaacaaccaaccaaaaatatatctaaaatgtcatctgttagcaattgactcacatattattagtatagaaaagagcaattcccaggaccttgtacagaggaagcaggctcaaaacagctgaggaataggccacttttatcagatagcattggatccatgcacatgggggttggcttcttacctaaatatgccatcagaaatcatccttgttcctgtcccctcagcttttgtagcttgcacagtgagtaaagggatggtggaggcagaaatggtaggagccagagatgttcaaaatccatctgatgcttggcctgtgctgaacgttctcaaactgtggccttgtcaggcccagaaagtggggtggattcctggccgtttctgcttctgcctgggtgtgagatgtgaatgctgcccctactgaagggtagtgcaattttttttttttcttaaaagcttagacccagagctgctaatctactggaaatcactcaggacacagggctctgggcagctgcgctgagcgagacacctgcaaatggagaccaacggggcctccagcaccctggagttccgtaaggcccccagctgaacccaggggagaagagggcagtgggtggcgcctcgctgctctgggcacacaccacctcttctgacttctcccacgtgctccggctgtgtcgcctatcagcactgataacagcctggaagctttcagaacagaagctttcccagcatgggaaactctcattctttcttttttttaattttccaaagcctttatttctaagaccaactgtggcctacccgtgcataaactgggcaggctgtagacagcaggcttgccaagtaaatactacagccttcctcccaatattgagccctgtcccattgatcctgcaggggagatgtgtagggcatttgttcacggggaggccacaagtttgggcctctcatcactgtgacctcacacccctgttgagtgtgtcgtaaacagaggagccgttcttcaagccccctgccctgagtgcacccctctcattcttttgttattattagcaaattcccccagttcctgatcattctttcttaagcctttagtgactgggtaaggttcttgtggctgactccaagctttcttctaaaaggaatagattctaggggtgagtagaggagacaggaatgtcggagtcagagctcaggaatctgggttccagccccaggtcaatcctagataaactagagggctccttaacttacttccctaggttgactctgggtttttttatcacgctcgacaggactccttatgcatttcttcgaaagagcatccagtcttaacatcatcatttggcctcatttggtttaagaagcagaattagggtaaaagcaatgatggataagcctcattttggtgaatatgatcttattgagacaagaattctgagtcaattgtccttggaaccaactgtctattgttttcatctttatcacaacactatgtccaaattttggaaacatgtttccctcctagcagaaaagaagccacccagggccaccagatgcttcccgacacttggctggctttgtctggtcttctatccttcccctatccccagagtcagtgggtactaaggtggccagggtcgctcaaggaatcagaatgcaaccgtccagaggcccagaatcagactgtcctctctgattaggaaagtgtttcctgccacctcccagggggatgtggggtgtggcttgagtctggtgcttttaccaggagcttcccagacctctctatgggtgatggagagagagtctggggtgtgaaggatggaaatataaacactgaatactcagagagtcaggccagcgagctggtgaggagactccatcaaactcaatatgaaaacatgggtgggcgtttggggatggataatgaatgacagctgaagtcacacatcaggagggaaggaaggactctcatcttcagcaaatgacataaatctggggagcctcagtttcctcacctgaacagtgagaatgatggaatctaccctgagtatatatcccaggtctttgtgcagcatggaatcagcccccagccttcctagctcttgctttattttattttattttagagaccaagcctcgctctgtcactcaggctggagtgcagtggcgcgatcttgacttactacaacctcctccgcctcctgggttcaagtgattctcctgcctcagcctcctaagtagttgggtttacaggtgcatgccactatgcctggttaatttttgtatttttagtagagacggggtttcaccatgttgcccaggctcaacatgcctgggctgaagcgatccacctgccttggcctcccaaagtgctaggattacaggcgtgagccaccgtgcctggcctcttgttttatgtttgctgttctcgctgtaggtgaggcattcccaccatattcccttgttaaaatcctactggcccttcaaatgccagctcatatccacactgtgtctgaccctgatccagaatcctctccccttctttgaccccttgtatatatctttcctacagtgctggtcatattctaacttctaatcatttgtagacttatctgggcattttctcccaggaggtcccaaaggacagagaccatcttgctcacctttgtccccactccagcacccagaatgtttcaataaggttttcctgaattaagtgggaagcaaagtattagattcaataccactacaatgggaaagtgagtgaataattgataaagtatactatgctctggaaatagattattgagtaatcagaggaaaacctcttgcaatgtagtatgtttttatatattaaattttatattatttatttatatttatattattaacatatttttgttattcattttgtttattaagatttactctatatatatatgtgtgtgtgtgtgcgcgtgtgtgtgtgtgtaacccaccttatttctaaaaaaaaattttggcagtcagtgactattaatagtagagcacaaactcttaacctttttttcctcccgctttcccagagtccttatcaccttctaatataataaagttttcttaactgtgatgttgattgttcaacgtttgtctttcccaccaaaatgtaagctattgcgggcagggatctttgcatgggttgttcttcattgcatcccaggccactagaacagtgtgtggcatatggcaggagtgcaataaacattcagcgaatgcaggcaggcatgcgtgaacgcatgaataataagtgttcctttcaactaccagaaagagcgaaaccacacaggagctgtctcaccctcagagatttaagacgacagcaatgagtccctctgatgtcttctaagtgagctttattttcaaaacaaatcattttccaataacctatcaaaagcaggtcctacctgaatatccttggctatttcctctggatacagataatgccttcctccaatggatcctcggctcacctgatgattgtgtgaaactggccagagaaagcagagggatttttcctggtgattggaaatcagagtcacggctgaatttaagcaactgtgtgaactcagcaaagtccccaccacctggaccatacatgacagctatggttattgacaaggtccttccttaatggagctggaacctccttcttaatctaaatgtggactcaaatgaactgtcaattcacatagagcaatgtgacaaatccggggggcaaagcattatgcaatagattgggcacatgcgcacgtctctgctacttagtcaactttcttctaaagtttcccacttttcccattaccacaatcaagatcagatatcagtaatattctccgcgtcccatgccctttcctcagggagatgccaaggcccaagagctggtccccccaaaaagctgaaggtctttgaaaaaaagtggggactcaggtcccgtgagtggttttgattttcttttcttttgaaagttgcatgtaagtgttttccaaatactatacaagaatgtctataacttaataatggaggaatgttttcgttgttctgtgttggtgagatgctttcctatgcgtttgttgtataagtaagtgagaatggcagaaggaaaggaggggagaggctgatcatcctatcccgtctcccactctgggggtctcggcgcttccagcctgaagcgcgcccgctgcgcgtccggagacgcaggttccaggagccccccggggttgcccgactaggccacttgcgccccggaagagggccgcggaggtgggagaccctaacttacccgggtctgagatgccgagagagccgggtgtggagctgagtgcgcgcctgccgagcgctgaggccacagacagccccgccccggggcggcaccttctaagggcctgagcgctgcacagggatgggggcgggcggggcctcccagagccgccaggcgtcccgccccactccgcccacacgcacggcccagcccagggttccccgggaccaccccagaccagccccggcccccccgggtcctccacactctgcaccccagaccaacaccaacgcgcgtagggaagcgttttagatcctgtcggagaggctcaaggccggcagaaggtttgcattaggatcgagaaagccgaccaacggacagatctacctaccttcctgcgggagtttgaggttgccaggggggaagccactgcagccaggagaaaggccgtctgggaaccaccccaccctcggacgtgcgggccttcaaatatctctgaacataatcctccaaagaccgctcaacctccgctcccgacgactctttctagcctcgtcccgcaccccagctgtggccacacacctattaggcaaacatttatgaagcacccacttactgggtgtgcagccctgagctgggggtgcagctgtggaccagacaggagggggcccggagcggcagacagtcgctggaggcacccgagccttggcgagcacaccctaacgtccttggggcctttcagcccgagccgtccttgtccagagagcaaaccatgcaatgatgcaggtgacttcccagcaaatttcatagcgttgctcaccagcttggcaggcaagaggagaaggggcagtccccaaaagacaatcccatgaaccttctagggaatgacgtccaggctccaggctcctgctctgcaggcgggtcgcagaggcaggttcctgacctaggactagaagacattctctagggtcactgcctccatggtcttccttggcaggtcacttcttcctgggcttcgacctcggtgttctcatggggacgagggtgattggaggccctccaaggggtgcaccgatgtgtcctgtgcaccaggcagaaccagcattgccctacagtgtgggtgcaaaatgaacccacatggccacgttggaaagtcctgaaatgttcatagcctatgacatgaaattgcactgtgtgaaatctatttattctttttttttttttcttttttttctgagacggagtctcaccctgtcgccccggctggagtgcaatggcacgatctcggctcactgcaacctccacctccctggttcaagcgattctcctgcctcagcctcccgagttgctgggattacaggcaccggccaccataccctgctgattttttgttatttttagtagagacggagtttcgccatgttggccaggctggtctcgaactcctgacttcaggtgatccacccgcctcggcctcccaaagtgctgggattacaggtgtgagtcagcgtgcccagactgaaatctatttattctatggaaaggatcagagctgtagaaaaatccttatgcatgtaaaagttctttgtgtttttacttgcaataactagaatctaaacatccaaaaatagaaaatataggtaattaaattgtagtacatatgatattattctacatagtagaatattatgtggagtccttaaaatgtttacaaataatttataacaacatggggccgggcacagtggcttacacctgtaattccagcactttgggaggccaaggtgggtgggtcacctgaggttaggagttcaagaccagcctggccaacatggtgaaacctgtctctactaaaaacacaaaaatttagctgggcgtggtggtgggcacctgtaatcccagctacttgggagtctgaggcaagagattcacttgaacccaggaggcggaggttgcagtgagccaaggtcacgccactgcactccagcctgggcgacaagagtgaagctctgactcaaaacaaacaaacaaacaaaaacccaacaggggagatctttatattatcatgttacgtgaaaaatacaaaaacagaaaacaaaacaaaaaccccacaaaactcaaggccttaaattgtaaatatgagatgccaggcattattcccaaaatctataaggaagcacaccaaccaccatgttaacattgtctattagtggtaggcctattggagatttattatcttatttatgctacttcatgttttccttccttttttgttttgcaacaactctgtattagtctgttctcacactgttataaagaactgcctgaaactgggtaatttataaaggaaaaagtcttaattgattcacagttcagcatggctgaggcctcaggaacttacaatcatggccgaaggggaagcaaacatgtccttctttacatggcagcaggagagagaagtgcagagcaaagtggaaggaaaagccccgtataaaaccatcagatctcgtgagaactcactcattatcatgaaaacagcatggaagaaccgcctccatgatccaatcacttcccacaaagtccctcctgcaacatgtggggattacaatttggattacaattcaagatgagatttgggtggggacacagccaaaccatatcaaactctatgtactttaatatttaaggaaaattacataaactttatctgaaaattccctggattcttctcctcaaggtcatgctgtacatatgcaggatcctcctgcctacatctccaaatggataatggattgaagcaaaatgtttgtcccaccaaacattgatgtgtaacccttttagtaacaattcatagaccaggtaaacatgtgtggagcagcccagatcagctggagggagcattattctcatcagagtgtggaacaatgcctacccatctgtcagctggttatggtgaagacagtataaatggaagcactgtcagaaactaaaggcttatgtaagtgatgctgttcttatgtctcctcttcctctctatcccacatatgatgaattattttattatgatgatgctgtagttgttattttctatttgaaatgaaaagacatgattacagatgagaaagagtgtattttgttatccttgatgcacttgaaatggtttcctcttttttttttcctgttttcttcttcttccttctctcttcactctttcattcttgcctctctccattttataggtatgattgatcttgaaataatgatgataacagaatgatagcccatatagtccttgggtcacttctgtctctatttctctttcttccctcctctttttttcttggtccttttgctagatgggttgcgagcatggctccctgcccctctcagtgggtttatcttcattttccatgagctcccacctcactgcatgtgacatcaaagccaaagctccagccacttctcatcctttcttaggaaaatctcaagtcttaacttgaaagttgaatgtcctgcttttgttcctaactctgctcacaggatagtggaagaagaaaggctcagcctgttaccagaaagaacagatctgcagtgtaacccatctaggatgaagggtcatgtggacagttcttcactcttccctctggctgcccttcagttggtgtccagatgcccctgtgttagcctgggggcattccttgccctttggcccctcttttgttgcctttttttttcttagacaaggtctaactccgctgcccaggctggagtgcagtggtgcgaccattgctcattgcaacctcgaactcctggctcaagacattctccccgctcagcctcgtgagtagctggaactacagttgtacaccaccatgccttggctaatttaaaaagtctttttgtagggatgggagtctcaggctggtcttgaacttctggcctccagtgatcctcctgccttggcctcccaaagttttgggattacaggcgtgagccattgtgccctgccctttgttgctttttcactcctttaccctgtggtttctactatcctcagggacaactctcattgccctggggcttctggatcttcagcaagacacacccctaaaggcaaacaatctttctttagcagcagcagagcacaaacggagtgttgctgtatgctaaaagcatactatttcccccccatgagaaagtctaaggggtccaggggtcctgaagtccctatcctgcccccgccagtgacaggtgatggggaacagaatgctgaaagagaccccacccaaccatctggtgtgtcaacacccgcccctgccggtgctgtccacaggttgatccccatcccacatgggtggcttaacacattcatgtcttctgagagccatttgttgctccccagtctcttctgtcctccttctttgaccaacatttccctgtctgatttgcttggtcacaggtagcctgtgtcagtttcctcccaggactctctttgcctgggaataagtgctatacatgagaagcatccctcccaagcgctgtgtgtggcctcctggcattctcctaagacttcctagaggattgctctggttccaaaaagaaaccagccacaacctgtttggagccctgcaggatgttccagctcaccgacttcattccccactacttgcccctctaacagagcttctagaccagcagccaaggtgcctccattcactgtacatgactcacctttcccccttctagacacttcttcacgggtctagcctctgtttccagctttacacagcacaggctgatgcctgccactgaacgggatccaggactttttcaaatctcagatccccagcaaaggtatgacaatgggcaccctgaccagctctgagcctctaagcatagggtctatttgtttaattttgaattcacttttaagatttaaaaattgagagctctcatcttcaacaaaattcaggggatctagaaacatcatgcccacttgtggcagagtagccaactggcagaaactgatgctgatgctgtctgtttcctacacaaaatgcaaaccagagtttaccacaggccccgctactccacattctcctccacaaggacactcagcaggctcctgtgctgaacggcttgcctggttctgtaggtgtagggtttgttactctgttccaggacctattttccgcaaagccccttacctggctgtttcttcccttggcatacgtgagaactcctttcctcactgaattgctttgaccttgctaattagttgtgttgcaagtgctttttggctgtgtcagacatgtatgttctgtttatcattttagagcaatggttattaatttttttcagattcttcttgggaattagagaaaaacttatggctctcctccaccatcctgcccccacctaccccaatgcacacatgtgcaacatttgttctacaattcaagagctctctagacccctgatatgctaggcaattcgtggctgccacattaggaacccctgatttaggggaaggactgttttctccattagacaaactcaactgtgtagcatcaatttcatgggtctactgtgtactgtgcccaaaaaatgccactgaatgctgcctgactggtggatagcaagactgtccattaatgtggtcatttaggttgcctctgcccaggtcttgaggtcattggcactaattcacaacaccctcaagtcacccagggaagatgagacacagttggctgtagacccacagtttgggcattacagctgcccttgaagttgacaaataaccacaaccttcaaattgttatgaaaagagcacaaatccaattaagaaagcttttccaaaagaaataacagtgttcctaccccctctgtcactctccaccccctttttgtcccagaataatgttgtgctgataggaacatggataaattaattacagtctggaatgttattcatgggtaggaaagaacactaaatctactcgcacaatgtttgatatttaaagataaacattgcctttatgttttttttttaaacctcagtcagcctagtttacgaagacataggtataatccttttaaatgctgtggattttttaatcgcaaaggtaacaatatgctgggtgttttacccagccagagaaccaggagatgcaggaatgagattagcatctctttagttccttgcatatttgatattattttggtgtacctccaattcctgataacatagaagaactcttgtggttgaagtccctgaaatggaaggatattggtaaccctgaatttaaaacaagcacaggcagcctttgtgggaatgtgtgtgaaggtcaccttctagaaacaggactgtccatagccattgccatggtttctgtgtcatttcaaccagaaccttaggcctggaagtctggatggatgtgggttggcatggtcctctatgggcattaaatgaataaatggatatagcagagggagtatccagcatgactcaaagaaggatgagaggaaacatattcaaataaaatctttagaaaagcaaatttcaaaaaaaaatgcttaagtataaaatattttgatgacaaccatgattttcaaattgaattcttattctaagtaatggtctaatctgaacttagacctctttccttaatttttttctcaataagcctttggtgtctagtcagttcaattcagtatttactgagtctctatacagacagggtataaggcattaatcaaatgtatgtccaaaattgcccaccatgcagggcagagctaaaatgcctaacacccctcctctcaccaacacatcccccacccacatctccaaagacttcctggcagaggtgatctctgcctgctgggacagatgtataggctccaacagcagcagggtggcccctctgaccaccaccttgggacccacattgctcttagaactattcctcttttttcatccttgaagcccccagcaaagctcagcctgaatcaactttttctaggaatctgacaagtttccaggctgatttcctgacccagtcagatcctcttccatctttctttgggtgttcaattttctacgtcattttccacctcacatattggccgttgatgaccacatcagctcttctatgctgtaagctcccaaggaacaaattctatcaaatgattggcctttcagctctctactgtgaccagaaagttgcccagtacataaaaaggggttcacaggtatttctcacgtggataactggtgactcatctatccatgattttggggatcccccacttcctggactaattgtaaaccaccttctaccacctgggggtgcctgagcacaacagagctaagtgaacatttcatcagtctaattgaattcagtggaatgttgggggcctggaaatttggactaggaaggtaagcaggaggaataagtgtgaatgacagtatctaaattaaaatctgttgccacgaaagaagatcagaccttttctcctctgatttgtccttctagaagtcacaagatgcccaaagaatcataagcaatgggtaactaggcaagggaattatctctgacaaatgccatgattgctcagtgtcccatttctcttggcagcaagagtggcccaaagactaaactgagatgggggtctgcacccctgcatgggactcaggctctgcagctagccttccaaccactaaacctgagctgaggtacttttagctctttatttcttgtttttctcatttgtcactcagatgagaagaatgcccgctctgtttgactcagtgtcagcgtgatgaagtaaaacagcttctttaaatccctctgcaacaaggcagtgaattgaaaataagaaagatagggaagaacattctgggcaagacagctcaatgagttcatgctttgatcgatctctcagctctgaacacaaagccatgacaggtaggtataaaaatagaaagctaaaaagagatgtctggctcaacagaagcagaagagacactgccagaagcctctgacctactgggctctttgtctaaaatcagcagggagtttggcctctgctgggcaaatccaagacgccccacccaagatggcagacaggaaccaagtacttgcttaaagtcaggaactagggtggggccccgaaagaaagacagtgcctcactgctgcctagggaccaaggttttagaaaaataaggttgaggggccaagatggccgattagctgctgctgcagtccgcggctctcatggagaggaatgaaaacagccagtgaattcagcaccttcaactaaaatatccagattctcggccccactcggactagtcagacaactagacctatggagaatgaagaaaagcaggctgggaaaatggtccacccgagagcggcacggagccaaaggaagccccaccccagcaaagggaagaggtgagtgagtgtgcgacaccacccggaaaaccatgcttctcccatggatcttcgcaacccgcagatcgggagatcccttcatgagcccatgccaccggggccttgggtccgacacacagagctgtgcagagtcgtggcagagcggccactcaggcacacacaaagacccaggaattttacatactccagcccaaggaatcccagcaaggcaggagatccattcatctattcccccaggaagggggctgaacccagggagccaaccagcattgctttgcaggccccgtttacacagcacctcacaggttaaggcccactgtaatttttgccagccagtggtgacagcctggagtcagcctgagatggactgagctctcgtgggtagaggcagccaccatctctgcggttcagttgactcagccattctagcctgccagctccggggagtccagacagtctggacaaggaggagtctcccacaacgtgtagcacaggtgctgtgccagatcgtggccagactgcttctttaagtgggaccccgatccaatcctcctcactgggtggggcctccctgtgggaatttcagcagctccagccagggttatatggaaaatactctgctctctcctgggacggagacccccatgagaaggggtggccgacgtcgctgcagttcagtggactcagtctttccagcctgctggctctggagagttcaggcggtctggaggaagggtcccctcaatgcagcacacccgctacacctgctctaacaaaaagcagccagactgcttctttaagtgggcccctgatcccgttcctcctgactgggtgagacctcccaacaggggtctccagagacctcccacaggagcgatcaggcaggcaacatgtcagtacattcctgggatggagaaaaatgagcaggctgccatcttgctgttttgcagacttcactggtgatacctccgggtatgggaaaaaccaaggcaactagggtctggagcagaccctgagcaaaccacagcagccctgcggaagagtgacctgactgataaaagaaaaacaaacaaacaaacagaaagcaccaccgacaacatcaaccaggaaaaccccattcaaaggtgagcaacctcgaaaatcaaaggttgataagcccacacagatcagaatcaatacaaaaacgctgaaaactcaaaaagccagagtgcctcttctcctccaaatgactgcaacacctttccagcaagggcatggaactaggctgaggctgagatggctgaaatgacagaagtaggcttcagaaggtggctaataatgaacgtcactgagctaaaggagcattttgtaacattaaaaagtggggaaacgacatgaacagacacttctcaaaagaagacattcatgcagccaacaaacaaatgaaaaaaagctcaacatcaccgatcattagagaaatgcaaatgaaaaccaccatcagctaccatctcactcccatcagaatggctattattaaaaagtcaagaaacaacagatgctggtgagattgcagataaaaatgaatgcttttaccctattggtgggaatataaattagttcaaccattatggaggacagtgtggcgatttctcaaagatctagaggcagaaataccatttggcccagcaatccctttactgggtatatatatcattctattatatatacataaaataggaatacaaaacatgctattcctattatatgtgtaataggaatacaaatcattgtattctaaagacatgcatatgttcattgcagcatgattcataatagtaaagacatggaatcaacctaaatgctagactggataaagaaaatgtggtacatatacaccatggaatactatgcagccataaaaaggaaagagattatgtcctttgcagggacaccgatggagctggaagccgttatcctcagcaaactaatgcaggaacagaaaaccaaacactgcatgatctcatttataagtgggagctgaatgacaagaacacatggccacgtgaggggaataacacacactggggcctgtcagggaagggggagagagagcatcaggaagaatagctaatggatgctgggcttaatacctacgtgatgggttgatctgtgcattttgtaaccaaatgtacctgtaatttatgatccaattcaagttgaattttttataaaagataaaggaaagattaggattatgtttttacatagaaatgcacaattgtttcagtacaaactaaagagattttcagaatttcatagatgaaaacaattcacatttgctaaaatgtatcctattaatactaacggttgtacttcagccataagaaaagaggacagaagggaatgtgtgaaagtcagtattaaatggtagtcaattaaaaataaaataaaaattttgaaaggtaaaataataattactgaaactgataaacaatattaataattttaatagccattaaattaacaaaataataataattagatttggaattttttaaagaataagatgagttaaatgggtgaaagtccacagaaagaaagttttctgggtccttgatgtgatcgggaagaaaacagaaatatttaacaacagaaattttgtaggaaattcatagtttactaagtatgctaaaattttatagataattacaaaaaggatataagtaatctataagttgcaaagcaacaaaatatattcttttgtgtaaataaaagggaaaatagaatggtttctcacaccaatgagaaataggagggaaaaatactttaagagaaaaagttgtgaaataaaaatcaaaatgtaacatggtaaaaatatatgcaggtacatcaataatcataatatctttaaatagaataagcacacaaaagactacaatgattacattgaataacaaaataaaatctaattatatgctgcttacaagatatacatttgaagtaaaaccaaattgaaaagttgaaaattaagtaataaaaaaatactaagcaaaggctaacacacagaaatctaaggtagcaatattaacacaagacaaagtaaaaattcaggtgattaatagtatacaaagatcacccaatttaataaaaggaaacagtctgctaggaaaatattacaattatgggtatgtagttaactatacagactcagcaaatataaagcaatcctggcagatttataagacattgatatatctatctatcttatcaattcccttaaggggaactgagttgtagggagccatttaacacacttctctcagcaactggtagatctgccctccccaacatagtaagcatatagaatatttgagtgatgaaattaacaaagttcattaaatatatatatagagagagcactacacccaaccaataaacaatatgcatttttttaacaagtgttcacggaactttttttaccatttggccatgtactagatcatgaaagaagtctcaagaacattttaaatattagttttacatacgtgcttggctctatgatcaaaatgcagttaggttataaatcagcagtaaatttatggtcaataaatcttcacatatctgaaaaccaaaaaccaagtacatgtctacttaacccattggttagagaagaaaacattttagaaacaataaaatactaaatgccatagaaaatactatatatgaaagtttctgggatgcagctaatgtggttcttagaggtaaattgacagcattaaatgaatttttgaaaagaaaaatgatagaaaataagtttaactaaaaaaaggagacatatgaaataaactaaagaaagtagattaaacaaaattttaaaaacaaaaattagcaaaaatgaaaatgaaaaaggagagaagagctactagatgaaaagctactcaaggaacacaatttgaagatttaaataagatatatatttttctagaaaaaaaacatgaacttccaaagtcaatttatgaatagagcttcatcataaaactggaatctataaaaagtatcagttcaatagatggatttactaacatattagacacagctgaagaaattatttatgaattagaatgtaagtcagttaaaaatattcagggtgaaacacaagagaaaaataatgaaaaatacaaaaaaagagtataagagatgtaaggaaaaggattaagagaagtgcagttagaggctgagaagtacagaagaaagtgaacagagcagaagtgatatttgaagagatagggactgagaattttccaaaaactgattttaaaaatgaagccatgggtgaaagaagtatttaaaacttcaagaaaaattactttaaggaaaatcagaatttcttagtgcatcatattaaaatgctgaaaacaaaaaataaagagaaaatcttacaatcagacagaggggaaaaagatatacaggaatcaccaataagatagatactgtatctcatttctcaaaaggaagattgaatactatagaaaattaaatggcatctttaaagtgctgaaagaaaataactacccacctagaattctatacctaatgaaaatgtcctttaaaaatgaaggcaaaataaaggctctaataattcaaggagcgttctgtaatctctaatgttttaactaaaataatgaaagaatgtataaataataatggggaaatatgaaacaaagaaaaatacttcattaatctaaaaagcataagaaataataagtccatagacaagtgtaacaaacagaaacattacagagttggtaaaacttgaggagaaatagatgaatccactattcaacactactttaacagaaacagacagatacagcatgctaaaaatcagtgcgaacatagttgaattcagcagcaccatcaatcaactggatctgattcatctaaaacgtcatccaacaacagcagaatacacattcttctcaagctcatatggaacactcaccaagatagaccacattctgcgtcataaaatacacttggcaaatttagaagaatcaaaatcatcctatgtctgccctcagaccacaatggaatgaaaactagaaatcaatgacagaaagataacaggaaaaatccccaactacttggaggttgaacaatatacctaataacacatgagtcaaagaagaaatctcaaggtaaactttaaaatattttgaactaaatgaaaataaaaatacgtgttgtcaaaatttgtgagatgcagcaaaagcagtgtttagaggaaaagttgtagcattaaatgcatatgttagaaatgaggaaagatctaaaattaacaatcagctttcagcatggaaaactgaagaagaacaacttaagcctaaagcaaatagaaaaaaaaagaaataagaaaaattaattaaaaataggaaataagtgaagaaaatcgacaaagacaaaagctggttctttgaaaacatcaataaaattgacaaacttctagtcaggctaagaacaaaaaacgggagacacaaattaccaacattagatatgaaagagagtcatcactactgatcacatgaacaacaaaatgatcatttaaaaatactgaaaacaacattatgctcacaattttgaagaactttgatgaaatggaccaattctttgaaagacccaaactaccaaaactcacacaaggaaaaatagatctgaataggcccatatttattagataaattgaatcaataattaatagacttccaaaaagaaagcaccaagctaacctggtttccctggtaaattctatctaacacttttaaaataagtgatattaattctctgtagtctctttcagaaaatagaagcagaggaaacacttcctaattcattatatgaggctaacattatcctaataccaagagcagacattacaataaagggaaactacagactaatatctctcatgaatgtggatgcaaaaattcacaacaaaatattaacaaatcaaatacaataatgtacaaaaagaattatacatcacaaatgagtgagatttatttcaggtatggaaggctggtttaacatttgagagtcagttaatggaacccaccacaccaacaggctgaagaaaaaaatcatatgattatatcaattgatgaagaaaaagcatgacaaaatccaaacccattcatgatgaaaactctcagcaaactaggaattcaacttcataaagcacatctacaaaaacctacagctaacatcatccttgatggtgagaaactgaatgttttctccttaagatcaggaattagaccaagatgtccctctcacaactcctattcaacattatactggaagttctagcttgtgttaaaaaacaagaaaaggaaataaaagacatacaagttgggaaggaaaaaataaaactgtctttttcacaaatgacatgattgtctatttagaaaatcccaagaattaactaaaatttcttggaactaataagtgattttattagtttactaagactgccaataacaaaatacaacagactgggtgagttaaatgacttaaatttattttctcatagttttggaggctagaagttcaaggtcagggtgtcagcaggtttgatttctcctgaggcctctctcctcctcttgcagatggccacatttttgctgtgtcctcacatggccttttctctgtgtatgaaaatccctggtgtctctttctgtttgtctcatcttcttagagggacaccagtcagattgaattagggtccaccctagaggccttattttaacttaatcactttttaaagtccacatctccaaatgcagtcacattctagggtactggggattagggtttcaacatatgaaatttgtggagggacaaattcagtccataatagtgattatattatagcaaggttgcagaatacaaggttgatacaggaaagccaatggctttcttatatactatcaatgaacaattaaaaatacaaatttaaaagcacaatatcatttacaatagtaccaaagaaagaaggaaagacattaattctcaggtagaaatctacaaaaacatatacaggatctatatgcagaaaactataaaactctgatgaaagaaatcaaatcaaatgaaaacaaatggagagatatttcatgtccttggattggaagactcaatgttatttaaaagacaattcactgtaacttgatctatagattcaacataatctccccaaattccagcaagctactttgtgcatatcaacaaactgattctgaagtttatataaaaaagcaaaagacataaaatagccaatacagtattgaagaacagagttgaaggctgacactactgacttcaagacttaatataaagctccagcaaggaagacaccacagtactggtgaaagaatagacacttaggtcagtggaacagaatagacaggccagaagaggactctcacaaatatactatagtcaattctctttgataaagaaccaaagacaattcaatggagtaagggcagtgttttcaacaaatggtgcataacaattggacagccacgtataagaaaacaaatctagactcagatcttacacctttcacaaaaactaactgaaatagatcatggatctcaatgtaaaatacaatattttcagatttccagaaaaaaaaaagcagaaaatcaatgtaaccttgaatttagtgatgagttttaaaatacaagccaaaaagcatgattcatgaaaaaaatttataaattatacttgattaaaattaaaatactatgttctgtgaaaaatactgttaagggaatcaaaagacaaggcacagattgggagaaaatatttgcaaaccacctatgtgatacgggaacttgtatccaaaatacacaagaaactcttaaaaaaacaagaaagcaagtaatgcaattttaaagtgggctaaagatctgaagagacagatcaccaaggaagattcatagaatggcagatagaaagatgcccatcataatttacggctgggcacagcagcaccagctcctcagaaggctgaggcaggagggccccttgaaaccaggagtttgaagctattgtaggctatgatgtgcctgtgaacggccactgcactccagactgggcaacatagtgagagctcatctttaaaataaataaacaaatgaataaataattaatttgtcattagagagttccaagttaaaacaatagcaagatgccactacacacctatgagaatggttaaaatccaaaagcctgacaataccaaatgatgacagagaggcagagcaacaggaactcttgctcatcgctggtgggaatgcagaatggtgcagccactttgaaagacagtttggctgcctcttacagaactaaatatagtcttagtacagaatccatctgctgtgctcctagatacttatccaattgatttgaaaacttatgttcgcataaaaaaatctgcatgtaaatgtttaaagcagatttattcataattgccaaaaactggaagcaactaagattctgttcaacagctgaatgaataaacaagttgtggtacatctatatagtggaatacggaatataattctgcaataaaaagaaatgagtattgagctatgaaaagttgtggaggaatcttaaatgcatactgctaagtgaaagaagccagtatgtttatagcagcatgatttatattcctttgggtatatacccagtaaactatgcaaccataaaaatgatgagttcatgtcctttgtagggtcatggatgaagctggaaaccatcattctcggcaaactatcgcaaggacagaaaaacaaacactgcatgttctcactcataggtgggaattgaacaatgagaacacttggacacaggaaggggaacatcacacaccggggcctgttgtggggtggagggggggagggatagcattaggagatatacctaatgtaaatgacgagttaatgggtgcagcacaccaacatggcacatgtatacatatgtaacaaacctgcacgttgtgcacatgtaccctagaacttaaagtgtaataaaatacatatatatatataaagaagccagtatgcaaaggctacatattatatgattccaattacataatagtctggaaaatgcaaaactgtagagactcgaaagtgatcagtgagttccagggttaaggtggagggtagagggtgaataggtgaactgcaggtaatttttagggcagtaagattattgtaatgtaaaattttagggcagtagaattatttaaatggtggatataagatattgcgttgcattgcctatgcaaccaaaggtgaaccttaatgaatgcaaattttgaaaaattatttaagaggttgggggatcccaagagagaatgcagaccatgagaagagaatctaactgtattacaaatataggaaacactctcactgaagggatgggtcggggaggggaagagaagaatactgaagtattttggaaataagtgaggcttataagattaaaggcaaagggaactgcatgtgagcactgtactctagttgaaaaaattgtttcccatagaggtactggttaacaattctgttattgctatgtatttatactggaatggaacaattacatgaatggatggcagatggtagaagccaggtttctcaccactggagtggctgtttatcaaaaagcaggaggagaaagaatcattcatgcagtgatggatttgagttggagagagcagtgtggactcatatttagctcaatagagaggctgatggttatctatagaagtatttatagatatgcatatatacatgatatagtataaacatgtgtgtttcttgctctgtccctgaaacagcctgaaagaaatgacatcccagtaacagcaaacgtgcacagcaccgtatcttggtttctaatactattctccatttaaacgaaccaggattctttggagaagtggctgtttctaagactgggacaggaaatatccaagatgagcctaaagcatctggtagtgccagaaagtaaggaggtgctcaagaacaaaacaggaccaaacaaaacattgatcagggtctgtcaaaggagcacagatgccagctaaaagagttcccaatggccaaagctggaacactttgcggtaataaagtagtattggattataacctacagtataaagtaaatatgcatggtataaatacatggttaaatatattaataaatgaggaagcagagacaaatctctcttacaaaagaattccatatattttacacaggtactctgtcttcaagaagaaggaatcaaactccccattccttcagtgtgagctgtacataatgacttcctcccaaagtgtacaatatagaaaaggggagaaaaagagtaaatttacagtggaggaccctgacaagcgccactcaggcaggcgaccaaggctaccttccgcactcataaatcatgctgacagtaggtacgcttgatatcacgggatgaaaatagcacttcacctctgtgattttctttccaataacttacaaccccagttttctaatgagaaaaatatcaggcaaattccaaaagtgggacattctacaaaatacctaagcagtcctcagaaccctcaatgcatctaaagaaggaaagtcggagaaactgccacagacagcaggtgcctaaagagacatgacaactaaatctaatgtgggattctggaacagaaggaaaagacattaagtaaagactgaaagaacaaaattatgaacttttgttaataacaggtcattatttgtttcattgtaacaaatgtaagatatcgataataggggaaactggatgtgaagtatattgaaagaattgaacaatgaaaacacttggacacaggaaggggaacatcacataaccagggcctgttgttggcgggggggatggggggagggatagcattaggggatacacctaatgtaaatgaagagttaatggatgcagcacaccaacatggcacatgtatacatatataacaaacctgcacattgtgcacatgtaccctagaacttaaagtataataataataaaaaagaaactctctgtgccatcttctcaacgtttctaaaaatctgaaactgctgtagaaaataaaatctattttaaaaaatttaaataagcaaactgctcactactacacaaaaaaagcaaagattagtctcttgagtataaaattgagcagaagaagccagacacagcctgcaagctccaactccattcataaagagtttgcaaactggcagcgatggcgcgagagcttaggaaattgtttcactgggggaagtggaacagacgttgactggatgatgtcacatgaggggcttctggggtactattaacattcgatctcaaatccaattggtggttatatttttgtttccttaaattaataagtattaatttatgaaaattaattgaaatgacactcataatctgtgcacttttctgtacaattcaataaacttaatgataaaaacaagaatgaatcagaactgtgtatatcaacatggatcaatctaaaaagcaatgttgattaaaaaaatttaaaaatatgtccgggtgcagtggctcatgcctgtcatcccatcactttgggaggccgaggtgggcggatcacctgaggtcaagagtttgagaccagcctgaccaacacggtgaaaccccatctctactaaaaattacaaaaattatcatgcctgtaatcccagcactttgggaggccgaggtgggcggatcacctgaggtcaggagtttgagaccagcctgaccaacatggtgaaaccccgtctctattaaaaaatacaaaaattatcatgcctgtaatcctggcactttgggaggccgaggcgggcagagcacgaggtcaggagtttgagaccagcctggccaacatggtgaaaccctgtccctactaaaaatacaaaaattagccaggcgtggtggcatgggcctgtaatcccagctactcaggaggctgaggcaggtgaattgcttgaacccaagaggcagaggttgcagtgagccaagatctcaccattgcacttcagctctgggcaacagagtaagactctgtctcaaaaaaaaaatacaaaaattagccaggcatggtggcgggcgcctgtaatcccagctactcaggaggctgaggcaggagaatcgcttgaacccgggaggcacagattgcagtgagccaagatcgtgccattgcacttcagcctgggtgacagagcaagactccatctcaaaataaataaatgaacaaataaataaacaaagcaatgttgaatgttaaaaaagtaatttgtcaaataataactaaaatagactactttttttatacgtaccttctgtaaaacaaactatgttcttatttatgggcttacaaaatttagcctaagtatcaaaacacacttgagattataaataccaaattcatgatagcagttatctctgcaaagagaggaaagaaaatgaaattgaggagggggactcacttttttttttttttttgagacagagtctcactctattgcccaggctggagtgcggtcgcatgattgcgactcactgcaagctctgcctcccagattcaagtgattctcctgcctcagcctcccgagtagctgagactacaggcgcacaccaccacacctgtattttttgtagagatggagttttgccttgttagccaagctggtctcgaactcctgacctcaggtgatccacctgctttggtctcccaaagtgctgggattataggcatgagccaccatgcctgaccaacttctacctatactgttgcatgtatatatatttaaaaatccaaaaaacatattgcaaaatgttaagttgtgatacagttgggttcagctacaagggtaaccatgacatttctctataactgcttctagttttgaaatacatatatatgtatacacacacacgagtgtgtgctctataagaacatgtaactaatattgtatagtgcaataacagcctaggagaattaacaagcattttgccatcaatacttatcctttgtgttgctgaggatgaatgaacccatagatcattagtctttgaagccgttggcttcttttaaaagtggttctaactcgaagactaatgacctttgcatttcaccagccccaccttgttaatctcatatctttcaagacatgtacactttgggaggccgaggcgggtggatcatgaggtcaggagatcgagaccatcctggctaacaaggtgaaaccccgtctctactaaaaatacaaaaaattagctgggcgcggtggcgggtgcctgtagtcccagctacttgggaggctgaggcaggagaatggcgtgaacccgggaagcggagcttgcagtgagccgagattacgccactgcagtccgcagtccggcctgggtgacagagagagactccgtctcaaaaaaaaaaaaaaaaaaaaaaaagacatgtaatcccaaagtttccttgaagataaattacatttgctgacaggactctttagaaccactgagaacagtcagatattggaggtcaatgaggaaacaaccccactgctgattcactccatagcatgcactgagcacccacatggtccacatgagatgtgatggggcttgaaccagtctggctgtagaggggaaagaaggagagaaacagatctgagaagcattttgaggcagagctgtcagaagtcaccaaatggctctgaataacatggcggagtccaagaggccagaagaagaatcaagaacagccagggccggtttgagcagctgtgtgaaggctggcaccattaactagggtagaaagcatggtggagaaatggggctggctaagcaaagttgcgggttcaatcaagaagtttgcctttggaatgtgtcatggttgagatgcctttcacaatccaagtctaggcctggtgaggtggctcatgcctgtaattccagcacttcgggaggctgagatgagaggatcgcatcagtccaagaatttgagaccagcctgggcatcatagtgggacctcatctctacaaaaaaacatttaaaaattagctggctgtaatggtaaatgcctgtagtcccagctacttgggaggttgaggtgggaggatggcttgagcctgggaggttgaggctgtagcaagctatgattatgccactgcactccagccatggtgacagagcaagacctcatttcaaaaaaaaaaaaaaaaatccaagtctagatgtgaccaggtatgtggaatctggagctcaaagaggagtcagactggaaagatatacacttggatgtcaccagcatattgatgttgcttcatgccatgggacccaatggggcccccccaccctggaggagggtagttagagaagagaggtctgaggatcaagtcctgggatggttagagtttcatagaggagcaggaacataaataataaaggccaaccacataaggaaaacaaaagctatatattcagggtatactgtaacaagggagtcgtcaccatcacttacattttggtagagactccaaggcaagagtgggaaagtttgacagtgatgttaaccaaaaactgacagaggcaggtgtctcaattgatagcggtttatttcgccaaggctgagaatgtgcctgggaaaaactcgagtcacaggaacatctatgacctgtgctttccaaagagggttttgggaattcagtgtcgaaaaggcaaagaacagacaggagggaaaaaagcgagggagggtgggcagtgaggcaaatggtaacattattgtgaggttctgattaacgctcagtaaattggcattttacataaaataaagcaaacacgtgaaaagaggaagtatggggaaaagtcaatgatgcatttatctcagggtggatgaagggatgatttctggtcttgtccttgtcctcttacctgtgaagataaacttgtaattgacattgttagggtgagattgaacagaactcagtttcggggctagcttataggggggatatgtatcctataagatttagggctcacacagaatttccttgtgagcaatttgtgaagaaggccatctggggagatatgtggcctcctatctttgtgggaacctggcttatgtatgacgttatgacacagggttttgaaattacagctatttgagaacaaaagaaaggcagtattgcatgactcagttcccaagcttaactttccctttggcatagtgagtttagggtcctgcgattttgttttctttcacagtggaaaggaagggaaggctgcaggtgcaccctgatgggagtctgttggcatggcgaagccctaggtgagctaattaggggcagggtgtcccatggaattggctagggatgcatatttggttttctctggttggtcctaaaattaaagtgaagacaaaaattaggggagctgtcagttattaatcaagtcctggtcattgtgggccaactgttatggatattattatttaacttcctgaattgttactagagatagcagtccggctttctatgagtctgacttatagcaggctggcttccggttgtttattgtagataaaggggttgggttcctggcaggtagctgcaagctgtgagtcatagttctatttatatatcatgtggccattgtccatttgtatatttagtctcttgggagaaaaaagccgaaaaggagattgaaaggagcagctagagagaggagggaaactaagacaatatcatcatcccagaacttaggaagataaagtcccaacaagaaaggggtggttcactgaagcaaatgctgctaaaatgtctgataagatgaggatgtcaaagtaggtgaagcttttccaggtgaaaaagagacgtagccatcattgttgctgaattctcagacacaggaaacattttcctgtggcttcaggcaatggtgaaataggaactaacagggtcagctaggaagagaaacttttaatgcctctagggggcacagcatatcatacctaacaactgagcagcaaataccgtcccctactctccagacgcattttccagcccaacatgggattcttagattggttagatggcagcatctgagaccacaattaacctgaaatccaagctcaggcacttgcagctccaaagcctcacactcgatgctccgagtttagggacttctatcaagtaaattgggaaatgggtcgttctcctttgaagactgttaggaaagagggacaaaaacggaaaaaaaaaaaaatcaatccctgagtttaatctccagtattccttcccagaaactttaagttagctacaagaatgttaatcatgagcagaaattgtttaataatcaaattatcataaatttgcttttcttttaccttagtaaggtaactatgtgacaaacatttgtgaagttgagaatagataaaagtacccatcatatgatctagccatcccactgttggacatatacccaaaagaaaggaaatcaatatcttgaggagatatctgcacttccatgttttttgcagcactgtttacgatagttaagatttggaagcaacctaagtgtccatcaacagatgaatggataaagaaaatgtgatacatccacacaatgcagtactattcaccccttaaaaagactgagatcctgtcatttacaacaacatggatggacatggaagacatcatgttaagtgaaataagccaggcacagaaagacaaacattgcatgttctcacttatttgtgagatctaaaaatcaaaataattgaacacatggatatagagagtagaaggatagttatcagaggctgggaaagctattcgggggctggtgggtgggtggggagagatggggatggttaatgcatgcaaaaaataactagaaagaatgaagaagacctactgtttgagaacacaacagggtgcctatagtcaataagaagttaattgtacacttaaaataactaaaagagtatacttggattgtttgcgacacaaaggataaatgcttgagggggtgaatacccctttcttatgatgtgcttatttcacattgcatgcttgcatcaaaacatctcaggttctccataaatatatacacctattatgtacaaaaattaaaattatttttaaaaagtgccaagaaactctgtaccctaacatagccctgttagaattacttagcactaatagttgcctttgctgagtgatgcaagcagatgtctctggccctcaaagatgaggagacactgctgctctgcttggtgtgaacataaactccagttcttctgggaactgccttaaagacagcagaaactggagagcagagaaaagtggaaagtggccaggcacggtggctcacacctgtaatcccagtactttggtaggccgaggcaggcagatcatgaggtcaggagttcgagaccagcctgaccaacatggtgaaaccccgtctctactaaaaatacaaacattagccagatgtggtggtaggtgcctctaatcccagctacttgagaggctgaggcaggagaattgcttgaacctggaaggctgaggtcagtgagccgagatcttgccactgcactccagcttgggcaacaagagcaaaactccttttcaaaaaaaaaaaaaagtggaaagcataaccttgcttgatggtgaggttgaatccccaccttcgcctttctcagatttattcccatcttcctactcctccaacccctatgttggctcaagcccagatggctctcacctgcattaacctaaccatctcgtaacccatctcctctctttgttcctttcctatgcaccctccacatggccagctgccagaggatctttcaaaatgactaatcttactattcttctcctctacaaagcttcagaggcttccagtctggactccttaacaacacataaaaaattcctcttctgttcttcctctggctggtggctctcaaccttggctgcacttgaggatcctggggagctttaaaaactgccctgctctggtttagtcagtctgggctgggtcccaggtgtctagagttttagttttgtttcccaggacctggtgactccttgaactatttgcagattcctgaacccctgtcggagagtaagctgtgttctaatctcatcagatctaaggagagatgtaggaacttgccttgaggcttgaattctttctcctactctccacttgtggtagtcagtcttttgcatttaagggtcaaaaataagaaggcctattgtgtttccaaggctggggtccatagtgcatacgataggtttcagagggagagatggcagtggagatggggaaagaaaatgtggaaacctgagtctaggatgttgcttgctaagtgtactagaatatgccaccccaaatatgcctctttggcatataattattttgagctgaaggctattgagaaccagcagatgcacgaaaggtctaaaaacagagtctaagttttccttttgtaaaggattgtagaggtgtctccttctcccaggaagaagactcttaactactcatcagaggagaaagggcagacttaattctgcacaacaaatcttactaaacacctcttgtttaccatccttttcctggttaacttctcataagttgcctcccctacacagaagccccaaccccttcttttttgttttagcctaagatggtatttaacccccagtctaaccacccctttgggttactcacctcttagtgttcctgtgtgtacacagacaacgaacttgtaagtagacttgtttttctcttgttaatcagtctttggccagtctaacttataaggtttcagttggaaaacctaagatgggtagaggaaaagattcccctgcaacacacttatattatgaaaccaaactggataccaagcaaggaggatcgggcatctaacacttaactcctgacctccacaatagcttgcaggtaagggtttttttttttttaatatatatatgtatttttatttaagttctagggtacatgtgcacaatgggcaggtttgttacatatgtatacatgtgccatgttggtgtgctgcacccattaactcgtcattttttttgttttgctttttgttttgttctgttttttttgagacggagtctcgctctgtcgccaaggctggagggcagtggcacaatcttggctcactttaagctccacctcctgggttcaagtgattcttctgcctcagcctcctgaatagctgggacttcaggtgcctgccaccacacccggctaatttttgtatttttagtagagacggggtttaaccatgttggccaggatggtctcaaactcctgacctcaggcaatccacccgcctcggcctcccaaagtgctgtgattataggcataagccactgtgcccggccacaggtaagggttttaaaggcaggaggcagaggttacaggcaaaataagaaatcatggaggttatacattggtttaacctagaaaggtggaacatcttgaagtgggcccacaggtcataggtgaggcaaagctttgtctaaaactgtgggatcagtagaaaagaatgtcagctctggctcatgggtgtgacttcctccaggctccccagggagaaatttagaacaaagaatggcagtcagaattcagtcctcaattcctctttatctgaagtctatgtgtcagtggatccatttggtggatccattggtgggggtccaggtttctgaaacaactctgggacatatgttaatggcacaggacttttttggggtgccacttcaccagccagagacctctgcagctggctgcacccctgcctgggcctcactcagctctgagctggcctctggccttgctccatccagttggcccagcaggctgcacccagctcaccctaccagccaccacaggtgagccaggtgtggagtggcaagtttgcagggtccagttactgtgcacagtcaggtgcatcagctgctgcaatggaatgagcagctccaggtgctggcatccagactaggggaacacagtggcacccaaaaacttggagatgccagcacctgtgaagccccaaagggggtgttacatcatgtcacagcactggctccagaagctctgaggtctagatgtccagaagggttgcagctcttttctccttcccgccactcacagtgcagaaaatgggggtatgttaacagctcattcagtcctgctgccctgctctagcttgtggctcctgggaaggcccggccctgctgccatttcccatcacgtgggacggatgcccagcactggcggagggtgggagggctacagtgttacagcagctacttttgcacccactgtttggtgggtcctgggttcttgtcccatgtccatgaagaatgagattatgctgacaactggagagtgagcaaggcagagaagagctttattgagcaacaaaacagctctcagcagagaggggagctgaaggtaggtagtctcaatgtgtggctgagtctctccagtttttatgggctcagaatgtgggaggtgtcagctatccatagccttggaaaaggcaacacttgattggttaaaaagcattattcagaaagaaccaattgggaaagagcaggcaaatgaaaatagaagttctcattctggtcatggactccatccagaactgacagcctggttttcaggcttcaggctgtctttggcttggaggttgggtttcatgggggacccaccccaatctgcctgggaatttgtctgtctcctgctgctatctttaagatgctatctttggctgggcatggtggcttacgactgtaatctcaatactttgggagactgtggtaggcagattgctcgagcctagtagtttgaccagtgtgggcaacatgacgaaaccctgcctctacaaaaaaaaaaaaaaatacaaaaattaacaagttgtggtggcatgtgcctgtggtcccagctactgacagagctgagatgggaggattgcttgagccctcagatcaaggatgcagtgagtcatgattgcaccactgcactccagcctgggcaacagagtgagaccctgtctcaaaacaaaacaaaatcaaacaaacaaaaaaagatgttatctttagtttttacagggagccaaacatcccatgattctcacttccatgattattgttttaagctactattactctcttgcttatcaagttgttcatttacttctcaggctagctaggtgcctggaatttccctttaagaaactcaagattttttaattcctctgtttggtgctggggagaccaggcccctaagaggggtccctgctccatctcatttgtaagagcttatgagacagccgctccagggctggccagtagctcaggaggaggaagagtcagtggcagggaaagggaggtccagctcgcctgggagataggagctcttccagcactgggctgggaaaccattctctggcagccctgccactcagtggaccctcaacttctccttaatttcctaggcagtataagggtaagtacaagtaaaaagaaattgaattttccctggtgccaaaaggcaaagagaagtccctccctcccttttcttagagtatttcctttataatcctttctctgtctctttgggaggtatataaacctttctgaaagctaaacaagccctttgccactttggcttcccaggaatgtgcttctcgggggcctcggagccatctctttgaaatgtgaacattaagatggatggtgccctgtctcctgtctctctgggagctttgcctaggagtctggctacaagttgtagcatatgagagttttcttcttcctttggatgagtgcaattaacacatatgtaatagattctatctgcctggctatgtaagagggtgatacattttttctgtctttgcaatttctttagtggattgcttttgatgtgtgttgcaatctggtttaatgcatatgtaataataacactttttttcatttcgtatatttttggacaggttttctagattggcagattttattttaaatttccgcaacagcagcaagtcctagcatacctcaacatcatcccaggaacaccccacccttggggaggaaatatgccagagataggaagggccacttctaaatacaagagagtcatcaggcacctgtcaggagggagagtatccagtctctagagatggaaatgtcaacctaaaaggaagaagcaaaggcagaattaatatagagagtttatttgggccaaggttgagagctgcagccatggatgcacttccaagttgccttggggagtgctctggaggacaaagaagagcctcaagtttttaaagaaaaaaggaagaatcatgagagaagcaattacgaaagctgctcatcaggaattttcattagtttacagaaataacattggttagtgattggctatacattgttgcaacttggcattcatctgcagcccacatagcaagtggcttcaagaggtcattattcagttccagggagagtgagacctgattgtggtcacattttaaatgcctttctgggcctgatgatttaaagggctcacattcctcagataaaggttttttttctttctcagattgaagtattctggtgcactcagcctttggacagaaaggagtggagattctcattacatatgggtgcttgccttagttgttttaaatttatgtgcaaccaggctgtttctcccatataaaagcacccctaaacggctgggcgcggtggctcactcctgtaatcccagcactttgggaggctgaggtgggtggatcacaaggtcaggagttcgagaccagcctggccaacatagtgtaaccccgtctctgctaaaaacacacacacacacacacacataaaaattagctgggagtggtggtgggtgcctgtaatcccagctactacggaggctgaggcaggcgaattgcttgaacctgtgaggtggaggttgcagggagccgagactgtgccactgcactccagccagggcaatagtccgagactccatcttaaaaaaaaaaaaaaaaaaaaaaaaaaggcacccctaacaagagccaacagtctctgttgagaccttcctacccttcaagagaacaccaaattggttgatgaacatagtggagaggaacggggatctccatcattgggaccaagagaggctgtgaaacatgataaacgctggtctagaacagtatggagaggcacatgtagtagcgggttcaactagcaaagagaagacagcgtcctttgcaattttatgtgagtccttccaatcagatgaccttacagaggttttaagtttaggttttgttttttttttgaatttgtgatgactttttggagtttggctcaactgtcttgtagaacatccctcattctagctttgtcagacagcttcgtcagggcctccttgacttgtccttctctcctctgtatttcctgtaactggatgtggatctaaaggctgaactgggctcatgagaagaatccttcacaggtgtgatggttaatactgagtgtcaacccgattggattgaaggatacaaagtattgatcctgggtttgtttgtgaggttgttgccaaaggagattaacgtctgagtcagaagggtgggaaaggcagacccactcttaatctgggtgggcaccattagctgctagtgcagctagaatataagcaggcagaaaatgtgaaaagagactgtcccagcctcccagcctacatctttgtctcgtgctggatgcttcctgccctcaaacatcggactacaagttcttcagtttggatctccctgctctcagagactggctctccttgctcctcagcctgcagatagcttattgtgggaccttgtgattatgtgagttaatacttaataaactcatatatatatattcattccattagttctgcccctctagagaaccctaactaatacaacagatggatcccatcaggacacatgatgacagcccatccctgctggcattgctcactttgataatttagggaaggtgacagtcaccgtatctttcatagtaaacgtgcattttccttctcaaaattagtaaatactgtaatttgttgaattatactttgacatcctgttcctcaacaacctttcacccaataaggtttggcatccactgaaggtgcttccctgaatctatttcttctttgagggttgcaataaatgtatatcttttttctacatttattggaggaagtcttccctaaagaagagttctcttttctctctctgttcctttttctttttttttgagtatcactgtgaattcatggatttctttataactcaatgtcaactgccatcattattatttctgatacttaatctcaatttggccggtgggaccctcttcaagctgcctctgctgttcgtttgacatgatcccattagtccgtgatttccttattttctggtacaataaggtgtcctaggctcaacttgtaatttacctgcttttgacttgtaatcagccggttcaatgaggatccctggttccctttcctggggaatggtacttagataccaagttcaaggcatgaggtgtgcccattgctattacaatgttatgacttctaggctctttgactgaaattaattacagacacacacatacatacgtgtacttatgaattcacactgacatttcttgtttttttttatttcaatagtttttggggaactggtcatgtttggttacttggataagttctttagtggtgatttctgatgttttggtgaacctgtcacccaagcagtgtacactgtacccaatgtgtagcctttttttccctcaaccccctcccacccttccccctgagtccccaaagtccattatatcattcttatgcctttgcgtcctcatagcttagctcccacttataagtgagaacatacaatgtttggttttctattcttgagttacttcactttgaataatggtctccaactccatccaggttactgttgctgtgaatgccattattttgttccttcttaaggctgagtggtattccatggtgtatatatgccacattttctttgtccactcattggttgatgggcatttaggctggttccatatttttgtaattgtgaattttgctgctataaacatgcatgtgtaagtgtcttttttgtataatgacttcttttcctctgagtaggtccccagtagtggaactgttggatcaaatggtagttctacttttagtttttaaaggaatttccgcactgttttccatagtggttgcagtagtttgcattcctaccagcagtgtaagtgttccttttcaccacatctatgccaacatctgttatttttttattttttaattatggccattcttgcaggagtaacgtggttctcattgtggtttcgatttgcatttccctgataattagcgatgtcaagctttttttatatgtttattggccatttgtatttcttcttttgagaattgtgtattcatttcctttgcccacttttttgagggtattattttttgttttgttttgttttgttgctgatttgagttccttgtagattctggatattagttctttgttggatgaatagtttatgaagattttctccccctctgtgggttgtctgtttactctgctgattgtttcttttgttgtgcagaagctatttagtttaattaggtcccatatatttatctttgtctttgttacatttgcttttgggttcttggtcatgaacactttgcctaagccaatgtctagaagagttttgccaatgttatcttctagaattgttatggtttcaggtcttagttttaagtctttgatccatcttgagttgatttttgtataaggagacagatgaggatccagtttcattcttttacatgtggcttgccaattatcccagcaccatttgttgaacagggtgtcctttccccactttatgtttttgtttgctttgtcgaagatccataggctgtaaatatttggctttatttctgggttctctattctgttctactggtctacatgactatttttatacaagtaccatgctgttttggtaactatacccttatagtatagtttgaagtcaggtaatatgatacctccagatttgttctttttgcttagtcttgtttcagctatgtgggctctttttttgttccatatgaattttaggatttttttttctagttctgtgaagaatgatgatggtattttgatgggaattgcattgaatttgtagattgcttttggcagtctggtcatttgcacaatattgattctacccatccatcaacatgagatgtgttttcatttgtttgtgttgtctaagatttctttcagcagtgttttgtagttttccttgtagagatctttcacctccttggttaggtatattcctaagtactttattattattattattgcagcttttgtaaaaggggttgagttcttgatttgattctcagcttggtcattgttggtatatagcagtgttactgatttgtgtacattgattttgtattccgaaactttactgaattcatttatcagatctagaagctttctggatgagtctttagggttttctaggtatacaatcatatcactggtgaacagcagtttgacttcctctttattgatttagatgccctttatttctttttcttgtcttactgctctgtctaggacttccagtactatgttgaatagaagtggtgaaagtaggcatccttgtcttgttccaattctcagggggaatgatttcaacttttccctattcagtataatgttggctgtgggtttgtcatagacggcttttattaccttaaggtgtgtcccttctatgccaattttgctgagggttttaatcataaaaagatgctggattttgtcaaatgcttttcctgcatctattgagatgatcacatgattttagtttttaattctgtttatgtgatgtatcacatttattgactcatgtatgttaaaccatccttgcatcccttgtatgaaacccacttgatcatggtgtttatctttatacatgatgatatatctttatatcttaatacactacttgatcatggtgtattatcttttttgatatgctgttggattcggttagctaatattttgttgaggatttttgcacctatgttcatcagggatattggtctgtagtttttctttttgttatgtcctttcctagttttggcattaggatgatactggtttcacagaatgatttaaggatgagtccctctttctctatcttttggaatagtttcagtaagattggtaccaattctttgaatagctgatagaatttagctgtgaatccatctggtcctggacttttttttttgttgggaatttttgtattattgtttttatcttgctacttgttattggtctgttcaaagtttctgtttattcctgatttaatataggagggttgtatatttccaggaatttatccattcttctacattttctagtttgtgtgtgtaaaggtattcatagtagccttgcatgatcttttgtatttctgtggtgtcagttgtaatagcttctgttttgtttctaattgagcttatttggatcttctctctccttttcttggttaatctcgctaatggtctatcaattttgtttatcttttcaaagaatcatcttttttgtttcacttatctttttgttaatgttgttgtttacatttcatttagttctgctatgatctttgttatttcttttcttctgctgggtttgagtttagtttgttcttgtttctctagttccttgagggtgtgaccttagattgtctatttgtgctctttcagacattttcatgtaggcatttaatgctatgaaatttttcttagcactgctttttctgtatcccagaggttcagctcaaatacttttttttttcttttttagatggagtctcactctgtggcccaggctggagtgcagtggctcatctcggctcagtgcaagctccgcctcccaggttcacaccattctcctgcctcagcttcctgagtagctgagactacaggcgcctgccaccactcccgtctaattttttctatttttagtagagacagggtttcaccgtgttagccaggatggtcttgatctcctgacctcgtgatccacccgccttggcctcccaaagtgctgggattacaggagtgagccaccacacctgacccagttcaaatactgtttaaatttctgtcttgatttcatggttgacccaaaggtcattcaggagcagattacttaatttccatgtatttgtgtagttttgagggttccttttggagttcatttccagttttattccacacggtctgaaagggtagttggtataatttcagttttcttaaatttattgagatgttttttgtggcctatcatatggtctatcttggagaatattccatgtgctgacgaaaagaatgtttattctgcagttgttgagtagaatgttctgtaaatatctgttaagtccatttgttctagggtatagtttaagttcattgtttctttgttgacttcctgtcttgatgatccatctagtgctgtcagtggagtattgaaatcccccactattatcatgttgccatctatctaatttcttaggtctggtaataattgttttagaaatttgagagctccagtgttgggtgcatatatatttaggattgtgatattttcctgttgcagcaatccttttatcattatataatgtccccctttgtctttttaaattgttgttgtgttaaagtctgttttgtctgatataagaatagctactcctgcttgcttttggtgtccatttgcatggagtatctgtttccattcctttaccttaagtttatgtgagtccttatgtgtctggtgagtctcttgaagatggcagatacttggttgatggatttttatctattcttccattctgtatcttttaagtggagcatttaagccatttacattcaactttagtgctgagatgtgaggtactgttctattcattgtgctagttgttgcctgaataacttttctgttgttgttgttgtttgttttttctatttgtattgttttataggccctgtgagatttatgctttaaggaagttctatcttggtgtattttgaggtttcgtttaaagatttagaactccttttagcatttcttgtggtgctggcttgggagtggcaaattatctcagcatttatttgtctgaaaaagactttatctctctttcatttatgaagcttaattttcctggatacaaaattcttggttaacaattattttgtttgaggaggctaaagataagaccccaattccttcttgcttatagggtttctgctgagaaatctgctgttaatctgataggttttcctttataggttacttgatgcttttgcctcacagctcttaagagtctttccttcatcttgactttagataatctgatgactacatgcctagatgatgatctatttgcaatgaatttcccaggtattctttgagcttgtttgatatctaggtctctagcaaggccagggaagttttcctcaattgttccctcaaataagttccacacttttagatttctctttttactcaagaacaccaattattcttaggtttggcagtttaacataatcccaaatttcttgggggctttgttcattttttaaattctttttttttcttttttttggtttttatctgattgggttcattcaaaagtcttgccttcgagctctgaagttctttcgtctgcttgttctaatctattgttgacactttccagtgcattttatctttctctaagtgtgtcttccatttccagaaattatgactgttttttctttatgatatctatttatctggagaattttcatccatatcctgtattgtctttttaatttctttaagttcattttcacctttttctggtatctccttgagtagcttaataaccaaccttctgaattctttatctggcaatttagatttcttctgggtttggatgcattgctgggaagctagtgtgatctttcaggggtgttatagaaccttgttttgtcatattaccagaattaattttcagattccttctcatttggtcagctttgagctcaccaaagagaatatttcaatggaaagatctggaactcaagggctgctgttcacattcttttgtcccacaggtgacccttgatgtggtgctctcccccttcccctagggatggggcttcctgggagccagactgcagtaattgtaattgttcttctgggtctagccacccagtggggttaccaggctctgggctggtgctgcggaatgtctgcaaagagtcctgtgacgtgatccattttcaggtctcctagccatagctaccagcacctgctctcgtggaggtggccagggaatgaagtagactctctgagagcctttggttgtagatatctttagtgtgacggctttctcaaatgcttgttatgttaacagtgaagttgtcacatggacagattcaagacctctggttagccaggatgttgcaggcagtggaattagctgttgttttctctttccttgaagcagggttattccgtcatgagttgttgtaatgtcctgagctgcttggcctccagccaagagatggtgctttcaagagaacaccagctgcagtagtagtagagggatctaagcttgcccgaatttggccaggattagtatttgggtttctcaggtgatgggtggggccataaagctccccaaaatttatgtcttttgtgatcaactaccagggcaggtagagaaatatccatcatgtgggggcagagtttggcatgtctgggctcagactctccttgagcaaggcttgccacagccactgtcgggggtgagaatgtggttctcaggccaatggggctatgttccaaggggtattatggctgcgtctgttgcattatataggtcaccagggaagtaggggaaagcaataggcctcacccagctcccacacagttggtggggccgatcttgctccttctgtatcccactaacagcaccaagtttatctctgggcagcttatgctctggactcagaccttgccccaggctataagcttccctgctgagaaagcaagcacagctttcgggccttgcccttccctgtctgcccatcctgttggccacagctttgcactcctatctgtagcagttcccttttgccctccggattctgttcaagagaatttgcacccagttgaaattattacaaagctcacttggaagcttctttcaccctgtggcccctgctaattctactggctgcctctctcaaggacccctgtgagatagagtcagagatggcttccccgggctaaagctggagcatgggaatgtctacaaggctcttcccactgctgcttctacttttatagaaaatattttgtactaaatccatttcagctgtagatacggttaaatccttctcctgtaatctggattttcaggttccccattggggatatgtgcttggaggcaggttttctccctctcacactttgggaatgcacagttttttgcctgtcttgtggaatttgcagcggtgtgccacttctttaaaaggatcagtgaattattttggttttcctggtacgttcctgtggtcgttcttagaacaaaagttcatgctttgtgtctccacatactcctctgtctgtccattcaagtgggagctgaacagtagccctgtctcctatctgtcatcttcctcttaaaacctggcaatttatttttattttttatagagacaaggtctcacaatgttgcccaggttggtcttgaactcctgggctcaagcttcccaaagacaccgatatttataatttaaatttaacattactgaattattatttaactttattttatttaataattgtatctattttccccttcaaaggaaattatgtttcctaaaaacatgtttgtataacatacatatatatacacatacatatgattaatatatatacacacagtactttcttgttctatccaaaaacattcacatagcagtctcaaaatgataataatagctttgttacaaacaataaatccagtaagggcaaagcttatttgtaacactttctgttcccagagagtatccaactaaggctgtgcagcccaagtgccacgtttgacagtttcttaaaatgattctttttgccatgttatcagtttgatatatagttggcctcatttctttgtgtgtacaattttggactgctttctctgatcttttttatttcatttatgttttgcataatgtaaaacacttacatggttcaaaagtcaaaactatttttgaaagtacagagaattctttcttccagccctatccctctacaccattcctacccacttgtatggttaatcatttttattggtttttggcttatctttccagtgtttctttacaataagcaaatatgtatatgtacacacatatataatcttatttttcaaaaaataacaccatatatgcactgtctgtatttggccttttctactaacaatatatcttggatattattccatagtggttaatggcaggcattttttattcttctttcttatggctgcatagcacttcactatgtgactctaccataattcactcaaattcatttcaaccagtttcccattggtggacacctgaaaaactcctatctctcgatatttggttagttgcctcaactgcatgccaacttctgctttggagtggataaggaaggtaagacctttggggacaagactcaagactcagccacttttgtcccaaagctacaggacttgttctgcctgccaatgctgtctctttcttcagcaaaagtgggattaagcgtgtgtataatgccaggtatgaagctgcactgctatgcaagttggacttctcaatcagcataaaagagctgaccattggaaccatccgaaatctcatgaagagggttgagggactctacttatgtacattttacagcagagagtaggaccgggtaagtcaaggttatccactatagtaagttactgctcaaaggaaaactgatagaaaaagggtctccaccttcttaaacacagaagcagtctgcttcaggcagaagatgacaggcaactcttctagtagaacttgaggtatacattcatggctccattgagaatggagatggggtttcaagcatggaagtggggacagtgacccatcagtctgagaagacacttttatgcccacatctcaagcattgctattattttagaagtagatgctcagttgtctgataaagagtatgatatcatccctattggttttaggacctagaaatagatttgcaggaccctaagggcaggatagaggtggatgagaaggtttatagtttttgggtccaagaggtggtggttggttagcgtatgggagaagaaccagcagaacctgagggtgtaagggttgatagacaaaacaaagctctaagtacatgggccccaggccagcgcccagaaacaagcccagacacaagaacccagccccatactatgatctcacccctagcaggcccccattcactctgcagctgaatgtccaggacttctgcaggttaaagaatgacatctgctaatctccagtcaaggtgcacctcagctacactctggactgtagtaacaatgtgcaccattgtctgtatgccctggggaatcactagactccaaggtgggctttgaacttggtgttgtcaccaaccagtgggtggggacctgggagtcccataccttagtgtaggaatgttgatgtcatgggtattggggacagaggagatggactgcattcatgcatgcttttgctgttgtgccagctctctaaaataccttgccttttttggtctatgtatcagagacctttccatctgtcaacaatcaacattagcatcaccttgctaatagagcttttcttgggccccctttggtagaagggtagtctactccttccttttggttcctaatccagtcctgactggattataaggacttcaattcatctctataactagtatttagcactgtgtcaggcacctagctggtactcagtaactgttcagagaatgagtgaataaatgaatgaatgattccaacagatgaaggaactggcctgaaaatgacttgcctatttgccaaattcacccagctttttagtttctcaccttctgacaccaatcaggaataaaagccaaaacctagattggcttttcatcccaagacatgtcctgtcctttatatgggtgtggacttacgttagagcccttgtcattcctaataattccctcttgtgcctacctggatggagctcaccttgggctatgattaggagagcctatctccagcacctgcactcactcacctgactccacctgatgacttgacctatttgttcctccatcagtcaacatgagtgcattggagacttactgtccgttgttctctgtggacacatgtgaagtgcaaagacatgctaaggcaactggcctgagcctgtaattcagccaaggctggtaatgacacatgatcagaggtcacaacactctttttaagtcacagcagtttcccttaagcatggctttagagtctctgagctcaccatgacttctattagagatagcataagcctacagtgctttccctactctttgttctcattcaccactcagcaccacacttttggcaccagatagatggggatttttcccacacgtatcagtaaagcaattctgcagcacacaccaatgaggtgtcctgcaattcaattcaattctgatgctaactacccaaagatgtcatcaaatcccacagggtgagggcttagtcctataagactctccccaaccttgcacaccaattgcaagccctaggatgtgacctgtgcctttgaccaaccagctacaaattgaggttcctacaaccccctccttgggttcaattaatttgttagagcagctcacagaattcagggaaacactttgcttatgtttatcccttatgataagggacattacaaagggtaaaataaacagccagctgaaagggaggcacaggatgaggtatgtgggaagggctgagaagctcccatgccctcctagggaccaccctccaggaagctccacatgttcagctgtccagagctcccaaaactcagcccttttgggtttttatggaagcttcattatataggcatgactgactacatcatgggccattggtgatcagcttaactttcagcctctctccccaccctggagtttggaagtggggctgtaagtcctaaccctctaatcatgccttggtctatggacgaccagttcccatcctgaagttacctagaggactcatccacccattactcattagcatacaaaagacactcatcactctggagacttcaactgtatatcaggaaacatggatgaagaccaaatatgtatttcacaatattatagctgccatcagccatgggtgagtttctcatcattcaaagtttccttcttttttagaaaccacctgttttactctaaacaaagtagattcttatgaaaggtaggctgtttgggggtccagaatttcaacatatgccaccaaacccttttcttccctctgaatttttggaggcgcacctcaccttgtgaatttgtagcaccccaaaccagtaagcacacacattcaaatacatgtacatgcccacagctacccactagtaagcaccatcccccatgtccggtcacacagatgtgagaagatggagaaatgttcacctaaacagctggtgtgtgaagtcctgcctctgtcagctgagctcacatgggaaagatccccagtccctaggccccacatcaatgggcacagggccttcggaggaaaggacaaccactccgtcgtggagggagaacactttggactcgggtgtgtgtttgagggattccagagggtagaggttgaggaagaggagttgggagagtgagaaggtaggatgttgcacaggatgagacccttcctctcaaaccaaacctaatagccaataagtacaggaaaagatccttgacatctctagtgatcagggaaatgcaaatccaaaccccaataagaaaccacttcatactctccagggtggccagaatacaaaaggctgagaacaagtattgggaggatgtggagagatcagaacactcctacgctgctggtggcaatgtaaaacggtacagctgccttggaaaacaggtccccaaatgttaaacacagagctatcacaggactcagcaattccactcctacatatataccctgagagaaatgaaagtacatgtccacatggacacttggacacaaatgtgcatagcagcattattcatagtagccaaaacccaaatgttcatcaactgatgaatgaactgacacaatgtggtctatccagacaatggaatattagtcatgaaaagggatgaagtacttatacttgatataccatggatgaacctcaagtatgttaggctaagtgaaagaagccagtcacaaaagacctcctgttatgtgattcattcatatgaaagtccagaatagggaaatctatagaaacagaaagaagattagtgggaacttagggctcagcttgcgaggtgggggcaggggcaggaagatgggaggtgacagctaaagggtttggagttttgtttggaggtgatgaaaatgttctaaaactgaccgaagtgatggttgcacatatctgtgaatagaccaaaaaccattgatcatacacattaaatgggcgaattgtatacatgcaagttatatctcagttaaggcattaagaactaaacaaaaactaagaacacagatcttctgtctttcctatttatttatttattttgagacagagtcttgctctgtcacccaggctggagtgcaatggcgtgatctcggctcactgcaacctccgcctcctgggttcaagcaattcttctgcctcagcctcccaagtagctgggattacaggcacccgacaccacacccgactaatcttttgtatttttagtagagatggggtttcaccatgttggccaggctggtctggaactcctgacctcaggtgatccacttgcctcggcctcccaaagaactgagattacaggcgcgagccaccacgcctgaccaccttgatcacctttttttttttggaaagcaatgagggagcaacactttgttacctgggaggcgtggaccaaaagagaggcagaggctggagggagagtgtgaggcagggatcaatgggcatcatgccaggcttagggcatccccaaagctgtgggattggggcttgaagcccaggtcttagagacctgagcaggcccagctgacacaggctgcaaacaaatgtcctctcatcctcaccgcaatccctacaagctgctcacctcctgttgccatgtggatgtgtcctgagtggcccacgcagatttctacacttgatcccctcgcttgaaataaaaggagataaagtgagtacaaacacccttatgcattactgtagctcaaacgaggccagactagatcctaaagaagacctggcgtgggccatcttctagagtcatcccacctcccaggacaagcaaaggtcctgcctccaagtcattgcaacttatatgacacagcaaggcaatatagactctgggggaaaaagttttttaactacagtatttttaaaatagaacattattttgaaattacttcgacatctactgtcaggtgacttgtaaaagcgcttgtatgttaaatgctctacattaggagattattttgttcttgagtccctacagagaattccttgggaatgaagtgctattgtgcattcagaattatgtggctatagccatattgcaggccgggaactcaggaatgtcccctctgtcccagctcttcaagttgggccctacagatcccacggggacaagcttttggaaaattgctgggtttctagaccaatcacgtctttgaaatgtcttcttgtcactccgtggtttcttgcttcagcttaaccccactggccccatagatcaggcagctcacaatttgaacacagccagggggcatggaggatgagaaccaatctatcctgacaatcctggcagcacgtggggaaagccaggcccaagtttccatatgtgaacacattacattgtctccaccaagaaaagagcccctgtgaaatattcatgtgcgtcacccactttgccttaggttccattacctaagggacagacctggtgttgctcaacagtgccaggcttagcactgccaggggagatctgcagctacaaagagttaaagaagaaggaattgaattgagttataagcaatacatctaataaatatttattgagtgactatttcattccaagcattctgctaggtgctgagaaatcagaaacaaatacattgaactcattggcaaactagctggggagatgggcagggaagccaactgttgcagtctggtgagagttgtgctggggaatgcagtggctttgcaggagcccggagcagagacatgtagttctgcttggtgggattgagcagatgtcaggcaaagcttcccaaaggacacgatgctcaagaagggtcctgaagaatgatttgaagctggaaagtcagaggaaagcatcgaaggtgaaggcacagaggtaggggacgcatggcacacccagagaactgcagacgccctgtcatgcctgcagtcttcacgggaggtgagaaagaatttccagggtacatggatgcatgttaggaggctgagactggtcttcgaagatgatcagacataggcttgaagacttgatgctttcaaaagctcgctctgacagtagcgtagagaaggaatgggggaagctttgcttataataaagtgagaaatgatgggggctgaattaagagaatggctctgggggtggagtatgagagtatttcctaaagatagaagagagaatggccaggacttgagagtggctgaagtcgggtacagggagacaggagacaccttttatggccatagcttgagtcactgtgtggacaggcgtgctcatcattgagaccaggaagcttggaggggaaaacgctcatatgcaattctgaagttcctaagagacaactggataacacacaaggatgaatgtgaaacaaacaaggggctaggtcccgtaagctcatcagaacttctttctgaaagaagtaaagcacatctctaatgacaacagaaataaccacaaacctgcgagtcagcctcaaatatctttcctgggggattaaatgatggctgagggacggggtaccccagaatgtcccttgcacaggaaaggacctagagaagagagactgttttttgagcaggtcacattcagcttactgcaatgtctttgctttaaacggtcccctgcattataagaatggagtttatatgagaggtgagagggtcccagtgacttagcaaccgtggcatgcttctgcaaacatttcaaagacctctactctggcttttagaatgctttctagagcaagtagcatgcataacgacaccactacctggaattatacactgtctttcttcagaggcacacaaagagcttaacacattaccttagttctaggttagctgctttgtttcatgcatgcttgctggtgtttctggaagaacatttatgaggtgattgctcttgaaagacttcagaacaatcaagatggtttgttgctgttgggttctttttttttttgagacagggtcttgctctgtggtccacgctggagtgcagtggtgcaatctcagctcaacacaaactctgcctcctgggctcaagcaattctcccacctcagcctccagattagctgggactataggtgcatgccaccactcctagcttttttttttttttttctgtagaggcaaggtttcaccatgttgcctaggctggtctccaactcctgggctcaagcaatctgcccgcctcggctttccaaagtgctgggattataggcgtgagccactgcactggctgggttttatattttattttatttatttatttatttagactgagtcttgctctgtcacccaggctggagtgcaatggcgccatctcagctcactgcaaactccacctcctggattcaagcaattctcctgtctcagcttccggagtagctgggattacaggcgcacaccatcacactcggctaatttttgtatttttagtacagacggggttttgccacattggccaggctggtcttgaactcctgacctcaggtgatccaccctcctcggcctcccaaagtgctggaattacaggcatgagccaccgcgcccagactggggttttttaattttcactattattttttaatagaaagcatgcaaaaagagacgacacagtcattggacagtattacaaaaaatagtcatagaagtgaatataaatgatgcaaaatgcaatacagctagagtcccttcttcaccctttttattgatatgttcacccaagtgttctcacacatagaagcaggtggttttctttactacagtagtatagtttggagtgtttatgcttcactaatggtacaaaattagctgagaaaagatttaaattggtgttttaattatccagtgtgataacaaaccacctaaaaatgtagtggtataaaacaactactgtgtattttctcacactactttgtggaggtttaaaaacaccacaaattcatcaccttggtttctgtgggtcaaaacaacccaaattcatcatctcggtttccatgggtcagaactgcaggtacgggttggctggggcctctgctcagggtctcaccaggttgaaatcaaggtgacagccagagctgtggtctcatctgaactaatgcagaactcaccagagcacatgtagtgttggtagaatccatttccttgtggttggaggacggaggtgtcctcttccttgctggctgctggccgggggccatcctcagctcctagaggctgccctcaagtcctggccacatggcaccccagtctcaccttgtggcagctccaggccagcaggggacaccactgctccctccagtgtcctctcagggttcacctgattgagtcaggcccatcaggataatcttccttcttttttttttttaactttttttttgtttttgagacagagtctcgctctgtcacccaggctggagtgtagtggcccagtctcagctcactgcaagctccgcctcccaggttcatgacattctcctgcctcagcctccccagtagctgggactacaggtgcctgccaccatgcctggctaattttttgtaattttagtagagacagggtttcaccacattagccaggatggtctcgatctcctgacctcgtgatccgcccgcctcggcctctcccaaagtgctgggattacaggcgtgagccaccacgcctggcccctttttcaacttttattttaggttcaggagtacatgtgcaggttcattattggggtaaacttgtgtcatgggggtttgttgtacagattatttcgtcacccaggtactaaacctagtacccagtagttatttttttctgatcctctttctcctcccaccctccactctcaagtagccactgtgtctgtcaatcatccttcttgataaactcaaagtcaaacgagtccagatcttacctacatctgcaaaatcaatttttcctataaaggaacgtaatcacagaagcactgtcccacagtagtacgagtgctgagccgttgtaggcagagagggttgtcctgcccacactcaaggggagagagtgcagggccagttcacccctcacgcggaagtggcagtgctgggggctcacttcgtgctctgctcaccacaactccaaactcacaactttattcccaccaatcccatcccctccagtccagggggcacacactccagcaggacttcagctgagcccagggaacgctttgctgactggtgatgagggacctacctcttcacacccatgacacccacccgctgagcccctcaccggggctccgaaggccctggtcaggtcacctctggtctcactttccattctcccctccttcctcccctccagccacagggtccttctcgatgtgcccagacatggtgggtgcacacttgtctgacagcctctcttcttttccctttgcttggaatgctctcttcccagttaccaaagatactcaggctctctccccaatttccttcaggcccttgctccaaaagctccttccgggtgaagcctcccctcccatcctccttaaagcttcagcctctacctgggacacttcctcccccactgcctgcctccttgaaactctccttagtcctcttgcagcccacacagctgaacacaggcaggagggggcgctgctgccctggctggtgtgcagccaccagaggctgaagctcactgacgtctgtctggggcccaggatcaccttccttgattccagctctctcaggctgtcaggacctggcgctgggaggcactaggccatgccctggcctgaggccttctctctccctctttgccctgtgtctctgcagggaagcccggccctgcccctgggagggtgggggcagacgtgtggagagtgggtgtacaaggccagggtttgccaggcccaggacagcctggcacctgtcaatggatgagcgcctctcccttagcctgatgtcagggtgggcatgagggtgggagcagagggtgcctaactgaggaaagggtctgtgcaacccccttctcctaccagttctcgtttctgaagtctcctcaagcacactgcggtgtccacaccattggcagcaggctccttctcttcaggtggtcttaggaacttctcagaactttttgagttatccttctggtctcttcctcctgagcacggttctcctggttgagctccaggccatgccattcaacgccctccaggacaggccgaagggcttgtctgtttggtggttgctaaggtttgaaaaaagccagctggaaacttaatccccaaagcaacagtgttgggaggtgggacctaatgggaggtgtttagtcatgagggctccacccttatgaatggattctctctctcttgttctctctctctctcttcccgccccgcccacccctccttccccaaccttgtgataccttccaccatgtcatggcaagaaggcccttgccagatgtggcccctccatcctgggttcccagtctccagaaccatgagccaaatgcatttctgtctgttacaaattatgtacggtgtggttttctgtgatgaacacagtgctgtaccagggccctcttgccaagacagccagcttataggagcctgcatgtgaggcccggacgtcctacagagcagcagttagaggtctggccttctggataggcactgccctgccctgcacacaggaccttggtggggcatgatggggctcttcaccacgctgccctcattttaggaggtgggcaaccctttctcccccttctccatgtgcttctgcagttggaagaagtgaggggggttcagacacacttaagctgagcttagagcaaagcatgtccctcaaggtgaccttgccgcatggcctgaacctagaattcccctgaccagggtggacagccatcaccatgggcctttctgcctggcctagtatggctctccttcgaactcacctagacccttgcatcaaaggactcggggactctgctgcagtcatcctagcacggtcgagaggagtaggaaggtgcccagcggctcagcctttaaggaggtctattggtcaccattgcttctgccttcttgagaaccatcaccctcggaggatccggtagtgtatcccagtcaagtgtcaaatgcgttgttccctggagaggaaggcttatttccagaaagtactctgacgttttgtaatttgtgatttc

SEQ ID NO: 798 - DNA, 10478 bp, Homo sapiens
ttctgtaaggagcatactgtgcccatttattatagaatgcagttaaaaaaaatattttgaggttagcctctccagtttaaaagcacttaacaagaaacacttggacagcgatgcaatggtctctcccaaaccggctccctcttaccaagtaccgtaaacagggtttgagaacgttcaatcaatttcttgatatgaacaatcaaagcatttaatgcaaacatatttgcttctcaaagaataaaaccatcttccaaatttccaaagcatgcattgttacttggcattaagtatttcaaaatgacaaacattgttacggtattgtaaggccaaaatataatacctatttaccagacatacacattacaactagaaaaaaattacaaatgttaacctagtataacaattccatcaggaatgaatggggaaaggcactgcatccctctcatatcgccacagatctactatccacttgacatgctttgaattcaagtcctgttagacatgggaacagcttttcctacaacatatgattcacaggtaggttaatacatcttagtctcccactgccatacttttcacccaagtgtacaacaggtatgaatatatgctatcagctttatttacaagtgtatcttgatgtcttcgtggggtaaaagaaccaactatctcaaccaacagtttccaaaaaagtttttggctatgattcatgtatagaaaccaccacataaaagaaacaacagaaactgaggtccgatcccaaacacctaaactaaaatttctcacccactaaaagttggcagtgaaactgctattctctgaattgtataagctaaattctacagaggaatttcagatcaacttcttttgcaaaagcacaagttacacgttgcacggttggggatgctgagtgaatgcattccaggaagagttccgcaagcaagtgctgttgcaaagagtcgagaatccgagaatctgggaaaggtgatacgttttccaaacgctttcctggcttcccaaaagatgtaaaacaacaacggtgtaactttatatacgaacaaaggttagtcttgtaaatcagtaatatacatgcacaaacatgagaacatgagggaagaaaggaaacgctacaatttccacattgcattgctgctgttttcacaacctctctgcactaggcggcttcctgtggtacctcttcctaccagtagagagtggcccctgcaggccacttagaaacaggaagctctctcctgagctcactgatcaacctgcccttggcacagacagaacctaccagaaaagaacaagtacaaaacactatcattatctgttttctcaagacagtcccaaatgtccttgtgcgatcaccacaaactcagtgattggcccaagtcattcccgggtgccatgaacagtaactggtgtgcagcattagaacaaggggacacggccttgattctcttctgagcaacatgaactgggatttctgccaccccgatctcggctgccacctccgaagaagtcgtgaccagccacctccacagtaaaagattcctcccgtgagtatgatttggaatgcgtcctcgtcgcgtgccagttcagctgaggtggatcggcgtgtactccggcctcctggtctggataatttttggcttaggtctcctcattctttccatttcctcttcttcctccttctcttgatcactctcacatacatggaccaccacgctgggagtggtgtcagtcgctgcgtgcaattcatacttttcccctaaggagggaaaataatcgcagggtcactcagacaagtccttgggagtcaaaaggcaaacataaaagagcattcagggctctgctgggccagctgctcgtgaccattcgattgggctgagagacacagccagacatattttgggtttgtatttctttgctagctcattcagaaaaagagagatttccattgtgcatgactctgtttttagtcaaacattctgggagtccaggcacatgagaagtatagaaggaatgcatttttctagttatacttcacatgtccaccagatatctaaactacccagagaactccctttctgtcagcatttcctcaagtgtgaatgtgagaaacttcggttcaggaaaaagatggatgaagaaacgtatttggaaacagaaccctgggcctccctcatgcagctcctatttgagggtcgcagtgcacgcccaggaagggcgccacaggaggccctgcagcagacgcaggggtggctgcacggagccaggtgctctggaaacgtttttgacctgggcatcttttccttagaacaacttctaatccccgggaccaggagtgtcctgctgttctatgtcagcctgagttctaccaggttggccaagttcaggccactctggtccagcaagggtggggagagctttctgcaactgaaaaacccggcaatgtagaatgaagggactggggcctcccgctggggtgccgctctggccacgggaagagtgtgcatctctggtgctcatgaaggcagctctgagcctggctccttagtacccagggctcatgggcactttattctgcttccctgtgcacctcagttccctcctcagtaaaggagacggtaaaggtattgacttcatggagctaacagcatgagtgagtgcccgaggcaatgagaacccggctcaccacatgcttgtccagcccatgtcacctagaaagatgtttaagaatggagactgcatcgttattggtgccctgctgggcagggatctgaaataggggcaggaggtttgcttcaacctgctccacccacagggtgtggcctcatggtcagttttcttccagggctttgtgcttgggatttcttttcttttcttttttctttttctttctttctttcttttttttttttttttttttgagacagagtcttgcctgttgcccaggctggaatgcagtgacaagatctcggctcagtgcaacctccgcctcccaggttcaagtgattctcctgcctcagcctcccaagtagctgggactacaggcgcatgccatcatactcagctaatttttgtatttttagtagagacgaggtttcaccatgttggccaggatggtcttgatctcctgacctcgtgatccgcctgcctcagccttccaaagtgctgggattacaggcatgagccaccgcgcccggcctgtgcttgggatttctttgcagttcgggtaagcgaggaggcaccgcaccaaccactgtgtgatttccgcccgacaagagcggcccaggagagcttcctacctccagccacactggttactcctctaaacctggaaggtacttttactgataaggaaggtggtgatcttttctctatcacatgtgggactggaatgttattataactgcactgaaaaaggcaaaggagctcagctctctgagagagagaattcaggcatgggaggtcagatggattgctgaaaatgctggttaagagcctcttacaaatctacctctttgcaagtctcttatctacctactaatcatcgaaaatccagaaagctcagggtttaggaccataatttgcaaaatctccgcaatcctgttggttgaaaagcacaggtgaaatatgaaatctcactcaagctcactgttaagtgaaccaaggacaaactgattttattacgtctatttcctaaaaagccttctccaataagccctcggtgaaggaagtggtatattctggagtatgcagaatttttattaacagcatttgcctctggaactgtggacacctctttgcaagtggagaccctgttttctcccattcctaacctaggggaagactccacaccctcagccatgctcatgcccccgggccaggagctgctgtggggggagcacacgcttcctcaaaatggccatttctgatcttgaccttcacgccacaattagcagtaagtaatgtgagtcttgctttatcccacagagggaatttccgtttggacaatgttttcagaaatgtaatcttttcaatatgaaactgctgatggaccaagaaaacaaaaccctcaacccaagggaacatcagattgctggtcaaggagaaatgaggagctgacggtctcagcatttatttgacttgctccacggacagagcaggagaaggctcaaacctcttcaccccaagactctccctcacacctgcctcctcacccaaaccctagaggacaggacaggaaccaccaacattttatggttttcaaaaatcctgcattgaacactgactgtgagccaggtgctgatggaagtgcctttcactcgatgatctcatctactgctcacaattccaccagttaaggcccacattttggacaaagagcctgaggaacctaccccctccccgcagtgctcacacttttgtccctccagaggacgggaacttcctctttctttagcaagctctgtaggggaccagcccacaggccctggggtagggcagcccgaccgcggcccttccctcaccatggcctatggttctccttcccttttcctttaagaaggccaggtgagaatcacaggaaagggagaatttattttgattaaaaataacatttcttaaagggggcatcgattttccctttccaaagtccaatcactcatccctatccggagcgacagaacctggggccggggctcaggcctcccacgcaggctgtgctcagtggacacaggaatggattcctgggacactgcggggggtggaggggcgtgatgcagggtccccacgatcagccgcagtctctctaacactgcaggtggtgccaagaggcaggcatgctcccagcacaagggacggtggcgcagaagaatacagagaagctcacaaaacatgccggcatgggctcaggagagctacgggggtagtggtggtactgctccctggtgcagggcagcagctgtgtctccccctgcctccctcccacccgagggccctgctcacctggccccagcttggagatggcatataagagatcatagtttatgactggggtcgcatcttccacttgtttccatcccactggcggagaggcgggaggggagatcagaaactgcttgtctggatttggcggagccaggtgtgagcttcctatgtgtaaggtctgaggagagaaaataagcacaggtcagttgttgccagggaagaactgcagtgaggcaacagcacctaacgccagttccgggagatgggcaggtcaatgtccaggcgtcaggacaggtgtgattccaggaccaattgtaagatggtctgtaatggggagggcaaaaggacatatgaactctggttgtggcacagataggatgacagccccctcccagggctatgggagtcacaggcacagggactgcaaataattacgcttgacctagatggacagaaaatcagcagaggtgactttagtatatatggaaatttaagtcactgtcattgaggtcaggagggctcttggaatcagtctctccccgctcctcataccacagaggcaagctctgaaagtccaaagcctaggccacagttctgagaggacacagcttctcagggacagggagccagggctccacctgcccctagggttccccacccagcagcagctctgcacctccctctccgggactctggatcagatgccagaaaaaaaaaaaaaagccacttcccaggagactttaagaaataagaataaggaacaataacctacgatcctagtttggttttagaaatgctgaccagtgatgagagggctgtccatagagctcttacatctcaagctgcgcggtgtaggttttctctgcacttccagattgccctccccaagttttcacaatgaatatgcattgttttacaaacagaaaaggtcagaggagtactaagtaattatttgcataaaatcttatcccgtgcagaaaggagtgtactcacacaggaaggcctaggcacccaaggtcaaagctcagcctgtgcctcccagggcaaaaaggtcaggggtggggcggggatcccaaatgctttatttatacttgaagggcccagcaagttcgctgtcctcactttgaggaagaaaagacactttggctctctggcgtggtgtcagatgagcttcctcccactgggggaggcctttggacagggtcctctcccatcccagcaaggtatgtgtgtatgtgtgtgtgtggtgggggcgggttgggggggtgctcagagcctgagggggacttgctttactgaggagctggctgcattctagaagctcctctcttcttccctgacaatctgtcagcccctaaggacatcaaatggaactctgggagctgccttgaaggtgggtcacctgtcctaagttccccagaggagggtcaaaatggtagtgggcaggagaaaaggcaagcccaaccccagctacccctctccctgccgtgggtgccctggggctgggaaccctgccaaccagagggtttcttagcatctgcgcccagtctggttatcccctattttcctttcaagccagacctggcagtcctgggctgatttgcaggcatcttctgcagactcctgtttctctgctgagtacccccagcaccacatgagcagggaaccactctggtctgctcagtctagagtgggtcatgagctccaacccttgagcaaattcatggaaacctgctgcgcaaaccttagggtgtttgcatagccacgcctaccccgctgcaccctgcaagctccccagtgaacagggaaggctttctttcccccatcattatcaacccaggaaggtcaggggcaatgtctgaggttgctttcaaatgcaccttgatatcttcttaaaacaagtgagacgctgaacattcagagtaggaattttgtctttctcaaggtgaagtctcagagtttccggtcagcatataacataagcaacgtataagctgctttacaaaagggagggagggaggagggagaagcatgcatagcaatgaacccaactcacctgagcaaaatataacttcatttcctttcccagaaactcagtcttatgcagctggagcctggcatctgctgcggagaaggggttgctgaagtttattctgactcgtttgaagctcttaaaatactgaaaggtgatgtccttgtcatacgtcctaaagagggactcaaatttggcctgaaaaataacaataaaaataaaaggagttgaaatttacctgcatatgacccttgactagatgatgtcattacttttttttttttcttcgagacagagtcttgctctgtcacccaggctggagtgcagtggtgcagttttggctcactgcaacctccacctcccaggttcaagtgattctcctgcctcagcctcccgagtagctggggttacaggtgcctgccagcacacctggctaatttttgtatttttagtagagacggggctttgccatgttggcaaggctggtctcaagctcctgtcctcaggtgatccctcggcctcccaaagtgctgggattacaggcatgagccaccgtgcctggcctcctcaatacattttttactgaggaagtggatcatcaatcctttcaagaactcctaacttctttcttagagaaaagcctttcccctcttaggggactatggcctttagtcccaatgcaggtgattttacaagaaggtaagaaggtatgatttattacattcatcgaatcagcagaacagttgccaatacatagacactacttacggtaacaaacttttttaaaaagtagaatgagcattttccagggaggtacagtttggtaatttgctccccatgtttctctgtcctatggccttcccccactcacccccccttttttctctgtcctatagccttccccggctagccaactccaaccccaccgttcagctcagggcagtgttgcatatatcaaagatttctttaaggcttaaaagaactgcagctaatttgaaaaaaagaaatactgacttgaaaaataacaaagttggtagaaagttttgcatttcttaaaataagtagtttttaaaaatttccacgatcgcttttatctcagtctgttactttttaactctctaaaatgatactggtttaaaaattaatgttctgcaaatggaccattttctgcatcctggctttcgtgtctgtgcacacctcgctctggtgccatagggctagtgagaattaggagatgtcctgagctcttagaatgcaaagctcgaggtgggggattacaagcttaggttgctcaggggacagccccctaggctgggtcctggagtgtggctgtcggtgggggcagctgggggccactgcaactcctcagagagggagtttaactggtggacagtcaaagctccaaggaagactgcatgggcttctagtcgccgggttttgtgaatctttttaccaggcaaaaacacttaggacagtttgtgggagcccgtgtgaaaggcagaaggggctggccaggaagaaggggatggcgcagggtgtggatggtaggcagcgcggacagagctcactgaggaccttggagaacctatggaaggcgcagtgtctctgcagtgggagcgaggattcaggataagagaggagagtgtcttcaggaatgttcactgctagcaagcgcggggaggcactggtggatgcctgctccacatggggctgcgggtaggagcagggtagtcggtccctgccaggcaggtcgttaaggagcagtcggaacaacctacgaccttgctctccttgcattccccggcttttcttcagtttagggacatttctgagactttcccacgagggatcccgcagaggcacgtgcgaaggaacgcggagctggcggacggtagagttcatctggccgcctctcactctttttccccacctctcttgagcacgggcaagtttctggcaaaagtgtgtcttcgtacatttggaattttgtatgacctcatcaataggcactgtgacccactgtttagttttgaagttatgattcagaatttgggagagatgactttgaagaatatttttagaatacaggttcagggcttaggaccagaacaaaagagaattcacattatctttaaaatctagattactatgatgcctttctcttataaaagaatcttatttgttctaataactgatacctagttattatagcttttggatggcatctctacttcatttaaaaaatagtgattttactcacataaggctcatgttaagtgaactcactttgtagtactttaaaaacatagaatgtgctctgcaatctagtccaaacactatggtgcgagcccataagcattatatacaattatggagttacatttgattttttttaaaaaaagaaaccttcgcatgtcccaatatggctttggatataaagcatataacaccaccaggcacaaataccacccctcaaatagagcatacaggattcattcctatacagtattattaaagctcaattagccggatagctgctgatgaaaaaacttacattttaatcaaatgaagaagaaaagtgtagtgattaaaatgattatattaatcaccatcaaagagagctgctgcccaggaggcacactgatctcacacttaatttctccagttttattatttgctctggcggcattttctcttgttagagaaatctgggagcttgaggccaggccctcataattactacaaacatacaaatatctttataacatttatttcctaagacgaaatgaaattattcacaacgctggctacaaaagtaaaacactattcactgtcagaagaggcctctttctgaaaagttcacttacaacatacacagaatgaaaaacacacgatgccccaactctcgccttcctagtgagttggttcaggggcctggatgttgtcaaatattgagatctttagaaattccttcctcagttaattcctcaggcaacagcttttgattttcaaggctcgaaagactttggatttctttcaaaacccccaaacccacaagagagccacattctcccaagtattcagttaatagtcccagttagcataatgctttgaaaactaaagaaaatcacgttatattagaagccttaccctggtttcactttcgctgaagatatcactgtttgccacacaggcaatcagggagctaaaactgtagttaaagtttctaaaatgcatcttgctttcttacagtgaaagcgctacagacccacgcagtcaagcccctagtgagattcctttccaagaggctgtaggttccttcttgagctggtgcttataaagcagtaagggccagcccccactccctggggaaaaaaaaagtgcagcttccacagcatcctgtttggacagcaaattcctgagtcaagtcctgcatgcttgcaggcagaca

SEQ ID NO: 799 - DNA, 97962 bp, Homo sapiens
ttctgtaaggagcatactgtgcccatttattatagaatgcagttaaaaaaaatattttgaggttagcctctccagtttaaaagcacttaacaagaaacacttggacagcgatgcaatggtctctcccaaaccggctccctcttaccaagtaccgtaaacagggtttgagaacgttcaatcaatttcttgatatgaacaatcaaagcatttaatgcaaacatatttgcttctcaaagaataaaaccatcttccaaatttccaaagcatgcattgttacttggcattaagtatttcaaaatgacaaacattgttacggtattgtaaggccaaaatataatacctatttaccagacatacacattacaactagaaaaaaattacaaatgttaacctagtataacaattccatcaggaatgaatggggaaaggcactgcatccctctcatatcgccacagatctactatccacttgacatgctttgaattcaagtcctgttagacatgggaacagcttttcctacaacatatgattcacaggtaggttaatacatcttagtctcccactgccatacttttcacccaagtgtacaacaggtatgaatatatgctatcagctttatttacaagtgtatcttgatgtcttcgtggggtaaaagaaccaactatctcaaccaacagtttccaaaaaagtttttggctatgattcatgtatagaaaccaccacataaaagaaacaacagaaactgaggtccgatcccaaacacctaaactaaaatttctcacccactaaaagttggcagtgaaactgctattctctgaattgtataagctaaattctacagaggaatttcagatcaacttcttttgcaaaagcacaagttacacgttgcacggttggggatgctgagtgaatgcattccaggaagagttccgcaagcaagtgctgttgcaaagagtcgagaatccgagaatctgggaaaggtgatacgttttccaaacgctttcctggcttcccaaaagatgtaaaacaacaacggtgtaactttatatacgaacaaaggttagtcttgtaaatcagtaatatacatgcacaaacatgagaacatgagggaagaaaggaaacgctacaatttccacattgcattgctgctgttttcacaacctctctgcactaggcggcttcctgtggtacctcttcctaccagtagagagtggcccctgcaggccacttagaaacaggaagctctctcctgagctcactgatcaacctgcccttggcacagacagaacctaccagaaaagaacaagtacaaaacactatcattatctgttttctcaagacagtcccaaatgtccttgtgcgatcaccacaaactcagtgattggcccaagtcattcccgggtgccatgaacagtaactggtgtgcagcattagaacaaggggacacggccttgattctcttctgagcaacatgaactgggatttctgccaccccgatctcggctgccacctccgaagaagtcgtgaccagccacctccacagtaaaagattcctcccgtgagtatgatttggaatgcgtcctcgtcgcgtgccagttcagctgaggtggatcggcgtgtactccggcctcctggtctggataatttttggcttaggtctcctcattctttccatttcctcttcttcctccttctcttgatcactctcacatacatggaccaccacgctgggagtggtgtcagtcgctgcgtgcaattcatacttttcccctaaggagggaaaataatcgcagggtcactcagacaagtccttgggagtcaaaaggcaaacataaaagagcattcagggctctgctgggccagctgctcgtgaccattcgattgggctgagagacacagccagacatattttgggtttgtatttctttgctagctcattcagaaaaagagagatttccattgtgcatgactctgtttttagtcaaacattctgggagtccaggcacatgagaagtatagaaggaatgcatttttctagttatacttcacatgtccaccagatatctaaactacccagagaactccctttctgtcagcatttcctcaagtgtgaatgtgagaaacttcggttcaggaaaaagatggatgaagaaacgtatttggaaacagaaccctgggcctccctcatgcagctcctatttgagggtcgcagtgcacgcccaggaagggcgccacaggaggccctgcagcagacgcaggggtggctgcacggagccaggtgctctggaaacgtttttgacctgggcatcttttccttagaacaacttctaatccccgggaccaggagtgtcctgctgttctatgtcagcctgagttctaccaggttggccaagttcaggccactctggtccagcaagggtggggagagctttctgcaactgaaaaacccggcaatgtagaatgaagggactggggcctcccgctggggtgccgctctggccacgggaagagtgtgcatctctggtgctcatgaaggcagctctgagcctggctccttagtacccagggctcatgggcactttattctgcttccctgtgcacctcagttccctcctcagtaaaggagacggtaaaggtattgacttcatggagctaacagcatgagtgagtgcccgaggcaatgagaacccggctcaccacatgcttgtccagcccatgtcacctagaaagatgtttaagaatggagactgcatcgttattggtgccctgctgggcagggatctgaaataggggcaggaggtttgcttcaacctgctccacccacagggtgtggcctcatggtcagttttcttccagggctttgtgcttgggatttcttttcttttcttttttctttttctttctttctttcttttttttttttttttttttgagacagagtcttgcctgttgcccaggctggaatgcagtgacaagatctcggctcagtgcaacctccgcctcccaggttcaagtgattctcctgcctcagcctcccaagtagctgggactacaggcgcatgccatcatactcagctaatttttgtatttttagtagagacgaggtttcaccatgttggccaggatggtcttgatctcctgacctcgtgatccgcctgcctcagccttccaaagtgctgggattacaggcatgagccaccgcgcccggcctgtgcttgggatttctttgcagttcgggtaagcgaggaggcaccgcaccaaccactgtgtgatttccgcccgacaagagcggcccaggagagcttcctacctccagccacactggttactcctctaaacctggaaggtacttttactgataaggaaggtggtgatcttttctctatcacatgtgggactggaatgttattataactgcactgaaaaaggcaaaggagctcagctctctgagagagagaattcaggcatgggaggtcagatggattgctgaaaatgctggttaagagcctcttacaaatctacctctttgcaagtctcttatctacctactaatcatcgaaaatccagaaagctcagggtttaggaccataatttgcaaaatctccgcaatcctgttggttgaaaagcacaggtgaaatatgaaatctcactcaagctcactgttaagtgaaccaaggacaaactgattttattacgtctatttcctaaaaagccttctccaataagccctcggtgaaggaagtggtatattctggagtatgcagaatttttattaacagcatttgcctctggaactgtggacacctctttgcaagtggagaccctgttttctcccattcctaacctaggggaagactccacaccctcagccatgctcatgcccccgggccaggagctgctgtggggggagcacacgcttcctcaaaatggccatttctgatcttgaccttcacgccacaattagcagtaagtaatgtgagtcttgctttatcccacagagggaatttccgtttggacaatgttttcagaaatgtaatcttttcaatatgaaactgctgatggaccaagaaaacaaaaccctcaacccaagggaacatcagattgctggtcaaggagaaatgaggagctgacggtctcagcatttatttgacttgctccacggacagagcaggagaaggctcaaacctcttcaccccaagactctccctcacacctgcctcctcacccaaaccctagaggacaggacaggaaccaccaacattttatggttttcaaaaatcctgcattgaacactgactgtgagccaggtgctgatggaagtgcctttcactcgatgatctcatctactgctcacaattccaccagttaaggcccacattttggacaaagagcctgaggaacctaccccctccccgcagtgctcacacttttgtccctccagaggacgggaacttcctctttctttagcaagctctgtaggggaccagcccacaggccctggggtagggcagcccgaccgcggcccttccctcaccatggcctatggttctccttcccttttcctttaagaaggccaggtgagaatcacaggaaagggagaatttattttgattaaaaataacatttcttaaagggggcatcgattttccctttccaaagtccaatcactcatccctatccggagcgacagaacctggggccggggctcaggcctcccacgcaggctgtgctcagtggacacaggaatggattcctgggacactgcggggggtggaggggcgtgatgcagggtccccacgatcagccgcagtctctctaacactgcaggtggtgccaagaggcaggcatgctcccagcacaagggacggtggcgcagaagaatacagagaagctcacaaaacatgccggcatgggctcaggagagctacgggggtagtggtggtactgctccctggtgcagggcagcagctgtgtctccccctgcctccctcccacccgagggccctgctcacctggccccagcttggagatggcatataagagatcatagtttatgactggggtcgcatcttccacttgtttccatcccactggcggagaggcgggaggggagatcagaaactgcttgtctggatttggcggagccaggtgtgagcttcctatgtgtaaggtctgaggagagaaaataagcacaggtcagttgttgccagggaagaactgcagtgaggcaacagcacctaacgccagttccgggagatgggcaggtcaatgtccaggcgtcaggacaggtgtgattccaggaccaattgtaagatggtctgtaatggggagggcaaaaggacatatgaactctggttgtggcacagataggatgacagccccctcccagggctatgggagtcacaggcacagggactgcaaataattacgcttgacctagatggacagaaaatcagcagaggtgactttagtatatatggaaatttaagtcactgtcattgaggtcaggagggctcttggaatcagtctctccccgctcctcataccacagaggcaagctctgaaagtccaaagcctaggccacagttctgagaggacacagcttctcagggacagggagccagggctccacctgcccctagggttccccacccagcagcagctctgcacctccctctccgggactctggatcagatgccagaaaaaaaaaaaaaagccacttcccaggagactttaagaaataagaataaggaacaataacctacgatcctagtttggttttagaaatgctgaccagtgatgagagggctgtccatagagctcttacatctcaagctgcgcggtgtaggttttctctgcacttccagattgccctccccaagttttcacaatgaatatgcattgttttacaaacagaaaaggtcagaggagtactaagtaattatttgcataaaatcttatcccgtgcagaaaggagtgtactcacacaggaaggcctaggcacccaaggtcaaagctcagcctgtgcctcccagggcaaaaaggtcaggggtggggcggggatcccaaatgctttatttatacttgaagggcccagcaagttcgctgtcctcactttgaggaagaaaagacactttggctctctggcgtggtgtcagatgagcttcctcccactgggggaggcctttggacagggtcctctcccatcccagcaaggtatgtgtgtatgtgtgtgtgtggtgggggcgggttgggggggtgctcagagcctgagggggacttgctttactgaggagctggctgcattctagaagctcctctcttcttccctgacaatctgtcagcccctaaggacatcaaatggaactctgggagctgccttgaaggtgggtcacctgtcctaagttccccagaggagggtcaaaatggtagtgggcaggagaaaaggcaagcccaaccccagctacccctctccctgccgtgggtgccctggggctgggaaccctgccaaccagagggtttcttagcatctgcgcccagtctggttatcccctattttcctttcaagccagacctggcagtcctgggctgatttgcaggcatcttctgcagactcctgtttctctgctgagtacccccagcaccacatgagcagggaaccactctggtctgctcagtctagagtgggtcatgagctccaacccttgagcaaattcatggaaacctgctgcgcaaaccttagggtgtttgcatagccacgcctaccccgctgcaccctgcaagctccccagtgaacagggaaggctttctttcccccatcattatcaacccaggaaggtcaggggcaatgtctgaggttgctttcaaatgcaccttgatatcttcttaaaacaagtgagacgctgaacattcagagtaggaattttgtctttctcaaggtgaagtctcagagtttccggtcagcatataacataagcaacgtataagctgctttacaaaagggagggagggaggagggagaagcatgcatagcaatgaacccaactcacctgagcaaaatataacttcatttcctttcccagaaactcagtcttatgcagctggagcctggcatctgctgcggagaaggggttgctgaagtttattctgactcgtttgaagctcttaaaatactgaaaggtgatgtccttgtcatacgtcctaaagagggactcaaatttggcctgaaaaataacaataaaaataaaaggagttgaaatttacctgcatatgacccttgactagatgatgtcattacttttttttttttcttcgagacagagtcttgctctgtcacccaggctggagtgcagtggtgcagttttggctcactgcaacctccacctcccaggttcaagtgattctcctgcctcagcctcccgagtagctggggttacaggtgcctgccagcacacctggctaatttttgtatttttagtagagacggggctttgccatgttggcaaggctggtctcaagctcctgtcctcaggtgatccctcggcctcccaaagtgctgggattacaggcatgagccaccgtgcctggcctcctcaatacattttttactgaggaagtggatcatcaatcctttcaagaactcctaacttctttcttagagaaaagcctttcccctcttaggggactatggcctttagtcccaatgcaggtgattttacaagaaggtaagaaggtatgatttattacattcatcgaatcagcagaacagttgccaatacatagacactacttacggtaacaaacttttttaaaaagtagaatgagcattttccagggaggtacagtttggtaatttgctccccatgtttctctgtcctatggccttcccccactcacccccccttttttctctgtcctatagccttccccggctagccaactccaaccccaccgttcagctcagggcagtgttgcatatatcaaagatttctttaaggcttaaaagaactgcagctaatttgaaaaaaagaaatactgacttgaaaaataacaaagttggtagaaagttttgcatttcttaaaataagtagtttttaaaaatttccacgatcgcttttatctcagtctgttactttttaactctctaaaatgatactggtttaaaaattaatgttctgcaaatggaccattttctgcatcctggctttcgtgtctgtgcacacctcgctctggtgccatagggctagtgagaattaggagatgtcctgagctcttagaatgcaaagctcgaggtgggggattacaagcttaggttgctcaggggacagccccctaggctgggtcctggagtgtggctgtcggtgggggcagctgggggccactgcaactcctcagagagggagtttaactggtggacagtcaaagctccaaggaagactgcatgggcttctagtcgccgggttttgtgaatctttttaccaggcaaaaacacttaggacagtttgtgggagcccgtgtgaaaggcagaaggggctggccaggaagaaggggatggcgcagggtgtggatggtaggcagcgcggacagagctcactgaggaccttggagaacctatggaaggcgcagtgtctctgcagtgggagcgaggattcaggataagagaggagagtgtcttcaggaatgttcactgctagcaagcgcggggaggcactggtggatgcctgctccacatggggctgcgggtaggagcagggtagtcggtccctgccaggcaggtcgttaaggagcagtcggaacaacctacgaccttgctctccttgcattccccggcttttcttcagtttagggacatttctgagactttcccacgagggatcccgcagaggcacgtgcgaaggaacgcggagctggcggacggtagagttcatctggccgcctctcactctttttccccacctctcttgagcacgggcaagtttctggcaaaagtgtgtcttcgtacatttggaattttgtatgacctcatcaataggcactgtgacccactgtttagttttgaagttatgattcagaatttgggagagatgactttgaagaatatttttagaatacaggttcagggcttaggaccagaacaaaagagaattcacattatctttaaaatctagattactatgatgcctttctcttataaaagaatcttatttgttctaataactgatacctagttattatagcttttggatggcatctctacttcatttaaaaaatagtgattttactcacataaggctcatgttaagtgaactcactttgtagtactttaaaaacatagaatgtgctctgcaatctagtccaaacactatggtgcgagcccataagcattatatacaattatggagttacatttgattttttttaaaaaaagaaaccttcgcatgtcccaatatggctttggatataaagcatataacaccaccaggcacaaataccacccctcaaatagagcatacaggattcattcctatacagtattattaaagctcaattagccggatagctgctgatgaaaaaacttacattttaatcaaatgaagaagaaaagtgtagtgattaaaatgattatattaatcaccatcaaagagagctgctgcccaggaggcacactgatctcacacttaatttctccagttttattatttgctctggcggcattttctcttgttagagaaatctgggagcttgaggccaggccctcataattactacaaacatacaaatatctttataacatttatttcctaagacgaaatgaaattattcacaacgctggctacaaaagtaaaacactattcactgtcagaagaggcctctttctgaaaagttcacttacaacatacacagaatgaaaaacacacgatgccccaactctcgccttcctagtgagttggttcaggggcctggatgttgtcaaatattgagatctttagaaattccttcctcagttaattcctcaggcaacagcttttgattttcaaggctcgaaagactttggatttctttcaaaacccccaaacccacaagagagccacattctcccaagtattcagttaatagtcccagttagcataatgctttgaaaactaaagaaaatcacgttatattagaagccttaccctggtttcactttcgctgaagatatcactgtttgccacacaggcaatcagggagctaaaactgtagttaaagtttctaaaatgcatcttgctttcttacagtgaaagcgctacagacccacgcagtcaagcccctagtgagattcctttccaagaggctgtaggttccttcttgagctggtgcttataaagcagtaagggccagcccccactccctggggaaaaaaaaagtgcagcttccacagcatcctgtttggacagcaaattcctgagtcaagtcctgcatgcttgcaggcagacagggacaaagtgtaagtttctactggaaagaggtgacgtcaacaccttagtcattttccctatgctaattaactttgcttggggagaatggaaaaaacagctgaggtttgcttcacagctgctttatcaacctctcttgcagcatagtttccactggtagtaattccattcagctactcagacaacacgctcctcggccgaatgggacgacccttcttaagatggaaaatgttacaaaagaaaaaggatgaaggtctgtggcaataaacagcaattagactgtagggaaatttcaaggctttgggaaacctggaaaccaaagtccgggtgacatacttgatccctggaatttcctgaaaacctcaatcaaagtttcactttggggtattagagaaaacattttgaaatctgtcttggtcaataaaaattttaaaggacaaaaagaggaatcattttgaagtgtagttaaaatttttttccccagtgacattttattggatgaatgtcccaatttctacttgtatcccacagtggaatggagcaaacagaacctaaaacaatcctaggattttcatttgaaaacttcattattataatttgagaactggggatatgaaacacttcgatcattttcaaagcactactgaattcaggcaaaggatacaaaaacactagcctttgaaactgagcaatctagcctttgaaactgagcaaagaagcattaacccatttatgccagaggttgcaattttttgaatttttgccatcagaccttggcaatgaccttgagcaataggatataaataactcccacatgcttagcgttccaataatggaacactaggcataaatgggttaagaggtcctgcttaaagactcataaactaaatgtaaaaaaaaaaaaaaaaaggaaaggaagaagaaatggaaagaatgtacactataattgaaagggaagatgcagggaagatgcctggtttggagaagtgctctgcgatgcaagactgactctagttctttcaaaaggttgcaactcttgaaccttctaagtattttaccagtttagatccctatggcagcctgggtcctatgttcttctcactctctccaattttattatcacctaaaagcactcaagttatttaagcattctctgatttaggggcacacagggacagctctcaagcttccagaagttaaatggaatcctgccattcacatttaaaaattaacttcaaagaatcattaaagtcagccaataatttaaaatacatgcaagaggaagaaacaaagcagggcatttagccttccaaaaaaggaaaagcaaagtccttttggatgagtgagtgttgcttaatttcaacgcactgtgccttgctgccaactgtagagttatgtaagaaaccagttatggtgtttgctttgccaaattatccataactcccaacctgaaaagacataaacgcatgtattccaaaaaagtgtagaatactgaacaatgcaacatgcatcaaacaccaaggggaagtggtcatcctggatgatgcttcgagagggaatgtgtatgcttgcagtcctgcattttcagtacagggagcctttgtctgtccagcaggcacatgaagattgtggtggtgggcaggagaggctaaggggaaacagaggtgaggggagcagacacagtcctgcattccactcctccagaggggcttggaacttctctgatgttccctccccctctccaactctttgtctcccccttttctcttctcctggcatgcacctgggcaaattccattaaaaggtgatcagaagagacagaagaggctaatttagacacaagaggctgatttcactgtcttcttttctcttttaaaatcatgacacaaagttccagctcaattttgtgggcaaatctcaaacatctctgttcatctgagacaacagtgtgggctcacccgaatatacaattttgatttcgttatatggatggaaaaaaaaaaaaagaacggtgaggtatttgaagattattcaactgtctttgctcatagaaatgataaatctttcactagattgcccaaaaacatgtaattctatatctgcctttgaattgatcggttctatctatctgaattgaatttagtaaacttgagcacttccatttttagatcaggagtaagagccggtcaaaatggtggctgccactttgtagggagactggaatgcatgttctctggcaaaaaaatcactggttcacaaattgtaccagagccctggatcagggggagggcacttaggatctgccaccttggttttccttggctaaaatgtgagaggtatggagcagatttgagtttccaaagtgcgtcttgctgagtagcaggaatccttagtggcacttggacactctggttggccaacagggcaaagcacagggtttcctgggacacctgtccctgtacccatagggtaagactgccttatgctcatatcaatgcctcctcatctgcttatctgacaattcttgctaagagagtctgtctttgactgcatgtctattatacgtgaacttgcatttctaaaggtcctatgcaaatgaatttactttataaatagtgattctccccactgagaataaaaacggatccaaagcaagtatttaaaaagctgactttcctacttgtatattccttgtggttttggaggcaagtatattcctgattcttgcttgctggttggatgtcagtgatctgaagaaagcagagcaagacccacagcaagacctctgatatggttgggctgtgtccccaccaaaatctcaacttgaattgtatctcccagaattcccacatattgtgggagggacccagggggaggtaattgaatcatggggggccagtctttcctgtgctattctcgtgatagtgaataagtctcacgagatctgatgggtttatcaggggttttcacttttgctttctcatcattttcccttgctgccgccatgtaagaagtgtctttcacctcccgccgtgattctgaggcctccccagccatgtggaactgtaagtccaattaaacctctttttcttcccagtcttgggtatgtcttgtctttatcagcagtgtgaaaacggactaatatagtctcattagagctcttgagaagcattctaaaacctgcactcaacatgataaaactgaacccagaagttaaagtaaatgaatgttttagtcaactgagagctttagaagttttgcatttcttccactcacaccataaaaatcataaatgagtctttttaacctgcatttgcctcctctggctccaaacagtttccattaggaagtttccattttcagtgaggaaaaattaaggtttatgatgaattccatcattcccattacagcattctgaaagcatcattaggatgacttcagcacatccattatgaactctaaggagttgacaactgcaccaagaatgtgccccctgtgaagctgtctgcaacatgaactgaccaaagacagaaactgagttttgacttccaacactgagcaaaaaatgaggcaacttgcaaaggctctcttgtgaatgaacatgatgacagttacattttatttcagttttttgcttctaagatagtgaaatagtttttttttttttttttttttttttttgagacagttttgctcttgtcgcccaggccggagtgcaatggcgtgatcttggctcactgcaacctctgcctcctgggttcaagcgattctcctgcctcagcctcccaagtagttgggattacaggcgcctgccaccacgcccagctaatttttgtatttttagtagagatggggtttcaccatgttggtcaggctggtctcaaactcctgacctcgtgatccacccgcctcggcctcccaaagtggtaaagtagttttactgttacttcacatgtgtaaccattccctatagaatgtggagcattgttccccagcctaagttactacacaaaaacaaaacaaaacaaaaaacaaccccacaagggtttgctctcttcctcatctttaccactttgtggtctaaaaggcattattaactaaggagaaggttcttattctcaacttttaagagggattaatatcaaattcagagttgtggagaggattcatctagtgatggtggcaaagtgcctagcacaatgcctgaaacacaggtggcggctaaagcacatcagttgcctttctatttccgatttcatcgataaagatattgaggttcagagtggcacacactatgtttaggagagccggaactcactctgggcttttcattgcagattccacgcttgttccaaggaactatgcccgccttgggccaatgccctgtggtactgtagctcatttccccatctctctgggtggtccagggcaccttggatgtcctcctatgtgccctgcaggtccacagaaagtcctgtaggttctctatcccatccttcaccgtgcatagtgctgcaggtaggcagccctcagcaactgtaatatcttcccaactggcctcgcttggcctgtgtcttaccactccaacataatgtgcaagtctgacacataaaaatccctgatgctgaccaagctcggtcacgttcctctcccgctgtataagcttcagtgataagcactgttcctgctgtagcccaggcagactgttcaaggtcgtcttgtgtctttcttgtcacatatcctgccagtgctgctctcacttttatgttcctccaagacaaatggcttatatgcctcaaaacacactcccctcttctcttccccaagtctctgctcgtgctctccctctccctggattattcctcctttctcccctttcctttccttccttaagattgagtgcaggcatgtcgttctccaggaagccaacaatgaccccccgtgttaaaaaaatattattcaatgatgcctgctgaagcccgacaaggcagactttattcaggaccaccacgatgggtatagagaccaccacaaccaggtcttgcagtgggggctgggggcgggggtagattgagctcaactccgaatacagcatggccaagaagcagtgtcagggtcagtggtggaaaattactaagaggaggcatcggggtaaagaggactctggctaagctgacctaataggattcttgctgaagacaggcccgggtgatcagacatcacctgacggatggtagaagatgaagaacccaatcagatattaagggtgggggggttcctgttaaactgactttgcggggttctttgctaaaactgggttttataaggaagtgcacaggtgagcctaggaaaaggttcagaaacctgacccaaatttggccaagcaaaaaatgtttgtcaccccaaacccactcatacccttgtccaaggtttgttaagcactctccaaacttcctacgtctgtctccagcaccgtgctcacttcagtaggtgaccacctatgtgatgacaccctggttctaaacggtgaacctcctgacggcttgagccacatcttattccacttgatagtcctggtgctggtacaaaatagtctctcaaaaatgccagctaaagaaacaaactgatgtctttcttcctgtcactgtcatccactgcttctactttgatcacatagaactaaaaactagttcctctttgacacaagagtcattcatacatttgacgacagatgtcatctcattcacatatccattcatttgatcagcaaatactgaatagccttttacatgatagatatgattgtagatactctagaaaagaatagataaatgaagtgtaaaccctgccactaagatgagtagaactttggatagttttcctggatcttactttcgaacattgcaaattccaaccccccactgcccaccttatcagtctcatttaaacaaatatttttaaaatttgataatacagtcatatgataaaaaacaaaataaactttttttttttttttgagacggagtcttgctctgtcgcccaggctggagtgcagtggcactatctcggctcactgcaagctccgcctcccgggttcacgccattctcctgcctcagcctcccgagtagctgggactacaggtgcccgccaccacgcccggctaattttttgtatttttagtagagatggggtttcaccgtgttagccaggatggtcttgatctcctgacctcatgatctgcctgcgttggcctcccaaagtgctgggattacaggcgtgagccaccgcgccaggcccaaaatatacttaaataggatacactgagaaagcttttcctacctctgtccctgtccactccattctcactctgcctgttaggtgtaacctcatttttttaaaccatttttattattttggggtttttttaatcaaataaaagcaattatgattttatttcccccactttaagtaaataaaaggtaacatgctatatttaaacaaaacaaaccttcaatgacttccctttgctcctgaagttgaacctaagccttctggttcacattcattcacgcatccctccatttattcattcatttgtctaaacactgttctaggtactaggaattcaaatatgaacaaaacagacaaaactccccgccctcttggagcttacattccagatggggaaaaaagacacaaaacaagatagatgggtacaatccacagtatgtttagacagccttgagtgtgggcaacagagcagcgcggaggggcagaaaagctggaaaagtggtgaaagcaagcccggccagggaaggcatccttgagaaggggacatgcgagtgcatgaggacctgaagcaggtaggggagtgaaccgttggatgctggggaacagcattctggcccagggaacagcaggtgtggaggccctgaggcaggagaatctggcatgctgcaagcccagcaaggaggctcagggtggctgcggaggagggtcatggagaaagtggttgggaatgaggacaagagagacctttagccattggaaggaccctggcttgtattctacagaagtgggagccataagggggtttgagcaaaggttagcatggtctgttatgacatgatttccatattacagaagtactctggtttctgtgttcagaatacagcgaaggggcgagggggaagcaaggtacccatgaggagacagctggggtaggcagggcagtgggagcttcttctccaaccagtgtccatacctcctccagggaccccctctgcagtacccactttctaaagctcctcagccagctcctccctgtctcattcctgcctgttgaactcttgttcatcctttaaagcctatcattaagtccaattcctccaggagctcccccatcccccaactaagtgttctttcccacctgtaacctggtgactcccacctcccgctgtcaccatagtctgcttggcatcatagtcatgttgggacttggcaatcttcatactacaacaaaagcttcatgaggacaatgcagcttattctgcagctccccagagatgtagacaaaagcttgtgcaagtcaatgacaccaaaattcggagaactgcaccagtgggggctcatctgatgcaaaccaagagccagaattcaccagggcatcaaaaggccatggcttctggtgtgacagactgaagggcagcctttgtctgtggtttgagcaaaggccaggccattcattgtggtcacaggaggtggtgtagggttgtgatgacatttctcacaggcctcaggggaagcactgtgcttgagggccacatgtgtgctctgtgggtgtcacattcccggatgtgcttcctatgtccttgctgtggggggcctagcaggatgccaggcactggcccgcaccatcacatggagactgggaggcccgaccacatggacactgctgagggccaggattcttcttatgggtacactgcagagatctccagcaccaaccccatgacaagaggaagagcagagtcaattggatgcatgtccaccttaaggacctgtctttagggcatgtttcataaagtatccagcatataggagaatttgtatagaatttacaaataaaatgctttactggcagatgtactaaaaaatcttctaccaaggaggttcataatccaaaacacttggagaccatgtgtttaagcaatagtgtgattaaattcccagttttctttaggctttttcatgataagcaagtgtaagaaagagaacagaagaacattcttcttgatatagttaaaggaatttctatttttgttcacttttagggcaatcaggaaatgggctcaggagtgtatttctcttagtattgctctcttactggtaaaatttgcttggccacagggaagtggtataaagcaaaacacataaccttttttttttttgatgggctttgaaggtgttaaccagaatgccccggagaaaatacgggaggtgctggttctgcaactacagagaatgacaactaagaattctaaatctgaaataatgaaattgtttaaaaaaacactttgaagtttaatgagtattaattttctgtaagaaaacacaataactgatattaaacttcagccaggcacagttctgatactttgaaaaaaaaataagaaacgctgaagtatcttttgatactttgcctgaattactacaagagagtttacaaatatgtatttctgggataacacagaacttttattccttagataaaaaatctgagtggctgatttatgccagtgaccaaaatgatggctgcaattatgcctgctctatattcatgttgttaaaggtgaaaatgctaaagactttttttttagcagaatggtgatcatgatctgttaacacagtagaaacaaaaaaaaaatccaagtataaagaaaaaaaaaagaataaaaaagaaaagagaaaaataaaataattgggaaaaacagggaggaagagtgtgtacaaatgtacatcttaagactgaggtcacagttcatactagatttcatcttgtttgttaaattccatgtgcgctcagaattccattaactcttattccgtattgcctcaatctttccttaatatgtaaaggttaaccaccccactgtaacttcttggaaacgcactgcttgcaatgtttaagatgaaaaaatagccacaggcaaatcaaaactctacttaatgacttggagaccagcagatgaggattaggggaggcaacatttatttggagattactggggccaaagccaccctaattaattaccctttatttgttctctctttccagagccaccttgctttaattactgactttaatttctgctttgatgccattctcagccaggggcacagcactgcagcagcaaaaacctggggaagaacaatcacccaggagtgggctggctgtggtcactcaggcccagggaacaccagtgtctggttagccctcatccctgcgctaagcagctttcacaaccccacggctggttcattctcaacaagtcagtccttcacacgcaaagtaggaattctactttccagggttaatgctgcctggaaaaccttttccttccgctgcagcattccatactctccttagaggagatgattctcccagggaggctggcgcagtgaggggtccaggcacacaccacgccggcacctggtgaatagctggctgaatgtcagcggaggagtaaaggtgagagggtcatggagggaaggggaaaaaaatgagcaagatcaaaatctgcaactcttcaataaagacagaaaacccagttctgaatggcttcgctaaagatcgtttgtatccacacccagtttcaaaactcaagaggcaggtcagaaatggttttctgttgttggtttgttttttctttttcaccaagtgctgggagaaaagtgagttatgtgctcttacctgctatttccattaccatacacacaccctgtttccatgtctgcagttgagaagtcccaacagggcactgcaaacgctttctttctgcatttggcctgcattctttgctgatgacttaaaagcctgataacaagtcacacgaggaagcatgtcctgtcatcttcatgaaggtcaccaatgattcaaaacatactgaaggaacaataaactacatacaaagaacaagcaagaccccaccacaacttggatattatctctgtccacccaaagagagaacaactgtgccaacctggttcatcaggaaaatctaggtgttcccgtcaagtgactaaaatgtgggcacacatctttgcaccgagtatctgattcctaagagctgttccctttccatcaggcctagaatggcccagttagttttctcctggtgaactgtagcccattaacattgacggaaaattagttgttaatattgaaaaattgggaggtgtcacacagaaatagaacttctgacttctttttggtggtggtggcccggggagatgtggccaccctgggcccagagctccatttcactgtggccgagcagatgccccttgttggggaacccatgctcttcaaataccccaggcctcatcactgtctgtggtctactcgcccctccaccaatgatggctgctggctgaccagcccccagggcatttcaatttgtggcttaatttggtaattcatcaaaaacagattagtcacctgctagggccagccatggtgtgaggtgccaggcgtacaggcagagaagtttacccagctctggggctcaagctgttctatgcctaacaatttacaccgaattatacatggagagggcatggccctcactcccacatggtaattgtgtgtgtgtgtgtgtgtgtacttattttttcatctggcccatgtatgggcacatcacattcctatgggtgactccctgggcatctgtgaaatgttgtctcccactcctgaaattatgctgtaaatgccagggaatggtggtgacatggttatagcgacgatcttgattctgctcaaacataaaccacagttggtttctttagcaattattaagaaatgattgggccatgtcagaggaagacagaggaagaatctgaactgtaattcacttacagatttctacagaattagctcatgattcatggaggcaaaaaaagttttgtcaggaatggcattcgaagacacagaaaaacaatttgaaaggagcctgaggtccaggtgttttcagagtgtggtctttaagatagtttcttaaaagatcattcggagaagagagcattttaaactgctcttgtacaaatctatggtacattttattccttatgttgaaaatgatgggaagattgtgcctgtttcacccatttaagaaacgctccctgttggtccaagccaccgtgggctcctccatcctgagggaggacacagtggctctactgtcctctgtagaggtgaaattatgtggcacatactgtgatcaaccacagctactgccaactccccagccaattccccatccactccccgccatgggtactggccgcttccagactctaagacagaggttcttgcgcaggggaggttattaggacgagtggtggggaggggaaaggaaactgggcagagggagagtgaagctaccaagtggtcctagtggaagcctagccgactctacagggagctttgaggatgagacgacccttatcggagcaggaggaccgggccttgatacccccacgttggtcagttctgggaaggggctaccctgagaagggggtggaacttgggcaaggtggctttgctctgccccaacagggctgactgtcaagggaggctgggagacaaattctatttttctgaagtgacctggggtgtgtcactgtgaccagtgcaccgaccagctaaccgaccaacccgcaaggcccaagctcaaggaattagaaggctccagacttgcaccctaagttaatcatctgaagtctcagaaatgtgacagcctttaaactgaacactacaaaaatgctgcttattccactccaaatcattagctcatcatccatgtaaggagcttcaagaagaatatcggtaagattagcggtaaattcaaacagtttaaactttcagtataaaccgcatcaactcaaatcccgaatactgactcaacaatttcactcctaggaatttattctaaagaaatcctcatggctgtgggcaaacattagatgcaaatatgttcctgcaaggcaaataaaatatgcaaaaatatagttttatgtaaataaaatacatcaagatccgtgatcagataatatacatgctaaattcattcagtagactatagagccactcatagtaaggtggtgaaaactaatgacatgaaaagatgttcaagacttgctgttaggagaaaaaaccaggttacaaagcaatgtttattgttctcattttggtgaaaagaaagaatatgtgtgatagtattagaagactcctgtgtttttcttcttgattatttggatttggattatttagattctagcatgaatttccacaatgaacacttattacttttataataacaaaaaagcttctcctttccccttccctcactagatgctatatatcaatggtcaaggtaaccgtggttaacagacacaatatgtaagggtaaaggttagttggagagaaaatcgactttgcctgtttttgtgtagtggtttggtatcacggcttttaatatttgctctgtatctgttatgcacaatctctaaacctgctcattttaacccattaacattttggagtgctagttattgaaagaatcctatttcatacctagaaacagggatttcaccagaaaatactgattttgtctttctttgattacctctcctgcctgccatctttatctggtgaaattctcatttaatcagtagtgttggctgagccattctcactggagtcagggctgtctgagtgccaggggacactcatctgaattgtttcttgtcactgccatgtccctacatctattccttgctcacctgcattattttccccattcttcttgcagtcccagaatcacatccaagccccttttctttctccctggatgaccccttcctctgaatctcctttctaacaagactggaaggttacataataaacttctccccattacagcattaatgatgacagttgtttaatatataaggccttcccagagaatttgtatttaatcagcaaattctggagatcagtctgcatctcaaaggaatgcattgctaaggggaaaattccaggcagtaagtcagttacaggggaaaattctctgcacaggtgggctcttccggggctgggtgctgcctacgtattgttcaagcacctacactgagcagattcttgcatggactgactgggattaagggcagacttccaagaaatcactcatgtctccattcattcaaccaccatttgttaaagatctcccacgtgacttctcgaactccttggctgggtaaaattacccctagttcttagtatttaccacactttaattgatttccttcaccgaactaagggtagaccaagccagagaccctggaacccttaaaacccttcataaacatttgttgaacaaatgcatgcagccaagtaactgactcttccttagagatataaagatgaggaaggtatggttattccttcaaaaagctcacagtgggccaggcgtggtggctcactcctgtaatcccagcactttgggaggccgaggtgggcagatcatgaggtcaggagttcgagacaagcctgaccaacatggtgaaaccctgtctctactaaaaatacaaaaattagctgggcggggtggcgggtgcctgtaatcccagctacttgggaggctgaggtagaagaaccgcttgaacctgggaggtggaggttgcagtgagccgagatcgcaccactgtattccagcctggaatacagagcgagactctgtctcaaaaagaaaaaaaagctcacagtgaaatcaatcaagaaatactaagccatgaccaggtgctcagtagtctactagggcctccaaaagcctcagtttctgtccctacaggggcttaagatggaagcttgagtgatgagactgcagctccagtgataatataaatgatctctcttgtgtgtcacagacactcagagctcaggatactagaagtggagcgtagcaatcagaaaagtctagctaggtatataagaatcccatctcaacctccaattggtccagttacaaaaagtcctacagatgaaggacttgagaatagggttaggctttaaataagtgggaaaaagatatacctctgcatttcctcattactacctaaaaagaaaaggtataaggaaagctttccccaatcaacctacacaagaatctgctcagtgtaggcgcttatactagttagttaacgttccactatcatccactgtcatgtggcatcaaataagcaggtgcttttattaaaggacatatatactttactcattttgaacaaatttgatggcttgtatttttttgcatggcattgggttagtgctaatatctattaacggatgtcctggatttcttaggaaatcctacctttgcatatttcattttaaaaataaatgctattcacggggcgggagcgatggctcacgcctgtaatgccagcactttgggaggccgaggtgggtggatcacaaggtcaggagatagagaccatcctggctaacacggtgaaacactgtctctactaaaaacacaaaaaactagccaggcgtggtggcgggtgcctgtaatcccagctactcgggaggctgaggcaggagaatggtgtgaacccaggaagtggagcttgcagtgagctcagattgcgccactgcactccagcctgggtgacagagtgagactccatctcaaaaaaaataaaataaataaaaaaaatttttttaatgctattcatgcaacacatttttaaaattttggtaaggacataaaaataaatacattggacaaaatcttgtgtttctgcatacacccaaatttgggcttggaaagtgcctataaacagaggtgaggtggggaggatgccatgtgtggtgtggtgggatgtcataggtagctatgataaagacaattctggaagaacaaattctctgaagatggctgcaacactgtctcctactccacatgctctcctacagccttgccattcctgttgggagaaggaatgtatgtcccctgcccttgaatgtggaggacctttgtgagtgcctcaagtgacactatatggtggaaaagacaccaagtttaggtcataaaaagccatgcccttctgccttgttctctcggggcacttcctcttggaacccagttgcccaccatgctttcaggaagcccaagcagcccatgaagagcccatacagagacgaactgaggctgctggcccagagctctggctgagctcctcactggcagctggtatttttgccagctatataagtgtgacaacttgggagtggaccctccagtcgccagccaagggaaacccagaggatgatgcatggaggagagaagaatcatctctgtgcaaactgcagattcacaagcaaaacagatgactattgttatttacagccattacgttttgggtggcttgttgtgcagcaatagtaactggaacaacatttctgcgatgggcagaagtggcaaggattgtaactcattagactcagaaggcgaggtcacctgagtaagcagggtccttagtggaacagtgggtgtaagaggaaggagagatgggtgggtgtggggcttcttgccatctacatatgtagggtctgccttttacttgcacatctgtgagaggtgtacaacagagttgtagaagtatggactctggagccaggccacctgggtctgaacctggtgttccatttcttagctgtgtgaccttgggcaaggttctcaagtcccatgtgcttcagattcttcatctgtaaagaggataatcacaggacctacctcatgtggtggtggtggcacaaattgacctaatgcctacattgaggcttggtgcataggaagtttccatgaaagcgttcactgttatgatccacataggtgtgggcctcagactatgagctgggctgaatgacagcccctccctagtccctggagcttgtaaatatgttgccatacatggaagaagggactctgcaggtgtgactaagctaaggatcttgagactaggagatgatggattaccagggtgggcccagtgtaatcaaggtgtctttataagcaggatatggcagggctggagtcggagatggagacaggatgatggaagcagagattcgagtgatatggggccatgagccaaggaaagtgggagtctttggaacctgggaaaaggcaacgaaacggattttgccctagaagtaacgcagccaggctgacacctgattttagcccattgagactgattttggagtttgatctccagaactgtacagtcataaatctgtgctgttttcagccactaaaattgtttggtaatctgttacatcagcaacaggaagcaaatacaaatttaagactggagaaaggtagctttatagaacatccagcagctagaatgttcaaaggaagttgggctttggaatcaataaactgctgtccttttatttcttcttctcctgacttaggcttcgagggatgacattttctttttaatcctagcatgtgaagtggccaaagctcaggcttgggtgtcagatgggcctgggcaggaaccctggctgcagtccttacttgctgggggtcctcagtcaactggtggtgctggccaagatgaccacagtggcactgacagccagagtcagttgcctgctagccattcggagtggtcagtgcccacgaggtaccagttactatgtgctatgaatattatctctagactgaatcctatgaacttcagtttcctcatttgcaatttgggaacaatctaagtcaaaggttgttgtagaatgtgcataggtaggtgcttttcagactgtggctgccacagcagcagtagctgccttacttggcaacttgccagaattcttgccctacctattgtggtaggctgaattctcaaatggccccctggtggacaagctttgcatgatcccgggactctgtgatggattctgtttccacagttaggttatattaccctgggagattatgtggggtgaacacttaaaagggaccgggttctttctgaagtcggagaaaggatgggagagacattctctgttgctgattctgaagatggagggggccatgtggcaaggactgagagtggcctcaaggagctagagtggccacggggatctgaatgtgcttagaagcagattctccgcaagagtctccagacaggaacgcagcccaggagagaaccggttccagccttgttaaccttgagcagagaaccctgttgtgcacatggtgatttctgacctacagacctgtcaactaagaaatgggcattgtaagccactagatttgtagtaatttgtcacacagcaatagaaaactaatatatatttactgaatcagaaactctgctggtttttgtttgtttgtttgagacagggtctcactgtgtcacccaggctggtctcaacgagcctttgctgaatctcttccttgtcagaggagactgctggtccccaagatagaaagtaaaggagacccagccctgctgtcaggaagcacccgcctcgggttggagtaaaagtcacacatgggacggggctgtaagtctcagcaaacagcagtgcgagggacgcacgtggaagaggggtagtgagggcaccttgtgggcaggagagccttttaaagactgtatgacgtgaactccaagatctatccttgaaggccagggagtggttgaaagatggagccctctgatttctgacttcacttctgcaaagcctactgtgtcatttactcctcaccatcagtggagcgagagcctctgggaccacgtctcccgagtcccatgcctgccatcatggtgcgggctggaccagccttcttagtgggatatgttccccatagaaagtaaaccaagaggcaaaagcaaagcaaagctacgaaagcaggctcagtgcccccgccccttgtttcagtgtcacctcaagtttgcttcttgctctcagagggagatcacagcattgcacaacgggcagtgttgactatttgctggcccttgtcacccacccttccaaaactcgggcagaggacaatctgaacaccagtgtgacagtttctaacaaaaggctttgctagtacagtgcctgagtgtgggtgtccactgaaaactaatttcagccctgactaagaaaggcatctcagaaatgaggaagtgtattttgggctcctgtggtttctgatgaaaaatgctgcaatgtggggcatgggtgaaagggaaacactgagaaaatagatgtgacccccagtatgcttccttgaagaagtggggggctggccaggccaggcacaaagatcctttgtgttccctgagcctgtgacttctcccgctgtttctcagcagttacactaacgacattgtggaggaaacagcttctccttgcatggccctgccccttgcactctagactgtttagcctccctgctggtcagtcccctctccctacaaatgccagcagctttcccccagtccttgctgcaaccacaaagtctcgcaaggattttcaaatgccactgggaggatagcggtgccacccatggagaataatgaccccaggccctaaaatgaaacaggttgctctaacattcgaagaatagccccagcacaccaaatgcattcacttaatttcttgttcaacagaaaagaatgacctcttttaatacagagctgctttgaaacatgtcatttcaaacaggtcctaagaagatcctgatatttgtctgtatcttaactggatctctgtgggttgaaaaacgctcatagaaatgttgaaggacatcagtcaatctttaataagatgagatttctcagagatacaacatgctgtttgaccatctgaaggatgctaaaagaaagtgatttactgaaataaaatagataacaaacatttcagtgacttagaaaatggcgagaaatcacgtcaggcaagtttatatttttgtgttaaaaaatccccacctaacaacactctcttccttacatttcttcccagcaggccaagaacttactaaactctggctctagaagaaaatgacattaaaatgctgactttacaggtatatagtctagcatttgttggcagttacttattagtttttttttttttttagaaatgtaaaaactattttctttgtttcaaacgaataggctctaacttaaaataatttacttgtacaattaaattgtctgaaaaaccccaacaatgctgttaacacgttgttaacaggtacacaactcccctctattttaggagctgacgcaaagaagacagcacaaacatgaacaagaaaacaatcgctgtcgcttaaaagcaacaccgtcttagcagtttaaagacagacactgcatgctcacatactaacaataattatgagtctccaactcagagggtagaagtcagaagacgcaaacaacatccaccgtaccaggaactgaagaataggaggaagcaggtttagaatagcaatgggtttttccctgagatgtacattttacaagaagcattcaattccattttagatatggaaaaagagcgtgtttttcccattaaaagggggaaacaggaaaagtataagtagcttgacccattattatgtcctacctggaaaaaagtttttttaagtggagaaaatgattagtcatgagtgcatgacttattaaaaatgactttctgggtaacagagaccagataatacctacgtgaataaatctctccccaaaccctagtttggggcccacacttttgcaaggtctccagtgagtaagacagtaaattctgtggctggcgttttctttggaacacaaagggtcgcaaacaaactcctactcagctgcagccactacccctgccaaaattgagtagctgaggattcagcgaagggttcgggttccacgtcacccaggtgctacaggagcctgagcccaggagcggggactgtcccacatgccaagagaatagggcatatccaggagtccaggcccatcacagcagccaggtttttacctaggtctactactctttccacatcacagcttcccctcacctttctccccctccctcacctgctcactgccatgtatgggaatgcaccccaggaaacacacaattttgaaaaacatcgtcccaagagaaaaaggctgtcatgaagaggccaggcaaatgacctcaattaagtactttgtccaatgctaatggattgaattctgttcccctaaaattcacatgttgaagtcctaacacccagtgcaatggtgctatggtttgaatgtgtcccccaaaagtttatgtgttagaaacttaattgccattttaacagtgttgagaggtagggccttgacaaggtgaggaggccacgagggcagagcccttacaaagggattcatgccattgttgcaggagtgggttagttatcctgggagtgggctcctgataaaaaggatgagtttggctccatgtcctctccctgtctcctgtgcttgcttcagcttctgccttctgccatgcgatgaccctcaccagatgctggcaccatgctcttagacttttcagcttccagaaccgcaaaccaaataaatctcttttatttataagttacccagtctgtggtgttatgttatagcaacagaaaatggactaagacatggtatttggaggtgaggcctttaggaggtaattagggttaggtgaagtcaggtgagtagagtcctttttgcaagaaggtgacagtctacaagccaggaggagagccctcaccaggaatcaaccatgctggcagcctaacctcagacttctcaacatccagaactgtgagaaataaatttctattgtttaaggcacctagaatagggcattttgttatagcagcccgagcagatgaagacacctaccaccactcagctttggaaccaggattctgaaccaaagcctatagatcctatgttcttaacaactgcattttactactctttgagaagaactgaatttagccaatcaatgtaatttcacattgattttcattacttttgctttcaaagttacatatgaaattttttttgcatggctagatatgtgctggatgactaagaattttataattggcatatcaataatcaaatcagttttcctaataaaatgacatgtctgatttctgcaaaagctcttcagtgtcctctcaaactgagaaagctggaaagtagagttttcaaaagagtaaaaataataataaaaaaaagttaaggcagtactgctgagaatttaaattctctgcaatgtcgaaacttttgaaatataaaacttttaaaaacagtttcactgaggtataccttacatcccattttagcacttgtaaaacctttgtctttaactgtattgtgataacattgatatcctgcttaacataagaaatattattttaattgaaaacattattcatgataatttaaaaagctgctattaacttctacatctgtcagtaaatctactaaagtttagttcaaaatatgccggcaaaggaatcttaaattctcttagtgccatctaaataaaactgtatttcttctaagttctattgtaaacaaagcaaaggactatgccagaatatatagcaattagagaaaaatgcctacttttcctctttgcacttattttgtgcgcttgtttcttgttttgtgtaggtttgatgattttgccaaattgcacggtcagcaaacagttcgttgtggtccaacacccaggatagggactatgagaccgtttgccaggtgctaggtggtgttcaatcatctcacgcctgaagctcttcatcagtcttctgttgctcaggctcttcactgtctccatcccacgtgatgaaagacaggcgtgtctctggccagggactaaggcgccatgagcatgtgtgctttgtttgggtgttggtgtgctctgactcatgctctcagtggccctcgaaggcaccaggtgaaagaagagggtcagacaaccactagccacagctgtggcagcctcggttcaaaaatgtaaaatctgccatgcaggcagtttcaaagacttaacctatgcccttgtataattattatttttacttcttttatagcaacgttcattttctaacctgaaggtggttcaggtgatgttctaatctgcttttgagtttgaaaatgcatctaccagatgattcatggtggctgccgaggtggtgaataccgaggatcccaaaatgaaaaattacggagggaaacttagaaaagtagtactctctcacagccagagtggtgctggtgaccctccagtccaggctaaaacaggtaagcaaaatatttgccttgtttttaatatacatcaagcaaaacaaggtttaactctatctgtggcatctacagcagctgtctccaagatggaggacaatgatggggaccaggaggaggtcagcagcctcaatggctgatgttctgaaatatttctgagcggagctaagggggaagtggtttgccaacattatcagtttattcgtttgtccatccatcatccatccatccatccatccaccgaacacctacaggcactgaccatgccagctactagaacccagagatgaccatgccacccagacagactccaggaggcactgaacacagacccaggtgaagttctgaggcccaccttgctccttccccgagatgtgcctgctggtggtggcagtgacagggcggcacatcaatgatgaggtggagtatggaagaatggaagcactgccaagactcctgagtggcagaggcccattctattatctgtggacaccctcgttgtatttctaaagaggttttctcacagagcaaaaccacctgataccctaaaatatcatttagacaattatgttattattgtcccaattcttacttccacgacaaaacagcagatgtgtcatctcccaatgaagatgaagacaaaactattctcaaaaagaaatggaagaaccatgaagtaatctccatttgagaaacagttttgcaaattcaaagtggcttctgtgaactttgttttggctgaaatgaactcctcccaaaaatacatatgttgagtcctaaccgtcctggtacctcacaatgtgactgtatttggaggtagggcctttaaatgggtgactaagttaaattgaggccattaaggaggagcccaatccaatctgctgggtgtcattataagaagaggagatttggacaccagacagagaaaagaccatgtgaggacacagagatagcatgtcatctatgagccaaggagcaaggcctctgagggaaatagccctgccatcaccttgatcttggacttccagcctccaggattgtgaaacaacacatttctgttgtttaagccacccagtctgtagtattcatcatggcagcccaagcagactaacaccactgccaacttaagagcatgtaacaatataaaatatgcccatctcaaactaccaccttcatccttataggtctctacagttggctttaatgttctcaaggaaaagcctctgaaagaaaatgatgagacaggaatgtaatgaatgtagcttcagtcccccatactaaggcatgcccccactacctttagatccatccaatggagtgggcagagctttatcatatagccgatagaatctgtatcctgctatcaactaataccaagctgtaagtaactcattcacatatgcacaactcaatgcacataactcaatgatgttgataaagtcagacaaggaattctatgacaacgattaaactcaccttttcaaatgccacattttggtaatcatctggaatggggctcttgtttttaaaactgggaagacccaaggaaaatagtagaaaggcttttaaaggcacccgtgacgctaagggaaaacattagaatgggtgcataccaatagtaactatttttaatcttatgtcctgaacactcttcctttttggatggtgtgtatgaaggtctgtggctggcttctaaactggaaaagtcacagatatttacccttgcagaaaatatctataatcatttcttccttggaaaaaataatgacaaaccctgaatcacatttcctaaaattttaaaataatgatgttgatttgctggtttatttgaaaattccatggtaataaagtaaccaattaaatatttaacctacttttactgggacaattgagggaaaacaggaggaggcagaaggcagctctctcactggttcaacaattcttcagctagtccaaaacccatgttctggtgattggtgattctgaaatacagctgctgaagtttccacactgggacacttcccctagtgaacattcttttttgattctttaagtcaatcttaaagaattctgaagtctcccaaacctttgttcattggacttccagcatttttcccttgccactaatgtcaaaatcccttcttatcccactaaactttctgaactctccctgaatgttggaggatgaagacaagtgggctgtgtaaaaaaaaaatcttagaatgaagacttaggaatagcgatcatgggtcccaggggaagacttagatgaccaacagttctaaccaccttccttgctcagaaagtgtccagtcaatggagaaaggaaggcattattagctcttgataaggctttggcagaatttgggacagatggctgtgtgctcagaggatcaagtgaagtttaagatacaaggtggaaaggccagtaggactcacgtgatgtctctatcagggttcctctccatcctagggtgttcctcactcctgctggagggctggtgtttatatgatgtagagaggtttgaggtcttggatacagaagggctggctctgcattactagcgttagaggcacgataccctttagggtttggcttcttgttgaactctacagatgttgtttggtatatagtgtccaagaacagtggcatcacctgtgagcttgccagaaacgcagaatctagagccccacctgagatctactcaaggagaattttcattttaacaagatccgaagtgactcctgtacatagtaaggtctgggaggcattggtctaaggtagagggggaggaagaacatgccaatttttaccacgtgattgctaagtgatactatgcgatgttaagttgggttaacttccagaccaacaattctccataggaaccctgccaggttaccacaaacggcaaacagggcagagaaacagggcaaacctggtttacgagattttttccagagaaaatgtttaccaggttgccaaaggcatcagaatcaatggaaatgacatcaatattcaatagtagtgtagccactcacatgcagactccattcctaactgaattattccattacatgtgcctattaaaaaaaaaaaccaatcatgcacacatagacacataccaagctgtcattattgaatgcctattcatggatgtatcgataataaaagacagtgaggaggctgacttgattatattttaactgacttacatgaccaataaagcaataaacttatttccctccatgggcaattttagtggttgagtatatttttagcatttccctctggagatatagctttatgaacttcacatgacccaaacttttaatccaccccatttgcgcaagtttttctttttctctttaataggatgatagaagactggaacataactgcctaattctgaatttcagactatctttctaaacacagcacaacacagggagaagcaactaccttctagaccataaatggcagagatctagaagcggccagacaaggggtatgagaaaaagtattacaaacaaaagaaacagacagatgccacatttttgtagcagcaactctgcggaagccaactgcttctcaaacctgacccagcagccacaatggacttttagatgaatgatccctcaccagcggagctcacagtgggggtggagatccattccagctgatagtagggacgagcaagcaactactgaaagggctttggtgcttttgcttcattggtgcttttcagttttatttcaaaaattataataataaaaaaaaagactctaggtgtctggatcagtatgccacatgatttatagcacataaaatcatggaaagtcatgccacttcctgatagcacacagctcacgctggccactgaaaccttttttctgactaattcattccataccgtagttttccatggctgattcataaccatatcctacttttctcatttcctgaaatgattctgatgaagcttattccacataaaaagtggaacaatatataaaacccagacacctaggtacaatttaaaaatcttaactctaaatcccaaatcaacatttggccatacattcctaagatgaaccactgtttctggattctaaaggacactgtatattccagtaagcaagcctgtagcacagtgctgggttcatgatcaaaacgcactgagttcattccagagtcagctctacttgtgatgaaacaaataacctataaagcgaaatcttttcagaccaaagagaggtctgaaatcgagaagaaacataatgaggatgcaaaggggataagaagcagcaactacaccctggctctgtaagacggcatgtcattacaccttactcaaagggactcctcaatatttaatcagcgattttttacattattacctaaaggaactggagtactttaagttgcctcaatttgctggcattttaaggaagataaatgctttagaattacttatgattaagacaaaaatctcagaaacaatgcactattcgaatctttagctagagctctcgggaggagagtaaacaagataactctactggttgcttctcatactcatcttctttctttgagacagaaatctttttattttcctagttagtaatcaagtatgtgtttctatggaaaaaatgtaaacacattttgaattatgccatcgctttcaccttgaaatcattattttattaagaatcactcagtatttctaactacctactagcaagtcatttttagaaatctttctttcaaagtgaattctgtattaggtgctgaaagtgtggtgctgaaaccacagagctgctgatacatctggaggctggggtaaacactggctgctgaaaccaccaggtgagaggcggatcaggaattgcagaagctgggccagactgaacacacctgaagccagggatggtgcttttaacatcacagaaggagacaatcagtgatcacatgcgtcttggtgtacagcaatagtcagtacaggatatttcgtgtgaagtagtcttgtccaaataaaaacaaaacaaaaacaaaaaactctgatttttcagcaagctcccaggcctctgagtttagataaatagatgtatattagtccgttttcatgatgttgataaagacatacctgacactgggcaatttacaaaagaaagaggtttaatggactcacagttccatgtaactgggaaagcatcactatcatggtggaaggcaaggaggagcaagtcacatcttacatggatggcagcaggcaaagagagcttgtgcagggaaactcccatttttaaaaccatcagattttgtgagccttatttactatcatgagaacagcatgggaaagacctgcccccatgattcaattatctcccactgggtccctcccacaacacgtgggaattatgggagctacaagaagagatttgagtagggactcagagccaaaccatatcagagggaatgcagagatgtgctaaacagtgctaacagtgcacttgctgtttccagactgtgggacagcctatgagacatatgaaaacagtttcactggggacctatgacaaaggatggagaaaccagatgaaaagagacagaagagacagatcactgaaatgcagtgagtgcctcttatttggattctaacgcaaacacgctaattataaaaagacattcatgagccaatcggggacatttgaacacagaatggatatttggtgatattaagaaagtacatttactttatttttgttaagtgtccttatctcttagagatacatacaaatgaaatgatatgatgcctgggatatgtttaaaatgatcccatgattggcagggtggctcatgtctgtaatttcagcactgtgggaggccaaggcaggaagattgcttgagcccaggaggtcagcactgtagtgagctgtggttgtgccactacactccagcctggcgacagagcaaggctgtgtctcaaaaaaaaaaataaataaaataataataataataaaaaaataaaattactccatggtgggaagtgtgggaaggaggattccatgtactgatcattgttgaggctgggtgaggagctgaatatagggagttcattagaatatcttccatgcttttgtatacacttgacaacctccataataaaaaggtatttttaaaaaaataaaaggcaggccgggcaccgtggctcaaacctgtaatcccagcactttgggaggccgaggcaggtggatcacgaggtccaggagattgagactatcctggctaacacgatgaaaccctgtctctacgaaaaatacaaaaaattagccgggcatggtggcgggtgcctgtcgtctcagctactcgggaggctgaggcaggagaatggtgtgaacccgggaggcagagcttgcagtgagctgagatcgtgccactgcgctctaacctgggcaacagagcgagactccatttcaaaaaataaataaataaataaataaataaataaataattaaaggccaaaaaaaaaaaaaaaagagcagtaaagacttgaggctaggtgaggtggtacatgtctgtaatctcagcactttgggaggctgaggcgggaggatagcttgagctcaggagtttcggaccagcctgagcaacatggtgagaaactcaatctctacaaaaaatagaaaaattagccggacatggtggtgtgcgcctctagtcccagttacttgggaggctaaagtaggagaatcgcttgagcccaggaggtcgaggctgcagtgagctgagatcgtgccactgcactccagcctgggtgacagactgagaccttgtctcaaaaaataataataataataataataataataataggtttaaaataaggtcagcactacccatgctaattctaaagggatgtggcataagatggctttcacaataaaatgtacaattcatacaagttgaaaatatgtaatttaatttttaatgatttttcaagtgaggtctctgatactctgatgatactaaaaatatacaacagaactctcttggaaatagtttatttttgcaatcattgtaatacagtcagtagcaaaaatatttagaacacttttcaaaaggctaaaaaaatatgacagaacgtttcagtgcaccgttcaggtgaagaccaagtattattgaagtttttgtttcttccaatgtaacagaagaatactgagcccagtggtgtgacgtcaatcacattacctatgaggttgcagggccatgctgagaagggtgctttcactgcactcctgatgaaaatatggggacacatttatggtcctttaaaagctgtaaaaggctgggcatggtggctgacgcctgtaatcccaacacttgggaggccgaggcaggcggatcacctgaggtcaggagttcgagaccagcctggccaacatggtaaaaccccatctctactaaaaatacaaaaattagctgggtatggtggtacacgcctgtaatctcagctactcgggaggctgaggcaggagaatttcttgaacccgggaggcggaggttgcagtgagccgagatcacgccactgcactccagccttggtgacagagtgagactctgtttcgaaaaataaaataaaattaaattaaatttaaaaaagctgtgaagaccacaccagagcccctggtaaaggtaatgtccattcggctagataagccacatggacacctcacacttggatagctcactccagccacctatgtcagaaacactaactcataattcccacaacgccccactgaggtgtgcaggtggcagcccacatgtttctgttccatctatggaaggctggtgcaggtcacgtgattgctcaagtcggggaatgagtcaaagggaaggctagaaagacagtccaacccaacaccctgagatcccagcaggcacctttaactatcacagtgtgcctttgccaagcctggggaagatgctaaaatgagtgacagattcagttacattagcaagtaacacgtggtggctttttaaaatttgagacaattttttaaaatagtaaacatcaacacaactttctcatttaacatacttgaaagatgagaaaggtggtggccatctttcacaaaaaaagatgatgctgatagatttaacagccactagtgatgaagatggcgatgatgaagatgatgagaaatagcagcgatccgaaattgactgccagtcacctatcaggtatggatgtaagcagtcaacactcactctctcatgtaaccctcaagccactctaggagacaggtactatcacttttttataggtgaggaactaaggctacatgttgtgcttaattctcttggatgtccgacctggaatcagaatttgaggtaaagtgacaatgaaattgtacccagcctaacacaaattcttaaaatagtgaagaataatccatcaagcctgtgatgaactatgttgacaagttcaagctgttgaggaggtgcttgtgcgttactgatagaaaaggataatgcttttcatgctgccgaccattcacaagacatttggctattccataaaagagattctccctctcgaactccgagggagaaggctgtttcaggttcccatcaccaaaccactctgcagctggggtgccctgctacccggtgcaggagccctgcaccaacactctgacaaagaactccatgagacagtcagagatggaaaggtttgccaggccaggacttcctctaggaaagcaggcctcaggttcagacctgtttaagctgacacccaactccacctccaccgtgactgagaattgagatgactgatgagctggaatgatcaagaaaggctaagaatcatcaggaaaggaaatgatcaagaagaaaacgttcatcattgtttaagaaggcagggttggactgtccattttagacactgattcctcaaatggttaaacatcacatttctaacaaccaagaggctatatacccttcagctctacagaaaatctggccatctcaaacaacttaacgtatttcctaaagattttgaattgtagagttttactctggtttttcaaggaaccacggcatcttcaaaaggacactggttctaggagtctgaagtcctggtttctagctctcgcttttccagtaacaaactgagttgcactggggagaacatttcatctcctggatctcgccctgtctgtcgcaaaatcaacggtaaaggctccctgggctccaatgctccaatggaattcagggaatccaaaaggatgtgaccggaaagaacacaatcatggataatctcattcagcttatataagtgaacaaagtgtgggaaagcaaggcagaggtattagcactcaagtgtattaatatctatgctaatggaatactacaagaaacattccacctaaatgctaaaaacaggtttccaattaatcataatttaacaaaatacaaattgctgtcagtctagctacatgaaattcccactagggccactggaaattgagagaatgcaaagatggatggatgtagtctacttattccaggaatagttggaaaatttggaataaggccaggattagggaaaaaataaaacaaaacttgcctgacaaattgagtagtgttgggaagtttaatacaatctgtgactgattcacagcgcaggagtctttctgtaagaagagccctgtttgttctgggcagtggcttatatgttcaagaatgagttcagatgagtgcaacttcaagtagagctccacaatgaatccaattacgtaggcggccaccacagcacttctttaactttcgtaggcaaggaagaagataaagaactcatttgtaaggtatacaaatgccctgctggtaatggtctaataagcctaacaatttaaatgccatgctctgaaataaccctttgtttcggtggattgagtcagccaaagtatccggaactgggtcccacagagggtcctgatgttctttggaacatagctcacattttccagtttattatgcaggttctgactgataataattctgtcacagtcaacctacactttgcagtttacaaggtcatttcacatgtattaactctttcaagtttctctaaaacctggagaggatatagggaaggtgttaactatccttacctttgaagaaaggaggcttggtgaattgagactacttgcctaaggtcaggcagctcacaatcgccagcatcaacattcacattcctgccctgtgattctgtggtcccggatggctgtacccaaatatttcttcctgaaggtctttgagttagtcctgaaaaaggcacggttcaggtacactgacatgccttcaagtttccacggtgagccagtgaacattacttaacgagagcaatggtgagctcatgcagatctcaggctctgaactgagaaaatgttcagaccattaaaaaacctttctccccccaacaattttgtcttttaatctaagaagtcaggttcttggcatttctgaccactctaacacaaatccagaatttgcctaagcgagcaaaagaggatgcacaaatcatgactgtaacaagcctggtttagtctgacggggttgccggtacaggcacattctaggatagatgcaggcagcccatgaaagtcccagggaaagaagtccacactgggaggggctaaaagcttcggacaggtggctaattctaaagttccttctgtgaactgctccacataagcaaagcaacctagacttccctaagaatttgaaagcaggatcttactttatcatttttccatcttttacgcttagaacaaagaagtaacaaagaataagaataaaaatcaaggagaaagaacagaggcaaacaatagtgcccatactgatacttattttaagattgttgatttttgtgggacatccatttcctggaaaactttacaaaagaggattgttgtaaagttctaaatgatgaagacagggctttataacggaaaccatttctcaattctttaataattttaatacttaataattagcaccagaagaaaatttggttgaagtgatgacaaaaagaaaatcatgtgtgaaaaattggaaatattgacatgatttcacaaagacatcagaagaatgatacatttgtgcaggaagtacagtaagagcctgggggaagctaaatggaaaattagtggtcaaataaagaaacaaaagagagcaatgtccagtaaggccattctgactataaagccattctgactatactcttacaaactgatgtgatttggctctgtgtccccacccaaatctcaccatgaattgtaatctcgataatccccacatgtcaagggtgggaccaggtggaggtaattggatcatgggggtggtttccctcatcctgttctggtgataatgagtgagtttcaggggatccgatgattttataagtgcctatcatttcccctgcttgcactcactccatcctgccgccctgtgaagaaggttgcctgcttctcctttgccttcctccatgattgtaagtttcctgaggcctccccagcaatgcagactgtgagtcaattaaacctctttcctttataaattaccctctctagggtagttctttatagcagcatgagaatggactaattcacaaactagtgctgtgttgacatcatgatcagagtaaatacgggataaaagttcccaagctatgcaactttctccagcaggagaaacttttttttgggcaagtggttactttaaaactttatttttagtacaagggaaaatgatcccaaaagtgtatttgtaagctatggtttgactatttttgatgtcaggaactgtgattcacctacaatatccaacttattttagatattattctaatgctctctacctaaacaaaaatacatttgaaatagtgaaatctttctccaagagttaaaaatgctggagctagttttgcttggctggtctgaaatacttgaaagcagaactgcaagaactagcactttctggaaagtgttgacctctttctggataattttataaagaagttagctacctcagtaaactgtttatgaaaaaaagagaagctaaacatgaatccatgcacagtgtcaatgcttttgatactgaattctaactcaagacctgaattttaactcaagaatattccgtcaatattggcccgacgttcagggccacggtggtcccacagctgaggacagctggagcacgctgggctgctcctgcccactgcaattttctataggcacacaggattgagggatttggttccttaaaaggctcgagatcctatcccttctcattcggagactacccagaaaatccctggtcatttatcactgcagtgcactggtgccacactcaattacatttccttccatgtgactgcattaaccagagtggggcactcccagatctgccccatactttctgtgaggtcatactgaacaagcacttcaagaaaatctgactgaatgctccatgaattccattatgaaggcatataaaacaatcatcttgctccatttccttcaggggcaatttcttaaggctacgttttggccagaagtcaataaagacttcatggagcaccgatttactctgcagtgacatcttttggtacattcttacgctcctggaaaatcaaacactctatattccatgacttccccgaatattctgctccatttggtcatcactgattagatgcctaccatgtgccaggcattcccaggaaagcgtatttccatggtggcatatgaataaagccaggtgacaaatgctgtgggcaaggggagcatgcacagagggtccccaaggagtgatgtgggagagcagaggcgacatgggtggtgccacctcagtccctcttcccaaggtgctctcactcacctgaaacttatcctagactttgaaagtctagaatactttcaaaaggacactttcacatcaactcaggcaaatgcaaaagttaaattctccattgtcaacggtggtatcagggctctgggctacccaggatcaaatcccagattcgctcagccctcgccacctttggtaagttatttgatctccatgtactttagttttctcatccataaaatacaataataataacatggtacctagcttgtgcagtggtgatgaagattcaatgagataggtgtaaaatgctcatggtacccagtgatattataataacgcacagtaggatattcttatctacgataatcagagatcctattcatgttgcatccatggcaacctgctgccaccagcacgccatcagcttatcttattaagttgcctattttgttcctcttcatttccacctttgtttgacacacagaacagggactcttccataaacaaaccttttaacttccccttacctccacacgcacaccattgccatcagtattgattgtggtgtccgctgttttcagggtaaaggaacatggggagacaaagaccccaacttgttagaactaacatctaaagcagaaagccagttctctcactttagccaccagaaacctgagaatacacagtaaaatctagcataaaactcaacttggggccaatctgacagaatatttttgagttaaaatttagggtttattgatgtggacactgaaaagtaatccaacctttctggaaaaccatttgacaaaatgcaatcatatttataaagggtccgtagtcttgagagttggtaattccatttggggaaattattcctacattaaaaaagataagttgtataaagatgtttaagtctgctgtttatgacagaaaaaacatgtggggaaatgaagaaacagctaccgttcactcagcagagtgctggtttatcagcaccaagggcagggaagcatgaaaaggcttccagaactgcattgaacttagcatggctgaagtccatggggtagggcagtgtattagtccattctcacactgctatagagaactgcccaatggccaggcacggtggctcatgtctgtaatcccagcactttgggaggctgaggcaggtggatcacttgatgtcaggagttccagaccagcctggccaacatggtgaaacccatctctactaaaaataccaaaaaaaaaaaaaaaaatatatatatatatatatatatatagagagagagagagagagagagagaggcaggcatggtggcaggtgcctataatcacagctactcaggaggctgaggctgaagaatcacttgaactagggaggcggaggttgcagtgagccgagatagtgccactgcactctagcgtgggcgacagagtgagactctgtcccaaaaaagaaaaaaagaactacccgacattgggtagtttataaaggaagaggtttaatcaactcacagttccgcatggctggggaggcctcaggaaccttacaatcatggtggaaggcacccttcacagggtgaaagaagagagaatgagtgccagcaggggaaatgccagacactttataaaaccatcagatctcaggagactcactatcacaagaacagcatgggggaaaccgtccccacgatctgaccacctccacctggtccccacccttgacatgtgggcattatggggattacaattcaagatgagatttcgggtggggacacagcaaaccatatcaggcggggggatcacagggcaggaaatgaataagaaatgaagctggagaggcaggcaggggccagatccattggtggaggaacccggacactgtcccataagaactgtgagactgccagaaggaaggaatgcagccaggctgcgatttgggggaagactgccctgggccgcccagagcctgatgtgaaaggagactggggaaaggagagaacagggaggcagggacagacagccagggtagcaaggagggccaggccagtgaataagagtggaatagcaacacagcggagagtcacaaccacatgaaatgtgggttgtgatcactggaaaaaatttaaagtaaagctgaagtaatgtaagttggatacaatattcattaattatttttctatgaagtttataaaagcctcataactataaatatacatatttatattttaaaatcctgggcttgacctctgcttgtcatctaagatagtgctacccaatatgtgatcagtggggaggggccaacatgtcatgagggaaaaccagaaaaagagaattagcctttaaaacctttaaatttatcagaaaacttgtatgactgttggaactaataagaaaaagctgaccgggtgtggtggctcacacctggaatcccagtgcttcgggaggccaagacagtaggattgcttgggcccaggagttaaagaccagcctgggcaacaagtgagaccccatctctaccaaaattaaacaaacaaacaaacaaaaccagtcaggcatggtggcatgcacctgtgcccagctactggggaagattgcttgagcccaggaagtcaaagtcaacaagtgagccgtgatggtgtcactgcaatctagcctgggcaacagagtgagaccttgtctgaaaaagaaaagaaaaagctaaggcttgtattccatgtctctttttgttccacttcattcttctagtaattcacttttatcatattatgtttatccgttggcaacaggttggaaatttaaacaaaaaccaggtttccctggtagatagtttgagaagtgctaactaaagacatcacattcctgctgggctttcagggcttggcagtgcacagagggcagcctgctccagctcacactctgtggcaatgtcacctatcctatcccgtgccctcaaatgggggctactgctccactgacacgctggttgggaaggtgagggcgctgcagctgaaacagctgtattacacaggagtacagccataactgaggaagatgcttctttaataaccacttatatgagtgtgtgtgtatatgtattgaacaaactgttcaacagatgggaaaacatggcctacacaagaaatggtgccactacatagccccagaactctttcctgaccaacacattcattttttgtcattttaaaatgcagtattaggtgaattcaatgagcctccttctatgtgtgctcggcaaaatgtgtggcttacataactagcacaaagagctggtataccttgtgatataatacacttcacagtatctcttccccagcgaccatgtatacacatttgcctgaagctctgcaagggcggagctcacacctgggttttgctccccaatgtgtgtgtgttcgtgtgaaccatctaccaggtgtcggggctggagactacgttcacgcaggaacactttccgtcacctgctgaacctgctacgtctctggaatgtactacacaacagtacagcagaagtggagatatttctggcctaagggaaaggggcactatttcagagctgcataaagatgaaatgggctgtctagggacagaggaagctgccttttcctgcgagtaggtagaggccgggcaaccatgtggcatgtggctgggcagtccagccccagagtggattgcttctgggcaaatgactcccagagtcttctcctaatccagggtctccaaattctgtgcgaaccccagacccactcaatattccaggactagggtctgtggcaggttacccttcctgaacaaatggccactaacattccctgagtccacatggctgaaagttacacttcatggcaacaaactgtaaataaaatatgttccattttccttccttgaaaacaaatgtggtcacagtgacctggaaggccacattcaaatttaggattctcagctccctggagtccctcactggaatggacaaagaatggagagtgggaccaggcctcacctgaagacccaggccttacctgaaaaaaaggggcagaggaggggtcagaagcacaccaagcaaactcacttcactgttctctgacctgatggtttttgtgttggtccctgctgtgttgctctcagggaatacctgagactgtgtaatgtataaagaaaagaggtttacttagctcatggttctgcaggctgtacaagcacgcaccagctctgctcggcttctggtgtggcctcaggaagcttctactcatggtggaaggtgaagggggagcaggcgtgtcacatggcaagagaaagagcgagagaggaggaggtgccaggctcctttaaccaaccagctcttctgtgaactcatagagtaagaactcaactcactactgcaagaacagcacccagccgttcatgagggatctacccccttgacccaaacatctcccaccaggcctccctgcaacactggggatcacatttgaacatgacatttggaggggacaaacatccaaactacaccagctttaaactaacaaacttgatcaatggtactgctttgcctcccacctccccaccccctaaatcctgctgtggttctatgtaaaatttcaaaatttgtgtagacacaaacaaaatgcttcaaagtaagaaaggtacaagtaatttccactaaaaagaaacccccgaggctgggcgcggtggctcacgcctgtaatcccagcactttgggaggccaaggcgggaggatcaggaggtcaggagaatcgagaccatccaggctaacatggtgaaaccctatctctattaaaaatacaaaaaattagccgagcgtggggggcacatgcctgtagtcccagctactcgggagactctggaatgtactacacaacactgcagcagaagtggaaatatttctggcctaagggaaaggggcaggagaattgcttgaacccaggaggcggaggttgcagtgagccgagatcaagccactgcaccccagcctggaagacagagtgagactccatctcaaaaaaaaaaaaaaaagaaagaaactcctgaatacttcgaaagttgagaacacaagctctaagaggcatacttctgttagaaaaaaaatatttcaccactcatgctaatctgaaatctattttcaaattcagaacttcggtctagttactgactgggaaggtgccaaggttctacctacacctaagaagtccctagcagcacgggcgccactggaatttcccacttgtcgctgctgttgatgcaaggaaatcgcaacataagaggaaaatggggttggagccacgaggcttgcttttgccacttatcttccagagttcattctgctacatggacagaagataactggagtgaaatagatatttccctatgttccttctgcatttggttggtcaatgtcaaagtaaggaccaaattccatctgatagctaagcgcacagaaggggctcggctctgggagcagtgagggtgttggcggatctgtatggcaatactcttaagacagcttccaccaggatgtgagcctcctgcttgggacctctgccccagctttcatagcatgccatggtccctttagaaggaagcccgaagtgcacattgaaagctgacctctgcttcattcagcactgcagctgcctggggccacttccactgacctcatcagcccctacaatcggaattcagccttgaaatctagacacttttttgtgctcatgttagaaaaaggaactaaaagtgctctacctttgatgcaaatctcccccctgcctcccacaaatccaacacaggaccttgctatatataattagatgagctggcaagagcttgacctcaaatgtttttttaacttttcagttaactttgagaatttggttttccaacttcacaatgaagtgagcttgtaactttgagtctagaaagtgtgtttgttggcgagatggcagcgatgcccggagtcacggtgtgtttgtgccaccttggttccctgtgtttacagcagaatgagctcttagagggctctccttacatccactggaggaattgcatgctaatcatacgtgaaggaggtctttaagaagaaaggagccttgcttctctgaggaatcatactcatgaattgctggggcagaaccagcaggcagcgtgcacttgggcctgctttccagtagctctgagaaggcccagagccatttcaagtctgatttcatttcatcccttttttcttcaatgtcttcctttctgcaagatctttcttagtgtattagtctgttttcacgttgctgataaagatatacccaagactgggaagaaaaagaagtttaattggacttacagttccacatggctggggaggcctcagaatcatggtgagagacaaaaggtgcttcttacatggcggcggcaaaggaaaatgaggaagaaacaaaagtgaaacctctgataaacccatcagatcttgtgagacttattcactaccatgagaaaagcatgggggacaccgcccccaggattcaaatgatctcccaccaggtccctcccacaacatgtgggaattatgggagtacaattcaataggagatttgagtggggacaaagagccaaaccatatcacttagtgtgtaaattttagagtagcctctgagcagtattatttagtcacactataggttgcataggtttctgtgggcttgagaatacagtattgtctctgtggaaaatgccttccagcactaaacagcaagtgcagagagagaatttttttagactatagcttatttttgaagttggaagaattgctatataggaatcaccataaatcctaaaagactgggcctcaaataagagcttttttcttttatctcaaaataatttaatacaaatactaacaaacgcacctttcttccatggtgatgttttatgtgttaccatatcctagattagaaacccacttatgatagcatctatgagctcagacagaaaggcagggcctgtccttcctccacctgcctaccctggagtcactgccagaggctaaggtggagaaatcactgtggcagagctttcaggatggagtgcctgatgggatacaggggaggaacaactggagagaaaaggaaggaaaaggaaggaaaaagcgactcacaatttaagcacatcctgtgtgccagcaactgtgctaggtgtttatatatatcatcttaaatttcttatcttggctctgaggtaggtgttatttacattttacagatgaggaaataatctcatgtcataatctcaaacaataaagaattcaagactttgcccagggacactgattaattccttcccggatccagtctttgaatgcagagaccacagggctcacaagatccactcaaggggcttcgggtggggtttggtagaggcaaaggggctggaggaagggaggtgaaggtagtggtgggcctgcccatggcttcttctggaagctggtggcacagcccaactacagactaaagttgaaggacagacgggagggcccaggcccaagctccctggggtagctgaaggaccctaaatccctatataaatgcagtgttcaataagtgtagtaactgtagagattttttttaaaaaccatccagtctagaaaattctagatagtgaaaaagggcctttcctttctaaagatgtagaggttaaaaactgttataggtaaaatatgatctggagaaaataagagaactagacaagtaagggaataataattaagaaaaaagaaagaaggagctttttaagcacaaggattctcaaaaagactagagtgatttgcttctgcatatagctttcgttacttaccagtggtgtaagaggtctggtaaatatggaaaaaacatcctaagaacaggatgtaaatgacaacctcttaggcaatatgagttaagattataaagcagcatgactgacgtcttgaattagtggtctaccactgaaacacgtggagcatgttttccacatatccatgctgagtggctcaaaactctttttgccttcatctagaacacttttttctgctgatacatctctgtcttgtgatgatagtggactcttttttttttttttttggaacactcaaaaccaaaatatgatacatgaagtgcacaatcaacccagtaacactacgataaaccaaaaatagaatgtgaccagaatccacatctaattttctcaagtgaacttgctccaaatacaatttaaaagagctacaaactgcttttagcacagtgctagaatatcctttttttatagaaatttacatgacttaggataaaatatattttttaaaaaattctttccccaatcattgactcaagcaagttgcaaactttaacaaaaattcacaaaaattaaccatgatgaagaagagtaaaaaggatctgttcttagaggggagttcctttataaacaaatgaaacatgtggccaggtgtggtggctcaaccctgtaatcccagcactttgggaggccgaggcaggcagatcacctgaagtcgggagttcgagaccagcctgaccaacatggagaaacctcatctctactaaaaatacaaaattagccgggcatggtgatgcatgcctataatcccagctactcgagaggctgaggcaggagaatcacttgaacccgggaggcggaggttgtggtgagccgagatcgtaccattgcactccagcctgggcaacaagagcgaaactccatctccaaaaataaataaatacataaataaaataaatgtaacatgtttaaatttgtcacattatttagttttctgacatacttgcaaaattatcctgaaaaaaagttaccacttaaaatcaattaaatacattttacaaaatttaaacttgtatctacctcttcaacagaagtattgtgttaaaatattaatgtatttttaattaaagagagcaaatttccctaacagtgtcaatcagtttgttttaaattagaactgtacacagaatacagataaaattttttttgagacagggtctcactctgttgccccagctggggtgcagtggtacaaacatggctcactgtagtgttacttcccaggctcgggtgatcctcccacctcagcctcctgagtagctgggactacaggtgtgtgccaccatgcctggctaattttttgtgaatatggggtttcagcatgttgctcaggctggtctcgaactcctgggctcaagcaaccctctcgcctcggcctcccaaagtgctgggattacaggtgtgagccactgtgcctgccagataaaaatttttaatgatattaaaaccatttagacaatttacttattgttgtaaattacaacaaatgcttttacttgcatgcctatcaaagacctaatttaatcaccactagtgtaattggtttaccaagaaactgtggaaaatgatcatcctatttcaagaagagctcccttttatcattaaggagacacagtacccagttgttccaaagacggtaggatggaaaatctgcagaattcaccttcaccttctctgaagcaaacacagaaaatcagtgggaccagaatacaaacagttaacccactatggcccagggatttcgcaagaggtcaaggtaaaaagtcctcgaattaaaaattccaggagatggctccctctgcccaatgaggactaggttgtccgagggctggactcatccacatgccttttgggtcccggacccactgcttctccagtggcaggcagaagatcacagaatactggaggcgcctgtagctccgacaccatgtgccctctttctggctcagttccattaactgtaaaataagggacatcctggggctggtggaggtggcacagggggtgactaggagctaatcagggggccccagggtggacccctacttcatgaggggctgctccactttgctgttttatgtgttggagttcagtgaaagaattcacttataaagatctgacattcagaacaacaacaacaaaataaaatgaaactgtttcaaaaccactgagcttgaccatctctaaggtttcttccagtctcaacattctaaagtccatgaaaaagggtgaatttggctgtattagtccggtctcacactgctacaaagaactacccaagactgggtaatttatgaagaaaagaggttgaatggactcacggttccacaggctgtacaggaagcatggctggaaaggtctcaggaaatgtataatcatggcagaagggcaaaagagaagcaagcatgtcttcacatgacagcaggagagagacagtgaaaggggagatgctatacactcttaaacaaccagatctcaaaagaactcattatcacaagaatagcaaggggggaatctacccccatgatccagtcacctcccaccaggcccaacactggggattacaattcaacatgagatttggatggggacacagagccaaaccatatccttggcttatctggactctcctcctagatccaagcaaatgtcagctaaaaattctgcatgcaagatgaaattattctcttgggtgaaatgttggttttacaacagtgatcaaaggatgctttttgaaaactgacttgatgtaaatggatagatttttagcagagaccattctgggaccaaaagttcccaacatcctttttttctcggttcttcttgggacacattttggcatggtaatggtgaatggggcagggagacacagacagactaagtcacaaacatggaaaaaggattatttagctaatcttttgtattaaccatcactgatggaaatattttgccttcactgagttccctcatcaatgtcctgttaccatgcttgccttgccaaatttcaaccctgctcctgctcataggttccaataatcgaacattacaaaaccaggccaactggtcccactacaaatgcagataggtcttcaaggctctgggtcaaactgccagtcaccacttttttcctctgtacatgtttcacaccttcttatgaccccaagtcttcagtctaagtaggtgacctcaacttccactttataaaactagcaaggccaagtgactcgagttcactgctcccctgtgtgctacaacatgttcctgcatctggactctttcttggtcctttctctggtatgtcaataaggagcattcctcttcctcccaaagataatgccatcttttgttccctcaattctgcatcttcctgcctcctccaaggccttgcttcattttataatcatgcctacttgtaatttttgttgtcgctgttacaatatacattgcttttctaattagaaaaccgtcaaaattatacgtgtcatgaaaacatataaaggaggaaaatataagacatacagagttcctatttaggaggcccagcattactaggaggcccagaaagaacagaaatcaaagggcagagcttaaggaacgctacaaaaatcctcaggttctaaagaagatgaattttccaatggaagggactcaccaaatgaagcctactatgaatacagacccatgtgaagacacatccacaaagcatttcagaatatccaagacaaagaaggatgtttcaagagagacaaaaaatcagtcatttgcaagggagtggaagttggactgacatcagtctttgcatcagctaaattggacactataagccaatgagctttcctagaagttctgagaaacaatgtccactggagaagtctacctgcagataagctatcaatcaagcgtgagggtgagatactacgtatattttcaagaaatcagacaactgacttttcattctcttttctaggggagaaaatataaatgtagtccagcaaaatgatggcataaaccataaaggagaaagacatgagatttaggatgcactagacccaacttagggacagagcgaagaagagcccccagaaggtagatcagcctcaggtcctgggaaaagccagtccagaataggaaacgtgaataatagaatgtttgtcataactgagaagatacaagaacttgaggatctgataaagcacacaatgcgtcaaaaaaagataatacaaactctaagaaaaataaaaatgccattcaagaaagtcagatccaaatatgaagtaaaacgtgacatgaaatgattttcagcagttgtttgagtgtaaacacggagtgtctgtctgcttccgcggctgagcacgttctcctcgggtgcctcccgcgtcagaagctagacctactcagaaggaacgtaatcctcaccagctgcttagctggcatcgaagaacatttttatagctgtattagcataaaccgtactgacaacttttcaggttttagcgtcaaattatgaataaaacatggacaatggttacggcatcaagtgttaatcacctaaatgtcaacgcatggctgatggaggcagaactgcacgggcagatgggaatcaagaagaaatgggaggaaactcacaactgcaaaatgtgagggcatctgctaaaactagttcatctacatcaaatgtttgcgaacagcacccgtgggtcactctctaccacatctggtcctggggtttctcagaggatgtggtcaggagcctctgtctgcacagctacctggcctttcttcaggatccgagcctgcacagtgtgcatcacagggctccatgggagcacaaacacagttcaccttctccccatctggagcggctatgctcatttgctagtagcagcatttcccacttccctcctttcctccttctcttcctccttccctcttgcctctcctacttactgagcttctagcgtatgccaagcactatggctgagacggtcttattctcaaggcgagcccactgaaaggaggtcaaacctacagcccggagaattgatgactaggggtgagaaagaagcttatgcaaagttaaagtgttttttatttcatttagatgtatatttttagagacaagctctcactctgtcacccaggttggagtgcagtgttacgatcatggctcactgcagcctcaacctcccgggctcaaacaatctgcccacctcagcctcccaagcaactggggttacaggtgtgtgccaccgtgccaggtgaaagtgtttttcaaaaggcatttaacataggaagattggtgactggacttcctaagcgcagttccattaacagcaacgacacgtgcaaaatgagctcctgtagctgaacctcagaagaagagacgagacagcggtgtgttaagggaccactagtgaccccaaaaggtgtcatttaatcctcaggacagccctgaggtaggcattattttacaaatgaggaaataaactcaaagaatttggacaggcccaacttaggtctgtctagcactagagtctgggttccttccatcacactgcatgggatccttaactctgagtgagccagggtcctgtggaattctccaaaactgctgtgccctataatatggtgactggaggggaagaaatgcaggaaagcttgtggaaaatttttattcatacccaacagctcaacaatgtagtttaccttagatgatccctaaggaaccacccagtgacatcattctctgattccataattgtccaacaagttcctccttctatttcccaataaaagcacagggttttgcattacctttgtcagataagtgcaataaacaagtcacagagctctgcaggttcgtacctgcaccacccctctctggaggctgtgtcctctacccgagctgttcttttctggcaataagagttggggcccctccaacggcagggatctggacagcttccagaggaacccaggacaagagaaaaagagccccagggacactgtccaactcggacacaaacccaagtgtggggtgggtggctgtgacacgttccaggcttgatggtatttttccctttactttaaatcagtctttgattgtcttgtgtgcacacaggaagaatgatgaatattaaaaataaaacgcaaatcagccagcaagtagtctttagaagaaataagtcacaggaggttgaaaacaatgtactagcactggagaagtctgaacattttggtcaatgtctgtgaatgtttcaaagtttaaactggatggagtttactgagactctaatcaccgctcagcaagaaatctatgctaatcacatcaatattataacacaaacaagcaggtggaagaaaatccaaagatagctaatggataatactttgtctttggttcaattataggacttggtttctaaaggagctgctaactcattcattcactcatcaaacatgtattgatcacatataacatggcaatgactgtgctaggagctggcaatactaaaattgtttcttcattccagaacatcagagattagttgggaacagagtcaccctctactgagaaaaggccatcagaaggccggcaggggtcagctccatggagaagaggtctggggcatcccaggcggaggcaactgcagtttccatcctacggtgccctgtgtcctgggaacctcaggtagttgagcaccactgcactaatgagctgagtgagggagaagcaagagctgagacacaacagggtccaaatgagaggccttattcacaaagtaaggattttgaacattaccttatgaacaacagataagtactgaagagtatctagaaacaggatagtgagatgatgacatacataggtttttagaaaaatcgcttgggccagtcatggtggcacgtgcctataatcccagcactttgagaggtggaggtgggtggatcctttgagcccaggagtttgagatcagcctgggcaacatggtgaaaccctgtctctacaaaaaaatacaaaaattggtcaggcatggtggtgtgcgcctgtagtcccagctacttgggaggctgaggtgggaggatcacttgagtccaggtggtagaggctacagtgagctgtgatcatgccactgcattccagcctgagtgacagagccagaccctgtctcaaaaacaaacaaacaaacaaacaaaagatcactcagggagcactagagggccactgaagagtgccggagaggaatcagaataccaggtaggagctgctgcgtactccaggcaggagtgttacatgaaagtgactgaaccaaggcagttatcctgagcacgggagagtggaagcaggctgaaacatcactgcttaggtgtgaaatctataaaacctttggctaatatgtaggagtgagagggaaggtgccaacaatatctccccactttctagcacaaacagtggagtggatgggagaggacaaaagaggggcagcaagttcaggaacagatcaaggctcagcttcggacacagtgtgaaaagtctgcggcatgaccgaggggacagcctgctggaaagtcagacagccaggtctggagccctgcagaggggtgtggactgtcagcccactgactattagaagtacagggaccaataagatgaggaaactgagggcaccaaggtcacacagtccagaggacaaccagcatgaaggccacatgcaaaaacacaaaagagcaagaggtgcgttagggaatgtaagatcttatattctccttgaccctcgtatctctgagagcttaccttatgattcttctcccctcacctgcaaatatatagcttgagtagcagatgaggcaggacatcataacgccctccatattaaatgagttccgtgaatagacaggatccagaaaataaacccatctgtttgatgcagaactaagaacattagattgagaaacttgaggtctcctgctgtaagcagccatcagccagcatcagccagatcccctaggaatctgcatcagaacaaactacctattcttatcatctctccactgggcctggtcatctgtgagcagggttcccaggcaggtgattgtcacagggcggcagatcagaacagacagactagttccagaccagggtcaattcctggtgtctgctctggtcttggtggccccactctgggccctgggggaatggacctgcccagggaggaagagaggctttgcagatggccctttgctaagggctctggaagaatctcctgaactttgtgggttctctaagacacccgccctgacaagagtgcctttccaagagtgcagggcatgttaccaagtgttaccagaagtggtctcggttgctctaaatacagcgcccaacagagtgggtcctcctggccactcggttgggctgtggtcacaccatgcctgggaagagcgtagctgggtttcccatcccgactccaacagtgacagatttgtgtgactccaggcaaggtcatctaccctttgggcccctggttcctcacctgaataacaacacatacaacaaacagacaaacaaaaacaagccaacaaaaaaaaggacttgcatccagtgattctcaaatgtggggtccctcaaaggtttttaggccagttgtttaggaactgcttggaagagttgttaaaaatgcgatgttatggccgggcgcggtggctcatgcctgtaatcctagcaccttgggaggctgaggtgggcagatcacttgagctcaggagtatgagaccaacctgggcaacatggcaaaacctagtttctaccaaaaatacaaaaaattagccaggtacggtggtgcatgcctgtagtcccagctacttgggaggctggaggctggggtgagaagatcacttgggcctggtaggcagaggctgcagtgagctgagattgcgccactgcactccagcctgggtgacacagcgagagtcccaccccccaaaaatgcaatgttaaagataaagggtccagatctttgaccccaggccttgggtagcaccagggcatctgaatttttaataagctctataggtgattctgataaacagctagatttgggacccactggactaaatgattactaagctgccttccatctctagcaatgtatgactcaatgcatgtatgtgacaaatgttcatgaccaattcaacaaccaggtcccaaaacctaacctagtacagttgcatcactcagacattacttatgcttgctaatgaatcactcttaggctttatagaaaatagagtaaaatgaattattcgagagtctcaaaatagaccccagtctcccatttccttcaaattacattttctaaaactgaaacacagtaccagccacaacccagtcctcagaagaggagagcgacaggttggcaggtccagagccatgagccaggccactggtttgcagttgtgaccttgagcagaagaatatttttttctttaaaattgcctttccactctgtaaaatagaaataaccactgctaacctatctcctagggctgctgagaatccacagggaaattactatccgtctgattctcccactaacacccggtgtcagagaacagaggggaaagtgtcacagtgcattactttcagacccaccgtgtctgcacaaatatttcaatggttcaaaataaaaaagagcccaaccaaggattcccagtgagaatggaagaggccctgtttgatttactttcctgggaagtcaagcccagctttagagcatcaggaaccatcttatctacccccgggtatgctagagacagaggccggcctgcacagcctggtcagcagttgcaactttctttagctaaacctgctggcattcaggcctgatagtaggcagggtcagcgcaaatggaaagaatgacagtgtgtccttccaccttcctgaggccctggctgatatggaaactggctggcacgggtggccatggaaagtatgaatccaggcttgcctagggttgaatgagtgaggaatgatcagatcaggcctgtgttaaaatatcaccacagctcacttgcccggctattatccagtcacgtcctccgggtttcaggaatgagatgctgcaacccgaagcagctggagacagtgtttgcaaaagcaggccaggcaggctccttggagctgaagctgggtggagagatgggtgtggtgactgcctgcacagacagacacctgtgaagggctgacttggctcccggatgctttctctacagttcctcacctttgtgcatggctcaccatgatctccgccccactctatagatgaaggaatccttcctagagaggtcaagtgtctggctggtgcttgcacgaagaagggacccaaatccaggaccctgtgatatccctcctggccttgcaaactttctagcacctggctgtctcgtgcacctacgtatgcacatggatgctgtaaatcaaggcaaagcacaggcaggcaggcaacacaggggaggtctatggaaaaggaggggtgagaaggaagaagagagttttaggccaaaagctcaaaaatgttctttagacaagcactaggagaaccacccagaagtcacgagtcgggagttctaagtccttgtggagatggacccaccgttgtctcagagatgccttagtctctacagggaaaaccactgaaaatgccttctagactggaaagtctaaataactaaaatgttttcacttctctaataacttttttttttaaggtcttagaatggaaagatccctattccaacgtcccaaccaaatcaagatgctgtttctagggtccaatccctattccaacatcccagccaaatcaagacgctgtttgtagggtccaaactgcctctgcttaggcagttctcagactgggtagagaaaggaagactacaagttaaggagtattcaaaaacaaaacaaaatgagtatctcagagagctgaaaaatgaattgctgttgcccccaaagaccctttcagtctgaggaagtattattcatgcccctctgccctcatacctgaaaagccccctcaaatcaaagatgaggaataagaggaagaagaaggaggaggaggaaacagaataaatcccctgctccacgtctctggttatggcagtcaagcaagcctaaaagaaaaacagccatcattcccagggtcaatgccagtgtatatgaggaaaaaaaatcactaaaaatgtaaagcctccattgcctacaggccctaaaaatattacacactatcagggcactttgcatgaaagttttaataccgttattcatgaaaaaaatctttgaaaaaaaggcagcccaggaagtggctggcctacatgtggaccaaaaggcaggctgagaagcgtgtctcccacgggctctacagtactcttgcaaagcaactgcctctccatttaggtcgcagaattggggactagccttgttagtgacctcccaactctaaatttgctatcaaaatgccaacagggccgatctctttcaagccagacgagtcatctacccttgtgggtagcttctcaactcatcatccaaggcaaggtgtattctgggcacgaggtaggggaagatgcaagtttctcccgggggttgctttggacctaaagaggggtctatgctcattaccaaaggcagtctgcccagcataacctttgacaccacggactcacttgagccacagaatgtcatttatcaatttaatacatattcatgaagcaagtgctattcttaggtactaagaacttccaagctcctaaggtactgggcacctagtggtaaatgagacaaaagccttcgtgaagctgacgttctagcaaacacagacaacaggcaattatataccctgatgttggggagtgaccagtgctatgaagacactttgaggacagatggtctggggtggggggaatggtgcgctcgcttagctaggggctcgggaagacatttctgaggaaggagcatctgggcagcgacctgggaggagtgagggagtaagccatgtgggtatctgggggaagaaccttccgggaattccaggctttgaggaagggaccacacttggcacatgggagcagtagcagcaaggccagagtagcccagctgtggtattggagacgcgaggaggagctgaatctggagagggcagagcgggccacgtcctcacatgcccaggcaagcatctggagcccgcgctaaatgtgctcagaggactcagagcaagagagtggccaggtttgattcatgttttcaaaacaccactggctgctccattgagaggcagagctccagagtgacaagagggaagcaagaatggggaggcttccgcgataacacaggcaggggaggacactggtttagacaggggtgagagagggagggtaaaaagcagaggagcccagaacatcatctgaagaggcacccaggactggctgctgggttggctgtgcggtgtggagatggaggctgatgccattctaaagagtgtcagagagagagagagagcctcttgctggttgttttaggaacaacagtgttggctaataaattcctgcagacactctgaatataactgagagagctcagctggctctaacagcattatggactgaactatgttcatgtccttcactccccacaagtttatgtgttgaagccctaaccatcagtaccgtagaactggactacacagttggcgatagggcctttttttttttttttttttgagacagtttcactcttgtcgcccaggctagagtgcagtggtgcaatctcagctcactgcaacctctgcctcctgggttcagcgattctccttcctcagcctcccaagtagctgggattacagttaggtgccaccatgcctggctaattttgtatttttagtagagacagggtttcaccatgttggtcaggctggtctcaaacgcctggcctcaggtgatccacccacctcagctggagatagggcctttaaagaggcaattaagttaaaatgaggtcatgagggtggggccccaatctaatctgatcggtgtctttgtaagaggagagaatgtggacacataaagggacactaggcatgtgcgtgcacagagggaagaccatgtgaggacacagggagaaggcagccgtctacaagccaaggagagaggcctcaggaggagccaaagctgccggcaccatgatctcggacttccagcctccagaactgtgagagaaaaaaggtctgtcgtttaagcccccaatctgtggtattatgttagagctgccctagcacactgatagagatagcctcaattttgctttgaattgctatgagttgacaaagttaaccacaagttagagaccccatgaccatatcagccactgcagagacctgaaggctgaccactgaaaaaactacaccctcctatatcacacacacacacatacacacacacacaatttattattacacacacatacacacatatttgttattgattataatcataaagtctaactatgagtttctgtttactcccaattaacttggaacaacttttctttgagcctcctcctgaatggaataagggaatggttgttcctgctcctacttggattcctgaagataggactggccaaggacagcctggaacaatcacagcctgctgctgtcatcgtgcaacaatttgttgcctgtattctagacgcagaaaaatctcacagcttatttcaagtaatctctattaatatccctccctggccctcaaaagatattaagaatccaaagggaaatcagaaactcaattgtgctagaaatagccaaactgtctcattcagaatgcattcaccaaacaacttcaaagcaaaatgatgatgaaaaataagccttccaacaccagagtatttctctttttgaatgtttctaccacatctaagaaaacagatgtcaccatggttaaaaaaaaaattgtaccttgcaaaaataaaacttcataatgatagttcgttcttgtgaataaatcctcaaatacatccctcttgcaaaaaaggttttctcttactgaccactcttcttccatcactgactgcagtggaaaattacattccactgtgaaatataatcctgttgatagtaacacctattgaggttttcatcaaattgctagatgagatggtgtaattagggacagccagggggaaaactacaaaggacacagaggacgtcagtccaaaggaggtaaaaactgaaaagataataccttcctcaaaccattgcagaagcgtgtacctgcttgcctggtgacaaagtctttttgaaaatcaacctgtacccataattctgctttctgactttcaccagaggattcataagagcatcctgaatccaaataacaaaattaaatatacactaaccacccgtccttaatcgcttcatgtaaatctgtggcattagaaactgaaaacaaaaattatctgagggtcatgttttgctatgcatttaatggatattacttctgcctgctccaagggcaatgttcagtttccacaaacagtgtagtttattatgaaaaataatttataaatcattcttgtttaaaacaaaatttttttaggagaattagtaacagaatttcaaaaaagttgaataatttctaaagattaagatttcaacttcactcttttaatgtatttaaggtaataatcacttactttggtgattatttataacattaacagctctaagaggcctttaagggccattttgttatacaaaaaagaaacacatttataagcattcttagaataatgctaatgtcattagctacagaagcagcacatgctaagatatcagctttaattttaaattcatattagaccttaataaaataagtcaaggatgcattttgtaatatctagaataaccactaaaagaacagtaatgtctaacaggcaagttagtagagggggaaaatgaaacaatttttaaaaatacataattcaggccaggcgcagtggctcacacctgtaatcccagcactttcggaggccgaggtgggcggatcacaaggtcaggagatcaagaccatcctggctaacacggtgaaatcccgtctccactaaaaacacaaaaaattagccgggcatggtggcgggcacctgtagtcccagctactcgggaggctgaggcaggagaatggtgtgaacccaggaggcggagcttgcagtgagccgagattgtgccactgcactccagcctgggtgacagagcgagactccatctcaaaaaaaaaaaaaaaaaaaaaacataattcaaaggaagataagaaagaaaaggaatatagaacaagtagaacaaacagaaaacaaacagtaagatgacaggaaatagaaggatggaaaaatgtgctataaaaatactaaccaaacaagagctggcacatcatgcaaaatagactttaagacaagaagcattactagcaaaaaagatggacatttaataataaaaaagggtcaatttgccaggctgatacaacaatcctaaatctgtatatatccaataatatagcctcaaatctatatgaaggaaaagctagcaggacaaaaaggagaaatcagcaaatccaaatcatggtgggaaattttaacacacttctctcagccactgataagaatagacgaaattcagtaaggccatagatgacataaacaatacgaataacaaacttaacccaactgtctatatacgttgttgttacatgactgcatctatatatgttgttgttaagaaggcatattttttcaagtgcacatgaaacacttatcaaaaccgacttactgttgagctacaaagcaagtctgaaaaaatgtcaaaggactgagagtgttttctgatcacataatggaattactctaggaatcaataacattaaaaaaaaaaccccaaatgtttatgaacaaagtgatacatttctaaacaatctacagatcaatgaagaaattatactggaaatcagaaaatatcctgaattggaaaataataaggatatgacatatcaaaacttgtaagatgcagcaaaagccatacttagaggtaaatttctagtcttatgtgaatatatgggataagaagactaaaaattaatgatttacatattgatcttaaaaagcaagaaaacagaacaagagattaaagaaagtagaaggagaaaaggacaggcgcagtggctcacacctgtaaccccagcactttgggaggccgagatgggtggatcacttaagatcaggagttcatgaccagcctggccaacatggcgaaaccctgtctctactaaaaatacaaaaaattagccaggcatggtggcaggctcctgtattccaagctacttgggaggctgaggcaggagaattgcttgaacccaggagacagaggttgcagtgagttgagatcgcaccattgcactccagcctgagcaacaagagtgaaactccgtttaaaaaaataaaaaaaaaagtagaagaaaaaaagtggaaaacactgaaacagaaaacaaaaaaacagaaattaagtcaaatgttgacttttcaaaatattaatacatttaataaacctctgacaggactgatgaagaaaagagcacaaattgtcactaccaggattgaaaaaggaaacataactacaggtcctacagatattagaaagcctatataaatattatgccaatatatttaagattttaagtaaaatggactacttcctagaaaaatacaacttacaaaaatgacagaagagaaaatcaattggttctatatctatttataaaactgaatatttaattaaaaacattctcaaaagaaaactctacacccagatatctttatcagtgaaatctcccaaacacttaagaaataatatgaatcctacatcaactcttcaatacaggaaacaaaaggaggggccctttctacttattttatgcttttagcataaccttgatcctgaaacctgagaaaaatattataaaaaagaaaagtgatcagcctatatctttcatgaacataaacataaaattacaaaatgaaaataatagtaaaacaaagccagagtcataaaaaagaatactgtactataaccaaggaaaagtgaatatatatatgttaaaatacatgtaggagattgttactgcagcattatcataatactcccaactggaaaagtcaaatggaaatgtgatatattcacaccacagaatagaaacaacaataaaagtgaactactatgacatgtataatggttaattttatgtgtgaacttggctgggccatggtgcccagataccagatatatggacaaacattattctggatgtttctgtgcaggtgttttgagatgcgattaacatttagattagtgaactctgagtaaagtatattggcagggagctcatccaatcagttaaaggccttaacggaacaaaaagactagcctaccccaagaaagaaggaatctgcagcagaaatcctttacacttgaactgtaacatcagttcattcctgggtctccagcctgtcaacccaccctggagattttggacttgccagtcactataattgtatgagccaatttcttaaaacaaacttttccctatatacatatacatcctattggttctatttctctggagaacgctgtagtcaataagcatttcataaacataatgttgaacaaaagaaacaagacacaaatgatgaaaaacatgcttccacttatataaagttccagacaagcaaaactcctctatggtgatggaggtcagcatggtgggtaacttggtgggccatggtggtgactggtgagtaatagctggggagggacatgaaggatgcttccaggtgtgctggcattgttctatttcttgacctgatatgggtgtgtttattttgtaaaatttcagcaaggttttgatttgtgtatttttctgtatgtatgttatacttcaattagaaaagtatagctttttattgattatacctcatagccattaggatggctagtatcaaaaacagaaaataacaagagttggcaaggaggtagagaaatcagaactgttgtgcactattgatgaaaatgtaaaatggtgtagccactgtgcagaacggaatggcagctcctcaaaaaattgaaaatagaattaccacatgatccagcaattccacctctgtgtatgtatctaaaagaattgaaagcagggtcctgacgagatatgctcaatcatgtccacagcagcatccttcaaaatagccaagatggcagcaaccccagtgtagatcaatgggaaaatgaataaacaaaatgtagtccatccatacagtagaatattattcaaccttaaaaaggaaggaaattttgaaacatgtacaatatagatgaaccttcaggacattatgctaagtgaggtaagccagtcatgaaaaaacaaatacttagaaacctaaagtagtcaaattcatagacacagaaagtagaatggtggttgccaggggctgagggaagagaaaatggggagttgatgtttgacggatacagagtttcagttgtacaagatgaaaagtgttctggagatgtgctacacaacaatgtgaatatatttaatatttaatacctctgaactgtacatgtaaagatggtaaattttaagttatgtgcattttaccacaatttttaaaagtttagtaaagaaaaaaatcaaagcataataaagattgtattcatactttggatcatacaaaggatcaagaagaacatatttaattgtagatccattaaatggggtctcccactgcttttcattaggcttcagttgtgaaaaagctttgtggatagcaaagtgctaaaactggaaggctttttaaactctgatcttactactatctttacaggattggtaattaaagttttaagaaggagatataggtaaaggatgctaattttcctggaaaaggacatgatcgttgaaaaaataagagaagatttagagcagttcagaagatgtggtggttaattgcgtgtgtcaaactggccccggtgtgtgcagactgagcattatctctggaagtacctgtgcgggtgtttctggatgagatcagcatttgaattggtggactctacaaggtagactgcccttcccaatgtgggtgggcatcatctaatctgctgggggcctgaagagaacaaaaggcaggagaacaaaaggggggagtctgcccccttttcctgcccgcctgcctgagctgggacagctcatctcatcttctcccaccctcgggctgggatttataccaccagctgccgtggttctcaggcctttggactagccagtctcaagtctccagcctgcagatggcagactgtgggacttctcagcctccataattatgtaagccacatcctcatgataaatttctttatatatctatatacacatctaccgctatgtctatcctattggttctgtttccctggagaaccctgattgatgcagaagactactgaatattcttcaatacccatttccctttgatcattaccttctgttcacactggcttcctgtgttagcacaccacagtctgtctgccagaggcccttgtgccaaccatttcctctgcctggaccttaccagagaggtccagaccacccccttctgagctgagtttaaaaatcatatcctcagagcggccctccagggcccatcagcacctcccattattgtttaccacagcccccatgtgcttaattccagcagcaatcgcaatctaataaactaaaaaaatagtatctgtctctcccatgaaaatgtgcactccacgagagcaaagatattgctttgttttcccctgggtccaggtacattgccagaacaattcaataaatatttgttgaatgaacaaatgaatacataaatgaatatataatgagcacacctcataggatactaactttattactctgatctagaaggtaataagaactggagacctacaggcaaaaaaactgtcctgaatttcctttctacactgcatctcctgaagtgagtgttttctccacattatcctgacatatattttttcatcctcctcccatcccagcacctgctcagcacctggtgcccttactgggtctgacattccaggatgctgtgctttttttacacagcatttccccctgctggggccagggactgagaaaggctgatctgtcagatccttgatggcccctgagtgcagggcttcaggatgagattacaagaggactagaagacaggcttcctatatctgagaagcgtggaatctcatggatacacacagctatgtcatagttgaaatattaagtttatctacagaattatagctgtatattggagtgctctgaatacttgatttggatggtctagaaatcctggggcacagcaatattttatgtcttcatctgggaggtcctaagaagggtttgcttatggaataaaagcccttatgatccgtgcacagcgaggcctctgtagtgttctgaagaagaaacctgacaggacacacaaaaattattttcctcgtggagggcatggaatcaagacagatccccgatccagtcctcactccctgaacactgcccagcttatgctaaatacgtatttatgcacctactatataccaggcacagttctaggagctgataatgtagccgtgaacaaaatgaaacccctgcccacatgctgtccacattctgataggaaaagatggacaatctgtaatcagtacaacacagtgtgccctctggacataagggaggggcacagagaaaaaaacaaagtaggctgaggacagaagagcaggggatggggtcaggtagccagggacagtttcctgcaaagtgaggagccaagacctaaccaaggtgagccatggctttctgggtgaaaactgctccaggagaaggcaagcatgggccctgggggggaacacgatgtattcaaacagcacggtggcagatgggaagggtccaaccagccacgctagggacaccttctatcctgtgggacatgagaaaccctggaggatcagaataaagtggaggaaaattaaagctgagctttgagtgcaactattttaagactaaatagagctcacattaagtctcttaaactgccactgggttctaattcgatgattaaatttatctagataaaggactctgagattctcgcatggtggatccatatgttgcgctaatacgtaaatgtccattattttacacaggtccagggaacctggccatcatctcgatgcaccaattctccctgccccacccaaattagaatgtaggtggtcacatagcaaactacaacatgaccgggatttcagctctaaaaagtgccatcaagacgtgttccccaacttgactgtggcagtcatttcttggtatccaccactgcagatcacatgcacacctcaaatacatgcagttcaatttgtcagtcatgccttaagaaagctggggggaaaggtgccaccaaatgaaataaagaagcgttcccctcccttgcaccctgccagcatttcagatctgtcttatcaaaactccctgtgcttgggcttagacagacgaaagaaaaatgatggggagccagaaaacctgagaaaactacgcaagtgcactccagtgtctgaatttccattctggaaaggaacgggcagcgctcagcctcacagcccacctgggcacctggcatcaaggccaccctctgccctggtctgcgtgcaatgccatgctgggctcagacacactcctggaacagcacagctctcatgagtccctgataatggcgtccgccacacgcccacacccttttggcactgtcttctgactgactgggctaaaaaaagcttcgataaaccccaaggatcagggctgggctgctgttcttctgaacataaacactggtcaggaggtgattacagttcaagcagaggggagcaaagtcccattttcccagcactaggattagatggcaaagtaatatcatgggcagtttttaccctcacaaatccctgacctccttccctgaggcccccttcccggagccgtctacatgcctgcctttactctacgccgggactccagtctataagaggataatcatttatgaataaacccatgatgatttacgttcccctcaaacgtgaacagaacccaatcatctgtttcttgtgttttccgattccaagaaaaaacatttcttggctgaggctgtcttgtttctggccagattttcctatatgatgtctatgttctctcgtgattaactcagagatatcaatctacaactacaggaaaacctcaatggctttacttaattggagcaccaggaggacatggtaaaggaccacagtgctggttcttctaagcgcatgtgggaactgaaggaaagaggatggggagctggactctgggtacccatgagggcttcagtacagaagacccatgaggacagtggttatgtgtcaatgcagtgcagtattaaaaattactatttgcctgcctttgctctgacatgagttaaatccttctcatctagattacaataacatttgaccctgagtttatatagactaggatcttttatgatgttcccaatcttgctttagttatggagaagctcattataaaatagtcttacaggaaaaacctgatcacagaggggaacactatagtgaagcaccaatacttttcatcaaaaatgttcaagtattggcaatttcatgtgtttcaacataatactactagccctcacccaaccacaggttacagagtgcctggagctgctagaataggcacaactgttctcaccatatgcaaggctcatcctcctccaaccttctcaatacatcattaccaattatcaaatcattacatctttatgaaaaagacttggcttatatgacacaggcagaagtgccaccctttcacaacattatgaaacgatgccaaataaggctagcacacctgccaccttttgcatttactgaagagctcttatgcatggacccacttggcctgtctcttagtcacagaagggggcatggggcagcctggctcggaacacctgtgcctgctgatagcagacgtgccagcctgccagagactgagaagctggacctcaaggtgttgggaggtcgggctgaggctgtggctgctgggccagctgatgcatggggaaaggatatgcatggtttccggagtaggaaaaaggtttaggaaataaacaagtggaaaaatatctggaaaatggaaccaggtacagtccctgccctcaaagagcaggtgctcagtctaaagaagtggtctatgcctgggtgcccactgctccagacagacttagaaattctataatacgtgtaagaaaaaaatcgttagtttccacttgttttttattctggggctggaggcgtggggcatggattcttaccctcttatttagcagtataggcaagtcattattttcagagttgttgcaaaacagaaaggggacaaaaatgttacatgatgatggattatattagaggagttcctgtcgtgacccttgagttagaaagcagatctgcgtaaaataaacaatctgagagctgaatgggcaaaggatatgaacagtcaattcacaggaggaaacagaaccagtaaacaagcacatggaaatatgtaataatctgtagtcagggacatagctgaaaaaaatgagaatgtttcacaaaagaagggtgggccgggcgcggtggctcatgcctgtaatcccagcactctgggaggccgaagtgggtggatcacggggtcaagagattgagaccatcctggccaacatggtgaaaccccacctctactaaaaatacaagcattagctgggtgtggtagcacatgcctgtactcccagttactccagaggttgggacaggagaatcgcttgaacccaggaggcggaggttgcattgagccaagatcgcgccactgcactccagcctggcaacagagggagactccatctcaaaacaagaacaacaacaacaacaaaacgaagggtggcaaggtacccatttaggggaccctcaggcccctaagtcagttacttgcatttgacagtcgtaatgtgaggagcactgaataaggcacagtccaggtgctcagaaataacaatgaccaatgggccaggtgcacagcagagatcagtgttaggagtcagacctgcaggtgttgcatcggaatcccaagcaggcactggcccccatacaaactcgccaggcctccgtgtcttcactgtaaaatggaatcgtaacaagcgcatacctcacagggatcctgggtggcaaacgaaatgggggaccagggtggacaggcagcatgggtagtggttaagaatgctaactctggaataagatggcctgggttcaaaccttgccccctcctccaacttagctgtgcaacatgggcaagttacttcacctccagatgcctcagtgactccatccataaaatggggacagtcatagtatctgcttcacagggtttatgtgaggatgaaatgcattcacacttctaggcagtgccatacttacagcagcacctggcactggacaaacactatggaaaacagtgcctgacacagaacaaatgcactaagagcatttccttacacacacacctggaaaccacttgctctagtaactgggcacagagtgggtgtggcataaatggtgggagaaattcatcatagcctcttcccatctgggggtgtgctgagatgctggaaaagagggtcatcaaaaaaggaggaaaaatcccttagctcttaagccctaagaaagtgcttcacagcttttccttgaccatgaaaaatacagaagcaacacccgcagaaagaatagaatcctagtaattttgtgttctgaatcaagctaagtttgacctttgagcaaattactggctctctgctaagagtgtacagacccatctattcatcatagacttcactgtctgggaatgagccccggagcccaggctctgcaggttgttgctgttacgtaagccagtgcaggagccgtgctgagaaaaggaaactgcgcaatctgctcaggttcccaggaaggccagggtccttgtcccacctgaggagctgacttctcaactggcagcagattcaggcatgcacactgccttcgccggccactggaagggcactgctcccaacacccactcacacgctgcctggatggctctgatgggggccactgggcaggccggacaggctgcctcaaggagctggggacctgtggtgtcagacaagctgaccaccccccggcaggggtgggacatacgtgtgaaaaggggagtctgggggtcccccacacagtccatctacgcagatgcaggccaagctccccagataagcctgcctcaaggattctggccgaggagcagagggggcccttcctggaggtcacctgcccttgaagcaggtagagaagacatcttagtgtggatcagtgctgacatctgtggagagtggactctcggcactttctgtctgtggactcacgtccccatccccggagccctgtgaggtggctattatgagccccatcctacaagtgggcaaactgaagcacccatgtccatgctaccagggagcagcagtgccaggaagaagctcaagtgcccggccttcttaacctctaagctccaacaggtgacctccagtataagcggaggccttcctgccctccagaaaaagccgagagtctctgtagcgtggttccctcctgcttcttttgaatgaacgactgggagggaaggctgaggagacccacaggggcccagggactgatgcagggaaccccctcactggggaaagagagaaagagttggctaaagtagaaaaaactcgaagtgcaagcagggctgtggctcctgcatgaccgagaaagcctccttgcccactggagcctcagctgagggccttctcgaaggctctgctttctatattctctccactccctgaccacggcaggctgggttctcgtaaggtttagagccgtctcagggacaggagcaacccccgctgccatgcagaagatgcagaaagtcttcttttagaagcactggaaaatacattcgaaccgggatgggcatttcctgatgatgttggaacaccaacacagtacctcagggtgctttccacctcgacaaagggccgaggactttgcctccctgcctttatcttgcgagaacctttgcactgtggagtgaaggagctcggctgaaaactcaacaactgcacagcccttggctggacccacactagggaaggtgtctgcgaggctcgggcctgctcactgtgctgtgcgttggtctgcacacactgggacttcggtgataacttacagaagggaaatgggaggggaggagtaaagaaggggttggacagtgacaccagcttgagacagagagtaagaatcctgggctcccagtctcagtttcgtcatgaacttgctgtgtgatgtgggcccaatctcagcatctctgggcacaatgagtggccaccagggcctttctagcattcatatcttacccttccatgaatgagcgaggaacccgtgcagcccagttctgcagctaccagccacatggggctatgtcaatgaaaattagcaaaagtaaacactcctcggtagtactagctacattttaagtgctcaataacatgacaatttaaatgaaaattaattaaaatgaaaaaaattaaaagttcagttcctcagtcatgtccaccacatttcaagcactcagtggccacaagtggccagtggttactgcagtggacagtgcggatacaggacactcccaccaccctagggagtcctccacagggcagcatcgagagtgtgcagatggagatgtggctcacagaacgttcgggaagctgcttctttaaagaagaattgtgtgtcagcttggagcctatgtaaaagtaatgaaagaaagctagatgtgtctgttggggtaactaggtctgtaacagggaaagtcatcaagatacctgaaggtgagataaaataccatattgccacacccaagctatggtcagtggtgaaagactagcgtgtttccataagatgagaatacccatctgctgcctctataatgttgaaatacaatttgaagtattataaacaagatggaaaaatcatcattatttgcaggtgatacgattttatacctagaaaatgcaaaagaatcaactattagaaatagtcaaaggctttagcacaggtggttggttacaaaattaatacacagaaacaataatcttctctatatagaggtaaaaataagtgtaatttaaaaatcccatttttaaataatttcttaaatttacataaaaatgttcatattgaagaatctaaaacataaatacaaattaaagaaatagatagggtctatataaagaaaacttccaccctgtactgagtagagaaaagatggcttacataagtagaataacaccacaggaacctaggatgtaaagacgtcaactctccctaagtaactataaacccaaagcaatctcactcaaaatattaacaggtttggatgttccattttcgttttcattcttgtaagggagtagaggacagtttgaaagtaacagtatacttctagagttcccaaagaagaagcagcaaatgatactagccaggaaaacaaatactggaaaaaaagaataggacaattcactgtattaattgttaaatcacgctaaaatgtaagatcacagtcatgaaaacagtagtatgaaactggcttagaaatgaacaaaaagatcaagagaagaatcctgatagaagagcatatttgatcatttaggtggtatttcaaatcttcaaagaaagagcactgcttagcaaacaacattggaacatcccacaggtaacatgcaaacgagaaaaccagaaatctaactcactcctcataccagaatgtccagtgaattaaaagcaaacatcaacaacaaaaatgtacaagttctagaagaaaacctactcctatacatcttggcctaggtatgaaacaacctcaggagaaaggaaggcaaaatttctgcatctgaactacaaataaaaataatacaaaattctatggagtaaaaacaccataaaatcaaatggcaaactggagaaaatatctgtaatatgtgcagtaaggtactaatttccttaataagcaaataacttacatattcctaagtacagacgataaactcaccagaaaagtagcgcaagatatacacaatcagtttatagaggaaaaaaagcaacaactgactaataagcatatggaagggtcagctttgttcctaattaaggaaaagcaaattcaaacaagatgatactattttacgtctatcagagatcctggcaatgattcaaaatgatttctaatccccagtactggtgagaatgtgggcagagaggaactcatgcgatgctgggggtaatacatcagtataaacagtttgcagagcaaactgacagtatctattaaaacgtaaagtaaccatacctcctggctcagaaattccacttctagcaatgtatcttacaaatacatttacataaggaaacaaagaatgctatttgcaacattatttataatagggaaaaaaacctggcaacaacctaaatgacaatcaataggaatagctggttgagttgtgttatgttctaatcatgaatcatcagggagtcatcaaaagaagtgcattaaattagctgggtgtggtggcaggtggctgtaatcccagttgctcaggaggctgaggcaggagaatcatttgaacccgggaggtggaggttgcagtgagccgagatcacgccactgcactccagcctgggcgacagagtgagactgtttcagaaaaaagaaatacattgagtctactgacaagatatccacaacatgttaaaaagccaagtagcaaaatatagtatgcaatctaatactacgtaatgtaaacatgcagatggtacctatttaagtgtatttatctttccaaacacaccacatatgtttatacatgtgtgtgaaagggtatacatacactcaacagaggctatccctaaagaagggttgagagaagatgggataccaactattactttgatagttaattacgcctctgtgatttgaggcgtaattaacaaagtgatagttggtcataaaaaaatcatctaacgaatgtgacaatctatagttggtgcctactatcagcaaacggtacttactatgagtcatgctcttcatgcatttctccccagtgccattaaatagcctcatgggcagcatgaccaataggtgtagacctattgcaactggtgggtaactttttgcttaagtcagcttgtaatggctgtgttgtgttctctggctagaagggtagataagggataagttaccctgaacctaaagcacgagaactggccccaacaaccaagagtccagatcacgctatgctaaagcccctcactccaatcttcagtcccctggtacctccctatgacacaggtggctcacagaaccatcactggggacagactgctgggtggcatgctgctgcagggctaagaatcgcgtttttaaaggttagttcatttaattaaaagcacagcagggtgctgcctactttcattaagaaaggtcatcttccccagcatattctaatggaaaccagggcagcattcagagataggaaccatcacaagttgattttgctctcttaaggtaagatacggcaaagaatgaccagccacctcctagcagggtgctgaggctggctggtgcagtaggtggagatttagcagatgacaatgtatttctgaaaaggtctgtttttcctctaaaaggcattctaggaaccagagagagaagggagaaaggaggggaaggggaagatcaggagagagggagggaaaggaaaggaggcgaggagacaggagaaaaacctcaccaccaagcattagcatttatttctcaattgcaatatttttattttaagttgtgctaagaagcctaggatttctttcttcaataataatgatttttatgctttatagttcatgaggctttcatattcattatgttgagatttattttcaaaaaagtgtttagagtcttaagttgtttgcaactttgtagcaaagctcatttcacattaaaacatccttttagcaaagtctcaacatactatagtgaaattaatacaggtttttctaagcatttataagtgttaataagccatgccagtctgctggcatagcatatatggtgctgcggtattctgaatattcagtatctaaatctgttcatttcatacacacatgcacgtgtgttcacaaacacacatgcatgcaggcacacaccactgcaaaatttttaagctgcaggaccccctggcctgaaaaaatgcacacagcttctgaaagtgcctaagttactcatgggaaaataaagcttattatttaatggacttaacaatattttcttgttcatgatgatgttttacttccactgatacacaaatatttattaagtgcctactatgtggcaggcactgtcccaggaacaggttaagcagctgcaagcaatgtagacactgtaatttctgcattttaataaaattgctaactcatactaaatacttactatgagcctgatattattgtaagccctctatttgtattatgtcttttcatcctcacaacacaaccccaggaggtaggagcttttataatcccacttgataaaccaggagacctaagtgcagagaagttaagttacttgcccaaggtcacacagctggttactggcagaactgggatttgaatccagaccaaccctccttactgctgtacattgatgtagtttaacaagaacaactctaaactaaggtgggtgtccatctataaagaaggtgaatgctaggctgggcacggtggctcacacctgtaatcccagcactttgggaggccaaggtgggcggatcacgaggtcaggagatcgagatcatcttggctaacacggtgaaaccccatctctactaaaaatacaaaaaattagccaggcgtggtggtgggcgcctgtagtcccagctacttgggaggctgaggcaggagaatggcgtgaacctgggaggcggagcttgcagtgagccgagatcgtgccactgcactccagcctgggcaacagagtgagactctgtctcaaaaaaaaaaaaaaaaaaaagaaggtgaatgctgtccacattcaggattcagagataacagtgatcacatgtgtaggtatagacaccttcacactcactgcactctcagctgagccatgaaaattactaagattaataagcagcaacaaaacctgcacctaaagaaaatagatgcacagaaaaataagcaaaaaattaaacattgacctaatataaaactggtaacaacatattcattgacattaaaacaagatccttcataaagactaaataaatattttctgagtatctcctgtccttgatacgatcacaaacgttaccatgctacatgcaattctcacagcatcctagtaagccaccatctagacctctttacagacacaaagctgaagatgctcagaatctcaggcacagccccgaaggcagccagctgggtccacttcattccaagccacaaatgcaacacagaatgctctgtgctgcctctgcataaccacccctttcactaaatgcaggaagtcacccccacaaccaacaagctctatacccgcaccccatttcaccctgtgtctagtttgaaagatacatcttgaatttagctattctagaaagagataccaatacaaatgaaccctgaatcactttccaaacacctgcaggtgtttccaggcagttcatgaactgtaacacagtgaatttttctgaagggtggtctgttttgaggggctgcacagcagttttactgattgcggaccagaccacctgagatctacaggttgggatgcatgtgagggaagctgtacaaattccccagaatcgtgactccagcccagaacactgtcactacttgactagagtggtggtaattctggaatcatccgggtgacctgcctaccagcaaaagcttttccttcttaatctactgagtaacctaatacctgaagccagctcagaaaattcccattatctctgaaataaaatgttttcatctgagttctctctctgtatttctttatgctgatattttcatatttcatattcttttcataataatgctgataatttcagtcatcttcaggaggagggtcattcctttcaaaagtctccccttcaggtgagcacgttcccctatttgtattctaaacaaagcgggcagcatctcccagcagcagggaataggtccactcaggaagcggctttctcacctgcacagtttctgctggagggagaggggtgtctctccacttgaaaggttcaattacacacttatctttataataatagcttctctgcagcacaaggcatgacttctcccttctgaaagtgcactttgcctttgatgcctgaaataaagtgtaagtcaaccagcaagctccactgcagcacacacatgaagttactgccccccggcggcgaccgctggtctttgaacagcattggacaggccctcggtgcaaagctctccggcccctccacaagctggagactgcttctccctacctgcggcctggggacagccttccctggcaatattaccgggttccagctggcttggactcccgaagtcccccggtttgtatgctccgggttcttttggatggcgctgggaaaggggagaacattattcgttggagaattaagtgggcagagtaaaaccagcaggctgcaagaaaaaaagacctgcttttgagttttgctagtatctattgagcacccttgaggaaatttcgtcacccttctcagcacgaatttctcactgaagagatgaaaggcacagccttggaagaaccttctggtcccaggacttcgagaaccccagagtcggatatccagttaccccgggattccacagtgcttattatttttataaagggtgaagaagtctccttcatctatgaaatggggaaataatagtatatatcttagaaggctgtaagaaggattcaaagagatgatgtacctaaaatatctggcacaagtggtaagtgctaagtaaataggagacctataattgattgtaagtataattgattgtaagtgctaagtgaatagaggacctataattataatttatcactcaagcttcagagtgggagagggtgctactaatgatttcacttggatgacaggcataagccaggatggacaaagtggatgagacatgtcaccttatcaatcaataattgccatcatgacatttggaaaagtcttcaatgttggcagatgttttgagaaacattttactcaagtgatctggccttgtgaggctatttttggcaaatcttcaagcagtaactggacagaatccgtcttggggtcacttcttttttctttttgagacacagctctgttgcccagactgaagtacagtggcacaaccttggctcattgcaacctccgcctcccgggttcaagcgattctcctgcctcagcctcccgagtagctaggattacaggcgcccaccactacgcccggctaatttttgtattttttaatagagatggggttttgccacgttggccaggctggtcttcaactcctgacctcaggtgatctgcccgcctcagcctcccaaagtgctgaaattacagggataagccacagcacccggccatcttggggtcatttaaatcatccctgacacaggggtcatctcagatcagtactgtatatgtttccaagaccaattaaagacacaaagtttaagtgactgaaatgtacctcctctctagccacatgctggacaaaacagggtacgggtgtaagccagagaagctgtgtggaagagaactagaatcacattgaagaaatgctctttttgagcagattcctacatggaaaactctgatttaccttatgagggtgtggggaatgacaggcaagtgggctgtgagttccgtgaagggagaggtggtgtttgtcattcaccaagatctgtctagagctgtgccctccttacactggggaagtgggctgccagcctggggccccacagctggttttgcaaccagcacagtgctcagaacagagatggcacccaaaaggtatttgttgaataaatgaatgaatgaatggattgatggagccaggattcaaatctgggtctgcctggtgccagtgtccaggcactgccttccacctgagcagcagggtgccacctgcctggcacgccatcggcatgcataaacatccattacatatatgtgatagttaatattaagtgtcaacttgattggattgaaagatgcaaagtattgttcctgaatgtgtctgtgagggtgttgccagaggagattaacatttgagtcagtggactgggaaaggcggacccaccctctatctgcgtgggcaccatctaatcagctgtcagaataaaagcaggcagaagaatgtgaaaagactaaactggcttagcctctcagcctccatctttctcctgcgctggatgcttcctgctctcaaacattagactccaggttcttcagctttgggactcagactggcttccttgctcctcagcttgtagacagcctattgtcggacctcaccttgggattgtgtgcgtcaatactccttaacaaactcccttttaactcctctttatatatatcgatctatcctattagttctgtccatctagagaaccctaatataatataaatacatgactgaaagaatgaagagtcgtaactcatgtgaatctctgtttcccgtaggtaaaaacactctcttcacagagctatcctaggattgaaatgagatgtgaaagatatatgaaaaattcactcgcattaatgccatgctttaagatgataagcagcagccaggtggagtggctcacacctgtaatcccagcactttgggaggccgaggcgggtggatcacaaggtcaggagtttgagaccaacctggccaacatggtgaaaccctgtctctactaaaaatacaaaaattagccgggcgtggtggcaggcacctgtaatcccagctattcaggaggccgaggcaggacaatcacttgaacccgggaagcagaggttgcagtgagctgagatcgtgccattgtactccagcctgggcaacagagcaagactcggtctcagaaaaaaaaaaaaaaaaaaagatgatgagcagcacaggctttagagttagctgaaactgggtttgagtctagggatcaacagttcctcacctgtgtgacctcagacaggtttacttggcctcagattcctcctctatagaatggggatgataacagtacctatgccacagagttcttgtaaagataaaatgatacgtcttgtggagtcctgataagtaaacaacaatgagaaaggggccccagatgggagagaacaatgaacagtgattctgagaaatggccaatcacaaacaaccccgggcacagtgacctttttcagcacataggcccctccagcgcaaccctataaaacttccttccagcctctgccgcttggcagacggccccttctctgctgtgctgcctgctgcacccttgcaacatatttttatactttctctaataaatctggctttctttacctgcaactgtcttggtaaattcctttactgcctgtgacactgaccccggctaggtgcacccgtgacatgtattacataaatagggtacttaatatacaaaataaagcacttcatattaatgaatagaaactattttattatctttaaaataaagcacaaagattaacaaaaattaaaggtgattatcatggattaaatgcttgcatcccccaagtccaaatgcagaagccctaatccccagtgtggctttatttggagatgaggcctctaaggaagtaattaggctaaaggaggtcagaagggtggggccctaatataataggattagtgctcttataagaagagacaccagagagcttgctcctctctccacacactgaggaaagaccacgtagggacacagggagaagggggccatctgcagcccagaggagaggcctcaccagaaagagaccatgctgggacctcgacctcagacttgcaggctccagaactgtgggaaatacatgtctattgctcaagcctcctaatctgtgttttttgttatggcagcctgagaagattaataatacagtgataaaataagacatgctattgttatgttgaggaactttctgaattaaataatatttttgtctcttaatcgtgaattcaggccgacctcagatacctctctctttggcattaattatgattgcacatgggaatttcatgcggcacctgctgaaattagtaacaaaaggaaaagtactggacctttccaagttataaaaggtttagcttcccgagttctttgttcagaaatatggtggggtaactgctcttgatactcagaaacttagtaacctagctatagtcctctcaatgaagtgttccatgttaaactatagtggctaaaactattcttttatggagctgaagctaaaaagaaaaaaatcagattagaaaaaaatcctctttttttcctccaaataagtctttttaataatgtcagggatccgtttggatttgctccctttttttttttgagacagagtcttgctctgtattccaggctgtagtgcagtggcgcaatctcagcttactgcaacctctgcctccagggttcaagcgattctcatgcctcagcctcctgaatagctgggactacaggcgcgtgccaccacactgagctaatttttgtattttctagtagagatggggtttcaccatgttggccatgctggtctggaactcctggcctcccaaagtgttggaattataggcattagtcaccacacccagccttagaaagaaatcttaatatgcatttctaaacactgattgctccacagaagtcaaaaaagtttccaaattaaaaaatgtactaatgaatatctaactgtggtaggcagcctatagcagggatcgccaacctccggaccacagaccagtgccagtccatggcctgttaggaagcgggccacacagcaggaggtgagcagcgggtgagccagcaaagcttcatctgtatttacagctgctgcccattgctcacattactgcctgagttccagcggcagcagagtcccataggagcatgaaccctattgtgaactgtgcatgtgagggatctgggttgcccactccttatgagaatctaatgcctgatgatctgtcactgtctcccatcagccccagatgggaccatctaattgcaggaaaacaagcttagggcttctactaattctacattatggtgagttgtataattattttattatataataatagaactaaagtacacagtaaatgtaatgcacttgaattatcctgaaactagctccctgccccctggtctgtagaaaaactgtcttccatgaaactggtccctggtaccaaaaatgttggggaccactggcctataggatggcccccagggatccccacgtcctggtatttacacccttttgtaattccctctccctgagtgagatttgcacttaccgactcgcttctcaggaatagaatacagcgaaagtgatgggatatcactgagattaggctacaaaaagatggtggatcccattccatctggcttgctctgagggaagcctgctgccatgctgcaagccaccctatggagagggtgcagcagcccccacacaagtgagcctggcagtagataccactccttcagttcagccttcagatgaaaccacagctgatattttattgcagccttgggagagactctgaggcaggggcaccaggctaagccatccctgaatttctgacccacagacactgtgacataattaacatttattatttaagccactaagtgttgggtttgttacatggcagtagataactaatacacaaacctatattgtatatacagacccaatcactctgacaggcattttatgtgtatcataaaatgtgagtactatcaacagctccatttacaggcagggaaaccaaggcatcggtaggataaatagcttcccagagtcacactgcataagtgggaaaggtatgcttaagacccatagccttaaccagtatgcttcccagcctcctcatgtagacttcactggggaatgtgagcatattaaacccagctaaatcttcagaggtgaaaataaataaaaaacctaccccaactatatcaaatatggtaaagaatttctatgatgattgaaatttacacaacatgaagccaaccctttccccaacgtcaaagtttgagttaaggtaattaatattctcctgaggttacactttgaaaatgtttctgtttttcccaagaagagacatttttactttctactgccatggtatagcctcctaatgctcagagatcatggcagagtgatcggctgtgtctcatcagcattcttatgctttgatggtgattagtatttacaaaggaaaaaattgtctctcacaactgaactgtatgtgaaatgactggcacttcctcagcatccttgagatgagtcctaatgattctgcatagacaatgtacacccagggtctacccatcccacacatgctgatgtgtgcacagtcactattactgtaccaggagtgatgcgttctcagacctgcgcaaacaggccctgcggtgatatgtatgaaaatgagtggatcacatttttttaaaaggagagaaacaaagagacaaagaatatagcctgaaatataaacattggaaccaacagctcctgccttagctattctgctctagcacaaagcctattttttgttcctttatgtaattgtcctgaggctggaaaagcctgaagttgcaggcagtaacatttaaagctactgctatggaagaaaaaatgctttaagtaatgaaggtgacagcagattgagctgagaggggaaccaagcagttgttagggggtggagtggtgaggaggatttaaagcagctctggatgtgaaaaacatctgattttagagtcagaaaccctaaaattagagaaatagtggaaaactgaaaataaacttcgcacatatgtaacatgtagctttcaaaaatgtacaacattctgaaccttcccaaataaattaaactctataccatattggagataagatcatttaaggggaaattttattcagaatttaaatctgagaaaccgcatgcctcaccctcacactagggtgaaaagtgaaaatggcctaaaactgcctggattttccagtgcaatagaacccaactgttactctcctgctaggatgtcacattttacaatatgctacaacagactggcttggaagaggaacaggcagaaacgcagccaagtatatacaacctcaggagtggaaactatgtacatcagcagggccaccttaggtcctcaaaacacttcaatcatcaaattgctttcgaatgatgtcctgcgaccagaaaacaagttttgggaggccaagtgcatgatctgccgtttgggtggagagtgagcagcacccattaaggcgaacggaggtaacctaaggttaaaccaaatgccccatctcctggtctgtgggcaccagtgaccccgcctgtaggccacagggtcaaacaacaatcaggagaaggaagcctgcagaccaagggcctggctcccggttcaggaaatcaaggcacagaaagggtaagtcatctagctagaagtggagcttcatcaaattttcagtgatctttttaagatataacgatgcctctggtcaggccaaaccccggcttcagacaatggttcccaacctcagctaacaattagaatcacctggggagctttccaggcgattcccagccccagagattggaatgggtttggagtggcctggaaatgggaatttttcaaagctccctagagactctgacgtgcagctaaggttgggagcactgctcaaaggtctctactcacataaagaatggaaggatgtcacttctacttctttcatgctgatccgaatattttgttattaaaagaaagtcatgatagcactacatctatcacaaatcttaggtgagttgtttttgttttttttaggtaagtttactcaagcgaaaagagtaaatttttctataattttctgacttagccttccagcaaagctctatgaatcaaatatacattcatatttcagacaactgaaaaaagggtatttgtttccattactatacggaactatattcactgcttggaaatgaacggaatattatctgagaactcttaaattcctggtcagcttgatgatgactgaataaactcttattccagggaaccaactaaccattttcagcaattcaaagcacatgtaattactggttcaaagcattttgaattgttttgcttttctaaatagaaaagaaaaaaagactcacaaaaagagtactataatggaatatgttcatcaaatatttgtacaaacagaaaataatcatattttaataaaagttttcattcatctgtaacagtgtgaatctaatacatttaattaacaaactcattatacagtatttacaatattgatcctgagccagccaatgaaaacaaatcttacatatctggccaagcaattatagttacaaaacagcttctgatgtaaattttcaaaagaattctagttcaggttaattttttttctttccttgaagactaagcttacagaatcatgtgactatatataaagaagtttgatccagtcttttttcctcacaccatcactctccagatccaacagactggctaaggaggggacggccagacccccagggacttttgtcagcattgcagttaatgatctgtttacacaaggggagataccaccaacctaaagtagatttacatttacattacatcatccaaaggtgacaccccagtcttaacagtaagactgccacattgaaaccgcagaaactacatattcccacctagaaggatggtttcagctaaatgagaaatggtccacttgctgcaaggcttaccaaggacccgctgtgactttagctctcaggttgcccactgcatagagctatttgccctcagagactgggactcccttagcccacctggtttttgggttttcactgattgctgtatatctcacaggaccctagaattggacatcagtgcacaaccctccctcatccccattctgaagctccagattctccaaatggagagaagaggctcagatggaggctctgcccctttctccatctccaataccaccatcctagtcccactcccttcctatctcccctggatgatggcaacagcctcctaccaggtctccttgcttcctctctagcctacccagtttccctcctgaaagccattctccaccaagatgtgcaattagaatcacacctgaatccttaccatggccccagggggatgttttctggttgcttatccaacctcagctaccaatcgcctctctgtctctcatgcaacccttcaagtcctttaaaaatggagttcaccctgcactggagcttctgcacctgctagtccctctgccgggatgccggccacacaaacacctccccagggagcttcttcctgtcaacctggtccaggctgtgcagaggcctccctgggccactccatctaaagtggctccctactaactcctctgtgtaagtcccctttatccacactgtccccagagccattatctacccttctgtgggccctgaaaggatgacccaacctatggactccactgcaggggctcccttgcctcctagctgtcctttgagttctgccaatgaaatcagaagcctgagaatttcttccctgcctgtaccctgccttagcatctcaactccacaccttcaagtctacagctcctggcaggcagctcctcccctaggtttccagccacgtgacttcctcccccagctccagcttccagctgttgctcatggctgcaggcctggacatcccttgttagttccctcaggactgccccaattcaccagctcttcaacaaaacccccacagtgttaggacctgaccactctgaccaagccccctccccttgctctctatccctgtttcagtctcttcatcgcatttatcactatccgaaatgatcttgttcacttgcctttttcctattgtctatctccccctcaaccactggatcctaagctccatgaaagcaaggagcttgaaatgttccctgctttatcctctgggcctaaaccagtggctggaacacagtaagcactcaatagacagcaaagcctgaatgaaccaatgctacattgtctctgctcaaaatatcaccatatcagtaagaccttccctgatcatcttatggaaaatagcaatctcccctccactcccagatctccactccctcctcctgccctccaagtcttattttttcctatagcatcattactttctgatacatttgatatttctttattgcttgtttcccttccaaaaaatgtcaaccctggaggcagaaatgctattttatttactgatgcagcctcagagcctaggacagtacctatcccgtagcgaagtctcaataaatatttgttaaaatgaatagctagcgaagtgggcaaactttcatacaacacaatttcaggattgtatccaacactggaaaaaattgtctccaacactacaagtaagtgccgtcttacgtgacttgaccttgttctagcagaaagacagcctagaactcctaaggaaaaggtctgaaatgctggctagcgcttagtttatatggagaggaaaaggttttagagtaagatcaatcagtaagaccctgagttcctgacaattgctgctctagaaagcatgcctggaagcttacctaagcacacggccattgtaattcctttcagaaagtaagtgaacatataaattataaataaatgacacttacatacaccattctgtttcacagtggtgttgtattggcagcagccttcaactatagttcattgacagcatttgtggacccacagccaagcgctgaaagcactgctttttttgacagctgctctcctaatggggcatctctcaaagaccggtttcattctgtgacgcccacgttgtccacattttattctgcacaataactgcagatttgaaataaattcttcctccccaccaccattattgattactcatacctgcccctcaccctccaaagtgtctaaattgtgtggattttgcgggggtggggggaggcgggggaaggagtcgactccccatgtactgggtgtccccgatggcggcaagccacaccttcacacaagggggcaaggttcttgactaaatatcctaaaggtctgaaagatggtccccttccccccaacacaattccaccaaaactggccagccgctggctaatgagcaaccacggatcctcacccaaacattggcttttcttccaatagtgcagattgggaatgcagggacgtcgtcctatttatgaacactgagtcacgtcgccgctcaatgtctgtttcctcctccctaggaatgaggtgaccccctcctccagcgagtaaatgcggggcgatggcgagagcgcaggggg

SEQ ID NO: 800 - DNA, 98599 bp, Homo sapiens
ttctgtaaggagcatactgtgcccatttattatagaatgcagttaaaaaaaatattttgaggttagcctctccagtttaaaagcacttaacaagaaacacttggacagcgatgcaatggtctctcccaaaccggctccctcttaccaagtaccgtaaacagggtttgagaacgttcaatcaatttcttgatatgaacaatcaaagcatttaatgcaaacatatttgcttctcaaagaataaaaccatcttccaaatttccaaagcatgcattgttacttggcattaagtatttcaaaatgacaaacattgttacggtattgtaaggccaaaatataatacctatttaccagacatacacattacaactagaaaaaaattacaaatgttaacctagtataacaattccatcaggaatgaatggggaaaggcactgcatccctctcatatcgccacagatctactatccacttgacatgctttgaattcaagtcctgttagacatgggaacagcttttcctacaacatatgattcacaggtaggttaatacatcttagtctcccactgccatacttttcacccaagtgtacaacaggtatgaatatatgctatcagctttatttacaagtgtatcttgatgtcttcgtggggtaaaagaaccaactatctcaaccaacagtttccaaaaaagtttttggctatgattcatgtatagaaaccaccacataaaagaaacaacagaaactgaggtccgatcccaaacacctaaactaaaatttctcacccactaaaagttggcagtgaaactgctattctctgaattgtataagctaaattctacagaggaatttcagatcaacttcttttgcaaaagcacaagttacacgttgcacggttggggatgctgagtgaatgcattccaggaagagttccgcaagcaagtgctgttgcaaagagtcgagaatccgagaatctgggaaaggtgatacgttttccaaacgctttcctggcttcccaaaagatgtaaaacaacaacggtgtaactttatatacgaacaaaggttagtcttgtaaatcagtaatatacatgcacaaacatgagaacatgagggaagaaaggaaacgctacaatttccacattgcattgctgctgttttcacaacctctctgcactaggcggcttcctgtggtacctcttcctaccagtagagagtggcccctgcaggccacttagaaacaggaagctctctcctgagctcactgatcaacctgcccttggcacagacagaacctaccagaaaagaacaagtacaaaacactatcattatctgttttctcaagacagtcccaaatgtccttgtgcgatcaccacaaactcagtgattggcccaagtcattcccgggtgccatgaacagtaactggtgtgcagcattagaacaaggggacacggccttgattctcttctgagcaacatgaactgggatttctgccaccccgatctcggctgccacctccgaagaagtcgtgaccagccacctccacagtaaaagattcctcccgtgagtatgatttggaatgcgtcctcgtcgcgtgccagttcagctgaggtggatcggcgtgtactccggcctcctggtctggataatttttggcttaggtctcctcattctttccatttcctcttcttcctccttctcttgatcactctcacatacatggaccaccacgctgggagtggtgtcagtcgctgcgtgcaattcatacttttcccctaaggagggaaaataatcgcagggtcactcagacaagtccttgggagtcaaaaggcaaacataaaagagcattcagggctctgctgggccagctgctcgtgaccattcgattgggctgagagacacagccagacatattttgggtttgtatttctttgctagctcattcagaaaaagagagatttccattgtgcatgactctgtttttagtcaaacattctgggagtccaggcacatgagaagtatagaaggaatgcatttttctagttatacttcacatgtccaccagatatctaaactacccagagaactccctttctgtcagcatttcctcaagtgtgaatgtgagaaacttcggttcaggaaaaagatggatgaagaaacgtatttggaaacagaaccctgggcctccctcatgcagctcctatttgagggtcgcagtgcacgcccaggaagggcgccacaggaggccctgcagcagacgcaggggtggctgcacggagccaggtgctctggaaacgtttttgacctgggcatcttttccttagaacaacttctaatccccgggaccaggagtgtcctgctgttctatgtcagcctgagttctaccaggttggccaagttcaggccactctggtccagcaagggtggggagagctttctgcaactgaaaaacccggcaatgtagaatgaagggactggggcctcccgctggggtgccgctctggccacgggaagagtgtgcatctctggtgctcatgaaggcagctctgagcctggctccttagtacccagggctcatgggcactttattctgcttccctgtgcacctcagttccctcctcagtaaaggagacggtaaaggtattgacttcatggagctaacagcatgagtgagtgcccgaggcaatgagaacccggctcaccacatgcttgtccagcccatgtcacctagaaagatgtttaagaatggagactgcatcgttattggtgccctgctgggcagggatctgaaataggggcaggaggtttgcttcaacctgctccacccacagggtgtggcctcatggtcagttttcttccagggctttgtgcttgggatttcttttcttttcttttttctttttctttctttctttcttttttttttttttttttttgagacagagtcttgcctgttgcccaggctggaatgcagtgacaagatctcggctcagtgcaacctccgcctcccaggttcaagtgattctcctgcctcagcctcccaagtagctgggactacaggcgcatgccatcatactcagctaatttttgtatttttagtagagacgaggtttcaccatgttggccaggatggtcttgatctcctgacctcgtgatccgcctgcctcagccttccaaagtgctgggattacaggcatgagccaccgcgcccggcctgtgcttgggatttctttgcagttcgggtaagcgaggaggcaccgcaccaaccactgtgtgatttccgcccgacaagagcggcccaggagagcttcctacctccagccacactggttactcctctaaacctggaaggtacttttactgataaggaaggtggtgatcttttctctatcacatgtgggactggaatgttattataactgcactgaaaaaggcaaaggagctcagctctctgagagagagaattcaggcatgggaggtcagatggattgctgaaaatgctggttaagagcctcttacaaatctacctctttgcaagtctcttatctacctactaatcatcgaaaatccagaaagctcagggtttaggaccataatttgcaaaatctccgcaatcctgttggttgaaaagcacaggtgaaatatgaaatctcactcaagctcactgttaagtgaaccaaggacaaactgattttattacgtctatttcctaaaaagccttctccaataagccctcggtgaaggaagtggtatattctggagtatgcagaatttttattaacagcatttgcctctggaactgtggacacctctttgcaagtggagaccctgttttctcccattcctaacctaggggaagactccacaccctcagccatgctcatgcccccgggccaggagctgctgtggggggagcacacgcttcctcaaaatggccatttctgatcttgaccttcacgccacaattagcagtaagtaatgtgagtcttgctttatcccacagagggaatttccgtttggacaatgttttcagaaatgtaatcttttcaatatgaaactgctgatggaccaagaaaacaaaaccctcaacccaagggaacatcagattgctggtcaaggagaaatgaggagctgacggtctcagcatttatttgacttgctccacggacagagcaggagaaggctcaaacctcttcaccccaagactctccctcacacctgcctcctcacccaaaccctagaggacaggacaggaaccaccaacattttatggttttcaaaaatcctgcattgaacactgactgtgagccaggtgctgatggaagtgcctttcactcgatgatctcatctactgctcacaattccaccagttaaggcccacattttggacaaagagcctgaggaacctaccccctccccgcagtgctcacacttttgtccctccagaggacgggaacttcctctttctttagcaagctctgtaggggaccagcccacaggccctggggtagggcagcccgaccgcggcccttccctcaccatggcctatggttctccttcccttttcctttaagaaggccaggtgagaatcacaggaaagggagaatttattttgattaaaaataacatttcttaaagggggcatcgattttccctttccaaagtccaatcactcatccctatccggagcgacagaacctggggccggggctcaggcctcccacgcaggctgtgctcagtggacacaggaatggattcctgggacactgcggggggtggaggggcgtgatgcagggtccccacgatcagccgcagtctctctaacactgcaggtggtgccaagaggcaggcatgctcccagcacaagggacggtggcgcagaagaatacagagaagctcacaaaacatgccggcatgggctcaggagagctacgggggtagtggtggtactgctccctggtgcagggcagcagctgtgtctccccctgcctccctcccacccgagggccctgctcacctggccccagcttggagatggcatataagagatcatagtttatgactggggtcgcatcttccacttgtttccatcccactggcggagaggcgggaggggagatcagaaactgcttgtctggatttggcggagccaggtgtgagcttcctatgtgtaaggtctgaggagagaaaataagcacaggtcagttgttgccagggaagaactgcagtgaggcaacagcacctaacgccagttccgggagatgggcaggtcaatgtccaggcgtcaggacaggtgtgattccaggaccaattgtaagatggtctgtaatggggagggcaaaaggacatatgaactctggttgtggcacagataggatgacagccccctcccagggctatgggagtcacaggcacagggactgcaaataattacgcttgacctagatggacagaaaatcagcagaggtgactttagtatatatggaaatttaagtcactgtcattgaggtcaggagggctcttggaatcagtctctccccgctcctcataccacagaggcaagctctgaaagtccaaagcctaggccacagttctgagaggacacagcttctcagggacagggagccagggctccacctgcccctagggttccccacccagcagcagctctgcacctccctctccgggactctggatcagatgccagaaaaaaaaaaaaaagccacttcccaggagactttaagaaataagaataaggaacaataacctacgatcctagtttggttttagaaatgctgaccagtgatgagagggctgtccatagagctcttacatctcaagctgcgcggtgtaggttttctctgcacttccagattgccctccccaagttttcacaatgaatatgcattgttttacaaacagaaaaggtcagaggagtactaagtaattatttgcataaaatcttatcccgtgcagaaaggagtgtactcacacaggaaggcctaggcacccaaggtcaaagctcagcctgtgcctcccagggcaaaaaggtcaggggtggggcggggatcccaaatgctttatttatacttgaagggcccagcaagttcgctgtcctcactttgaggaagaaaagacactttggctctctggcgtggtgtcagatgagcttcctcccactgggggaggcctttggacagggtcctctcccatcccagcaaggtatgtgtgtatgtgtgtgtgtggtgggggcgggttgggggggtgctcagagcctgagggggacttgctttactgaggagctggctgcattctagaagctcctctcttcttccctgacaatctgtcagcccctaaggacatcaaatggaactctgggagctgccttgaaggtgggtcacctgtcctaagttccccagaggagggtcaaaatggtagtgggcaggagaaaaggcaagcccaaccccagctacccctctccctgccgtgggtgccctggggctgggaaccctgccaaccagagggtttcttagcatctgcgcccagtctggttatcccctattttcctttcaagccagacctggcagtcctgggctgatttgcaggcatcttctgcagactcctgtttctctgctgagtacccccagcaccacatgagcagggaaccactctggtctgctcagtctagagtgggtcatgagctccaacccttgagcaaattcatggaaacctgctgcgcaaaccttagggtgtttgcatagccacgcctaccccgctgcaccctgcaagctccccagtgaacagggaaggctttctttcccccatcattatcaacccaggaaggtcaggggcaatgtctgaggttgctttcaaatgcaccttgatatcttcttaaaacaagtgagacgctgaacattcagagtaggaattttgtctttctcaaggtgaagtctcagagtttccggtcagcatataacataagcaacgtataagctgctttacaaaagggagggagggaggagggagaagcatgcatagcaatgaacccaactcacctgagcaaaatataacttcatttcctttcccagaaactcagtcttatgcagctggagcctggcatctgctgcggagaaggggttgctgaagtttattctgactcgtttgaagctcttaaaatactgaaaggtgatgtccttgtcatacgtcctaaagagggactcaaatttggcctgaaaaataacaataaaaataaaaggagttgaaatttacctgcatatgacccttgactagatgatgtcattacttttttttttttcttcgagacagagtcttgctctgtcacccaggctggagtgcagtggtgcagttttggctcactgcaacctccacctcccaggttcaagtgattctcctgcctcagcctcccgagtagctggggttacaggtgcctgccagcacacctggctaatttttgtatttttagtagagacggggctttgccatgttggcaaggctggtctcaagctcctgtcctcaggtgatccctcggcctcccaaagtgctgggattacaggcatgagccaccgtgcctggcctcctcaatacattttttactgaggaagtggatcatcaatcctttcaagaactcctaacttctttcttagagaaaagcctttcccctcttaggggactatggcctttagtcccaatgcaggtgattttacaagaaggtaagaaggtatgatttattacattcatcgaatcagcagaacagttgccaatacatagacactacttacggtaacaaacttttttaaaaagtagaatgagcattttccagggaggtacagtttggtaatttgctccccatgtttctctgtcctatggccttcccccactcacccccccttttttctctgtcctatagccttccccggctagccaactccaaccccaccgttcagctcagggcagtgttgcatatatcaaagatttctttaaggcttaaaagaactgcagctaatttgaaaaaaagaaatactgacttgaaaaataacaaagttggtagaaagttttgcatttcttaaaataagtagtttttaaaaatttccacgatcgcttttatctcagtctgttactttttaactctctaaaatgatactggtttaaaaattaatgttctgcaaatggaccattttctgcatcctggctttcgtgtctgtgcacacctcgctctggtgccatagggctagtgagaattaggagatgtcctgagctcttagaatgcaaagctcgaggtgggggattacaagcttaggttgctcaggggacagccccctaggctgggtcctggagtgtggctgtcggtgggggcagctgggggccactgcaactcctcagagagggagtttaactggtggacagtcaaagctccaaggaagactgcatgggcttctagtcgccgggttttgtgaatctttttaccaggcaaaaacacttaggacagtttgtgggagcccgtgtgaaaggcagaaggggctggccaggaagaaggggatggcgcagggtgtggatggtaggcagcgcggacagagctcactgaggaccttggagaacctatggaaggcgcagtgtctctgcagtgggagcgaggattcaggataagagaggagagtgtcttcaggaatgttcactgctagcaagcgcggggaggcactggtggatgcctgctccacatggggctgcgggtaggagcagggtagtcggtccctgccaggcaggtcgttaaggagcagtcggaacaacctacgaccttgctctccttgcattccccggcttttcttcagtttagggacatttctgagactttcccacgagggatcccgcagaggcacgtgcgaaggaacgcggagctggcggacggtagagttcatctggccgcctctcactctttttccccacctctcttgagcacgggcaagtttctggcaaaagtgtgtcttcgtacatttggaattttgtatgacctcatcaataggcactgtgacccactgtttagttttgaagttatgattcagaatttgggagagatgactttgaagaatatttttagaatacaggttcagggcttaggaccagaacaaaagagaattcacattatctttaaaatctagattactatgatgcctttctcttataaaagaatcttatttgttctaataactgatacctagttattatagcttttggatggcatctctacttcatttaaaaaatagtgattttactcacataaggctcatgttaagtgaactcactttgtagtactttaaaaacatagaatgtgctctgcaatctagtccaaacactatggtgcgagcccataagcattatatacaattatggagttacatttgattttttttaaaaaaagaaaccttcgcatgtcccaatatggctttggatataaagcatataacaccaccaggcacaaataccacccctcaaatagagcatacaggattcattcctatacagtattattaaagctcaattagccggatagctgctgatgaaaaaacttacattttaatcaaatgaagaagaaaagtgtagtgattaaaatgattatattaatcaccatcaaagagagctgctgcccaggaggcacactgatctcacacttaatttctccagttttattatttgctctggcggcattttctcttgttagagaaatctgggagcttgaggccaggccctcataattactacaaacatacaaatatctttataacatttatttcctaagacgaaatgaaattattcacaacgctggctacaaaagtaaaacactattcactgtcagaagaggcctctttctgaaaagttcacttacaacatacacagaatgaaaaacacacgatgccccaactctcgccttcctagtgagttggttcaggggcctggatgttgtcaaatattgagatctttagaaattccttcctcagttaattcctcaggcaacagcttttgattttcaaggctcgaaagactttggatttctttcaaaacccccaaacccacaagagagccacattctcccaagtattcagttaatagtcccagttagcataatgctttgaaaactaaagaaaatcacgttatattagaagccttaccctggtttcactttcgctgaagatatcactgtttgccacacaggcaatcagggagctaaaactgtagttaaagtttctaaaatgcatcttgctttcttacagtgaaagcgctacagacccacgcagtcaagcccctagtgagattcctttccaagaggctgtaggttccttcttgagctggtgcttataaagcagtaagggccagcccccactccctggggaaaaaaaaagtgcagcttccacagcatcctgtttggacagcaaattcctgagtcaagtcctgcatgcttgcaggcagacagggacaaagtgtaagtttctactggaaagaggtgacgtcaacaccttagtcattttccctatgctaattaactttgcttggggagaatggaaaaaacagctgaggtttgcttcacagctgctttatcaacctctcttgcagcatagtttccactggtagtaattccattcagctactcagacaacacgctcctcggccgaatgggacgacccttcttaagatggaaaatgttacaaaagaaaaaggatgaaggtctgtggcaataaacagcaattagactgtagggaaatttcaaggctttgggaaacctggaaaccaaagtccgggtgacatacttgatccctggaatttcctgaaaacctcaatcaaagtttcactttggggtattagagaaaacattttgaaatctgtcttggtcaataaaaattttaaaggacaaaaagaggaatcattttgaagtgtagttaaaatttttttccccagtgacattttattggatgaatgtcccaatttctacttgtatcccacagtggaatggagcaaacagaacctaaaacaatcctaggattttcatttgaaaacttcattattataatttgagaactggggatatgaaacacttcgatcattttcaaagcactactgaattcaggcaaaggatacaaaaacactagcctttgaaactgagcaatctagcctttgaaactgagcaaagaagcattaacccatttatgccagaggttgcaattttttgaatttttgccatcagaccttggcaatgaccttgagcaataggatataaataactcccacatgcttagcgttccaataatggaacactaggcataaatgggttaagaggtcctgcttaaagactcataaactaaatgtaaaaaaaaaaaaaaaaaggaaaggaagaagaaatggaaagaatgtacactataattgaaagggaagatgcagggaagatgcctggtttggagaagtgctctgcgatgcaagactgactctagttctttcaaaaggttgcaactcttgaaccttctaagtattttaccagtttagatccctatggcagcctgggtcctatgttcttctcactctctccaattttattatcacctaaaagcactcaagttatttaagcattctctgatttaggggcacacagggacagctctcaagcttccagaagttaaatggaatcctgccattcacatttaaaaattaacttcaaagaatcattaaagtcagccaataatttaaaatacatgcaagaggaagaaacaaagcagggcatttagccttccaaaaaaggaaaagcaaagtccttttggatgagtgagtgttgcttaatttcaacgcactgtgccttgctgccaactgtagagttatgtaagaaaccagttatggtgtttgctttgccaaattatccataactcccaacctgaaaagacataaacgcatgtattccaaaaaagtgtagaatactgaacaatgcaacatgcatcaaacaccaaggggaagtggtcatcctggatgatgcttcgagagggaatgtgtatgcttgcagtcctgcattttcagtacagggagcctttgtctgtccagcaggcacatgaagattgtggtggtgggcaggagaggctaaggggaaacagaggtgaggggagcagacacagtcctgcattccactcctccagaggggcttggaacttctctgatgttccctccccctctccaactctttgtctcccccttttctcttctcctggcatgcacctgggcaaattccattaaaaggtgatcagaagagacagaagaggctaatttagacacaagaggctgatttcactgtcttcttttctcttttaaaatcatgacacaaagttccagctcaattttgtgggcaaatctcaaacatctctgttcatctgagacaacagtgtgggctcacccgaatatacaattttgatttcgttatatggatggaaaaaaaaaaaaagaacggtgaggtatttgaagattattcaactgtctttgctcatagaaatgataaatctttcactagattgcccaaaaacatgtaattctatatctgcctttgaattgatcggttctatctatctgaattgaatttagtaaacttgagcacttccatttttagatcaggagtaagagccggtcaaaatggtggctgccactttgtagggagactggaatgcatgttctctggcaaaaaaatcactggttcacaaattgtaccagagccctggatcagggggagggcacttaggatctgccaccttggttttccttggctaaaatgtgagaggtatggagcagatttgagtttccaaagtgcgtcttgctgagtagcaggaatccttagtggcacttggacactctggttggccaacagggcaaagcacagggtttcctgggacacctgtccctgtacccatagggtaagactgccttatgctcatatcaatgcctcctcatctgcttatctgacaattcttgctaagagagtctgtctttgactgcatgtctattatacgtgaacttgcatttctaaaggtcctatgcaaatgaatttactttataaatagtgattctccccactgagaataaaaacggatccaaagcaagtatttaaaaagctgactttcctacttgtatattccttgtggttttggaggcaagtatattcctgattcttgcttgctggttggatgtcagtgatctgaagaaagcagagcaagacccacagcaagacctctgatatggttgggctgtgtccccaccaaaatctcaacttgaattgtatctcccagaattcccacatattgtgggagggacccagggggaggtaattgaatcatggggggccagtctttcctgtgctattctcgtgatagtgaataagtctcacgagatctgatgggtttatcaggggttttcacttttgctttctcatcattttcccttgctgccgccatgtaagaagtgtctttcacctcccgccgtgattctgaggcctccccagccatgtggaactgtaagtccaattaaacctctttttcttcccagtcttgggtatgtcttgtctttatcagcagtgtgaaaacggactaatatagtctcattagagctcttgagaagcattctaaaacctgcactcaacatgataaaactgaacccagaagttaaagtaaatgaatgttttagtcaactgagagctttagaagttttgcatttcttccactcacaccataaaaatcataaatgagtctttttaacctgcatttgcctcctctggctccaaacagtttccattaggaagtttccattttcagtgaggaaaaattaaggtttatgatgaattccatcattcccattacagcattctgaaagcatcattaggatgacttcagcacatccattatgaactctaaggagttgacaactgcaccaagaatgtgccccctgtgaagctgtctgcaacatgaactgaccaaagacagaaactgagttttgacttccaacactgagcaaaaaatgaggcaacttgcaaaggctctcttgtgaatgaacatgatgacagttacattttatttcagttttttgcttctaagatagtgaaatagtttttttttttttttttttttttttttgagacagttttgctcttgtcgcccaggccggagtgcaatggcgtgatcttggctcactgcaacctctgcctcctgggttcaagcgattctcctgcctcagcctcccaagtagttgggattacaggcgcctgccaccacgcccagctaatttttgtatttttagtagagatggggtttcaccatgttggtcaggctggtctcaaactcctgacctcgtgatccacccgcctcggcctcccaaagtggtaaagtagttttactgttacttcacatgtgtaaccattccctatagaatgtggagcattgttccccagcctaagttactacacaaaaacaaaacaaaacaaaaaacaaccccacaagggtttgctctcttcctcatctttaccactttgtggtctaaaaggcattattaactaaggagaaggttcttattctcaacttttaagagggattaatatcaaattcagagttgtggagaggattcatctagtgatggtggcaaagtgcctagcacaatgcctgaaacacaggtggcggctaaagcacatcagttgcctttctatttccgatttcatcgataaagatattgaggttcagagtggcacacactatgtttaggagagccggaactcactctgggcttttcattgcagattccacgcttgttccaaggaactatgcccgccttgggccaatgccctgtggtactgtagctcatttccccatctctctgggtggtccagggcaccttggatgtcctcctatgtgccctgcaggtccacagaaagtcctgtaggttctctatcccatccttcaccgtgcatagtgctgcaggtaggcagccctcagcaactgtaatatcttcccaactggcctcgcttggcctgtgtcttaccactccaacataatgtgcaagtctgacacataaaaatccctgatgctgaccaagctcggtcacgttcctctcccgctgtataagcttcagtgataagcactgttcctgctgtagcccaggcagactgttcaaggtcgtcttgtgtctttcttgtcacatatcctgccagtgctgctctcacttttatgttcctccaagacaaatggcttatatgcctcaaaacacactcccctcttctcttccccaagtctctgctcgtgctctccctctccctggattattcctcctttctcccctttcctttccttccttaagattgagtgcaggcatgtcgttctccaggaagccaacaatgaccccccgtgttaaaaaaatattattcaatgatgcctgctgaagcccgacaaggcagactttattcaggaccaccacgatgggtatagagaccaccacaaccaggtcttgcagtgggggctgggggcgggggtagattgagctcaactccgaatacagcatggccaagaagcagtgtcagggtcagtggtggaaaattactaagaggaggcatcggggtaaagaggactctggctaagctgacctaataggattcttgctgaagacaggcccgggtgatcagacatcacctgacggatggtagaagatgaagaacccaatcagatattaagggtgggggggttcctgttaaactgactttgcggggttctttgctaaaactgggttttataaggaagtgcacaggtgagcctaggaaaaggttcagaaacctgacccaaatttggccaagcaaaaaatgtttgtcaccccaaacccactcatacccttgtccaaggtttgttaagcactctccaaacttcctacgtctgtctccagcaccgtgctcacttcagtaggtgaccacctatgtgatgacaccctggttctaaacggtgaacctcctgacggcttgagccacatcttattccacttgatagtcctggtgctggtacaaaatagtctctcaaaaatgccagctaaagaaacaaactgatgtctttcttcctgtcactgtcatccactgcttctactttgatcacatagaactaaaaactagttcctctttgacacaagagtcattcatacatttgacgacagatgtcatctcattcacatatccattcatttgatcagcaaatactgaatagccttttacatgatagatatgattgtagatactctagaaaagaatagataaatgaagtgtaaaccctgccactaagatgagtagaactttggatagttttcctggatcttactttcgaacattgcaaattccaaccccccactgcccaccttatcagtctcatttaaacaaatatttttaaaatttgataatacagtcatatgataaaaaacaaaataaactttttttttttttttgagacggagtcttgctctgtcgcccaggctggagtgcagtggcactatctcggctcactgcaagctccgcctcccgggttcacgccattctcctgcctcagcctcccgagtagctgggactacaggtgcccgccaccacgcccggctaattttttgtatttttagtagagatggggtttcaccgtgttagccaggatggtcttgatctcctgacctcatgatctgcctgcgttggcctcccaaagtgctgggattacaggcgtgagccaccgcgccaggcccaaaatatacttaaataggatacactgagaaagcttttcctacctctgtccctgtccactccattctcactctgcctgttaggtgtaacctcatttttttaaaccatttttattattttggggtttttttaatcaaataaaagcaattatgattttatttcccccactttaagtaaataaaaggtaacatgctatatttaaacaaaacaaaccttcaatgacttccctttgctcctgaagttgaacctaagccttctggttcacattcattcacgcatccctccatttattcattcatttgtctaaacactgttctaggtactaggaattcaaatatgaacaaaacagacaaaactccccgccctcttggagcttacattccagatggggaaaaaagacacaaaacaagatagatgggtacaatccacagtatgtttagacagccttgagtgtgggcaacagagcagcgcggaggggcagaaaagctggaaaagtggtgaaagcaagcccggccagggaaggcatccttgagaaggggacatgcgagtgcatgaggacctgaagcaggtaggggagtgaaccgttggatgctggggaacagcattctggcccagggaacagcaggtgtggaggccctgaggcaggagaatctggcatgctgcaagcccagcaaggaggctcagggtggctgcggaggagggtcatggagaaagtggttgggaatgaggacaagagagacctttagccattggaaggaccctggcttgtattctacagaagtgggagccataagggggtttgagcaaaggttagcatggtctgttatgacatgatttccatattacagaagtactctggtttctgtgttcagaatacagcgaaggggcgagggggaagcaaggtacccatgaggagacagctggggtaggcagggcagtgggagcttcttctccaaccagtgtccatacctcctccagggaccccctctgcagtacccactttctaaagctcctcagccagctcctccctgtctcattcctgcctgttgaactcttgttcatcctttaaagcctatcattaagtccaattcctccaggagctcccccatcccccaactaagtgttctttcccacctgtaacctggtgactcccacctcccgctgtcaccatagtctgcttggcatcatagtcatgttgggacttggcaatcttcatactacaacaaaagcttcatgaggacaatgcagcttattctgcagctccccagagatgtagacaaaagcttgtgcaagtcaatgacaccaaaattcggagaactgcaccagtgggggctcatctgatgcaaaccaagagccagaattcaccagggcatcaaaaggccatggcttctggtgtgacagactgaagggcagcctttgtctgtggtttgagcaaaggccaggccattcattgtggtcacaggaggtggtgtagggttgtgatgacatttctcacaggcctcaggggaagcactgtgcttgagggccacatgtgtgctctgtgggtgtcacattcccggatgtgcttcctatgtccttgctgtggggggcctagcaggatgccaggcactggcccgcaccatcacatggagactgggaggcccgaccacatggacactgctgagggccaggattcttcttatgggtacactgcagagatctccagcaccaaccccatgacaagaggaagagcagagtcaattggatgcatgtccaccttaaggacctgtctttagggcatgtttcataaagtatccagcatataggagaatttgtatagaatttacaaataaaatgctttactggcagatgtactaaaaaatcttctaccaaggaggttcataatccaaaacacttggagaccatgtgtttaagcaatagtgtgattaaattcccagttttctttaggctttttcatgataagcaagtgtaagaaagagaacagaagaacattcttcttgatatagttaaaggaatttctatttttgttcacttttagggcaatcaggaaatgggctcaggagtgtatttctcttagtattgctctcttactggtaaaatttgcttggccacagggaagtggtataaagcaaaacacataaccttttttttttttgatgggctttgaaggtgttaaccagaatgccccggagaaaatacgggaggtgctggttctgcaactacagagaatgacaactaagaattctaaatctgaaataatgaaattgtttaaaaaaacactttgaagtttaatgagtattaattttctgtaagaaaacacaataactgatattaaacttcagccaggcacagttctgatactttgaaaaaaaaataagaaacgctgaagtatcttttgatactttgcctgaattactacaagagagtttacaaatatgtatttctgggataacacagaacttttattccttagataaaaaatctgagtggctgatttatgccagtgaccaaaatgatggctgcaattatgcctgctctatattcatgttgttaaaggtgaaaatgctaaagactttttttttagcagaatggtgatcatgatctgttaacacagtagaaacaaaaaaaaaatccaagtataaagaaaaaaaaaagaataaaaaagaaaagagaaaaataaaataattgggaaaaacagggaggaagagtgtgtacaaatgtacatcttaagactgaggtcacagttcatactagatttcatcttgtttgttaaattccatgtgcgctcagaattccattaactcttattccgtattgcctcaatctttccttaatatgtaaaggttaaccaccccactgtaacttcttggaaacgcactgcttgcaatgtttaagatgaaaaaatagccacaggcaaatcaaaactctacttaatgacttggagaccagcagatgaggattaggggaggcaacatttatttggagattactggggccaaagccaccctaattaattaccctttatttgttctctctttccagagccaccttgctttaattactgactttaatttctgctttgatgccattctcagccaggggcacagcactgcagcagcaaaaacctggggaagaacaatcacccaggagtgggctggctgtggtcactcaggcccagggaacaccagtgtctggttagccctcatccctgcgctaagcagctttcacaaccccacggctggttcattctcaacaagtcagtccttcacacgcaaagtaggaattctactttccagggttaatgctgcctggaaaaccttttccttccgctgcagcattccatactctccttagaggagatgattctcccagggaggctggcgcagtgaggggtccaggcacacaccacgccggcacctggtgaatagctggctgaatgtcagcggaggagtaaaggtgagagggtcatggagggaaggggaaaaaaatgagcaagatcaaaatctgcaactcttcaataaagacagaaaacccagttctgaatggcttcgctaaagatcgtttgtatccacacccagtttcaaaactcaagaggcaggtcagaaatggttttctgttgttggtttgttttttctttttcaccaagtgctgggagaaaagtgagttatgtgctcttacctgctatttccattaccatacacacaccctgtttccatgtctgcagttgagaagtcccaacagggcactgcaaacgctttctttctgcatttggcctgcattctttgctgatgacttaaaagcctgataacaagtcacacgaggaagcatgtcctgtcatcttcatgaaggtcaccaatgattcaaaacatactgaaggaacaataaactacatacaaagaacaagcaagaccccaccacaacttggatattatctctgtccacccaaagagagaacaactgtgccaacctggttcatcaggaaaatctaggtgttcccgtcaagtgactaaaatgtgggcacacatctttgcaccgagtatctgattcctaagagctgttccctttccatcaggcctagaatggcccagttagttttctcctggtgaactgtagcccattaacattgacggaaaattagttgttaatattgaaaaattgggaggtgtcacacagaaatagaacttctgacttctttttggtggtggtggcccggggagatgtggccaccctgggcccagagctccatttcactgtggccgagcagatgccccttgttggggaacccatgctcttcaaataccccaggcctcatcactgtctgtggtctactcgcccctccaccaatgatggctgctggctgaccagcccccagggcatttcaatttgtggcttaatttggtaattcatcaaaaacagattagtcacctgctagggccagccatggtgtgaggtgccaggcgtacaggcagagaagtttacccagctctggggctcaagctgttctatgcctaacaatttacaccgaattatacatggagagggcatggccctcactcccacatggtaattgtgtgtgtgtgtgtgtgtgtacttattttttcatctggcccatgtatgggcacatcacattcctatgggtgactccctgggcatctgtgaaatgttgtctcccactcctgaaattatgctgtaaatgccagggaatggtggtgacatggttatagcgacgatcttgattctgctcaaacataaaccacagttggtttctttagcaattattaagaaatgattgggccatgtcagaggaagacagaggaagaatctgaactgtaattcacttacagatttctacagaattagctcatgattcatggaggcaaaaaaagttttgtcaggaatggcattcgaagacacagaaaaacaatttgaaaggagcctgaggtccaggtgttttcagagtgtggtctttaagatagtttcttaaaagatcattcggagaagagagcattttaaactgctcttgtacaaatctatggtacattttattccttatgttgaaaatgatgggaagattgtgcctgtttcacccatttaagaaacgctccctgttggtccaagccaccgtgggctcctccatcctgagggaggacacagtggctctactgtcctctgtagaggtgaaattatgtggcacatactgtgatcaaccacagctactgccaactccccagccaattccccatccactccccgccatgggtactggccgcttccagactctaagacagaggttcttgcgcaggggaggttattaggacgagtggtggggaggggaaaggaaactgggcagagggagagtgaagctaccaagtggtcctagtggaagcctagccgactctacagggagctttgaggatgagacgacccttatcggagcaggaggaccgggccttgatacccccacgttggtcagttctgggaaggggctaccctgagaagggggtggaacttgggcaaggtggctttgctctgccccaacagggctgactgtcaagggaggctgggagacaaattctatttttctgaagtgacctggggtgtgtcactgtgaccagtgcaccgaccagctaaccgaccaacccgcaaggcccaagctcaaggaattagaaggctccagacttgcaccctaagttaatcatctgaagtctcagaaatgtgacagcctttaaactgaacactacaaaaatgctgcttattccactccaaatcattagctcatcatccatgtaaggagcttcaagaagaatatcggtaagattagcggtaaattcaaacagtttaaactttcagtataaaccgcatcaactcaaatcccgaatactgactcaacaatttcactcctaggaatttattctaaagaaatcctcatggctgtgggcaaacattagatgcaaatatgttcctgcaaggcaaataaaatatgcaaaaatatagttttatgtaaataaaatacatcaagatccgtgatcagataatatacatgctaaattcattcagtagactatagagccactcatagtaaggtggtgaaaactaatgacatgaaaagatgttcaagacttgctgttaggagaaaaaaccaggttacaaagcaatgtttattgttctcattttggtgaaaagaaagaatatgtgtgatagtattagaagactcctgtgtttttcttcttgattatttggatttggattatttagattctagcatgaatttccacaatgaacacttattacttttataataacaaaaaagcttctcctttccccttccctcactagatgctatatatcaatggtcaaggtaaccgtggttaacagacacaatatgtaagggtaaaggttagttggagagaaaatcgactttgcctgtttttgtgtagtggtttggtatcacggcttttaatatttgctctgtatctgttatgcacaatctctaaacctgctcattttaacccattaacattttggagtgctagttattgaaagaatcctatttcatacctagaaacagggatttcaccagaaaatactgattttgtctttctttgattacctctcctgcctgccatctttatctggtgaaattctcatttaatcagtagtgttggctgagccattctcactggagtcagggctgtctgagtgccaggggacactcatctgaattgtttcttgtcactgccatgtccctacatctattccttgctcacctgcattattttccccattcttcttgcagtcccagaatcacatccaagccccttttctttctccctggatgaccccttcctctgaatctcctttctaacaagactggaaggttacataataaacttctccccattacagcattaatgatgacagttgtttaatatataaggccttcccagagaatttgtatttaatcagcaaattctggagatcagtctgcatctcaaaggaatgcattgctaaggggaaaattccaggcagtaagtcagttacaggggaaaattctctgcacaggtgggctcttccggggctgggtgctgcctacgtattgttcaagcacctacactgagcagattcttgcatggactgactgggattaagggcagacttccaagaaatcactcatgtctccattcattcaaccaccatttgttaaagatctcccacgtgacttctcgaactccttggctgggtaaaattacccctagttcttagtatttaccacactttaattgatttccttcaccgaactaagggtagaccaagccagagaccctggaacccttaaaacccttcataaacatttgttgaacaaatgcatgcagccaagtaactgactcttccttagagatataaagatgaggaaggtatggttattccttcaaaaagctcacagtgggccaggcgtggtggctcactcctgtaatcccagcactttgggaggccgaggtgggcagatcatgaggtcaggagttcgagacaagcctgaccaacatggtgaaaccctgtctctactaaaaatacaaaaattagctgggcggggtggcgggtgcctgtaatcccagctacttgggaggctgaggtagaagaaccgcttgaacctgggaggtggaggttgcagtgagccgagatcgcaccactgtattccagcctggaatacagagcgagactctgtctcaaaaagaaaaaaaagctcacagtgaaatcaatcaagaaatactaagccatgaccaggtgctcagtagtctactagggcctccaaaagcctcagtttctgtccctacaggggcttaagatggaagcttgagtgatgagactgcagctccagtgataatataaatgatctctcttgtgtgtcacagacactcagagctcaggatactagaagtggagcgtagcaatcagaaaagtctagctaggtatataagaatcccatctcaacctccaattggtccagttacaaaaagtcctacagatgaaggacttgagaatagggttaggctttaaataagtgggaaaaagatatacctctgcatttcctcattactacctaaaaagaaaaggtataaggaaagctttccccaatcaacctacacaagaatctgctcagtgtaggcgcttatactagttagttaacgttccactatcatccactgtcatgtggcatcaaataagcaggtgcttttattaaaggacatatatactttactcattttgaacaaatttgatggcttgtatttttttgcatggcattgggttagtgctaatatctattaacggatgtcctggatttcttaggaaatcctacctttgcatatttcattttaaaaataaatgctattcacggggcgggagcgatggctcacgcctgtaatgccagcactttgggaggccgaggtgggtggatcacaaggtcaggagatagagaccatcctggctaacacggtgaaacactgtctctactaaaaacacaaaaaactagccaggcgtggtggcgggtgcctgtaatcccagctactcgggaggctgaggcaggagaatggtgtgaacccaggaagtggagcttgcagtgagctcagattgcgccactgcactccagcctgggtgacagagtgagactccatctcaaaaaaaataaaataaataaaaaaaatttttttaatgctattcatgcaacacatttttaaaattttggtaaggacataaaaataaatacattggacaaaatcttgtgtttctgcatacacccaaatttgggcttggaaagtgcctataaacagaggtgaggtggggaggatgccatgtgtggtgtggtgggatgtcataggtagctatgataaagacaattctggaagaacaaattctctgaagatggctgcaacactgtctcctactccacatgctctcctacagccttgccattcctgttgggagaaggaatgtatgtcccctgcccttgaatgtggaggacctttgtgagtgcctcaagtgacactatatggtggaaaagacaccaagtttaggtcataaaaagccatgcccttctgccttgttctctcggggcacttcctcttggaacccagttgcccaccatgctttcaggaagcccaagcagcccatgaagagcccatacagagacgaactgaggctgctggcccagagctctggctgagctcctcactggcagctggtatttttgccagctatataagtgtgacaacttgggagtggaccctccagtcgccagccaagggaaacccagaggatgatgcatggaggagagaagaatcatctctgtgcaaactgcagattcacaagcaaaacagatgactattgttatttacagccattacgttttgggtggcttgttgtgcagcaatagtaactggaacaacatttctgcgatgggcagaagtggcaaggattgtaactcattagactcagaaggcgaggtcacctgagtaagcagggtccttagtggaacagtgggtgtaagaggaaggagagatgggtgggtgtggggcttcttgccatctacatatgtagggtctgccttttacttgcacatctgtgagaggtgtacaacagagttgtagaagtatggactctggagccaggccacctgggtctgaacctggtgttccatttcttagctgtgtgaccttgggcaaggttctcaagtcccatgtgcttcagattcttcatctgtaaagaggataatcacaggacctacctcatgtggtggtggtggcacaaattgacctaatgcctacattgaggcttggtgcataggaagtttccatgaaagcgttcactgttatgatccacataggtgtgggcctcagactatgagctgggctgaatgacagcccctccctagtccctggagcttgtaaatatgttgccatacatggaagaagggactctgcaggtgtgactaagctaaggatcttgagactaggagatgatggattaccagggtgggcccagtgtaatcaaggtgtctttataagcaggatatggcagggctggagtcggagatggagacaggatgatggaagcagagattcgagtgatatggggccatgagccaaggaaagtgggagtctttggaacctgggaaaaggcaacgaaacggattttgccctagaagtaacgcagccaggctgacacctgattttagcccattgagactgattttggagtttgatctccagaactgtacagtcataaatctgtgctgttttcagccactaaaattgtttggtaatctgttacatcagcaacaggaagcaaatacaaatttaagactggagaaaggtagctttatagaacatccagcagctagaatgttcaaaggaagttgggctttggaatcaataaactgctgtccttttatttcttcttctcctgacttaggcttcgagggatgacattttctttttaatcctagcatgtgaagtggccaaagctcaggcttgggtgtcagatgggcctgggcaggaaccctggctgcagtccttacttgctgggggtcctcagtcaactggtggtgctggccaagatgaccacagtggcactgacagccagagtcagttgcctgctagccattcggagtggtcagtgcccacgaggtaccagttactatgtgctatgaatattatctctagactgaatcctatgaacttcagtttcctcatttgcaatttgggaacaatctaagtcaaaggttgttgtagaatgtgcataggtaggtgcttttcagactgtggctgccacagcagcagtagctgccttacttggcaacttgccagaattcttgccctacctattgtggtaggctgaattctcaaatggccccctggtggacaagctttgcatgatcccgggactctgtgatggattctgtttccacagttaggttatattaccctgggagattatgtggggtgaacacttaaaagggaccgggttctttctgaagtcggagaaaggatgggagagacattctctgttgctgattctgaagatggagggggccatgtggcaaggactgagagtggcctcaaggagctagagtggccacggggatctgaatgtgcttagaagcagattctccgcaagagtctccagacaggaacgcagcccaggagagaaccggttccagccttgttaaccttgagcagagaaccctgttgtgcacatggtgatttctgacctacagacctgtcaactaagaaatgggcattgtaagccactagatttgtagtaatttgtcacacagcaatagaaaactaatatatatttactgaatcagaaactctgctggtttttgtttgtttgtttgagacagggtctcactgtgtcacccaggctggtctcaacgagcctttgctgaatctcttccttgtcagaggagactgctggtccccaagatagaaagtaaaggagacccagccctgctgtcaggaagcacccgcctcgggttggagtaaaagtcacacatgggacggggctgtaagtctcagcaaacagcagtgcgagggacgcacgtggaagaggggtagtgagggcaccttgtgggcaggagagccttttaaagactgtatgacgtgaactccaagatctatccttgaaggccagggagtggttgaaagatggagccctctgatttctgacttcacttctgcaaagcctactgtgtcatttactcctcaccatcagtggagcgagagcctctgggaccacgtctcccgagtcccatgcctgccatcatggtgcgggctggaccagccttcttagtgggatatgttccccatagaaagtaaaccaagaggcaaaagcaaagcaaagctacgaaagcaggctcagtgcccccgccccttgtttcagtgtcacctcaagtttgcttcttgctctcagagggagatcacagcattgcacaacgggcagtgttgactatttgctggcccttgtcacccacccttccaaaactcgggcagaggacaatctgaacaccagtgtgacagtttctaacaaaaggctttgctagtacagtgcctgagtgtgggtgtccactgaaaactaatttcagccctgactaagaaaggcatctcagaaatgaggaagtgtattttgggctcctgtggtttctgatgaaaaatgctgcaatgtggggcatgggtgaaagggaaacactgagaaaatagatgtgacccccagtatgcttccttgaagaagtggggggctggccaggccaggcacaaagatcctttgtgttccctgagcctgtgacttctcccgctgtttctcagcagttacactaacgacattgtggaggaaacagcttctccttgcatggccctgccccttgcactctagactgtttagcctccctgctggtcagtcccctctccctacaaatgccagcagctttcccccagtccttgctgcaaccacaaagtctcgcaaggattttcaaatgccactgggaggatagcggtgccacccatggagaataatgaccccaggccctaaaatgaaacaggttgctctaacattcgaagaatagccccagcacaccaaatgcattcacttaatttcttgttcaacagaaaagaatgacctcttttaatacagagctgctttgaaacatgtcatttcaaacaggtcctaagaagatcctgatatttgtctgtatcttaactggatctctgtgggttgaaaaacgctcatagaaatgttgaaggacatcagtcaatctttaataagatgagatttctcagagatacaacatgctgtttgaccatctgaaggatgctaaaagaaagtgatttactgaaataaaatagataacaaacatttcagtgacttagaaaatggcgagaaatcacgtcaggcaagtttatatttttgtgttaaaaaatccccacctaacaacactctcttccttacatttcttcccagcaggccaagaacttactaaactctggctctagaagaaaatgacattaaaatgctgactttacaggtatatagtctagcatttgttggcagttacttattagtttttttttttttttagaaatgtaaaaactattttctttgtttcaaacgaataggctctaacttaaaataatttacttgtacaattaaattgtctgaaaaaccccaacaatgctgttaacacgttgttaacaggtacacaactcccctctattttaggagctgacgcaaagaagacagcacaaacatgaacaagaaaacaatcgctgtcgcttaaaagcaacaccgtcttagcagtttaaagacagacactgcatgctcacatactaacaataattatgagtctccaactcagagggtagaagtcagaagacgcaaacaacatccaccgtaccaggaactgaagaataggaggaagcaggtttagaatagcaatgggtttttccctgagatgtacattttacaagaagcattcaattccattttagatatggaaaaagagcgtgtttttcccattaaaagggggaaacaggaaaagtataagtagcttgacccattattatgtcctacctggaaaaaagtttttttaagtggagaaaatgattagtcatgagtgcatgacttattaaaaatgactttctgggtaacagagaccagataatacctacgtgaataaatctctccccaaaccctagtttggggcccacacttttgcaaggtctccagtgagtaagacagtaaattctgtggctggcgttttctttggaacacaaagggtcgcaaacaaactcctactcagctgcagccactacccctgccaaaattgagtagctgaggattcagcgaagggttcgggttccacgtcacccaggtgctacaggagcctgagcccaggagcggggactgtcccacatgccaagagaatagggcatatccaggagtccaggcccatcacagcagccaggtttttacctaggtctactactctttccacatcacagcttcccctcacctttctccccctccctcacctgctcactgccatgtatgggaatgcaccccaggaaacacacaattttgaaaaacatcgtcccaagagaaaaaggctgtcatgaagaggccaggcaaatgacctcaattaagtactttgtccaatgctaatggattgaattctgttcccctaaaattcacatgttgaagtcctaacacccagtgcaatggtgctatggtttgaatgtgtcccccaaaagtttatgtgttagaaacttaattgccattttaacagtgttgagaggtagggccttgacaaggtgaggaggccacgagggcagagcccttacaaagggattcatgccattgttgcaggagtgggttagttatcctgggagtgggctcctgataaaaaggatgagtttggctccatgtcctctccctgtctcctgtgcttgcttcagcttctgccttctgccatgcgatgaccctcaccagatgctggcaccatgctcttagacttttcagcttccagaaccgcaaaccaaataaatctcttttatttataagttacccagtctgtggtgttatgttatagcaacagaaaatggactaagacatggtatttggaggtgaggcctttaggaggtaattagggttaggtgaagtcaggtgagtagagtcctttttgcaagaaggtgacagtctacaagccaggaggagagccctcaccaggaatcaaccatgctggcagcctaacctcagacttctcaacatccagaactgtgagaaataaatttctattgtttaaggcacctagaatagggcattttgttatagcagcccgagcagatgaagacacctaccaccactcagctttggaaccaggattctgaaccaaagcctatagatcctatgttcttaacaactgcattttactactctttgagaagaactgaatttagccaatcaatgtaatttcacattgattttcattacttttgctttcaaagttacatatgaaattttttttgcatggctagatatgtgctggatgactaagaattttataattggcatatcaataatcaaatcagttttcctaataaaatgacatgtctgatttctgcaaaagctcttcagtgtcctctcaaactgagaaagctggaaagtagagttttcaaaagagtaaaaataataataaaaaaaagttaaggcagtactgctgagaatttaaattctctgcaatgtcgaaacttttgaaatataaaacttttaaaaacagtttcactgaggtataccttacatcccattttagcacttgtaaaacctttgtctttaactgtattgtgataacattgatatcctgcttaacataagaaatattattttaattgaaaacattattcatgataatttaaaaagctgctattaacttctacatctgtcagtaaatctactaaagtttagttcaaaatatgccggcaaaggaatcttaaattctcttagtgccatctaaataaaactgtatttcttctaagttctattgtaaacaaagcaaaggactatgccagaatatatagcaattagagaaaaatgcctacttttcctctttgcacttattttgtgcgcttgtttcttgttttgtgtaggtttgatgattttgccaaattgcacggtcagcaaacagttcgttgtggtccaacacccaggatagggactatgagaccgtttgccaggtgctaggtggtgttcaatcatctcacgcctgaagctcttcatcagtcttctgttgctcaggctcttcactgtctccatcccacgtgatgaaagacaggcgtgtctctggccagggactaaggcgccatgagcatgtgtgctttgtttgggtgttggtgtgctctgactcatgctctcagtggccctcgaaggcaccaggtgaaagaagagggtcagacaaccactagccacagctgtggcagcctcggttcaaaaatgtaaaatctgccatgcaggcagtttcaaagacttaacctatgcccttgtataattattatttttacttcttttatagcaacgttcattttctaacctgaaggtggttcaggtgatgttctaatctgcttttgagtttgaaaatgcatctaccagatgattcatggtggctgccgaggtggtgaataccgaggatcccaaaatgaaaaattacggagggaaacttagaaaagtagtactctctcacagccagagtggtgctggtgaccctccagtccaggctaaaacaggtaagcaaaatatttgccttgtttttaatatacatcaagcaaaacaaggtttaactctatctgtggcatctacagcagctgtctccaagatggaggacaatgatggggaccaggaggaggtcagcagcctcaatggctgatgttctgaaatatttctgagcggagctaagggggaagtggtttgccaacattatcagtttattcgtttgtccatccatcatccatccatccatccatccaccgaacacctacaggcactgaccatgccagctactagaacccagagatgaccatgccacccagacagactccaggaggcactgaacacagacccaggtgaagttctgaggcccaccttgctccttccccgagatgtgcctgctggtggtggcagtgacagggcggcacatcaatgatgaggtggagtatggaagaatggaagcactgccaagactcctgagtggcagaggcccattctattatctgtggacaccctcgttgtatttctaaagaggttttctcacagagcaaaaccacctgataccctaaaatatcatttagacaattatgttattattgtcccaattcttacttccacgacaaaacagcagatgtgtcatctcccaatgaagatgaagacaaaactattctcaaaaagaaatggaagaaccatgaagtaatctccatttgagaaacagttttgcaaattcaaagtggcttctgtgaactttgttttggctgaaatgaactcctcccaaaaatacatatgttgagtcctaaccgtcctggtacctcacaatgtgactgtatttggaggtagggcctttaaatgggtgactaagttaaattgaggccattaaggaggagcccaatccaatctgctgggtgtcattataagaagaggagatttggacaccagacagagaaaagaccatgtgaggacacagagatagcatgtcatctatgagccaaggagcaaggcctctgagggaaatagccctgccatcaccttgatcttggacttccagcctccaggattgtgaaacaacacatttctgttgtttaagccacccagtctgtagtattcatcatggcagcccaagcagactaacaccactgccaacttaagagcatgtaacaatataaaatatgcccatctcaaactaccaccttcatccttataggtctctacagttggctttaatgttctcaaggaaaagcctctgaaagaaaatgatgagacaggaatgtaatgaatgtagcttcagtcccccatactaaggcatgcccccactacctttagatccatccaatggagtgggcagagctttatcatatagccgatagaatctgtatcctgctatcaactaataccaagctgtaagtaactcattcacatatgcacaactcaatgcacataactcaatgatgttgataaagtcagacaaggaattctatgacaacgattaaactcaccttttcaaatgccacattttggtaatcatctggaatggggctcttgtttttaaaactgggaagacccaaggaaaatagtagaaaggcttttaaaggcacccgtgacgctaagggaaaacattagaatgggtgcataccaatagtaactatttttaatcttatgtcctgaacactcttcctttttggatggtgtgtatgaaggtctgtggctggcttctaaactggaaaagtcacagatatttacccttgcagaaaatatctataatcatttcttccttggaaaaaataatgacaaaccctgaatcacatttcctaaaattttaaaataatgatgttgatttgctggtttatttgaaaattccatggtaataaagtaaccaattaaatatttaacctacttttactgggacaattgagggaaaacaggaggaggcagaaggcagctctctcactggttcaacaattcttcagctagtccaaaacccatgttctggtgattggtgattctgaaatacagctgctgaagtttccacactgggacacttcccctagtgaacattcttttttgattctttaagtcaatcttaaagaattctgaagtctcccaaacctttgttcattggacttccagcatttttcccttgccactaatgtcaaaatcccttcttatcccactaaactttctgaactctccctgaatgttggaggatgaagacaagtgggctgtgtaaaaaaaaaatcttagaatgaagacttaggaatagcgatcatgggtcccaggggaagacttagatgaccaacagttctaaccaccttccttgctcagaaagtgtccagtcaatggagaaaggaaggcattattagctcttgataaggctttggcagaatttgggacagatggctgtgtgctcagaggatcaagtgaagtttaagatacaaggtggaaaggccagtaggactcacgtgatgtctctatcagggttcctctccatcctagggtgttcctcactcctgctggagggctggtgtttatatgatgtagagaggtttgaggtcttggatacagaagggctggctctgcattactagcgttagaggcacgataccctttagggtttggcttcttgttgaactctacagatgttgtttggtatatagtgtccaagaacagtggcatcacctgtgagcttgccagaaacgcagaatctagagccccacctgagatctactcaaggagaattttcattttaacaagatccgaagtgactcctgtacatagtaaggtctgggaggcattggtctaaggtagagggggaggaagaacatgccaatttttaccacgtgattgctaagtgatactatgcgatgttaagttgggttaacttccagaccaacaattctccataggaaccctgccaggttaccacaaacggcaaacagggcagagaaacagggcaaacctggtttacgagattttttccagagaaaatgtttaccaggttgccaaaggcatcagaatcaatggaaatgacatcaatattcaatagtagtgtagccactcacatgcagactccattcctaactgaattattccattacatgtgcctattaaaaaaaaaaaccaatcatgcacacatagacacataccaagctgtcattattgaatgcctattcatggatgtatcgataataaaagacagtgaggaggctgacttgattatattttaactgacttacatgaccaataaagcaataaacttatttccctccatgggcaattttagtggttgagtatatttttagcatttccctctggagatatagctttatgaacttcacatgacccaaacttttaatccaccccatttgcgcaagtttttctttttctctttaataggatgatagaagactggaacataactgcctaattctgaatttcagactatctttctaaacacagcacaacacagggagaagcaactaccttctagaccataaatggcagagatctagaagcggccagacaaggggtatgagaaaaagtattacaaacaaaagaaacagacagatgccacatttttgtagcagcaactctgcggaagccaactgcttctcaaacctgacccagcagccacaatggacttttagatgaatgatccctcaccagcggagctcacagtgggggtggagatccattccagctgatagtagggacgagcaagcaactactgaaagggctttggtgcttttgcttcattggtgcttttcagttttatttcaaaaattataataataaaaaaaaagactctaggtgtctggatcagtatgccacatgatttatagcacataaaatcatggaaagtcatgccacttcctgatagcacacagctcacgctggccactgaaaccttttttctgactaattcattccataccgtagttttccatggctgattcataaccatatcctacttttctcatttcctgaaatgattctgatgaagcttattccacataaaaagtggaacaatatataaaacccagacacctaggtacaatttaaaaatcttaactctaaatcccaaatcaacatttggccatacattcctaagatgaaccactgtttctggattctaaaggacactgtatattccagtaagcaagcctgtagcacagtgctgggttcatgatcaaaacgcactgagttcattccagagtcagctctacttgtgatgaaacaaataacctataaagcgaaatcttttcagaccaaagagaggtctgaaatcgagaagaaacataatgaggatgcaaaggggataagaagcagcaactacaccctggctctgtaagacggcatgtcattacaccttactcaaagggactcctcaatatttaatcagcgattttttacattattacctaaaggaactggagtactttaagttgcctcaatttgctggcattttaaggaagataaatgctttagaattacttatgattaagacaaaaatctcagaaacaatgcactattcgaatctttagctagagctctcgggaggagagtaaacaagataactctactggttgcttctcatactcatcttctttctttgagacagaaatctttttattttcctagttagtaatcaagtatgtgtttctatggaaaaaatgtaaacacattttgaattatgccatcgctttcaccttgaaatcattattttattaagaatcactcagtatttctaactacctactagcaagtcatttttagaaatctttctttcaaagtgaattctgtattaggtgctgaaagtgtggtgctgaaaccacagagctgctgatacatctggaggctggggtaaacactggctgctgaaaccaccaggtgagaggcggatcaggaattgcagaagctgggccagactgaacacacctgaagccagggatggtgcttttaacatcacagaaggagacaatcagtgatcacatgcgtcttggtgtacagcaatagtcagtacaggatatttcgtgtgaagtagtcttgtccaaataaaaacaaaacaaaaacaaaaaactctgatttttcagcaagctcccaggcctctgagtttagataaatagatgtatattagtccgttttcatgatgttgataaagacatacctgacactgggcaatttacaaaagaaagaggtttaatggactcacagttccatgtaactgggaaagcatcactatcatggtggaaggcaaggaggagcaagtcacatcttacatggatggcagcaggcaaagagagcttgtgcagggaaactcccatttttaaaaccatcagattttgtgagccttatttactatcatgagaacagcatgggaaagacctgcccccatgattcaattatctcccactgggtccctcccacaacacgtgggaattatgggagctacaagaagagatttgagtagggactcagagccaaaccatatcagagggaatgcagagatgtgctaaacagtgctaacagtgcacttgctgtttccagactgtgggacagcctatgagacatatgaaaacagtttcactggggacctatgacaaaggatggagaaaccagatgaaaagagacagaagagacagatcactgaaatgcagtgagtgcctcttatttggattctaacgcaaacacgctaattataaaaagacattcatgagccaatcggggacatttgaacacagaatggatatttggtgatattaagaaagtacatttactttatttttgttaagtgtccttatctcttagagatacatacaaatgaaatgatatgatgcctgggatatgtttaaaatgatcccatgattggcagggtggctcatgtctgtaatttcagcactgtgggaggccaaggcaggaagattgcttgagcccaggaggtcagcactgtagtgagctgtggttgtgccactacactccagcctggcgacagagcaaggctgtgtctcaaaaaaaaaaataaataaaataataataataataaaaaaataaaattactccatggtgggaagtgtgggaaggaggattccatgtactgatcattgttgaggctgggtgaggagctgaatatagggagttcattagaatatcttccatgcttttgtatacacttgacaacctccataataaaaaggtatttttaaaaaaataaaaggcaggccgggcaccgtggctcaaacctgtaatcccagcactttgggaggccgaggcaggtggatcacgaggtccaggagattgagactatcctggctaacacgatgaaaccctgtctctacgaaaaatacaaaaaattagccgggcatggtggcgggtgcctgtcgtctcagctactcgggaggctgaggcaggagaatggtgtgaacccgggaggcagagcttgcagtgagctgagatcgtgccactgcgctctaacctgggcaacagagcgagactccatttcaaaaaataaataaataaataaataaataaataaataattaaaggccaaaaaaaaaaaaaaaagagcagtaaagacttgaggctaggtgaggtggtacatgtctgtaatctcagcactttgggaggctgaggcgggaggatagcttgagctcaggagtttcggaccagcctgagcaacatggtgagaaactcaatctctacaaaaaatagaaaaattagccggacatggtggtgtgcgcctctagtcccagttacttgggaggctaaagtaggagaatcgcttgagcccaggaggtcgaggctgcagtgagctgagatcgtgccactgcactccagcctgggtgacagactgagaccttgtctcaaaaaataataataataataataataataataataggtttaaaataaggtcagcactacccatgctaattctaaagggatgtggcataagatggctttcacaataaaatgtacaattcatacaagttgaaaatatgtaatttaatttttaatgatttttcaagtgaggtctctgatactctgatgatactaaaaatatacaacagaactctcttggaaatagtttatttttgcaatcattgtaatacagtcagtagcaaaaatatttagaacacttttcaaaaggctaaaaaaatatgacagaacgtttcagtgcaccgttcaggtgaagaccaagtattattgaagtttttgtttcttccaatgtaacagaagaatactgagcccagtggtgtgacgtcaatcacattacctatgaggttgcagggccatgctgagaagggtgctttcactgcactcctgatgaaaatatggggacacatttatggtcctttaaaagctgtaaaaggctgggcatggtggctgacgcctgtaatcccaacacttgggaggccgaggcaggcggatcacctgaggtcaggagttcgagaccagcctggccaacatggtaaaaccccatctctactaaaaatacaaaaattagctgggtatggtggtacacgcctgtaatctcagctactcgggaggctgaggcaggagaatttcttgaacccgggaggcggaggttgcagtgagccgagatcacgccactgcactccagccttggtgacagagtgagactctgtttcgaaaaataaaataaaattaaattaaatttaaaaaagctgtgaagaccacaccagagcccctggtaaaggtaatgtccattcggctagataagccacatggacacctcacacttggatagctcactccagccacctatgtcagaaacactaactcataattcccacaacgccccactgaggtgtgcaggtggcagcccacatgtttctgttccatctatggaaggctggtgcaggtcacgtgattgctcaagtcggggaatgagtcaaagggaaggctagaaagacagtccaacccaacaccctgagatcccagcaggcacctttaactatcacagtgtgcctttgccaagcctggggaagatgctaaaatgagtgacagattcagttacattagcaagtaacacgtggtggctttttaaaatttgagacaattttttaaaatagtaaacatcaacacaactttctcatttaacatacttgaaagatgagaaaggtggtggccatctttcacaaaaaaagatgatgctgatagatttaacagccactagtgatgaagatggcgatgatgaagatgatgagaaatagcagcgatccgaaattgactgccagtcacctatcaggtatggatgtaagcagtcaacactcactctctcatgtaaccctcaagccactctaggagacaggtactatcacttttttataggtgaggaactaaggctacatgttgtgcttaattctcttggatgtccgacctggaatcagaatttgaggtaaagtgacaatgaaattgtacccagcctaacacaaattcttaaaatagtgaagaataatccatcaagcctgtgatgaactatgttgacaagttcaagctgttgaggaggtgcttgtgcgttactgatagaaaaggataatgcttttcatgctgccgaccattcacaagacatttggctattccataaaagagattctccctctcgaactccgagggagaaggctgtttcaggttcccatcaccaaaccactctgcagctggggtgccctgctacccggtgcaggagccctgcaccaacactctgacaaagaactccatgagacagtcagagatggaaaggtttgccaggccaggacttcctctaggaaagcaggcctcaggttcagacctgtttaagctgacacccaactccacctccaccgtgactgagaattgagatgactgatgagctggaatgatcaagaaaggctaagaatcatcaggaaaggaaatgatcaagaagaaaacgttcatcattgtttaagaaggcagggttggactgtccattttagacactgattcctcaaatggttaaacatcacatttctaacaaccaagaggctatatacccttcagctctacagaaaatctggccatctcaaacaacttaacgtatttcctaaagattttgaattgtagagttttactctggtttttcaaggaaccacggcatcttcaaaaggacactggttctaggagtctgaagtcctggtttctagctctcgcttttccagtaacaaactgagttgcactggggagaacatttcatctcctggatctcgccctgtctgtcgcaaaatcaacggtaaaggctccctgggctccaatgctccaatggaattcagggaatccaaaaggatgtgaccggaaagaacacaatcatggataatctcattcagcttatataagtgaacaaagtgtgggaaagcaaggcagaggtattagcactcaagtgtattaatatctatgctaatggaatactacaagaaacattccacctaaatgctaaaaacaggtttccaattaatcataatttaacaaaatacaaattgctgtcagtctagctacatgaaattcccactagggccactggaaattgagagaatgcaaagatggatggatgtagtctacttattccaggaatagttggaaaatttggaataaggccaggattagggaaaaaataaaacaaaacttgcctgacaaattgagtagtgttgggaagtttaatacaatctgtgactgattcacagcgcaggagtctttctgtaagaagagccctgtttgttctgggcagtggcttatatgttcaagaatgagttcagatgagtgcaacttcaagtagagctccacaatgaatccaattacgtaggcggccaccacagcacttctttaactttcgtaggcaaggaagaagataaagaactcatttgtaaggtatacaaatgccctgctggtaatggtctaataagcctaacaatttaaatgccatgctctgaaataaccctttgtttcggtggattgagtcagccaaagtatccggaactgggtcccacagagggtcctgatgttctttggaacatagctcacattttccagtttattatgcaggttctgactgataataattctgtcacagtcaacctacactttgcagtttacaaggtcatttcacatgtattaactctttcaagtttctctaaaacctggagaggatatagggaaggtgttaactatccttacctttgaagaaaggaggcttggtgaattgagactacttgcctaaggtcaggcagctcacaatcgccagcatcaacattcacattcctgccctgtgattctgtggtcccggatggctgtacccaaatatttcttcctgaaggtctttgagttagtcctgaaaaaggcacggttcaggtacactgacatgccttcaagtttccacggtgagccagtgaacattacttaacgagagcaatggtgagctcatgcagatctcaggctctgaactgagaaaatgttcagaccattaaaaaacctttctccccccaacaattttgtcttttaatctaagaagtcaggttcttggcatttctgaccactctaacacaaatccagaatttgcctaagcgagcaaaagaggatgcacaaatcatgactgtaacaagcctggtttagtctgacggggttgccggtacaggcacattctaggatagatgcaggcagcccatgaaagtcccagggaaagaagtccacactgggaggggctaaaagcttcggacaggtggctaattctaaagttccttctgtgaactgctccacataagcaaagcaacctagacttccctaagaatttgaaagcaggatcttactttatcatttttccatcttttacgcttagaacaaagaagtaacaaagaataagaataaaaatcaaggagaaagaacagaggcaaacaatagtgcccatactgatacttattttaagattgttgatttttgtgggacatccatttcctggaaaactttacaaaagaggattgttgtaaagttctaaatgatgaagacagggctttataacggaaaccatttctcaattctttaataattttaatacttaataattagcaccagaagaaaatttggttgaagtgatgacaaaaagaaaatcatgtgtgaaaaattggaaatattgacatgatttcacaaagacatcagaagaatgatacatttgtgcaggaagtacagtaagagcctgggggaagctaaatggaaaattagtggtcaaataaagaaacaaaagagagcaatgtccagtaaggccattctgactataaagccattctgactatactcttacaaactgatgtgatttggctctgtgtccccacccaaatctcaccatgaattgtaatctcgataatccccacatgtcaagggtgggaccaggtggaggtaattggatcatgggggtggtttccctcatcctgttctggtgataatgagtgagtttcaggggatccgatgattttataagtgcctatcatttcccctgcttgcactcactccatcctgccgccctgtgaagaaggttgcctgcttctcctttgccttcctccatgattgtaagtttcctgaggcctccccagcaatgcagactgtgagtcaattaaacctctttcctttataaattaccctctctagggtagttctttatagcagcatgagaatggactaattcacaaactagtgctgtgttgacatcatgatcagagtaaatacgggataaaagttcccaagctatgcaactttctccagcaggagaaacttttttttgggcaagtggttactttaaaactttatttttagtacaagggaaaatgatcccaaaagtgtatttgtaagctatggtttgactatttttgatgtcaggaactgtgattcacctacaatatccaacttattttagatattattctaatgctctctacctaaacaaaaatacatttgaaatagtgaaatctttctccaagagttaaaaatgctggagctagttttgcttggctggtctgaaatacttgaaagcagaactgcaagaactagcactttctggaaagtgttgacctctttctggataattttataaagaagttagctacctcagtaaactgtttatgaaaaaaagagaagctaaacatgaatccatgcacagtgtcaatgcttttgatactgaattctaactcaagacctgaattttaactcaagaatattccgtcaatattggcccgacgttcagggccacggtggtcccacagctgaggacagctggagcacgctgggctgctcctgcccactgcaattttctataggcacacaggattgagggatttggttccttaaaaggctcgagatcctatcccttctcattcggagactacccagaaaatccctggtcatttatcactgcagtgcactggtgccacactcaattacatttccttccatgtgactgcattaaccagagtggggcactcccagatctgccccatactttctgtgaggtcatactgaacaagcacttcaagaaaatctgactgaatgctccatgaattccattatgaaggcatataaaacaatcatcttgctccatttccttcaggggcaatttcttaaggctacgttttggccagaagtcaataaagacttcatggagcaccgatttactctgcagtgacatcttttggtacattcttacgctcctggaaaatcaaacactctatattccatgacttccccgaatattctgctccatttggtcatcactgattagatgcctaccatgtgccaggcattcccaggaaagcgtatttccatggtggcatatgaataaagccaggtgacaaatgctgtgggcaaggggagcatgcacagagggtccccaaggagtgatgtgggagagcagaggcgacatgggtggtgccacctcagtccctcttcccaaggtgctctcactcacctgaaacttatcctagactttgaaagtctagaatactttcaaaaggacactttcacatcaactcaggcaaatgcaaaagttaaattctccattgtcaacggtggtatcagggctctgggctacccaggatcaaatcccagattcgctcagccctcgccacctttggtaagttatttgatctccatgtactttagttttctcatccataaaatacaataataataacatggtacctagcttgtgcagtggtgatgaagattcaatgagataggtgtaaaatgctcatggtacccagtgatattataataacgcacagtaggatattcttatctacgataatcagagatcctattcatgttgcatccatggcaacctgctgccaccagcacgccatcagcttatcttattaagttgcctattttgttcctcttcatttccacctttgtttgacacacagaacagggactcttccataaacaaaccttttaacttccccttacctccacacgcacaccattgccatcagtattgattgtggtgtccgctgttttcagggtaaaggaacatggggagacaaagaccccaacttgttagaactaacatctaaagcagaaagccagttctctcactttagccaccagaaacctgagaatacacagtaaaatctagcataaaactcaacttggggccaatctgacagaatatttttgagttaaaatttagggtttattgatgtggacactgaaaagtaatccaacctttctggaaaaccatttgacaaaatgcaatcatatttataaagggtccgtagtcttgagagttggtaattccatttggggaaattattcctacattaaaaaagataagttgtataaagatgtttaagtctgctgtttatgacagaaaaaacatgtggggaaatgaagaaacagctaccgttcactcagcagagtgctggtttatcagcaccaagggcagggaagcatgaaaaggcttccagaactgcattgaacttagcatggctgaagtccatggggtagggcagtgtattagtccattctcacactgctatagagaactgcccaatggccaggcacggtggctcatgtctgtaatcccagcactttgggaggctgaggcaggtggatcacttgatgtcaggagttccagaccagcctggccaacatggtgaaacccatctctactaaaaataccaaaaaaaaaaaaaaaaatatatatatatatatatatatatagagagagagagagagagagagagaggcaggcatggtggcaggtgcctataatcacagctactcaggaggctgaggctgaagaatcacttgaactagggaggcggaggttgcagtgagccgagatagtgccactgcactctagcgtgggcgacagagtgagactctgtcccaaaaaagaaaaaaagaactacccgacattgggtagtttataaaggaagaggtttaatcaactcacagttccgcatggctggggaggcctcaggaaccttacaatcatggtggaaggcacccttcacagggtgaaagaagagagaatgagtgccagcaggggaaatgccagacactttataaaaccatcagatctcaggagactcactatcacaagaacagcatgggggaaaccgtccccacgatctgaccacctccacctggtccccacccttgacatgtgggcattatggggattacaattcaagatgagatttcgggtggggacacagcaaaccatatcaggcggggggatcacagggcaggaaatgaataagaaatgaagctggagaggcaggcaggggccagatccattggtggaggaacccggacactgtcccataagaactgtgagactgccagaaggaaggaatgcagccaggctgcgatttgggggaagactgccctgggccgcccagagcctgatgtgaaaggagactggggaaaggagagaacagggaggcagggacagacagccagggtagcaaggagggccaggccagtgaataagagtggaatagcaacacagcggagagtcacaaccacatgaaatgtgggttgtgatcactggaaaaaatttaaagtaaagctgaagtaatgtaagttggatacaatattcattaattatttttctatgaagtttataaaagcctcataactataaatatacatatttatattttaaaatcctgggcttgacctctgcttgtcatctaagatagtgctacccaatatgtgatcagtggggaggggccaacatgtcatgagggaaaaccagaaaaagagaattagcctttaaaacctttaaatttatcagaaaacttgtatgactgttggaactaataagaaaaagctgaccgggtgtggtggctcacacctggaatcccagtgcttcgggaggccaagacagtaggattgcttgggcccaggagttaaagaccagcctgggcaacaagtgagaccccatctctaccaaaattaaacaaacaaacaaacaaaaccagtcaggcatggtggcatgcacctgtgcccagctactggggaagattgcttgagcccaggaagtcaaagtcaacaagtgagccgtgatggtgtcactgcaatctagcctgggcaacagagtgagaccttgtctgaaaaagaaaagaaaaagctaaggcttgtattccatgtctctttttgttccacttcattcttctagtaattcacttttatcatattatgtttatccgttggcaacaggttggaaatttaaacaaaaaccaggtttccctggtagatagtttgagaagtgctaactaaagacatcacattcctgctgggctttcagggcttggcagtgcacagagggcagcctgctccagctcacactctgtggcaatgtcacctatcctatcccgtgccctcaaatgggggctactgctccactgacacgctggttgggaaggtgagggcgctgcagctgaaacagctgtattacacaggagtacagccataactgaggaagatgcttctttaataaccacttatatgagtgtgtgtgtatatgtattgaacaaactgttcaacagatgggaaaacatggcctacacaagaaatggtgccactacatagccccagaactctttcctgaccaacacattcattttttgtcattttaaaatgcagtattaggtgaattcaatgagcctccttctatgtgtgctcggcaaaatgtgtggcttacataactagcacaaagagctggtataccttgtgatataatacacttcacagtatctcttccccagcgaccatgtatacacatttgcctgaagctctgcaagggcggagctcacacctgggttttgctccccaatgtgtgtgtgttcgtgtgaaccatctaccaggtgtcggggctggagactacgttcacgcaggaacactttccgtcacctgctgaacctgctacgtctctggaatgtactacacaacagtacagcagaagtggagatatttctggcctaagggaaaggggcactatttcagagctgcataaagatgaaatgggctgtctagggacagaggaagctgccttttcctgcgagtaggtagaggccgggcaaccatgtggcatgtggctgggcagtccagccccagagtggattgcttctgggcaaatgactcccagagtcttctcctaatccagggtctccaaattctgtgcgaaccccagacccactcaatattccaggactagggtctgtggcaggttacccttcctgaacaaatggccactaacattccctgagtccacatggctgaaagttacacttcatggcaacaaactgtaaataaaatatgttccattttccttccttgaaaacaaatgtggtcacagtgacctggaaggccacattcaaatttaggattctcagctccctggagtccctcactggaatggacaaagaatggagagtgggaccaggcctcacctgaagacccaggccttacctgaaaaaaaggggcagaggaggggtcagaagcacaccaagcaaactcacttcactgttctctgacctgatggtttttgtgttggtccctgctgtgttgctctcagggaatacctgagactgtgtaatgtataaagaaaagaggtttacttagctcatggttctgcaggctgtacaagcacgcaccagctctgctcggcttctggtgtggcctcaggaagcttctactcatggtggaaggtgaagggggagcaggcgtgtcacatggcaagagaaagagcgagagaggaggaggtgccaggctcctttaaccaaccagctcttctgtgaactcatagagtaagaactcaactcactactgcaagaacagcacccagccgttcatgagggatctacccccttgacccaaacatctcccaccaggcctccctgcaacactggggatcacatttgaacatgacatttggaggggacaaacatccaaactacaccagctttaaactaacaaacttgatcaatggtactgctttgcctcccacctccccaccccctaaatcctgctgtggttctatgtaaaatttcaaaatttgtgtagacacaaacaaaatgcttcaaagtaagaaaggtacaagtaatttccactaaaaagaaacccccgaggctgggcgcggtggctcacgcctgtaatcccagcactttgggaggccaaggcgggaggatcaggaggtcaggagaatcgagaccatccaggctaacatggtgaaaccctatctctattaaaaatacaaaaaattagccgagcgtggggggcacatgcctgtagtcccagctactcgggagactctggaatgtactacacaacactgcagcagaagtggaaatatttctggcctaagggaaaggggcaggagaattgcttgaacccaggaggcggaggttgcagtgagccgagatcaagccactgcaccccagcctggaagacagagtgagactccatctcaaaaaaaaaaaaaaaagaaagaaactcctgaatacttcgaaagttgagaacacaagctctaagaggcatacttctgttagaaaaaaaatatttcaccactcatgctaatctgaaatctattttcaaattcagaacttcggtctagttactgactgggaaggtgccaaggttctacctacacctaagaagtccctagcagcacgggcgccactggaatttcccacttgtcgctgctgttgatgcaaggaaatcgcaacataagaggaaaatggggttggagccacgaggcttgcttttgccacttatcttccagagttcattctgctacatggacagaagataactggagtgaaatagatatttccctatgttccttctgcatttggttggtcaatgtcaaagtaaggaccaaattccatctgatagctaagcgcacagaaggggctcggctctgggagcagtgagggtgttggcggatctgtatggcaatactcttaagacagcttccaccaggatgtgagcctcctgcttgggacctctgccccagctttcatagcatgccatggtccctttagaaggaagcccgaagtgcacattgaaagctgacctctgcttcattcagcactgcagctgcctggggccacttccactgacctcatcagcccctacaatcggaattcagccttgaaatctagacacttttttgtgctcatgttagaaaaaggaactaaaagtgctctacctttgatgcaaatctcccccctgcctcccacaaatccaacacaggaccttgctatatataattagatgagctggcaagagcttgacctcaaatgtttttttaacttttcagttaactttgagaatttggttttccaacttcacaatgaagtgagcttgtaactttgagtctagaaagtgtgtttgttggcgagatggcagcgatgcccggagtcacggtgtgtttgtgccaccttggttccctgtgtttacagcagaatgagctcttagagggctctccttacatccactggaggaattgcatgctaatcatacgtgaaggaggtctttaagaagaaaggagccttgcttctctgaggaatcatactcatgaattgctggggcagaaccagcaggcagcgtgcacttgggcctgctttccagtagctctgagaaggcccagagccatttcaagtctgatttcatttcatcccttttttcttcaatgtcttcctttctgcaagatctttcttagtgtattagtctgttttcacgttgctgataaagatatacccaagactgggaagaaaaagaagtttaattggacttacagttccacatggctggggaggcctcagaatcatggtgagagacaaaaggtgcttcttacatggcggcggcaaaggaaaatgaggaagaaacaaaagtgaaacctctgataaacccatcagatcttgtgagacttattcactaccatgagaaaagcatgggggacaccgcccccaggattcaaatgatctcccaccaggtccctcccacaacatgtgggaattatgggagtacaattcaataggagatttgagtggggacaaagagccaaaccatatcacttagtgtgtaaattttagagtagcctctgagcagtattatttagtcacactataggttgcataggtttctgtgggcttgagaatacagtattgtctctgtggaaaatgccttccagcactaaacagcaagtgcagagagagaatttttttagactatagcttatttttgaagttggaagaattgctatataggaatcaccataaatcctaaaagactgggcctcaaataagagcttttttcttttatctcaaaataatttaatacaaatactaacaaacgcacctttcttccatggtgatgttttatgtgttaccatatcctagattagaaacccacttatgatagcatctatgagctcagacagaaaggcagggcctgtccttcctccacctgcctaccctggagtcactgccagaggctaaggtggagaaatcactgtggcagagctttcaggatggagtgcctgatgggatacaggggaggaacaactggagagaaaaggaaggaaaaggaaggaaaaagcgactcacaatttaagcacatcctgtgtgccagcaactgtgctaggtgtttatatatatcatcttaaatttcttatcttggctctgaggtaggtgttatttacattttacagatgaggaaataatctcatgtcataatctcaaacaataaagaattcaagactttgcccagggacactgattaattccttcccggatccagtctttgaatgcagagaccacagggctcacaagatccactcaaggggcttcgggtggggtttggtagaggcaaaggggctggaggaagggaggtgaaggtagtggtgggcctgcccatggcttcttctggaagctggtggcacagcccaactacagactaaagttgaaggacagacgggagggcccaggcccaagctccctggggtagctgaaggaccctaaatccctatataaatgcagtgttcaataagtgtagtaactgtagagattttttttaaaaaccatccagtctagaaaattctagatagtgaaaaagggcctttcctttctaaagatgtagaggttaaaaactgttataggtaaaatatgatctggagaaaataagagaactagacaagtaagggaataataattaagaaaaaagaaagaaggagctttttaagcacaaggattctcaaaaagactagagtgatttgcttctgcatatagctttcgttacttaccagtggtgtaagaggtctggtaaatatggaaaaaacatcctaagaacaggatgtaaatgacaacctcttaggcaatatgagttaagattataaagcagcatgactgacgtcttgaattagtggtctaccactgaaacacgtggagcatgttttccacatatccatgctgagtggctcaaaactctttttgccttcatctagaacacttttttctgctgatacatctctgtcttgtgatgatagtggactcttttttttttttttttggaacactcaaaaccaaaatatgatacatgaagtgcacaatcaacccagtaacactacgataaaccaaaaatagaatgtgaccagaatccacatctaattttctcaagtgaacttgctccaaatacaatttaaaagagctacaaactgcttttagcacagtgctagaatatcctttttttatagaaatttacatgacttaggataaaatatattttttaaaaaattctttccccaatcattgactcaagcaagttgcaaactttaacaaaaattcacaaaaattaaccatgatgaagaagagtaaaaaggatctgttcttagaggggagttcctttataaacaaatgaaacatgtggccaggtgtggtggctcaaccctgtaatcccagcactttgggaggccgaggcaggcagatcacctgaagtcgggagttcgagaccagcctgaccaacatggagaaacctcatctctactaaaaatacaaaattagccgggcatggtgatgcatgcctataatcccagctactcgagaggctgaggcaggagaatcacttgaacccgggaggcggaggttgtggtgagccgagatcgtaccattgcactccagcctgggcaacaagagcgaaactccatctccaaaaataaataaatacataaataaaataaatgtaacatgtttaaatttgtcacattatttagttttctgacatacttgcaaaattatcctgaaaaaaagttaccacttaaaatcaattaaatacattttacaaaatttaaacttgtatctacctcttcaacagaagtattgtgttaaaatattaatgtatttttaattaaagagagcaaatttccctaacagtgtcaatcagtttgttttaaattagaactgtacacagaatacagataaaattttttttgagacagggtctcactctgttgccccagctggggtgcagtggtacaaacatggctcactgtagtgttacttcccaggctcgggtgatcctcccacctcagcctcctgagtagctgggactacaggtgtgtgccaccatgcctggctaattttttgtgaatatggggtttcagcatgttgctcaggctggtctcgaactcctgggctcaagcaaccctctcgcctcggcctcccaaagtgctgggattacaggtgtgagccactgtgcctgccagataaaaatttttaatgatattaaaaccatttagacaatttacttattgttgtaaattacaacaaatgcttttacttgcatgcctatcaaagacctaatttaatcaccactagtgtaattggtttaccaagaaactgtggaaaatgatcatcctatttcaagaagagctcccttttatcattaaggagacacagtacccagttgttccaaagacggtaggatggaaaatctgcagaattcaccttcaccttctctgaagcaaacacagaaaatcagtgggaccagaatacaaacagttaacccactatggcccagggatttcgcaagaggtcaaggtaaaaagtcctcgaattaaaaattccaggagatggctccctctgcccaatgaggactaggttgtccgagggctggactcatccacatgccttttgggtcccggacccactgcttctccagtggcaggcagaagatcacagaatactggaggcgcctgtagctccgacaccatgtgccctctttctggctcagttccattaactgtaaaataagggacatcctggggctggtggaggtggcacagggggtgactaggagctaatcagggggccccagggtggacccctacttcatgaggggctgctccactttgctgttttatgtgttggagttcagtgaaagaattcacttataaagatctgacattcagaacaacaacaacaaaataaaatgaaactgtttcaaaaccactgagcttgaccatctctaaggtttcttccagtctcaacattctaaagtccatgaaaaagggtgaatttggctgtattagtccggtctcacactgctacaaagaactacccaagactgggtaatttatgaagaaaagaggttgaatggactcacggttccacaggctgtacaggaagcatggctggaaaggtctcaggaaatgtataatcatggcagaagggcaaaagagaagcaagcatgtcttcacatgacagcaggagagagacagtgaaaggggagatgctatacactcttaaacaaccagatctcaaaagaactcattatcacaagaatagcaaggggggaatctacccccatgatccagtcacctcccaccaggcccaacactggggattacaattcaacatgagatttggatggggacacagagccaaaccatatccttggcttatctggactctcctcctagatccaagcaaatgtcagctaaaaattctgcatgcaagatgaaattattctcttgggtgaaatgttggttttacaacagtgatcaaaggatgctttttgaaaactgacttgatgtaaatggatagatttttagcagagaccattctgggaccaaaagttcccaacatcctttttttctcggttcttcttgggacacattttggcatggtaatggtgaatggggcagggagacacagacagactaagtcacaaacatggaaaaaggattatttagctaatcttttgtattaaccatcactgatggaaatattttgccttcactgagttccctcatcaatgtcctgttaccatgcttgccttgccaaatttcaaccctgctcctgctcataggttccaataatcgaacattacaaaaccaggccaactggtcccactacaaatgcagataggtcttcaaggctctgggtcaaactgccagtcaccacttttttcctctgtacatgtttcacaccttcttatgaccccaagtcttcagtctaagtaggtgacctcaacttccactttataaaactagcaaggccaagtgactcgagttcactgctcccctgtgtgctacaacatgttcctgcatctggactctttcttggtcctttctctggtatgtcaataaggagcattcctcttcctcccaaagataatgccatcttttgttccctcaattctgcatcttcctgcctcctccaaggccttgcttcattttataatcatgcctacttgtaatttttgttgtcgctgttacaatatacattgcttttctaattagaaaaccgtcaaaattatacgtgtcatgaaaacatataaaggaggaaaatataagacatacagagttcctatttaggaggcccagcattactaggaggcccagaaagaacagaaatcaaagggcagagcttaaggaacgctacaaaaatcctcaggttctaaagaagatgaattttccaatggaagggactcaccaaatgaagcctactatgaatacagacccatgtgaagacacatccacaaagcatttcagaatatccaagacaaagaaggatgtttcaagagagacaaaaaatcagtcatttgcaagggagtggaagttggactgacatcagtctttgcatcagctaaattggacactataagccaatgagctttcctagaagttctgagaaacaatgtccactggagaagtctacctgcagataagctatcaatcaagcgtgagggtgagatactacgtatattttcaagaaatcagacaactgacttttcattctcttttctaggggagaaaatataaatgtagtccagcaaaatgatggcataaaccataaaggagaaagacatgagatttaggatgcactagacccaacttagggacagagcgaagaagagcccccagaaggtagatcagcctcaggtcctgggaaaagccagtccagaataggaaacgtgaataatagaatgtttgtcataactgagaagatacaagaacttgaggatctgataaagcacacaatgcgtcaaaaaaagataatacaaactctaagaaaaataaaaatgccattcaagaaagtcagatccaaatatgaagtaaaacgtgacatgaaatgattttcagcagttgtttgagtgtaaacacggagtgtctgtctgcttccgcggctgagcacgttctcctcgggtgcctcccgcgtcagaagctagacctactcagaaggaacgtaatcctcaccagctgcttagctggcatcgaagaacatttttatagctgtattagcataaaccgtactgacaacttttcaggttttagcgtcaaattatgaataaaacatggacaatggttacggcatcaagtgttaatcacctaaatgtcaacgcatggctgatggaggcagaactgcacgggcagatgggaatcaagaagaaatgggaggaaactcacaactgcaaaatgtgagggcatctgctaaaactagttcatctacatcaaatgtttgcgaacagcacccgtgggtcactctctaccacatctggtcctggggtttctcagaggatgtggtcaggagcctctgtctgcacagctacctggcctttcttcaggatccgagcctgcacagtgtgcatcacagggctccatgggagcacaaacacagttcaccttctccccatctggagcggctatgctcatttgctagtagcagcatttcccacttccctcctttcctccttctcttcctccttccctcttgcctctcctacttactgagcttctagcgtatgccaagcactatggctgagacggtcttattctcaaggcgagcccactgaaaggaggtcaaacctacagcccggagaattgatgactaggggtgagaaagaagcttatgcaaagttaaagtgttttttatttcatttagatgtatatttttagagacaagctctcactctgtcacccaggttggagtgcagtgttacgatcatggctcactgcagcctcaacctcccgggctcaaacaatctgcccacctcagcctcccaagcaactggggttacaggtgtgtgccaccgtgccaggtgaaagtgtttttcaaaaggcatttaacataggaagattggtgactggacttcctaagcgcagttccattaacagcaacgacacgtgcaaaatgagctcctgtagctgaacctcagaagaagagacgagacagcggtgtgttaagggaccactagtgaccccaaaaggtgtcatttaatcctcaggacagccctgaggtaggcattattttacaaatgaggaaataaactcaaagaatttggacaggcccaacttaggtctgtctagcactagagtctgggttccttccatcacactgcatgggatccttaactctgagtgagccagggtcctgtggaattctccaaaactgctgtgccctataatatggtgactggaggggaagaaatgcaggaaagcttgtggaaaatttttattcatacccaacagctcaacaatgtagtttaccttagatgatccctaaggaaccacccagtgacatcattctctgattccataattgtccaacaagttcctccttctatttcccaataaaagcacagggttttgcattacctttgtcagataagtgcaataaacaagtcacagagctctgcaggttcgtacctgcaccacccctctctggaggctgtgtcctctacccgagctgttcttttctggcaataagagttggggcccctccaacggcagggatctggacagcttccagaggaacccaggacaagagaaaaagagccccagggacactgtccaactcggacacaaacccaagtgtggggtgggtggctgtgacacgttccaggcttgatggtatttttccctttactttaaatcagtctttgattgtcttgtgtgcacacaggaagaatgatgaatattaaaaataaaacgcaaatcagccagcaagtagtctttagaagaaataagtcacaggaggttgaaaacaatgtactagcactggagaagtctgaacattttggtcaatgtctgtgaatgtttcaaagtttaaactggatggagtttactgagactctaatcaccgctcagcaagaaatctatgctaatcacatcaatattataacacaaacaagcaggtggaagaaaatccaaagatagctaatggataatactttgtctttggttcaattataggacttggtttctaaaggagctgctaactcattcattcactcatcaaacatgtattgatcacatataacatggcaatgactgtgctaggagctggcaatactaaaattgtttcttcattccagaacatcagagattagttgggaacagagtcaccctctactgagaaaaggccatcagaaggccggcaggggtcagctccatggagaagaggtctggggcatcccaggcggaggcaactgcagtttccatcctacggtgccctgtgtcctgggaacctcaggtagttgagcaccactgcactaatgagctgagtgagggagaagcaagagctgagacacaacagggtccaaatgagaggccttattcacaaagtaaggattttgaacattaccttatgaacaacagataagtactgaagagtatctagaaacaggatagtgagatgatgacatacataggtttttagaaaaatcgcttgggccagtcatggtggcacgtgcctataatcccagcactttgagaggtggaggtgggtggatcctttgagcccaggagtttgagatcagcctgggcaacatggtgaaaccctgtctctacaaaaaaatacaaaaattggtcaggcatggtggtgtgcgcctgtagtcccagctacttgggaggctgaggtgggaggatcacttgagtccaggtggtagaggctacagtgagctgtgatcatgccactgcattccagcctgagtgacagagccagaccctgtctcaaaaacaaacaaacaaacaaacaaaagatcactcagggagcactagagggccactgaagagtgccggagaggaatcagaataccaggtaggagctgctgcgtactccaggcaggagtgttacatgaaagtgactgaaccaaggcagttatcctgagcacgggagagtggaagcaggctgaaacatcactgcttaggtgtgaaatctataaaacctttggctaatatgtaggagtgagagggaaggtgccaacaatatctccccactttctagcacaaacagtggagtggatgggagaggacaaaagaggggcagcaagttcaggaacagatcaaggctcagcttcggacacagtgtgaaaagtctgcggcatgaccgaggggacagcctgctggaaagtcagacagccaggtctggagccctgcagaggggtgtggactgtcagcccactgactattagaagtacagggaccaataagatgaggaaactgagggcaccaaggtcacacagtccagaggacaaccagcatgaaggccacatgcaaaaacacaaaagagcaagaggtgcgttagggaatgtaagatcttatattctccttgaccctcgtatctctgagagcttaccttatgattcttctcccctcacctgcaaatatatagcttgagtagcagatgaggcaggacatcataacgccctccatattaaatgagttccgtgaatagacaggatccagaaaataaacccatctgtttgatgcagaactaagaacattagattgagaaacttgaggtctcctgctgtaagcagccatcagccagcatcagccagatcccctaggaatctgcatcagaacaaactacctattcttatcatctctccactgggcctggtcatctgtgagcagggttcccaggcaggtgattgtcacagggcggcagatcagaacagacagactagttccagaccagggtcaattcctggtgtctgctctggtcttggtggccccactctgggccctgggggaatggacctgcccagggaggaagagaggctttgcagatggccctttgctaagggctctggaagaatctcctgaactttgtgggttctctaagacacccgccctgacaagagtgcctttccaagagtgcagggcatgttaccaagtgttaccagaagtggtctcggttgctctaaatacagcgcccaacagagtgggtcctcctggccactcggttgggctgtggtcacaccatgcctgggaagagcgtagctgggtttcccatcccgactccaacagtgacagatttgtgtgactccaggcaaggtcatctaccctttgggcccctggttcctcacctgaataacaacacatacaacaaacagacaaacaaaaacaagccaacaaaaaaaaggacttgcatccagtgattctcaaatgtggggtccctcaaaggtttttaggccagttgtttaggaactgcttggaagagttgttaaaaatgcgatgttatggccgggcgcggtggctcatgcctgtaatcctagcaccttgggaggctgaggtgggcagatcacttgagctcaggagtatgagaccaacctgggcaacatggcaaaacctagtttctaccaaaaatacaaaaaattagccaggtacggtggtgcatgcctgtagtcccagctacttgggaggctggaggctggggtgagaagatcacttgggcctggtaggcagaggctgcagtgagctgagattgcgccactgcactccagcctgggtgacacagcgagagtcccaccccccaaaaatgcaatgttaaagataaagggtccagatctttgaccccaggccttgggtagcaccagggcatctgaatttttaataagctctataggtgattctgataaacagctagatttgggacccactggactaaatgattactaagctgccttccatctctagcaatgtatgactcaatgcatgtatgtgacaaatgttcatgaccaattcaacaaccaggtcccaaaacctaacctagtacagttgcatcactcagacattacttatgcttgctaatgaatcactcttaggctttatagaaaatagagtaaaatgaattattcgagagtctcaaaatagaccccagtctcccatttccttcaaattacattttctaaaactgaaacacagtaccagccacaacccagtcctcagaagaggagagcgacaggttggcaggtccagagccatgagccaggccactggtttgcagttgtgaccttgagcagaagaatatttttttctttaaaattgcctttccactctgtaaaatagaaataaccactgctaacctatctcctagggctgctgagaatccacagggaaattactatccgtctgattctcccactaacacccggtgtcagagaacagaggggaaagtgtcacagtgcattactttcagacccaccgtgtctgcacaaatatttcaatggttcaaaataaaaaagagcccaaccaaggattcccagtgagaatggaagaggccctgtttgatttactttcctgggaagtcaagcccagctttagagcatcaggaaccatcttatctacccccgggtatgctagagacagaggccggcctgcacagcctggtcagcagttgcaactttctttagctaaacctgctggcattcaggcctgatagtaggcagggtcagcgcaaatggaaagaatgacagtgtgtccttccaccttcctgaggccctggctgatatggaaactggctggcacgggtggccatggaaagtatgaatccaggcttgcctagggttgaatgagtgaggaatgatcagatcaggcctgtgttaaaatatcaccacagctcacttgcccggctattatccagtcacgtcctccgggtttcaggaatgagatgctgcaacccgaagcagctggagacagtgtttgcaaaagcaggccaggcaggctccttggagctgaagctgggtggagagatgggtgtggtgactgcctgcacagacagacacctgtgaagggctgacttggctcccggatgctttctctacagttcctcacctttgtgcatggctcaccatgatctccgccccactctatagatgaaggaatccttcctagagaggtcaagtgtctggctggtgcttgcacgaagaagggacccaaatccaggaccctgtgatatccctcctggccttgcaaactttctagcacctggctgtctcgtgcacctacgtatgcacatggatgctgtaaatcaaggcaaagcacaggcaggcaggcaacacaggggaggtctatggaaaaggaggggtgagaaggaagaagagagttttaggccaaaagctcaaaaatgttctttagacaagcactaggagaaccacccagaagtcacgagtcgggagttctaagtccttgtggagatggacccaccgttgtctcagagatgccttagtctctacagggaaaaccactgaaaatgccttctagactggaaagtctaaataactaaaatgttttcacttctctaataacttttttttttaaggtcttagaatggaaagatccctattccaacgtcccaaccaaatcaagatgctgtttctagggtccaatccctattccaacatcccagccaaatcaagacgctgtttgtagggtccaaactgcctctgcttaggcagttctcagactgggtagagaaaggaagactacaagttaaggagtattcaaaaacaaaacaaaatgagtatctcagagagctgaaaaatgaattgctgttgcccccaaagaccctttcagtctgaggaagtattattcatgcccctctgccctcatacctgaaaagccccctcaaatcaaagatgaggaataagaggaagaagaaggaggaggaggaaacagaataaatcccctgctccacgtctctggttatggcagtcaagcaagcctaaaagaaaaacagccatcattcccagggtcaatgccagtgtatatgaggaaaaaaaatcactaaaaatgtaaagcctccattgcctacaggccctaaaaatattacacactatcagggcactttgcatgaaagttttaataccgttattcatgaaaaaaatctttgaaaaaaaggcagcccaggaagtggctggcctacatgtggaccaaaaggcaggctgagaagcgtgtctcccacgggctctacagtactcttgcaaagcaactgcctctccatttaggtcgcagaattggggactagccttgttagtgacctcccaactctaaatttgctatcaaaatgccaacagggccgatctctttcaagccagacgagtcatctacccttgtgggtagcttctcaactcatcatccaaggcaaggtgtattctgggcacgaggtaggggaagatgcaagtttctcccgggggttgctttggacctaaagaggggtctatgctcattaccaaaggcagtctgcccagcataacctttgacaccacggactcacttgagccacagaatgtcatttatcaatttaatacatattcatgaagcaagtgctattcttaggtactaagaacttccaagctcctaaggtactgggcacctagtggtaaatgagacaaaagccttcgtgaagctgacgttctagcaaacacagacaacaggcaattatataccctgatgttggggagtgaccagtgctatgaagacactttgaggacagatggtctggggtggggggaatggtgcgctcgcttagctaggggctcgggaagacatttctgaggaaggagcatctgggcagcgacctgggaggagtgagggagtaagccatgtgggtatctgggggaagaaccttccgggaattccaggctttgaggaagggaccacacttggcacatgggagcagtagcagcaaggccagagtagcccagctgtggtattggagacgcgaggaggagctgaatctggagagggcagagcgggccacgtcctcacatgcccaggcaagcatctggagcccgcgctaaatgtgctcagaggactcagagcaagagagtggccaggtttgattcatgttttcaaaacaccactggctgctccattgagaggcagagctccagagtgacaagagggaagcaagaatggggaggcttccgcgataacacaggcaggggaggacactggtttagacaggggtgagagagggagggtaaaaagcagaggagcccagaacatcatctgaagaggcacccaggactggctgctgggttggctgtgcggtgtggagatggaggctgatgccattctaaagagtgtcagagagagagagagagcctcttgctggttgttttaggaacaacagtgttggctaataaattcctgcagacactctgaatataactgagagagctcagctggctctaacagcattatggactgaactatgttcatgtccttcactccccacaagtttatgtgttgaagccctaaccatcagtaccgtagaactggactacacagttggcgatagggcctttttttttttttttttttgagacagtttcactcttgtcgcccaggctagagtgcagtggtgcaatctcagctcactgcaacctctgcctcctgggttcagcgattctccttcctcagcctcccaagtagctgggattacagttaggtgccaccatgcctggctaattttgtatttttagtagagacagggtttcaccatgttggtcaggctggtctcaaacgcctggcctcaggtgatccacccacctcagctggagatagggcctttaaagaggcaattaagttaaaatgaggtcatgagggtggggccccaatctaatctgatcggtgtctttgtaagaggagagaatgtggacacataaagggacactaggcatgtgcgtgcacagagggaagaccatgtgaggacacagggagaaggcagccgtctacaagccaaggagagaggcctcaggaggagccaaagctgccggcaccatgatctcggacttccagcctccagaactgtgagagaaaaaaggtctgtcgtttaagcccccaatctgtggtattatgttagagctgccctagcacactgatagagatagcctcaattttgctttgaattgctatgagttgacaaagttaaccacaagttagagaccccatgaccatatcagccactgcagagacctgaaggctgaccactgaaaaaactacaccctcctatatcacacacacacacatacacacacacacaatttattattacacacacatacacacatatttgttattgattataatcataaagtctaactatgagtttctgtttactcccaattaacttggaacaacttttctttgagcctcctcctgaatggaataagggaatggttgttcctgctcctacttggattcctgaagataggactggccaaggacagcctggaacaatcacagcctgctgctgtcatcgtgcaacaatttgttgcctgtattctagacgcagaaaaatctcacagcttatttcaagtaatctctattaatatccctccctggccctcaaaagatattaagaatccaaagggaaatcagaaactcaattgtgctagaaatagccaaactgtctcattcagaatgcattcaccaaacaacttcaaagcaaaatgatgatgaaaaataagccttccaacaccagagtatttctctttttgaatgtttctaccacatctaagaaaacagatgtcaccatggttaaaaaaaaaattgtaccttgcaaaaataaaacttcataatgatagttcgttcttgtgaataaatcctcaaatacatccctcttgcaaaaaaggttttctcttactgaccactcttcttccatcactgactgcagtggaaaattacattccactgtgaaatataatcctgttgatagtaacacctattgaggttttcatcaaattgctagatgagatggtgtaattagggacagccagggggaaaactacaaaggacacagaggacgtcagtccaaaggaggtaaaaactgaaaagataataccttcctcaaaccattgcagaagcgtgtacctgcttgcctggtgacaaagtctttttgaaaatcaacctgtacccataattctgctttctgactttcaccagaggattcataagagcatcctgaatccaaataacaaaattaaatatacactaaccacccgtccttaatcgcttcatgtaaatctgtggcattagaaactgaaaacaaaaattatctgagggtcatgttttgctatgcatttaatggatattacttctgcctgctccaagggcaatgttcagtttccacaaacagtgtagtttattatgaaaaataatttataaatcattcttgtttaaaacaaaatttttttaggagaattagtaacagaatttcaaaaaagttgaataatttctaaagattaagatttcaacttcactcttttaatgtatttaaggtaataatcacttactttggtgattatttataacattaacagctctaagaggcctttaagggccattttgttatacaaaaaagaaacacatttataagcattcttagaataatgctaatgtcattagctacagaagcagcacatgctaagatatcagctttaattttaaattcatattagaccttaataaaataagtcaaggatgcattttgtaatatctagaataaccactaaaagaacagtaatgtctaacaggcaagttagtagagggggaaaatgaaacaatttttaaaaatacataattcaggccaggcgcagtggctcacacctgtaatcccagcactttcggaggccgaggtgggcggatcacaaggtcaggagatcaagaccatcctggctaacacggtgaaatcccgtctccactaaaaacacaaaaaattagccgggcatggtggcgggcacctgtagtcccagctactcgggaggctgaggcaggagaatggtgtgaacccaggaggcggagcttgcagtgagccgagattgtgccactgcactccagcctgggtgacagagcgagactccatctcaaaaaaaaaaaaaaaaaaaaaacataattcaaaggaagataagaaagaaaaggaatatagaacaagtagaacaaacagaaaacaaacagtaagatgacaggaaatagaaggatggaaaaatgtgctataaaaatactaaccaaacaagagctggcacatcatgcaaaatagactttaagacaagaagcattactagcaaaaaagatggacatttaataataaaaaagggtcaatttgccaggctgatacaacaatcctaaatctgtatatatccaataatatagcctcaaatctatatgaaggaaaagctagcaggacaaaaaggagaaatcagcaaatccaaatcatggtgggaaattttaacacacttctctcagccactgataagaatagacgaaattcagtaaggccatagatgacataaacaatacgaataacaaacttaacccaactgtctatatacgttgttgttacatgactgcatctatatatgttgttgttaagaaggcatattttttcaagtgcacatgaaacacttatcaaaaccgacttactgttgagctacaaagcaagtctgaaaaaatgtcaaaggactgagagtgttttctgatcacataatggaattactctaggaatcaataacattaaaaaaaaaaccccaaatgtttatgaacaaagtgatacatttctaaacaatctacagatcaatgaagaaattatactggaaatcagaaaatatcctgaattggaaaataataaggatatgacatatcaaaacttgtaagatgcagcaaaagccatacttagaggtaaatttctagtcttatgtgaatatatgggataagaagactaaaaattaatgatttacatattgatcttaaaaagcaagaaaacagaacaagagattaaagaaagtagaaggagaaaaggacaggcgcagtggctcacacctgtaaccccagcactttgggaggccgagatgggtggatcacttaagatcaggagttcatgaccagcctggccaacatggcgaaaccctgtctctactaaaaatacaaaaaattagccaggcatggtggcaggctcctgtattccaagctacttgggaggctgaggcaggagaattgcttgaacccaggagacagaggttgcagtgagttgagatcgcaccattgcactccagcctgagcaacaagagtgaaactccgtttaaaaaaataaaaaaaaaagtagaagaaaaaaagtggaaaacactgaaacagaaaacaaaaaaacagaaattaagtcaaatgttgacttttcaaaatattaatacatttaataaacctctgacaggactgatgaagaaaagagcacaaattgtcactaccaggattgaaaaaggaaacataactacaggtcctacagatattagaaagcctatataaatattatgccaatatatttaagattttaagtaaaatggactacttcctagaaaaatacaacttacaaaaatgacagaagagaaaatcaattggttctatatctatttataaaactgaatatttaattaaaaacattctcaaaagaaaactctacacccagatatctttatcagtgaaatctcccaaacacttaagaaataatatgaatcctacatcaactcttcaatacaggaaacaaaaggaggggccctttctacttattttatgcttttagcataaccttgatcctgaaacctgagaaaaatattataaaaaagaaaagtgatcagcctatatctttcatgaacataaacataaaattacaaaatgaaaataatagtaaaacaaagccagagtcataaaaaagaatactgtactataaccaaggaaaagtgaatatatatatgttaaaatacatgtaggagattgttactgcagcattatcataatactcccaactggaaaagtcaaatggaaatgtgatatattcacaccacagaatagaaacaacaataaaagtgaactactatgacatgtataatggttaattttatgtgtgaacttggctgggccatggtgcccagataccagatatatggacaaacattattctggatgtttctgtgcaggtgttttgagatgcgattaacatttagattagtgaactctgagtaaagtatattggcagggagctcatccaatcagttaaaggccttaacggaacaaaaagactagcctaccccaagaaagaaggaatctgcagcagaaatcctttacacttgaactgtaacatcagttcattcctgggtctccagcctgtcaacccaccctggagattttggacttgccagtcactataattgtatgagccaatttcttaaaacaaacttttccctatatacatatacatcctattggttctatttctctggagaacgctgtagtcaataagcatttcataaacataatgttgaacaaaagaaacaagacacaaatgatgaaaaacatgcttccacttatataaagttccagacaagcaaaactcctctatggtgatggaggtcagcatggtgggtaacttggtgggccatggtggtgactggtgagtaatagctggggagggacatgaaggatgcttccaggtgtgctggcattgttctatttcttgacctgatatgggtgtgtttattttgtaaaatttcagcaaggttttgatttgtgtatttttctgtatgtatgttatacttcaattagaaaagtatagctttttattgattatacctcatagccattaggatggctagtatcaaaaacagaaaataacaagagttggcaaggaggtagagaaatcagaactgttgtgcactattgatgaaaatgtaaaatggtgtagccactgtgcagaacggaatggcagctcctcaaaaaattgaaaatagaattaccacatgatccagcaattccacctctgtgtatgtatctaaaagaattgaaagcagggtcctgacgagatatgctcaatcatgtccacagcagcatccttcaaaatagccaagatggcagcaaccccagtgtagatcaatgggaaaatgaataaacaaaatgtagtccatccatacagtagaatattattcaaccttaaaaaggaaggaaattttgaaacatgtacaatatagatgaaccttcaggacattatgctaagtgaggtaagccagtcatgaaaaaacaaatacttagaaacctaaagtagtcaaattcatagacacagaaagtagaatggtggttgccaggggctgagggaagagaaaatggggagttgatgtttgacggatacagagtttcagttgtacaagatgaaaagtgttctggagatgtgctacacaacaatgtgaatatatttaatatttaatacctctgaactgtacatgtaaagatggtaaattttaagttatgtgcattttaccacaatttttaaaagtttagtaaagaaaaaaatcaaagcataataaagattgtattcatactttggatcatacaaaggatcaagaagaacatatttaattgtagatccattaaatggggtctcccactgcttttcattaggcttcagttgtgaaaaagctttgtggatagcaaagtgctaaaactggaaggctttttaaactctgatcttactactatctttacaggattggtaattaaagttttaagaaggagatataggtaaaggatgctaattttcctggaaaaggacatgatcgttgaaaaaataagagaagatttagagcagttcagaagatgtggtggttaattgcgtgtgtcaaactggccccggtgtgtgcagactgagcattatctctggaagtacctgtgcgggtgtttctggatgagatcagcatttgaattggtggactctacaaggtagactgcccttcccaatgtgggtgggcatcatctaatctgctgggggcctgaagagaacaaaaggcaggagaacaaaaggggggagtctgcccccttttcctgcccgcctgcctgagctgggacagctcatctcatcttctcccaccctcgggctgggatttataccaccagctgccgtggttctcaggcctttggactagccagtctcaagtctccagcctgcagatggcagactgtgggacttctcagcctccataattatgtaagccacatcctcatgataaatttctttatatatctatatacacatctaccgctatgtctatcctattggttctgtttccctggagaaccctgattgatgcagaagactactgaatattcttcaatacccatttccctttgatcattaccttctgttcacactggcttcctgtgttagcacaccacagtctgtctgccagaggcccttgtgccaaccatttcctctgcctggaccttaccagagaggtccagaccacccccttctgagctgagtttaaaaatcatatcctcagagcggccctccagggcccatcagcacctcccattattgtttaccacagcccccatgtgcttaattccagcagcaatcgcaatctaataaactaaaaaaatagtatctgtctctcccatgaaaatgtgcactccacgagagcaaagatattgctttgttttcccctgggtccaggtacattgccagaacaattcaataaatatttgttgaatgaacaaatgaatacataaatgaatatataatgagcacacctcataggatactaactttattactctgatctagaaggtaataagaactggagacctacaggcaaaaaaactgtcctgaatttcctttctacactgcatctcctgaagtgagtgttttctccacattatcctgacatatattttttcatcctcctcccatcccagcacctgctcagcacctggtgcccttactgggtctgacattccaggatgctgtgctttttttacacagcatttccccctgctggggccagggactgagaaaggctgatctgtcagatccttgatggcccctgagtgcagggcttcaggatgagattacaagaggactagaagacaggcttcctatatctgagaagcgtggaatctcatggatacacacagctatgtcatagttgaaatattaagtttatctacagaattatagctgtatattggagtgctctgaatacttgatttggatggtctagaaatcctggggcacagcaatattttatgtcttcatctgggaggtcctaagaagggtttgcttatggaataaaagcccttatgatccgtgcacagcgaggcctctgtagtgttctgaagaagaaacctgacaggacacacaaaaattattttcctcgtggagggcatggaatcaagacagatccccgatccagtcctcactccctgaacactgcccagcttatgctaaatacgtatttatgcacctactatataccaggcacagttctaggagctgataatgtagccgtgaacaaaatgaaacccctgcccacatgctgtccacattctgataggaaaagatggacaatctgtaatcagtacaacacagtgtgccctctggacataagggaggggcacagagaaaaaaacaaagtaggctgaggacagaagagcaggggatggggtcaggtagccagggacagtttcctgcaaagtgaggagccaagacctaaccaaggtgagccatggctttctgggtgaaaactgctccaggagaaggcaagcatgggccctgggggggaacacgatgtattcaaacagcacggtggcagatgggaagggtccaaccagccacgctagggacaccttctatcctgtgggacatgagaaaccctggaggatcagaataaagtggaggaaaattaaagctgagctttgagtgcaactattttaagactaaatagagctcacattaagtctcttaaactgccactgggttctaattcgatgattaaatttatctagataaaggactctgagattctcgcatggtggatccatatgttgcgctaatacgtaaatgtccattattttacacaggtccagggaacctggccatcatctcgatgcaccaattctccctgccccacccaaattagaatgtaggtggtcacatagcaaactacaacatgaccgggatttcagctctaaaaagtgccatcaagacgtgttccccaacttgactgtggcagtcatttcttggtatccaccactgcagatcacatgcacacctcaaatacatgcagttcaatttgtcagtcatgccttaagaaagctggggggaaaggtgccaccaaatgaaataaagaagcgttcccctcccttgcaccctgccagcatttcagatctgtcttatcaaaactccctgtgcttgggcttagacagacgaaagaaaaatgatggggagccagaaaacctgagaaaactacgcaagtgcactccagtgtctgaatttccattctggaaaggaacgggcagcgctcagcctcacagcccacctgggcacctggcatcaaggccaccctctgccctggtctgcgtgcaatgccatgctgggctcagacacactcctggaacagcacagctctcatgagtccctgataatggcgtccgccacacgcccacacccttttggcactgtcttctgactgactgggctaaaaaaagcttcgataaaccccaaggatcagggctgggctgctgttcttctgaacataaacactggtcaggaggtgattacagttcaagcagaggggagcaaagtcccattttcccagcactaggattagatggcaaagtaatatcatgggcagtttttaccctcacaaatccctgacctccttccctgaggcccccttcccggagccgtctacatgcctgcctttactctacgccgggactccagtctataagaggataatcatttatgaataaacccatgatgatttacgttcccctcaaacgtgaacagaacccaatcatctgtttcttgtgttttccgattccaagaaaaaacatttcttggctgaggctgtcttgtttctggccagattttcctatatgatgtctatgttctctcgtgattaactcagagatatcaatctacaactacaggaaaacctcaatggctttacttaattggagcaccaggaggacatggtaaaggaccacagtgctggttcttctaagcgcatgtgggaactgaaggaaagaggatggggagctggactctgggtacccatgagggcttcagtacagaagacccatgaggacagtggttatgtgtcaatgcagtgcagtattaaaaattactatttgcctgcctttgctctgacatgagttaaatccttctcatctagattacaataacatttgaccctgagtttatatagactaggatcttttatgatgttcccaatcttgctttagttatggagaagctcattataaaatagtcttacaggaaaaacctgatcacagaggggaacactatagtgaagcaccaatacttttcatcaaaaatgttcaagtattggcaatttcatgtgtttcaacataatactactagccctcacccaaccacaggttacagagtgcctggagctgctagaataggcacaactgttctcaccatatgcaaggctcatcctcctccaaccttctcaatacatcattaccaattatcaaatcattacatctttatgaaaaagacttggcttatatgacacaggcagaagtgccaccctttcacaacattatgaaacgatgccaaataaggctagcacacctgccaccttttgcatttactgaagagctcttatgcatggacccacttggcctgtctcttagtcacagaagggggcatggggcagcctggctcggaacacctgtgcctgctgatagcagacgtgccagcctgccagagactgagaagctggacctcaaggtgttgggaggtcgggctgaggctgtggctgctgggccagctgatgcatggggaaaggatatgcatggtttccggagtaggaaaaaggtttaggaaataaacaagtggaaaaatatctggaaaatggaaccaggtacagtccctgccctcaaagagcaggtgctcagtctaaagaagtggtctatgcctgggtgcccactgctccagacagacttagaaattctataatacgtgtaagaaaaaaatcgttagtttccacttgttttttattctggggctggaggcgtggggcatggattcttaccctcttatttagcagtataggcaagtcattattttcagagttgttgcaaaacagaaaggggacaaaaatgttacatgatgatggattatattagaggagttcctgtcgtgacccttgagttagaaagcagatctgcgtaaaataaacaatctgagagctgaatgggcaaaggatatgaacagtcaattcacaggaggaaacagaaccagtaaacaagcacatggaaatatgtaataatctgtagtcagggacatagctgaaaaaaatgagaatgtttcacaaaagaagggtgggccgggcgcggtggctcatgcctgtaatcccagcactctgggaggccgaagtgggtggatcacggggtcaagagattgagaccatcctggccaacatggtgaaaccccacctctactaaaaatacaagcattagctgggtgtggtagcacatgcctgtactcccagttactccagaggttgggacaggagaatcgcttgaacccaggaggcggaggttgcattgagccaagatcgcgccactgcactccagcctggcaacagagggagactccatctcaaaacaagaacaacaacaacaacaaaacgaagggtggcaaggtacccatttaggggaccctcaggcccctaagtcagttacttgcatttgacagtcgtaatgtgaggagcactgaataaggcacagtccaggtgctcagaaataacaatgaccaatgggccaggtgcacagcagagatcagtgttaggagtcagacctgcaggtgttgcatcggaatcccaagcaggcactggcccccatacaaactcgccaggcctccgtgtcttcactgtaaaatggaatcgtaacaagcgcatacctcacagggatcctgggtggcaaacgaaatgggggaccagggtggacaggcagcatgggtagtggttaagaatgctaactctggaataagatggcctgggttcaaaccttgccccctcctccaacttagctgtgcaacatgggcaagttacttcacctccagatgcctcagtgactccatccataaaatggggacagtcatagtatctgcttcacagggtttatgtgaggatgaaatgcattcacacttctaggcagtgccatacttacagcagcacctggcactggacaaacactatggaaaacagtgcctgacacagaacaaatgcactaagagcatttccttacacacacacctggaaaccacttgctctagtaactgggcacagagtgggtgtggcataaatggtgggagaaattcatcatagcctcttcccatctgggggtgtgctgagatgctggaaaagagggtcatcaaaaaaggaggaaaaatcccttagctcttaagccctaagaaagtgcttcacagcttttccttgaccatgaaaaatacagaagcaacacccgcagaaagaatagaatcctagtaattttgtgttctgaatcaagctaagtttgacctttgagcaaattactggctctctgctaagagtgtacagacccatctattcatcatagacttcactgtctgggaatgagccccggagcccaggctctgcaggttgttgctgttacgtaagccagtgcaggagccgtgctgagaaaaggaaactgcgcaatctgctcaggttcccaggaaggccagggtccttgtcccacctgaggagctgacttctcaactggcagcagattcaggcatgcacactgccttcgccggccactggaagggcactgctcccaacacccactcacacgctgcctggatggctctgatgggggccactgggcaggccggacaggctgcctcaaggagctggggacctgtggtgtcagacaagctgaccaccccccggcaggggtgggacatacgtgtgaaaaggggagtctgggggtcccccacacagtccatctacgcagatgcaggccaagctccccagataagcctgcctcaaggattctggccgaggagcagagggggcccttcctggaggtcacctgcccttgaagcaggtagagaagacatcttagtgtggatcagtgctgacatctgtggagagtggactctcggcactttctgtctgtggactcacgtccccatccccggagccctgtgaggtggctattatgagccccatcctacaagtgggcaaactgaagcacccatgtccatgctaccagggagcagcagtgccaggaagaagctcaagtgcccggccttcttaacctctaagctccaacaggtgacctccagtataagcggaggccttcctgccctccagaaaaagccgagagtctctgtagcgtggttccctcctgcttcttttgaatgaacgactgggagggaaggctgaggagacccacaggggcccagggactgatgcagggaaccccctcactggggaaagagagaaagagttggctaaagtagaaaaaactcgaagtgcaagcagggctgtggctcctgcatgaccgagaaagcctccttgcccactggagcctcagctgagggccttctcgaaggctctgctttctatattctctccactccctgaccacggcaggctgggttctcgtaaggtttagagccgtctcagggacaggagcaacccccgctgccatgcagaagatgcagaaagtcttcttttagaagcactggaaaatacattcgaaccgggatgggcatttcctgatgatgttggaacaccaacacagtacctcagggtgctttccacctcgacaaagggccgaggactttgcctccctgcctttatcttgcgagaacctttgcactgtggagtgaaggagctcggctgaaaactcaacaactgcacagcccttggctggacccacactagggaaggtgtctgcgaggctcgggcctgctcactgtgctgtgcgttggtctgcacacactgggacttcggtgataacttacagaagggaaatgggaggggaggagtaaagaaggggttggacagtgacaccagcttgagacagagagtaagaatcctgggctcccagtctcagtttcgtcatgaacttgctgtgtgatgtgggcccaatctcagcatctctgggcacaatgagtggccaccagggcctttctagcattcatatcttacccttccatgaatgagcgaggaacccgtgcagcccagttctgcagctaccagccacatggggctatgtcaatgaaaattagcaaaagtaaacactcctcggtagtactagctacattttaagtgctcaataacatgacaatttaaatgaaaattaattaaaatgaaaaaaattaaaagttcagttcctcagtcatgtccaccacatttcaagcactcagtggccacaagtggccagtggttactgcagtggacagtgcggatacaggacactcccaccaccctagggagtcctccacagggcagcatcgagagtgtgcagatggagatgtggctcacagaacgttcgggaagctgcttctttaaagaagaattgtgtgtcagcttggagcctatgtaaaagtaatgaaagaaagctagatgtgtctgttggggtaactaggtctgtaacagggaaagtcatcaagatacctgaaggtgagataaaataccatattgccacacccaagctatggtcagtggtgaaagactagcgtgtttccataagatgagaatacccatctgctgcctctataatgttgaaatacaatttgaagtattataaacaagatggaaaaatcatcattatttgcaggtgatacgattttatacctagaaaatgcaaaagaatcaactattagaaatagtcaaaggctttagcacaggtggttggttacaaaattaatacacagaaacaataatcttctctatatagaggtaaaaataagtgtaatttaaaaatcccatttttaaataatttcttaaatttacataaaaatgttcatattgaagaatctaaaacataaatacaaattaaagaaatagatagggtctatataaagaaaacttccaccctgtactgagtagagaaaagatggcttacataagtagaataacaccacaggaacctaggatgtaaagacgtcaactctccctaagtaactataaacccaaagcaatctcactcaaaatattaacaggtttggatgttccattttcgttttcattcttgtaagggagtagaggacagtttgaaagtaacagtatacttctagagttcccaaagaagaagcagcaaatgatactagccaggaaaacaaatactggaaaaaaagaataggacaattcactgtattaattgttaaatcacgctaaaatgtaagatcacagtcatgaaaacagtagtatgaaactggcttagaaatgaacaaaaagatcaagagaagaatcctgatagaagagcatatttgatcatttaggtggtatttcaaatcttcaaagaaagagcactgcttagcaaacaacattggaacatcccacaggtaacatgcaaacgagaaaaccagaaatctaactcactcctcataccagaatgtccagtgaattaaaagcaaacatcaacaacaaaaatgtacaagttctagaagaaaacctactcctatacatcttggcctaggtatgaaacaacctcaggagaaaggaaggcaaaatttctgcatctgaactacaaataaaaataatacaaaattctatggagtaaaaacaccataaaatcaaatggcaaactggagaaaatatctgtaatatgtgcagtaaggtactaatttccttaataagcaaataacttacatattcctaagtacagacgataaactcaccagaaaagtagcgcaagatatacacaatcagtttatagaggaaaaaaagcaacaactgactaataagcatatggaagggtcagctttgttcctaattaaggaaaagcaaattcaaacaagatgatactattttacgtctatcagagatcctggcaatgattcaaaatgatttctaatccccagtactggtgagaatgtgggcagagaggaactcatgcgatgctgggggtaatacatcagtataaacagtttgcagagcaaactgacagtatctattaaaacgtaaagtaaccatacctcctggctcagaaattccacttctagcaatgtatcttacaaatacatttacataaggaaacaaagaatgctatttgcaacattatttataatagggaaaaaaacctggcaacaacctaaatgacaatcaataggaatagctggttgagttgtgttatgttctaatcatgaatcatcagggagtcatcaaaagaagtgcattaaattagctgggtgtggtggcaggtggctgtaatcccagttgctcaggaggctgaggcaggagaatcatttgaacccgggaggtggaggttgcagtgagccgagatcacgccactgcactccagcctgggcgacagagtgagactgtttcagaaaaaagaaatacattgagtctactgacaagatatccacaacatgttaaaaagccaagtagcaaaatatagtatgcaatctaatactacgtaatgtaaacatgcagatggtacctatttaagtgtatttatctttccaaacacaccacatatgtttatacatgtgtgtgaaagggtatacatacactcaacagaggctatccctaaagaagggttgagagaagatgggataccaactattactttgatagttaattacgcctctgtgatttgaggcgtaattaacaaagtgatagttggtcataaaaaaatcatctaacgaatgtgacaatctatagttggtgcctactatcagcaaacggtacttactatgagtcatgctcttcatgcatttctccccagtgccattaaatagcctcatgggcagcatgaccaataggtgtagacctattgcaactggtgggtaactttttgcttaagtcagcttgtaatggctgtgttgtgttctctggctagaagggtagataagggataagttaccctgaacctaaagcacgagaactggccccaacaaccaagagtccagatcacgctatgctaaagcccctcactccaatcttcagtcccctggtacctccctatgacacaggtggctcacagaaccatcactggggacagactgctgggtggcatgctgctgcagggctaagaatcgcgtttttaaaggttagttcatttaattaaaagcacagcagggtgctgcctactttcattaagaaaggtcatcttccccagcatattctaatggaaaccagggcagcattcagagataggaaccatcacaagttgattttgctctcttaaggtaagatacggcaaagaatgaccagccacctcctagcagggtgctgaggctggctggtgcagtaggtggagatttagcagatgacaatgtatttctgaaaaggtctgtttttcctctaaaaggcattctaggaaccagagagagaagggagaaaggaggggaaggggaagatcaggagagagggagggaaaggaaaggaggcgaggagacaggagaaaaacctcaccaccaagcattagcatttatttctcaattgcaatatttttattttaagttgtgctaagaagcctaggatttctttcttcaataataatgatttttatgctttatagttcatgaggctttcatattcattatgttgagatttattttcaaaaaagtgtttagagtcttaagttgtttgcaactttgtagcaaagctcatttcacattaaaacatccttttagcaaagtctcaacatactatagtgaaattaatacaggtttttctaagcatttataagtgttaataagccatgccagtctgctggcatagcatatatggtgctgcggtattctgaatattcagtatctaaatctgttcatttcatacacacatgcacgtgtgttcacaaacacacatgcatgcaggcacacaccactgcaaaatttttaagctgcaggaccccctggcctgaaaaaatgcacacagcttctgaaagtgcctaagttactcatgggaaaataaagcttattatttaatggacttaacaatattttcttgttcatgatgatgttttacttccactgatacacaaatatttattaagtgcctactatgtggcaggcactgtcccaggaacaggttaagcagctgcaagcaatgtagacactgtaatttctgcattttaataaaattgctaactcatactaaatacttactatgagcctgatattattgtaagccctctatttgtattatgtcttttcatcctcacaacacaaccccaggaggtaggagcttttataatcccacttgataaaccaggagacctaagtgcagagaagttaagttacttgcccaaggtcacacagctggttactggcagaactgggatttgaatccagaccaaccctccttactgctgtacattgatgtagtttaacaagaacaactctaaactaaggtgggtgtccatctataaagaaggtgaatgctaggctgggcacggtggctcacacctgtaatcccagcactttgggaggccaaggtgggcggatcacgaggtcaggagatcgagatcatcttggctaacacggtgaaaccccatctctactaaaaatacaaaaaattagccaggcgtggtggtgggcgcctgtagtcccagctacttgggaggctgaggcaggagaatggcgtgaacctgggaggcggagcttgcagtgagccgagatcgtgccactgcactccagcctgggcaacagagtgagactctgtctcaaaaaaaaaaaaaaaaaaaagaaggtgaatgctgtccacattcaggattcagagataacagtgatcacatgtgtaggtatagacaccttcacactcactgcactctcagctgagccatgaaaattactaagattaataagcagcaacaaaacctgcacctaaagaaaatagatgcacagaaaaataagcaaaaaattaaacattgacctaatataaaactggtaacaacatattcattgacattaaaacaagatccttcataaagactaaataaatattttctgagtatctcctgtccttgatacgatcacaaacgttaccatgctacatgcaattctcacagcatcctagtaagccaccatctagacctctttacagacacaaagctgaagatgctcagaatctcaggcacagccccgaaggcagccagctgggtccacttcattccaagccacaaatgcaacacagaatgctctgtgctgcctctgcataaccacccctttcactaaatgcaggaagtcacccccacaaccaacaagctctatacccgcaccccatttcaccctgtgtctagtttgaaagatacatcttgaatttagctattctagaaagagataccaatacaaatgaaccctgaatcactttccaaacacctgcaggtgtttccaggcagttcatgaactgtaacacagtgaatttttctgaagggtggtctgttttgaggggctgcacagcagttttactgattgcggaccagaccacctgagatctacaggttgggatgcatgtgagggaagctgtacaaattccccagaatcgtgactccagcccagaacactgtcactacttgactagagtggtggtaattctggaatcatccgggtgacctgcctaccagcaaaagcttttccttcttaatctactgagtaacctaatacctgaagccagctcagaaaattcccattatctctgaaataaaatgttttcatctgagttctctctctgtatttctttatgctgatattttcatatttcatattcttttcataataatgctgataatttcagtcatcttcaggaggagggtcattcctttcaaaagtctccccttcaggtgagcacgttcccctatttgtattctaaacaaagcgggcagcatctcccagcagcagggaataggtccactcaggaagcggctttctcacctgcacagtttctgctggagggagaggggtgtctctccacttgaaaggttcaattacacacttatctttataataatagcttctctgcagcacaaggcatgacttctcccttctgaaagtgcactttgcctttgatgcctgaaataaagtgtaagtcaaccagcaagctccactgcagcacacacatgaagttactgccccccggcggcgaccgctggtctttgaacagcattggacaggccctcggtgcaaagctctccggcccctccacaagctggagactgcttctccctacctgcggcctggggacagccttccctggcaatattaccgggttccagctggcttggactcccgaagtcccccggtttgtatgctccgggttcttttggatggcgctgggaaaggggagaacattattcgttggagaattaagtgggcagagtaaaaccagcaggctgcaagaaaaaaagacctgcttttgagttttgctagtatctattgagcacccttgaggaaatttcgtcacccttctcagcacgaatttctcactgaagagatgaaaggcacagccttggaagaaccttctggtcccaggacttcgagaaccccagagtcggatatccagttaccccgggattccacagtgcttattatttttataaagggtgaagaagtctccttcatctatgaaatggggaaataatagtatatatcttagaaggctgtaagaaggattcaaagagatgatgtacctaaaatatctggcacaagtggtaagtgctaagtaaataggagacctataattgattgtaagtataattgattgtaagtgctaagtgaatagaggacctataattataatttatcactcaagcttcagagtgggagagggtgctactaatgatttcacttggatgacaggcataagccaggatggacaaagtggatgagacatgtcaccttatcaatcaataattgccatcatgacatttggaaaagtcttcaatgttggcagatgttttgagaaacattttactcaagtgatctggccttgtgaggctatttttggcaaatcttcaagcagtaactggacagaatccgtcttggggtcacttcttttttctttttgagacacagctctgttgcccagactgaagtacagtggcacaaccttggctcattgcaacctccgcctcccgggttcaagcgattctcctgcctcagcctcccgagtagctaggattacaggcgcccaccactacgcccggctaatttttgtattttttaatagagatggggttttgccacgttggccaggctggtcttcaactcctgacctcaggtgatctgcccgcctcagcctcccaaagtgctgaaattacagggataagccacagcacccggccatcttggggtcatttaaatcatccctgacacaggggtcatctcagatcagtactgtatatgtttccaagaccaattaaagacacaaagtttaagtgactgaaatgtacctcctctctagccacatgctggacaaaacagggtacgggtgtaagccagagaagctgtgtggaagagaactagaatcacattgaagaaatgctctttttgagcagattcctacatggaaaactctgatttaccttatgagggtgtggggaatgacaggcaagtgggctgtgagttccgtgaagggagaggtggtgtttgtcattcaccaagatctgtctagagctgtgccctccttacactggggaagtgggctgccagcctggggccccacagctggttttgcaaccagcacagtgctcagaacagagatggcacccaaaaggtatttgttgaataaatgaatgaatgaatggattgatggagccaggattcaaatctgggtctgcctggtgccagtgtccaggcactgccttccacctgagcagcagggtgccacctgcctggcacgccatcggcatgcataaacatccattacatatatgtgatagttaatattaagtgtcaacttgattggattgaaagatgcaaagtattgttcctgaatgtgtctgtgagggtgttgccagaggagattaacatttgagtcagtggactgggaaaggcggacccaccctctatctgcgtgggcaccatctaatcagctgtcagaataaaagcaggcagaagaatgtgaaaagactaaactggcttagcctctcagcctccatctttctcctgcgctggatgcttcctgctctcaaacattagactccaggttcttcagctttgggactcagactggcttccttgctcctcagcttgtagacagcctattgtcggacctcaccttgggattgtgtgcgtcaatactccttaacaaactcccttttaactcctctttatatatatcgatctatcctattagttctgtccatctagagaaccctaatataatataaatacatgactgaaagaatgaagagtcgtaactcatgtgaatctctgtttcccgtaggtaaaaacactctcttcacagagctatcctaggattgaaatgagatgtgaaagatatatgaaaaattcactcgcattaatgccatgctttaagatgataagcagcagccaggtggagtggctcacacctgtaatcccagcactttgggaggccgaggcgggtggatcacaaggtcaggagtttgagaccaacctggccaacatggtgaaaccctgtctctactaaaaatacaaaaattagccgggcgtggtggcaggcacctgtaatcccagctattcaggaggccgaggcaggacaatcacttgaacccgggaagcagaggttgcagtgagctgagatcgtgccattgtactccagcctgggcaacagagcaagactcggtctcagaaaaaaaaaaaaaaaaaaagatgatgagcagcacaggctttagagttagctgaaactgggtttgagtctagggatcaacagttcctcacctgtgtgacctcagacaggtttacttggcctcagattcctcctctatagaatggggatgataacagtacctatgccacagagttcttgtaaagataaaatgatacgtcttgtggagtcctgataagtaaacaacaatgagaaaggggccccagatgggagagaacaatgaacagtgattctgagaaatggccaatcacaaacaaccccgggcacagtgacctttttcagcacataggcccctccagcgcaaccctataaaacttccttccagcctctgccgcttggcagacggccccttctctgctgtgctgcctgctgcacccttgcaacatatttttatactttctctaataaatctggctttctttacctgcaactgtcttggtaaattcctttactgcctgtgacactgaccccggctaggtgcacccgtgacatgtattacataaatagggtacttaatatacaaaataaagcacttcatattaatgaatagaaactattttattatctttaaaataaagcacaaagattaacaaaaattaaaggtgattatcatggattaaatgcttgcatcccccaagtccaaatgcagaagccctaatccccagtgtggctttatttggagatgaggcctctaaggaagtaattaggctaaaggaggtcagaagggtggggccctaatataataggattagtgctcttataagaagagacaccagagagcttgctcctctctccacacactgaggaaagaccacgtagggacacagggagaagggggccatctgcagcccagaggagaggcctcaccagaaagagaccatgctgggacctcgacctcagacttgcaggctccagaactgtgggaaatacatgtctattgctcaagcctcctaatctgtgttttttgttatggcagcctgagaagattaataatacagtgataaaataagacatgctattgttatgttgaggaactttctgaattaaataatatttttgtctcttaatcgtgaattcaggccgacctcagatacctctctctttggcattaattatgattgcacatgggaatttcatgcggcacctgctgaaattagtaacaaaaggaaaagtactggacctttccaagttataaaaggtttagcttcccgagttctttgttcagaaatatggtggggtaactgctcttgatactcagaaacttagtaacctagctatagtcctctcaatgaagtgttccatgttaaactatagtggctaaaactattcttttatggagctgaagctaaaaagaaaaaaatcagattagaaaaaaatcctctttttttcctccaaataagtctttttaataatgtcagggatccgtttggatttgctccctttttttttttgagacagagtcttgctctgtattccaggctgtagtgcagtggcgcaatctcagcttactgcaacctctgcctccagggttcaagcgattctcatgcctcagcctcctgaatagctgggactacaggcgcgtgccaccacactgagctaatttttgtattttctagtagagatggggtttcaccatgttggccatgctggtctggaactcctggcctcccaaagtgttggaattataggcattagtcaccacacccagccttagaaagaaatcttaatatgcatttctaaacactgattgctccacagaagtcaaaaaagtttccaaattaaaaaatgtactaatgaatatctaactgtggtaggcagcctatagcagggatcgccaacctccggaccacagaccagtgccagtccatggcctgttaggaagcgggccacacagcaggaggtgagcagcgggtgagccagcaaagcttcatctgtatttacagctgctgcccattgctcacattactgcctgagttccagcggcagcagagtcccataggagcatgaaccctattgtgaactgtgcatgtgagggatctgggttgcccactccttatgagaatctaatgcctgatgatctgtcactgtctcccatcagccccagatgggaccatctaattgcaggaaaacaagcttagggcttctactaattctacattatggtgagttgtataattattttattatataataatagaactaaagtacacagtaaatgtaatgcacttgaattatcctgaaactagctccctgccccctggtctgtagaaaaactgtcttccatgaaactggtccctggtaccaaaaatgttggggaccactggcctataggatggcccccagggatccccacgtcctggtatttacacccttttgtaattccctctccctgagtgagatttgcacttaccgactcgcttctcaggaatagaatacagcgaaagtgatgggatatcactgagattaggctacaaaaagatggtggatcccattccatctggcttgctctgagggaagcctgctgccatgctgcaagccaccctatggagagggtgcagcagcccccacacaagtgagcctggcagtagataccactccttcagttcagccttcagatgaaaccacagctgatattttattgcagccttgggagagactctgaggcaggggcaccaggctaagccatccctgaatttctgacccacagacactgtgacataattaacatttattatttaagccactaagtgttgggtttgttacatggcagtagataactaatacacaaacctatattgtatatacagacccaatcactctgacaggcattttatgtgtatcataaaatgtgagtactatcaacagctccatttacaggcagggaaaccaaggcatcggtaggataaatagcttcccagagtcacactgcataagtgggaaaggtatgcttaagacccatagccttaaccagtatgcttcccagcctcctcatgtagacttcactggggaatgtgagcatattaaacccagctaaatcttcagaggtgaaaataaataaaaaacctaccccaactatatcaaatatggtaaagaatttctatgatgattgaaatttacacaacatgaagccaaccctttccccaacgtcaaagtttgagttaaggtaattaatattctcctgaggttacactttgaaaatgtttctgtttttcccaagaagagacatttttactttctactgccatggtatagcctcctaatgctcagagatcatggcagagtgatcggctgtgtctcatcagcattcttatgctttgatggtgattagtatttacaaaggaaaaaattgtctctcacaactgaactgtatgtgaaatgactggcacttcctcagcatccttgagatgagtcctaatgattctgcatagacaatgtacacccagggtctacccatcccacacatgctgatgtgtgcacagtcactattactgtaccaggagtgatgcgttctcagacctgcgcaaacaggccctgcggtgatatgtatgaaaatgagtggatcacatttttttaaaaggagagaaacaaagagacaaagaatatagcctgaaatataaacattggaaccaacagctcctgccttagctattctgctctagcacaaagcctattttttgttcctttatgtaattgtcctgaggctggaaaagcctgaagttgcaggcagtaacatttaaagctactgctatggaagaaaaaatgctttaagtaatgaaggtgacagcagattgagctgagaggggaaccaagcagttgttagggggtggagtggtgaggaggatttaaagcagctctggatgtgaaaaacatctgattttagagtcagaaaccctaaaattagagaaatagtggaaaactgaaaataaacttcgcacatatgtaacatgtagctttcaaaaatgtacaacattctgaaccttcccaaataaattaaactctataccatattggagataagatcatttaaggggaaattttattcagaatttaaatctgagaaaccgcatgcctcaccctcacactagggtgaaaagtgaaaatggcctaaaactgcctggattttccagtgcaatagaacccaactgttactctcctgctaggatgtcacattttacaatatgctacaacagactggcttggaagaggaacaggcagaaacgcagccaagtatatacaacctcaggagtggaaactatgtacatcagcagggccaccttaggtcctcaaaacacttcaatcatcaaattgctttcgaatgatgtcctgcgaccagaaaacaagttttgggaggccaagtgcatgatctgccgtttgggtggagagtgagcagcacccattaaggcgaacggaggtaacctaaggttaaaccaaatgccccatctcctggtctgtgggcaccagtgaccccgcctgtaggccacagggtcaaacaacaatcaggagaaggaagcctgcagaccaagggcctggctcccggttcaggaaatcaaggcacagaaagggtaagtcatctagctagaagtggagcttcatcaaattttcagtgatctttttaagatataacgatgcctctggtcaggccaaaccccggcttcagacaatggttcccaacctcagctaacaattagaatcacctggggagctttccaggcgattcccagccccagagattggaatgggtttggagtggcctggaaatgggaatttttcaaagctccctagagactctgacgtgcagctaaggttgggagcactgctcaaaggtctctactcacataaagaatggaaggatgtcacttctacttctttcatgctgatccgaatattttgttattaaaagaaagtcatgatagcactacatctatcacaaatcttaggtgagttgtttttgttttttttaggtaagtttactcaagcgaaaagagtaaatttttctataattttctgacttagccttccagcaaagctctatgaatcaaatatacattcatatttcagacaactgaaaaaagggtatttgtttccattactatacggaactatattcactgcttggaaatgaacggaatattatctgagaactcttaaattcctggtcagcttgatgatgactgaataaactcttattccagggaaccaactaaccattttcagcaattcaaagcacatgtaattactggttcaaagcattttgaattgttttgcttttctaaatagaaaagaaaaaaagactcacaaaaagagtactataatggaatatgttcatcaaatatttgtacaaacagaaaataatcatattttaataaaagttttcattcatctgtaacagtgtgaatctaatacatttaattaacaaactcattatacagtatttacaatattgatcctgagccagccaatgaaaacaaatcttacatatctggccaagcaattatagttacaaaacagcttctgatgtaaattttcaaaagaattctagttcaggttaattttttttctttccttgaagactaagcttacagaatcatgtgactatatataaagaagtttgatccagtcttttttcctcacaccatcactctccagatccaacagactggctaaggaggggacggccagacccccagggacttttgtcagcattgcagttaatgatctgtttacacaaggggagataccaccaacctaaagtagatttacatttacattacatcatccaaaggtgacaccccagtcttaacagtaagactgccacattgaaaccgcagaaactacatattcccacctagaaggatggtttcagctaaatgagaaatggtccacttgctgcaaggcttaccaaggacccgctgtgactttagctctcaggttgcccactgcatagagctatttgccctcagagactgggactcccttagcccacctggtttttgggttttcactgattgctgtatatctcacaggaccctagaattggacatcagtgcacaaccctccctcatccccattctgaagctccagattctccaaatggagagaagaggctcagatggaggctctgcccctttctccatctccaataccaccatcctagtcccactcccttcctatctcccctggatgatggcaacagcctcctaccaggtctccttgcttcctctctagcctacccagtttccctcctgaaagccattctccaccaagatgtgcaattagaatcacacctgaatccttaccatggccccagggggatgttttctggttgcttatccaacctcagctaccaatcgcctctctgtctctcatgcaacccttcaagtcctttaaaaatggagttcaccctgcactggagcttctgcacctgctagtccctctgccgggatgccggccacacaaacacctccccagggagcttcttcctgtcaacctggtccaggctgtgcagaggcctccctgggccactccatctaaagtggctccctactaactcctctgtgtaagtcccctttatccacactgtccccagagccattatctacccttctgtgggccctgaaaggatgacccaacctatggactccactgcaggggctcccttgcctcctagctgtcctttgagttctgccaatgaaatcagaagcctgagaatttcttccctgcctgtaccctgccttagcatctcaactccacaccttcaagtctacagctcctggcaggcagctcctcccctaggtttccagccacgtgacttcctcccccagctccagcttccagctgttgctcatggctgcaggcctggacatcccttgttagttccctcaggactgccccaattcaccagctcttcaacaaaacccccacagtgttaggacctgaccactctgaccaagccccctccccttgctctctatccctgtttcagtctcttcatcgcatttatcactatccgaaatgatcttgttcacttgcctttttcctattgtctatctccccctcaaccactggatcctaagctccatgaaagcaaggagcttgaaatgttccctgctttatcctctgggcctaaaccagtggctggaacacagtaagcactcaatagacagcaaagcctgaatgaaccaatgctacattgtctctgctcaaaatatcaccatatcagtaagaccttccctgatcatcttatggaaaatagcaatctcccctccactcccagatctccactccctcctcctgccctccaagtcttattttttcctatagcatcattactttctgatacatttgatatttctttattgcttgtttcccttccaaaaaatgtcaaccctggaggcagaaatgctattttatttactgatgcagcctcagagcctaggacagtacctatcccgtagcgaagtctcaataaatatttgttaaaatgaatagctagcgaagtgggcaaactttcatacaacacaatttcaggattgtatccaacactggaaaaaattgtctccaacactacaagtaagtgccgtcttacgtgacttgaccttgttctagcagaaagacagcctagaactcctaaggaaaaggtctgaaatgctggctagcgcttagtttatatggagaggaaaaggttttagagtaagatcaatcagtaagaccctgagttcctgacaattgctgctctagaaagcatgcctggaagcttacctaagcacacggccattgtaattcctttcagaaagtaagtgaacatataaattataaataaatgacacttacatacaccattctgtttcacagtggtgttgtattggcagcagccttcaactatagttcattgacagcatttgtggacccacagccaagcgctgaaagcactgctttttttgacagctgctctcctaatggggcatctctcaaagaccggtttcattctgtgacgcccacgttgtccacattttattctgcacaataactgcagatttgaaataaattcttcctccccaccaccattattgattactcatacctgcccctcaccctccaaagtgtctaaattgtgtggattttgcgggggtggggggaggcgggggaaggagtcgactccccatgtactgggtgtccccgatggcggcaagccacaccttcacacaagggggcaaggttcttgactaaatatcctaaaggtctgaaagatggtccccttccccccaacacaattccaccaaaactggccagccgctggctaatgagcaaccacggatcctcacccaaacattggcttttcttccaatagtgcagattgggaatgcagggacgtcgtcctatttatgaacactgagtcacgtcgccgctcaatgtctgtttcctcctccctaggaatgaggtgaccccctcctccagcgagtaaatgcggggcgatggcgagagcgcagggggcggcggcgctgccccaccttggggagcgaattcacccccctagtcgcaccagcctgggcgcacacgggggccggggcgagcctgtgggactctgcagtgagctccgcgcgccccgggggtgctaggggaccgggaccctcggggcgccgtccccacgccccagccctgacgggtccgcggccgagcagcccgggggacgtcgctgcctccccgccccgcgcgcggccgggactgggcgctgcgacccgcgccgcctcctcgggcaacaagtgtccgccctccgccccgacggcccgcccggcgcggtcctcacccggcacaggccgtccacgaacacgcgcgggtccaggtgacaggcgatggtggcgctgggcaggtcctgcaggtccacctcctccatctcgcagtcaatgaagctccagtcgccgccgccctcgtccgcctcggccgcccccgagaggggcgcgaagggccgcagcgtcaccccgggccgcgctcgcgcctcggccgcctccgccgcctccgccgcggccccgagctggggaccggccacgccgtcctccatccccgcgcccgcgcgaccctgtgcgccccagcgggctgctccgggcttgcgcgccggagcctcacgcgctcc

SEQ ID NO: 801 - DNA, 53999 bp, Homo sapiens
cgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacgttggccaggctggtcttgaagctctgacctcaagtcatccacccgcctcagcctcccaaagtgctgggattacaggcgtgagccaccaagcccggcctttttttttttttaactagagcatttgctagtacaacagagtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttgaggcggagtctctctctgtcacccaggctggaatgcagtagcccaatcttggctcactgcaagctctgcctcccgggttcacgccgttctcctgcctcagcctcccgagtagctgggactgcaggtgcccgccaccgcgcccggctaattttttgtatttttagtagagacggggtttcactgtgtcagccaggatggtctcgaactcctgaccttgtgatccgcctgcttcggcctcccaaagtgctgggattacaggcgtgaaccaccacgcccggcaagatttcttgttttaaatctttaccactgatcctaacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaagatcgagtacagtccatcagtttttttaaaaaagttaattatagtgccggccgcggtggctcacgcctgtaatcccagcactttgggaggccgaggcgggcggatcatgaggtcaggagatcgagaccatcctggctaacacggtgaaacccccgtctctactaaaaatacaaaaaattagctgggcgtggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagc

SEQ ID NO: 802 - DNA, 53999 bp, Homo sapiens; identical to SEQ ID NO: 801

SEQ ID NO: 803 - DNA, 53999 bp, Homo sapiens; identical to SEQ ID NO: 801

SEQ ID NO: 804 - DNA, 53999 bp, Homo sapiens; identical to SEQ ID NO: 801

SEQ ID NO: 805 - DNA, 53999 bp, Homo sapiens; identical to SEQ ID NO: 801

SEQ ID NO: 806 - DNA, 2230 bp, Homo sapiens
actgaaaaatatgaccagcaactttatgttctcaactttttaccaaactctttgaacactatttgtttttacaagagagaagtcttataataaatgagcagagcatctgaagactaatcacacctctagaattacctggagatgacaattgcaattgttttggtaacaaagaatcctctctgctcttctgccctaaatgataactccacctcagttcctcatggtgtttaacaaaagtccttaccactttcaaaggcctctctcaccagccctggcattttctctgtctgaaaagaagccagcaaattgttttacaaactcctgcaatggtacttcttagagaaagcaacatgaagcagcccagtctcacttggtgaaatttgcagcatggaagatcctggccagtgggagacatggaacttgtcacaagttgggcaggagttatcaatatcctgtagctgggtgggagtcattttatcctgtagctgggcaggattaatcaatatcctgtagctgggtgggattaatcgatatcctgtagctgggcgggattcatcaatatcctgtagctggaagggattcatcaataacctatagctgagtgggattcatcaatatcctgtagctgggcgggattcatcaatatcctgtagctgggtgggattcatcaataacctatagctgggtgggattcaccaatatcctgtagctgggtgggattaatcaatatcctgtagctgggtgggattcatcaatatcctgtagctggtcgggattcatcaataacctatagctggctgggattcgtcaatatcctatagctggctgggattcatcaatatcctgtagctgggtgggattcatcaatatcctgtagctgggtgggattaatcaatatcctgtagccgggcgggattcatcaatatcctgcagctgggtgggattcatcagtaacgtatagctgggtgggattcatcaatatcttgtagctgggagggattcatcaataacctatagctgagtaggattcatcaatatcctgtagctgggcgggattcatcaatatcctgtagctgggcgggattcatcaatatcctgtagctgggtgggattcatcaatatcctgtagctgggggggattcatcagtacccaaagctgggtaggatttatcaatatcctgtagctggctgggattcgtcaatattttatagctggttgggattcatcaatatcctatacctggctgggattcatcaataccctgtagctagggggattcatcaatatcctgtagctggccagaggaaaacctcaaggtttttgggttggctgcttccaaaatgtaggccctcgagtaaagaacctaattttatatgaaagagacaactgctgctgaccaggtggctgctgaatagatgtgtctgatccatgcagcttagttgaaaaacaagttaaatgaagtaaaaaaaaatctctttgggagagagaacaacgtaggctgtgttggggtcctaagcggaatttcactcagcaggagcaactgtttcatcagagaaaggattatggagctcttgagagaggtttccaagaaacagaaaaatagtcccaattcaagttcggtaaagaatgaggtgtctgtctgttggccgctgaaataccgagcccgagtgaagccgaaaagtgagggaggagatgaatgcgctgtaagaggcggattcatcggaggagaaaataaagcagtgtcattaacaccaaagggcgtagggacagaaggaacatcacggtgggagggcagagtggagatttgtggaggtgggagggtccccagctcgcccttgttggtcaagtttaaatgaaggcaaagttctttccattcaaactcttgagtgtggatacaatgccacagtgagtaacgccgggagttctgacttctgttccgtttaagttcaaaaagaacctaaatgacgttgttgggaaacttaggagtcaggaaacaatgctttaaaatgcacggatgtagaaataagggcctagagtcacccagacatctttcatttctacagcccagaaatctctcctttctacagccctataaattattgagggagccccttcttggacaacaaaaacgatgtaataggatcctttcaagctcataattacctcagacatccttctttagtcaggagaagacttgggtttcggttctccatcacaactccgtgtttg

SEQ ID NO: 807 - DNA, 32983 bp, Homo sapiens
taaatgaaggaaattagcaaactaaagaacaacaaatgggcaacagtgctgtgagggaaacagaacaaggactgctgagctcattttgtagctgaggaactgaggcctgaagagtttaaaagttcaggctccccatctctatcttatgcctttcctccgcaccagatctcgaaactgttccctgataattttgagctggtccctggggtgagaagcagctgggccaaagagaaggcattcagtggctctgtgcctaagcttaggcagaaaggacactgagagatggggaggagggggggctgctctactttttttttttttttgagacggagtctcgctttgtcgcccaggctggagtgcagtggcacgatctcggctcactgcaacctctgcctcccaggttcacgccattctcccacctcagtctcctgagtagctgggactacaggcgcccaccaccacacccagctaatttttttgtatttttagtagagacggggtttcaccatgttaactaggatggtctagatctcctgacctcgtgatctgcccgtctcggcctcccaaagtgctgggattacaggcgtgagccacagcgcccagctggggggctgctctatttcaactgcatagcgaagagcctgggtggccctgcctggcttggtgggtgcaaacctgacttcagccactgctaactgtgtggccttgagcaagtgacatattctctcagctttagtttcctcatctgtaaaatgggaataccataatgatgcccagctcctgaggtttttgcaagtattaaatgagataatgcatagaaagtaattagcacagtgcctggcacagcataaatactccagaaatatcggctgtttttcttatatatatatatatatatttctttcctattaatgtatttttaattttatttatttgttattattattttgagacagggtcccactctgtcacccaggctggagtgcagtggtgcaatcttggcttactgcagcctcagcctcctgggctcaagcaatcttcctgcctcagcctcccaaagtgctgggattacaggcatgagccactgtgcttggcctttttaatttttttatggtcaattgcaatagtgttctttttcttttttatgttttttcttttttatagtaattatttttattatttggtgcaacaggcattaactgcatactcacttcgtggtgtagtgggagctgcttcagaggacaaaagtctgacactcctgttatttggcaaatcccatggcttctctgcgactcagtctccatgtctgtaatatggggttttacctaattcagggctgctgtgagaagtgtgagctagtgtgtatttggagagaacaagtacttaataaatgagccatctctttcctccccatgcccgtcttaaactttagaatgatcctgtaaagttcatattattattatttttatttatttatgtatgtatgtgtgtatttattttttgagacagagtcttgcactgttgcctgggctggagtgcaatggcactatcccagctcactgcaacctctgcctcctgggttcaagcgattctcctgcctcagcctcctgagtagctgggattacaggcgcctgccaccacacccagctaaatttttgtatttttagtagagacggggtttcactatgttggccaggctggtctcgaactcctgacctggtgatccacccgcctaggcctcccaaagtgctgggattacaggcaagagccaccgcgactggcctacatagtattattattcccaacttacagaaaaggaaacagtcattagaggatacttagaaaacgtctgtgtcgtgaataaatgaacgagtgactgagtgagtggatgcgtggacgaacgaatggatgaatgaatgagcggatgtgcgtggactctgcgggcggggcgcccgtagtctccctccttcgcaccccgggcgcctgggaacctcctcgcgcgtttggccactcgctgctcctggcagtaggggcttcgggccccgccgctgtccccacccaggtatggggatgcggagttgatgggtgcggggcgctgggagggggcagatgaaaggggcagtcgaaagggggccatgcgcgccgagcgcagccgggtcattagccgcgggtgtgagcggcggggcaggcttatcgcccatccaggcctggcgggcgggcgagtccccgacgcggctgccgccgccgcccgcggcagagggcacggcggttcccacgctcgggccctggttcgggggcgttctcgggacggcgtggccgcgctcaccaccaccgcggaggccgggctgtaattaggataattgcgctgctcccagcctggggcagctcaggaccccggctgcaccgcgctggcccgggacgggcgggggcagggggtggcggggcccgagcgatacagcccctggcgcagtccgttcctctagacaggtgagtcagcacacctgggcggccccagccaccaaggggctttgtggggaaatgagggaaggggagagaactagcctggacggagcacctaatgtatgccggcggtgtggattaaactattccattacggctcaacattggggtattgcgggagtaggtgagaacatctgtcctgcccggtggtgcctgacccagagaagatgtgcaagacgaatagcatcttcatctgcacagcagtttagcaggtgggcatcaggaggcccagaggttaagtctcaagactacacagccgggagatgcatgcttcagaaaggaggacgatgaagacctgcctggagtggtggcccacaactgtaatcctagcactttgggaggcctaggcgggggaattgtttgagttcaggagttcgagaccagcctgggcaacatagcaagacccaggtctcccccaccactccatctctacaaaaaatacaaaacaggcctggcacgatggctcacgcctataatcccagaactttgggaggccaaggcggtcagatcacctgaggtcaggagttcaagagcagagctggccaacatagtgaaaccccatctctattaaaaatacaaaaaaattagctgggtgtggtggcaggcgcctgtaatcccagctactcatgaggctgaggcaggagaattgcttgaacccgagaggcggaggttgcagtgagccgagattgcgccattgcactccagcctgggcaacaagagcgaaactccatctcaaaacaaacaaacaaaaatattacctgggtggtgttgtgcgcaggtagtcccagctactcagaaggctgaggcaggtgaattgcctgaacccgggaggtggaggttgcagtgagatgacattgtgccactgcactccagcctgggtgatggtgtgagaccctgtctcaaaaataaaaagaaaagaaaagaaaaaagaaagaaaatgaagacctgaccgtcctggctaacacagtgaaaccccgtctctactaaaaatacaaaaattagccgggcacggtggcgggtgcctgtagtcccagctactcgggaggctgaggcaggagaatggcatgaaccccggaggcggagcttgcagtaagccgagattgtgccactgcactccagcctggacgacagagcgagactccatctcaaaaaaaaagaaaaagaaaaagaaaaagaaaatgaagacctatgcccagcgagctttggctttgctccctcaagtacctcatttttactgcatcttggatcccaaccataaagcccattcctgatccttaggttcttggcaggcctaatcataactgcagatctttatcactgatacaagccacatgaaatccttctggaaaaggcaggttaaaaagaaatgatctgatttcaagatctaatctctaatcctaaacccaacctaaaccttaaccctgctcctccatacctaactcccaaattaatcttcaccttggcccctgcccatgtctccaaacttctccccgcagtgatcctctgccactcctcccacctccccaggtgccctcctttcagtggtggtttcaagtctctgggtctttgcatatgctgcagccgcacgtcaggatatccttttccagggccacctggtaaactcctctcacccttcaaggtcctccacaagcccttggtgttcctttcccggccctgtgctgccttgtttcctgaccaggctctcctcagattcagctcttaggaggtagggtcttaatctgctgggagtaaaaattggaagtagaacaaatgattgattgtgaatgagtgagtgagagaatgaatgaatgaatgacttactgaataaacaagtgaacactggccaggtgcagtggctcatgtgtgtaatcccagcactttgggaggccgaggcaggaggatcactagagcccaggaggttgagacagcctgggcaacatagggagactggatctctacaatttttttttttaaacaaacaagtgaatacctattctgaatctaaatccttaaccttctccctggatccattcccaagaagggaacaattggaagatcaagagaacccccagccaccaggtgccctgagattgttctgtgtgtgtgcgtgtgtgcgtgtgtgggtgtgtgtgttttcctgtgtgcatgcccgtgcatgcacatgcgcttgagtcaggaactttgaatcagacaagcctggagtccgctcctggccacagggttcaccaactgagtgacctgagcaagtacctgcacctctctgggtcttcatgaactcaaacatgctaacaataaaaaacccatcatggagaatcagctcttcttcctttgttcatttaccctcccccagccccttgcctatggcaggctcagtgtttggtgctgcgggaacaggagtggaaggaacacatttttcccctcaaggagcactagtaagggtaggaagcaggtctgcagggaagagggaacagcccctgggtggagagggaagcttcttagaggatgtgagaatcacttgggtttgctgctggacaagtcaaggcagaggcagccacatgttcaaagacaacaagctgtgaacaaagggttccctattactgctggagaatgaggtgggaggtggggggtggtggcagaaattggggctggtgagggtgacagtgtccagatcagggaaggctttaggggcagtctgtgaagtctatgaaatatgcacactttattctctaagcaatagggagccattgcaggtttgggcagggagggatgggcaggtctgtgctgtagaaagctcactctgaccagcagtgtggaggccatcatggaggtggctgtggtgagaagccggtgggggagtgcaagggacatgaaatgatcttggtaatagccgacctttattgaatgcctactatgttctaggtgcttaactcatctaattcccacaacacccatctgaagtagattctctcatgagctccttctagaaatgtcatcaaaacactaaagtctccaatgtttctatctccagcctgaacctcccttctgaattccacacctatatgtgcaatagccggttggcttctctactgaatgtctaataggatcttaaccttaacgagtccgaaaacaatctccccaaacctgcttctctcagtcttctccatctcagtcaatagcagtttcacttttccagttgctcaggctaaaaatgttggagtcatccctgtccaccctccacttcttacttcccatatctgatctatctgcaaatcttgtcggttctaacttcggtacataccttctggtcttctcacccctctcctccagactgctgccaggtgggccaagtccccactgtttcctacctgaattactgcagcggccccattactgatgggctccctgcctctgccccttcgacctattcttcacgcagcagctggtgtgaccttaacatacaaagctagatcaggttcctcctgctcaaaccttttcccagctccctagagtcaaagtcctgataatagcagagagatcccaacatgatccagtccttgtctccccagccccttgtcagacctcttcccacatgcttccccccaactccagccacactgacccccttgccagctttcccattaacctcagaattattgcacttgccattccttctacctggaatgccatcttcccagatatccgtgtcattttctccttcaaatttctgttcaaatgtcatcttactagtgagatcctccttaaccaccccattaaaaataacaacttggctgggtgcaatggctcacacctgtaatgccagcactttgggaggccgaggtgggaggattgcttgaggctaggagtttgagaccagcctgagaaacataaggagacccccccatctatacgaaaaattaaaaaattagctgggcatggtggtgcgtgcctgtagtcccagtgactctggaggctgaggcaggaggatcccttaagcccaggaggttgactctgcagtgatccatgatcctgctgctgcactccagcctagccaacagagcgagagcctgtctcaaaaacaaaacaaaacctcaccttcctcccctacccaggcaccttgtatccccttccctgtttattgtttatactacatgtcaccatctgaaacattttataaattatattttactttctggtttattatctttctcttctcctctccccttccctcccctcccctcaccccactagaatgtcagctccacaaggacagagatttttctttatttgcttcactgccatatccccagtgcctaaagtattgtaggtgcccagtaaattcttctgaatgttgactatggaatctgtgtgctacagaaactaaggcacaaggagattaagtaaacttgcacaaagtcacacactagtaagtggttggatttggataatgaactcagaatataggcagtgacagcagagaatgagaggagggaatgaaagaaaacaaggacctgacagatgggctccaggtccatgggctgatgttgcaccaaggggtgaggttgatgttgtgagacctccgggggttgacatgaagattaaatgagctgagacttgaaaacacattgtatatatagggaaaagagattttaagaaaactattattccatgaattttgaattcccagccatgttcctggccttctccacccttgctgctgaggcatctgttgcttccagtcgggggcagattcagcagcagatgagcagctcatccttagctttgcctttctaaatggattttttgaaagagtagaggagacctaacagtgtcagaatccagaatttcaatgtaaaggcctacacagttgggagagatacccaaaacttccttttaaatgtcaagacctgggctgggcgcagtggctcacgcctgtaattccagcactttgggaggctgaggtaggtggatcacctgaggtcaggagttgagaccagtcttgctaacatggtgaaaccccgtctctactaaaaatacaaaaattagctgggcgtggtggcgtgcgcctgtagtcccaggtactcgggaggctgaggcaggagaatcacttgaacccgggaggcagaggttgcagtgagccgagattgcatcactgcattccagcctgggctacagagtgagactcttgtctctaaaaataaaaataaaatcaatgtcaagatctggagtctggccaaggtggggcctggactttttactatgagccctggagggagggaaggtatgagacaaagcagtgattctccaatttgagtgtgcatcagaatcatctggagggcttgtttcaacagggatggctgcctgggccccacctgcagagtttctgattcagtagctccagggcggggctggagaatttgcatttctaacatcttcctaggtgatatgaaccacatatatatatatatatatatatttaagaggcaaggtctagctctgtcactcagactggagtgcagtagcctgatcacagctcactgcaacctcaaattcccgggctcaagcaagcctcttgcttcagcctctggagtatctaggactacaggcatgtgccacaacacctggctaatttttttttttttttgtagaggcggggtctcgctgtgttgcccaggctagtctcaaactcctaggttcaagtgatccccctgcctcagcctcccaaaatgctgggattgcaggcatgagccaccgagcctagctctaataccaaccacactttgaatagccctgatgtaagggttgttctcagttccaggggcagcctcgcagagcccatgccctccaggatggaggtgtgaagagggaaccccaggaggtggtgggggtaggtgtatggaaatgctcaggaagacggtaggcaagaagaaggttggggtcagaggagagggtgtgaagactgtggccaggaacatagttgtgggcagcagaggccaggggacctgcccagaggacaggtgggacgtgtgcctcagccacactgcagaaggcagacacttgaaagaggaagcagtactgggtcagaggccccttccccaaccatgagactatccaagcccccaactccattccccttcagatgtcaccctgaagaagggacagatggggctgagaagtggtgaaagattgagtattttctcccaaagagcctgaggggacttgggatggcacaatttagaatgtcttgcaacaacatcatgaattaatccctctgctcctaccagggtatgaagaagtggccccaaagttgcagtgcaatggttaagagcaaacatttcctggatgcgcaatcctaggcaggagacaccctctctgaacttcagtcctcaaatctaaatcgaggatgaaattatcatccatctcatcagattgagaggtttaaaagagaccatgcatatagtggagtgttgagctagagcctggcagagggcaaatattcaatcaatggtatttatgatgataggttttaaaggctgggcatggtggctcatgcctgttatcccagcactttgggaggctgaggtgggtggatcacttgaggtcaggagttcaagatcagcccggccaacatggtgaaaccccgtctctcctaaaaatacacacacacacacacacacacacacacacacacacacacacacacatattagcccagcatggtggcgggtgcctgtaatcccaggtacttgagaggctgaggcaggagaatcacttgaacctgggaggctgagattgcagtgagctgagattgtgccactgtactccagcctggacaacagagtgagactctgtctcaaaaaaaaaaaaaaaaaaaaaattcttccctgccttcagtttgttctctcttcctcccttcctcaaatacttatacttactgggacctactggcccctgacatggattttgcctccttggaactcacatcaggaaatcagaccagtcaacaggcacttagtagctgactgtgggctggtgctgtgttggggtaagctcggggcactgggactggggacgctgagaagtctttctggaggatgagatgcattgcttatttagggggctttattgaagctgataataaattaaaagtatatatatatttaaagaataataacacttggggctgggcatggtggctcacacctgtaatcccagcaccttgggaggccaaggcaggaggatggcttgcacccaggtgttcaagaccagcctgggcaacatagtgaggcctcgtctctattttacttaaaaaagaatcactcctgggaaggaaagagtgaaaattataaactttctccctcagtcaaggttcagaaatataattatagtgcgcaacactttataatgggaggcaggagagcatggttgactttggaatcagacgagctggaatccagattctgaggtttaacaaatggtctgaccctggactacttagcttctctgagcctcggttttccttatctgtaaaatgagactaaaggtagctacttgacatgtgggtttgtggtaagatttaaaggacgcagattatgtacagcacctagcatatattatttgctaactaattctgagtccagggctggagagtggatctgggcttttttcctctccaccctgtgtcctgtcactttctgtttctccctggttttctggatcataatgaactgattgatgacccacctgtcttctccaccaacctgggtgctccttgagaacagagtctggttcagggtctgtttagtttatcccccgctttttttttttgctcagagacagtcttgctctgttgcccaggctgaagtgcagtggtatgatcatagcttactgtaaccttgaactcctgggctcatgtgatcctcccacctcagcctcccaaagcactgggattataggtgtaagataacatgccctgtcgctagatatcttctttggtgaagtatctgttcaagtattttgcccctatttgcattacttattttctaattattgcatttggaagttctttttatattctggacacaagacttttatcaaatatattgtattagccgatttttacactgctataaagaactacccgagactgggtaatttataaagaaaagaggttgaccaggcgtggtggctcatgcctgtaatcccagcactttgggaggctgaagcgggcagatcacgaggtcaggagtttgagaccagcctggccaaaatggtgaaaccccatctctactaaaaatacaaaaattagccaggcgtggtggcaggtgcctgtattcccagctactcagggggctgaggcaggagactcacttgaacctgggaggcagaggttgcagtaagccaagaccatgccattgcactccagcctgggtgacagagtgagactccatcaacaacaacaacaacaacaacaaaaaaaaaaaagaataagaagaagaagaaaaagaaaaagaaaagaaaaaaaagaggtttaattgactcacagtttcacatggctggggaggcctcaggaaacttaacaatcatggcagaaagtaaaggagaagcaagggcacatttaacatggtggcaagagagagagtgaggtagggaactgccacactttaaaaccatcagatctcaggggaactaactcactgtcatgaaaacagtaagggagaaacctgcccccatgatccaatcatctcccaccaggccccttctttaacacatgggaattataattccagatgggatttgggtgggcacacagagccaaataagatcatttggcccatggctcctccaaaatctcatgtcctttcacatttcaaaactaattatgccttcccaacagtccccagaagtcttaaatcattgcaacattaactcaaaagtctaagtctaatgtctcatcagagacaaggcaagtcccttctgcctatgagcctgtaaaatcaatggtggtacaggcattggttaaatgttcctgttccaaatgggagaaactgaccaaaacaaaagggccacaggccccatgcaagtccaaaacccaacagggcagccattaaatcttaaagctctaaaataatctcctttgactccatgtgtcacatcaagggcacgctgatgcaagaagtgggtttccaaggccttgggcagctccacccctgtggctctacagggtatagcctccacaactgcttttaaaggctggcattgaggacctgaggctttttcaggtgcatggtgcaagctgtcagtgtatctaccactcttgggtctggaagacaatggccttcttctcacagctccagtaggcagtgccctggtggggactctgtgttggggctccaatcccacatttcccctccatactgccctagcagaggttctccatgagggctttgcccctgcagcagacttctgcctggacatccaaatgtttccacacctcctctgaaatctaggcaaagtctcctaaactcctgccttctgcacacctgcaggcacaacaccacatggaagtcaccaaggcttggaggttgcaccctctgaagccatggtcttagctataccttggccccttttagccacagctggatctccagtggctgggatgcagggtgccatgtcccaaggctgcatagagcagcaggggccctgaacctggctcatgaagccatttttctattctagacctctgggcctgtggtgggagggactgaggaagatctctgaaatgccctggagacattttccctactgtcttggtgagtaacatttggctccttgttacttatgcaaatttatccagccagcttgaatttctccccaggaaatgggtttttcttttctactgcttggtcaggctgcagatttcccaaacttttgctctgcttcccttttaaacataagttccaatttcagaccatctatttgtgactgcatatgactgtatgttgttagaagcacccaagccacctcttgaatgctttgctgcttagaaatttcttccactagatatcctaaatcatttatctcaagttcaaagttccatgtatctctagggcaggggtaaaatgccaccagtgtctttgctaaagcatagcaagagtgacctttgctccagttcccaataagttcctcatctctatgtgagaccacttcagcctggacttcgttgtccatatcactatcagcatttttgtcaaaaccattcaacaagtctctaggaagttccaaactttcccacatcttcctgtcttcttctgagccctccaaactgttccaacctctgcctattacccagttccaaagtcacttccatattttcaggaatttttacagcagtaccccactcctggtaccaattttctgtgttagtccgttttcacattgctatacagaactacctgagactgggtaatttataaagaaaagaggtttaattgactcacaatttcacatgactggggaggcctcatgaaacttacaataatggcagaaggtgaaggagaagcaaggcacatcttacatggtgacaggagagagacagagagagagcaagggaaggaagaaccacactttaaaaccatcagatcttatgagaactgactatcacaagaacaccaaggggaaaattcacccccatgatccaatcacctcccatcaggcccttcctctgacatgtgggaattagaatttgagatgagatttgagtagggacacaaaaccaaaccacaccataaatcatttgcaaatattttctctcagtctgtggattgtatttgcattctcttgtgtcttccaaagggcagacattttaaatttattcatctgtataccaataccacactgtcttgattgcagtggctttctctaactactccaagacaaaggcataagtgaaaaaggaaaaaaaaatagaggaatgttttttgagttctatatgtgcaagcatacttgccaagaaagaaattttatttttcttagaaagttgtgaggtcacaggtcctcttcctagagcccgccccctccccaccactaggtgttgtctgatagggactgaggtggacatgactaacatctcccatcttctagagataaaacttttcttaatatggcctgagatcacattagctttgtgatggtttctgttgactcacataaagcttgtgatcaactaaaactcctttgttttacaagtgatcctgttaagtctggtcaagtcaaaccctctgcactgatcagtaagcactttatattacataatttttgattagtgattatgtgtctagcctcatctaggtactttatataataaatcactattatggctaccacatactgagcacttttactgtgtgccaaagtgctaaacactttgcataccacattcaaaccttgcaacaaccacttaaaacaggctttattaaccccactttattgttgaagacattgagagttttaggagtgatgccgttccccaagagtctggagcatgagtaggtctggggcaagtcatcccaggctggagtgatgacccctatgttagggacttttaaattataaaacaccaatcaaatgtcaggggtgtcattagcatcattaccattatgccgacttgccaagtctaatttgggaaactttgaaggacgggcttcactatatcagtgattgatttgtttacatgaaatagaagcccactccagctagtttaagcaaaaaatgtaattcaatataaggcgttagaactatctcacagatctcaagggcaggcaagtcgcacaaggaccttacactcaggactggtgttgggggaatgcccacctttccgtccacttctctcaaaacaccaatttcctttctgtctttcagacacgtgtcccaagcagccctccttggcaaatctacatttccttacccaaccaggacctgtggcaaacagtctggcctctccttgtcctaattccaaagttcaggaatctgactggcccagcctggcctctagagtggttgcctgtgagtcaggtacctgcttctgccccagttaactggacaaggaggctgggctgcatagaagaaccaaggacccaggagactccctgggcttgtgggctgagcaggtacctactgaagaaacctgaagaaaactgaagaaacctacttcagtttggccggtcctggggactaggagcaggccaggtgggccacgtttctgcccagtcatttcccagtgctgagcttcttcaggggtaaaatggctttctctggcattttagtgtcttagtgcctctagaaactctggaaggttctttttattttttactttattacttttttttttttttttgagacggggtcttgctctgtgcagcggcgccatctcggctcactgcaacctctgcttcccaggttcaagcaattctcccacctcagcctcctgagtagctgggattacagacgcctgccaccatgcctgactaatttttgtatttttagtagaaatgaggtttcgccacgttggccaggctggtctgtaactcctgacctcaggtgatccgcccgcctgggcctcccaaagtgctgagattacaggtgtgagccaccactcctggcctctttttaaattatttatttattttatttttggtagagacaaggtctcgctatgttgcccaggctggtctcgaattcctgggttcaacctatcctcccacctcagcttcccaaagtgctgggatcacaggcgtgagccaccatgcctggccagctctgaaaggttctgacagagtctagtgacatatgtgtagctcatgctttgggggctgtttaaggctcctggggacttatctacctgtttttcttagtccctcgccctggtttacagaccattcccaagggacttcctgtcttgccttcctgagtcactgctgagctttgaaaacacgatacatgtgctgcttttgaccagccacctcttcactgattccgtctagtctctgtgttttcctttgctgggtgtgactctttgaatcagacttccagaatgttagggctgaaagatcattgcatccgaatgccctccactgctcacttgtgggacctgaggtgcagagaggagaggatgagtgaatgcagatacatccaaggtggcacagaagagggttttaggtgatacatggacaaacattttgttattgtaatagctatatttaaacagactgtactgttgcttaggctgaggctaaatttatttaagtaaaatagtccaataaagaaaaacacaaagcaaaaatatcttacagattataaaaaatgatgaaagtagtacaggaatgagtgacatttgggaaatactacattgatgaatgagtgggtgaatggatgaatgaatgaatatatcaatggataaggtacaacactggaatctttaggattcattttcttacagacatggaattttttcccagtccttgcacttcaagtcagagaatcatcatgatcccacgaaacaccagctcagcccccacaggtgctatacttttgacgagatggaacacaaatggattactatgcagttctcttttttccaggtcagcaaagtccaaacgcaggggcaactgagtgtaccttttaaggtgaatgtcttgaactccagttgctccgcctcctttgggttgctatgacctttttcctaatcttaaagagaggaagagctttaagggccagatggggtctctggtttcccacggggctccccaaaggcagcccttcttggcaaaaccctgggcccatgccaggactgagtcatagaagggaaagtaccctgggtggaagttggacagtgaccttgggcaagccccttccctccttcgctgggtcttagtgcttcctctgagaagcaaggaggtttaactccacctcattcgtgccttcattcaataaacaccaaatgcattcctggcatttgcttggtatgtgggcagataaatagagtaattggattcagtgcctggaagaacccacagtcaggttgggtggggagaaggcacctaagggcctgtaattacagatatgtttaagaagggctagatgatgtggacagtccctgcccactccgggatccctagaatgtgtcagtgcaggggaaggaatacataagtaacttggcaaggtcacagggttacacccagaaaaatgttagcccttgaagttagggacagccctgggcctagctcctgatccttctccatcctacagaaaacctgctgaacatggattttggagttgagccaattcagattccaacccctgagcagacaccaactggaactggaagcgtcactctccgggcctcagtttcctcctttatccaagggggataggccctgggatcctaggacatatgagggttccataagataagtataatgtgtatcatgtcaagagctcagcacagggcctggcccattgtacgactccaccatcaaggcaggaggtcgaatggacatctgtccactctggaaacacacccacctcttgcctcccttggctggtcccagggttggctctctttctggggccctcttacccaagaggtcttgccttagtcctctcttgaccctttgaatgctctcaggggcttcctcttctcaggccagagcctccccattgtacacctctgctctactgatctggctgtgaactggtatgtgccagagacagggaggaggctggtagggctgggattccttgggggaaagctggccagagctgcaggttccccgactctcttcccagcattaaattagcactggagctgcctggtcttgcccaataacttgcccaggacaaggtgacatccttcctcccttctttgaggcaggactgagtggcttcctagaagaagacaggcaggacaagccaagacgcacccaaagaatgggggagggaacctgattgggggagaagatgggagagtctggagcttggggcagcagtggatggaacaggtttgcccacattcctggcaggccccaggattccaaagcactttctgtttttgtcactgccccaccaatcacatactctgccagggccacaaggcaccaggcttttcagagcaccaagcccttccaccttcacttctcattcttcacaccaaaagatgggtactactggctctgttttacagatgaagaaattgaggctcacagaggaagaatcacatgccccaactcggaagggctgatacaattaacatttaatggccaggtgtggttgctcatgcctgtaattccagcattttgggaggccgaggtgggtggatcacttgagcccaggagttcaagaccagcctgggcaacatggtgaaacctgactctacaaaaaatacaaaaattagctgggcgtgatggcacgtggctgtagtcccagctacccagtaggctgaggcagaaggatcacctgggctccagtggtcgaggctacagtgcgccatgattgtaccactgcactgcagcctgagagacagaattagatcctatcaaaaaataaagtaaaatagccattcactaagaactactatgaaccaggtggatttcatacaaaaatcatctctgttcccaatatcccagcaaggtgcccattttacagatgagcagaccaaaatgcaacctgatgaaagcacttgcccaagggcccagaactagcaagcacagagcaaagatgtgaacctagatttgttggactccagatcctaccccttctcaatgttaaaggcaaggaagcggaggctcagtaaggttcaaaccatgtccaaggtcataccaccagcaaggcaaagccagttttcaacccaggtctgtctaaccctgcaacttctgtgtttgccgtatgctacattgtctcaataaacctttttttcatggagcaactggctgatgccaaatgactacaactgtatctcaaacagataaagatccaggacagaaagggtcatgaactattattaccattatcatcaacgctattattaattgctaacatagcagggtcagcatttatactgtatgattcagatttgcagaaataaaactttccttccacaactgaacccaacgcgatcacaactcctcttcccctgatttatttctgggttaaaatgtattttttcatgacaactaaatgcagtgggagagcgtgcattttcttttgctttaaaggacatttggggacaattggtaaaatctgaaataagtctacaggttagataatagtcttgtataatgttaattctccaatttttaattttcgtgttaaaaaaaaattttttttgagacggagttttgctcttgttgcccaggctggagtgcaatggtgcaacctcggctcactgcaacctccgtctcccaggttcaggtgattctccggcctcagcctcccaagcagctgggattacaggcgcccaccaccatgcccagctaatttttgtgttttagtagagacagagtttcacctcgttggtcaggctggtctcgaactcctgacctcaggtgatccgcctgcctcagcctcccaaagtgctgggattacaggcgtgagctaccacgcccggcctaaaaaatttttttaagatagggagtctcactatgttggccaggctggtctccagttcctggcctcaagtgatcctcctgcctcagcctcccaaggtgctgggattatagaggtgtgagccaacatgcccggccaattctccaagtttgataactatactgtggatatgtagggttacgtccatgtttttaggaaatacacactaaagtatttaggaacaaaagggcactatgtggacaacttttaaacatttcagaaaaaaatacacatgcacatgtgcacacaaacacagaagaatatagcagatatagtaaaatgttaacatttagggaatttggatgaagggattcagaattctttgccttactcttccaacttttctataaatctgaaattatgtcaataccaaaaaatttagacaaaaatatttagtcttgtttggaaaaatcgtcagctcaggatctgaacttgctgttagggttgctcgtctctcggtggtgccttctccttctgtccaaggatcacatcgggtggcagaggagccttacctaacacctatgggcttgggcctaggcttctgggcttgatggccctatgggctgccttgccctctgtggtgtctggtgccagcttctccccattgcttctctgctggtgtcactggtcctctctggctttgggcctgggcatacgtcactcctgaagcctccagccacggtgtctgttgccagagctgtgtgctctgagccctcctcatcctgaccccaagcctctcacaggttcctcagggcttagatgtgtcctactggaaacttctgatgcttacccatgacccacaaaggcctcaggggagtcagacgtttgtatgagtcagtctcatcaggaacacagaaagcagactggttgctttaagagagggaattgaatagaaagaattgactatttcaacaggagttttgatggagacaaagaaaaacaaaaaattttaaatgtttttaaaagaactgactaaacattaattgacagatggaaaagccggcggcatgagagcggaggtagtaactgcaggaaacagacaccacccctagggaagggagaacaagggaggaagttaggtgtcaggacctagcagctgggacccagacccggaggagggcatggctgtaactggtgctggtgtctccgaggggccacagtggggctggttctgggaaggtggggaaaacctagaaactagaaccgcttgctgctggaaccaatttcctctgccagggtgaatgaagggccatcgctgaggcgatggtgacaggatggaacggtatgctgagacctttcttcctgggaccgccttgcaccctccagggtcccctattggcagagcctatcctggaaacagctgacggaacagaaatagggtgggccccaatgccagccccagcgtcaccagacggcacatacagggataggtttggggacaagggctgatagcttcagaactggtacgtggagggaatggggagccgtggggctgggccagagagaacgttgcttctctctctccctcaataggcctcacagccattccacctcccgtggaaggaggcatacgccccttagttcattggtcttctactccttccactgggcattcaccctaagcagatgagacctgaatcccaggcacttgctctcttttctatgtttctcagtccatccaggaagagtttcttgcctgacctgagaaattacctacttgatgacatcagggaaacttttattccttgggtcatccaagtttcatctcttgattttttttccttttactttttatcctccttgatctgttaataaatctcttgatatttaaagagaagattttgaaaaaaatgtgtctcttctgtatatattgactttgtagttgagtgcctggatctttaaaataattctgctttggacttttataagagtcccatttgacattcaaggctgaacaatgacttctttctctcaggctatactccagtgccccttcagacaattggtgaagggccattaaacagaaaaaaaaaaaagttggtgaggaagaaaaaggctcaattaaaaagctccaaatatgaccctgctctactactgtgaactgagtactatgtgcttggatgtgttaaggacggaggccattgccatgtgaagaaggtaggaaggtctctttgacttcaaagccctaggttttccccactgggctatcccacttttctggggccatttctagccttttaccttttgataaactgaggcccaggaggctactatgcaaatcagtattgaatccaagttcaggagcagtctaacttgggcaagtcacgtaagcttactttatgtaaaacagggatgttgtgaagatttgaggtaatggatgcagagttttgggcacagtgtctagaaaaaagtgggtatttgataaatggtactactactactaataacaataattaatgtttattgccaggcgtggtggctcatgcctgtaatcctagcactttgggaggccaagatggggggatcacctgaggtcaggagttcgagaccagcctggccaacatggcgaaaccccgtctctactaaaaatacaataaattagccgggcgtggtgggacatacctgtagtcccagctacatgggaggctgaggcaggagaattgcttgaacccatgtggtggaggttacagtgagccgagatcgtgccactgcactctagcctgggctacagagcgagactccatctcaaaaataacaataataataataataaacttttattgactggttactatgccaggctcagggctaagcacttttcatgtgtgaattatcttcatttaattatttgatttaattattttaatccactgcctccctccattcctgctggaacacacagaacctaccttccgtcttcccaccctgacccactgagaaacctcaagctttggacttgtccatgctgccctctaaccctagatcacagttctgagtgtgaatactgccagcccagaagagaacattcatgctggatgcagtggctcacacctgtaatcccagcactttgggaggctgaggtgagtggatcacttgagtccaggagtttgagaccagcctgagcaacacggcaaaacctcatttctacaaaaaataccaaaaaaaaaaaaattatccaggcatggtggtgcacacctggagtcccagctatttagaaggctgaggtgggaggctcatttgagcccaggaggcagcagttgcagtgagccgagatcatgccactgcactccagccagggtgacagagtgagaccctgtctcaagagaaaagaaggaggacatccattgcactcaactgcacatgcattgggatggttggaaacatctgcatgacctcctgctttttgttagtattattgttggattctttcatcgagctatttgcatgttgtgtaaactgcagttcccaatatttgtgaaaacattttgtttgcttgtttgtttaattggggaatttgaaggctttgtgattttattattcttgttggtttttttgtttgtttgtttttgagacagggtctcactctgtcacccaagctggagtgcagtggcgcgattttggctcactgcaacctctgcctcctgagctcaagagatactcccacttcagtctcctgagcagctgggacttcaggcgagcaccaccacaccctgctaatttttatattattattattattattattattattgtacagacagagtttcggtatgttgctgaggctggtctcaaactcctgggttcaagcaatccgcctacgtcagcctcccatagtgttgggattacagatgtgagccaccgcaccaggcttcctgttggtatttttaatctattattttgaaatgattttagatttacagaagagttgtaaaagggaacagagagttcccatataactttcacccatcttccctttttgttacatagccatggcaggaaaatcaaaactaagaaattgacattgccagctgggcatagtggcacttgcctgtaatcccagcattttgggaagctgaagtgggaggatcactggagaccaggagtttgagattgcagtgagctatgattgtgtcactgcacttcagcctgggcaacagagtgggactctcttaaaaaaaaattgacattaccacaacactattaactacacaactacaaatgttatttagattttgccagtttttccatgaatgtgctttttctgtgccaggattccagccagtatatcatgttgtatttaaccatcatgtctccttactcgcttccaatctgtgacaatttcttggtcttgttttttcatgaccttggcacttttctttggtgttttttgtttttgttttttcattagagatggggtctcaatttataagccaggctacagtacagtggcacaatcatagctcactgctgcctagaattcttgggcttgagggatgctcccacatagctggggttacaggaacctgccaccgtacctggctaatttaaaaaatttttttttttttttgtggagacagagtttctccatcttatccagactgatctttaactcctgggctcaatccatcctcttgcctgggccttccaaggtgttgggattacaaatgtgagccactgcacctggcttattggcagttttttattttatcttattttatttatttatttatttatttatttatttatttatttatttgagacagagtctcactctgttacccaggctagagtgcagtggcaagatctcggctcattgcaacctctacctcctgggctcaagtgattctcctgcctcagcctcccgagtagctgggattacaggcatgcaccaccacacccagctagtttttgtacttttagtagagagcgggcttcaccatgttggccaggctggtctcgaacacctgacctcaagtgatccaccacctcaacttcccaaaatgctgggattagaggtgtgagccaccgcgcccagccccattggcacttttgaagagtactggttgggaattttgtagaatgtccctgaggctttgtctgatatttctcactagactggagtcatggattttggggaataccacagagggggaagcatccctcaccttaaataatatctggggatatatgagatcagcataacttgttgctggtgatgttaaccttaatcacttggttaaggttatgtctgccaagtttctctgttgtgaagttgccatttttcctctttccatactctagaagcaagtcactaagtccagtccgcaccaaaggggaaaagaattaagtcccacttcccagaggaggtgtatcaaagaatctgtggacatctgttaaaaccaccatggtcattaatattttgaagaaaatgctttaaggctatccaaatgttgtgttgctccttaacatttcattcactcttttagcattcatcagtggatcttgcctttttaacataaataatgtcacattagccattgtttgacaaaatacataatgtcaataagctattgtgaaatcaggtcttgtattgtactaaccacaataaaatctacacggtctagatgaatttaaaaggtattgcattcagggctgattcagagctgggacctgtggccatattagcttaattattgaaatacatctgtccctactctgttctaagtcccatttctgcccaactcttgggaaacctctccacagttaaaaacaactttctagacatttctgttaagtatactgtggtattatgacatatattggtttttgtgcacagttccgggttcataactcccatagcccttgttacagtcttttgttacaatgttgggcgtgttaggcctcaggggcaggcctcaggaaacagaatctctctttcttctgccctcctttcatctgccccaaggcaggcctctaatctacccccacctttctgactatgagtattaagaccctgtacacactgaggaaaggaatgctgatgtcatgaagcttctataaaaacccaaaagggccaggtgtggtggctcacacctgtaaccccagcactttgggaggctgaggtggaaggcttgagcccaggagtttgaaactagcctgggcaacataatggaacctggcctctaccaaaaaaaaaattaaaaaattagccaggcatgatggtaaaagtctttagtcctagctacttgggtggctgaggtaggaggatcacttgagcccaggaggtcaaggctgcagtgagctgttatccatgccactgcactccagcctgggccacagagcaaaaacttgtctacaaaaaaagagaaaacatggccaggcacagtggctcaagcctgtaatcccagcactttgggaggccaagacaggaggatcacctgaggtcaggagttctagaccagcctggtcaacatggcgaaaccccatctctagtaaaaacacaaaaaattagctgggcgtggtggtgggcgcctgtagtcccagctacttgggaggctgaggcaggacaatctcttgaacctgggaggcagaggttgcagtgagccgagatcatgtcactccactccagcttgggcaacagagcaagactctgtcaaaaaaaaagaaagaaagaaggaaagaaggaaggaaggaaagaagggagggagggaaggagaaaggaaggaaggagaagagagagaaagagagagaaagaaaataaaaataaaaaacaaaacaaaaatacccaagaggactgggttgggagagctccgggtagctgaacacgtggaggttcctggagggtgatgtgcccagggaggacatggaagctctgagtcccttctcccatactttgccctccacgtctcttcatctgtatcccttgtaacatcctttataataaagcagttaacatgtttccctgagttctgtgagccgctcctgcaaattaatccaacccaaaaagggggtcatgggaccacaacttgaagccaatccccgcactggcttcaggaagttttggaggcccggacttgcaactatttcccagggactagggaaaaagagaagagaagtgtctagggatgggaggaccgtcctggggactgagctctcaactgtgggatctcacgttatctgcaaagagacagtgttggaattgaattggaggacatccagctgctgtccgctggttggtgtctcaggaaaacttcccctcacatttgatcacagaagtcttctctgttgattgttgtggtgtgtgagagtaggagaaaaacacggtttggatagagtttttttttccaacacaagtacatatcagagttttattacaatcttgcttcaaggggaaaggtctctagtgggccaatccaaagattcactcctggaagggacattttatgagaaaagagaatggccagcataattattattagatgaacaagaaaaagaacatatcaccctatatcattaaggcaaggacatgggctttggtactactttgttattccccatgatccagtaactaaagcagcagtgcctggctcaggaccagaatgctgcccgcctctcacccctagcttggggttgggccagcctccattctgatggtcagccctgtgctggaatggttgttaattacttgactagtgtccaagttttgggtatccacaaaacaagacatattaattattattatcattattgagatggagttttgctcttgttgcccaggatggagtccaatggtgcaatctcggctcactgcaacctccgcttcccgggttcaagtgattctcctgcctcagcttcccgagtagctggaattacaggcatgtgccaccaggcccagctaattttgtatttttagtagagatggggtttctccatgttggtcaggatggtctcgaactcccggcctcaggtgatccacccacctcagcctcccagaatgctgggattaaaggcatgagccaccgtgcccggccctttattattattattttgagacagggtctgtctgtcacccaggctggagtcccatgacgcaatcagaactcaatgcaggcttaacttccctggcttaagcgatcctcctgcttgagtagctgggactacaggcatgcgccaccatgcctggttattttttttttttcagtagatatgggatctcgctatgttgtccaggccagtcttgaactcccaggctcaagcgatcctcctgcctcattctcccaaagtactgggattacaggcatgaaccaccatacctggccaaaacgaggcatattaaataatcagtctacagtttggttcaggcatagtttgatttggttcagagaaagcagtctttagagccagcaagagtaggttttgaaaaccagtatcgaatacaagttctggaacagtctagcattgggcaagtcatgtaagctcattttatataaaatggagatgtcatgaggatttgagatcataaatgtgaagtttctgacacagtccctgggaaataatagctatttgataaacggtagtactattaataataaaaatagtagtaattaataaacatctattggctagttactatgtcaggcacagagctaaacactttgcatatgttaattattttaattctcacattaaatctatgagttagatgcctttagtatcacccccactctataaataatgaacttgaggctcagagaattcaagtaacacattttaagatcacacacagccaggcgcagtgactcacgcctgtaatcccagcactttgggaggccaaggtgggtggatcaccaggtcagagttcaagaccagcctgaccaacatggtgaaacctcgtctctactaaaaaaacaaaaattagcagggcatggtggcgcatgcctgtaatcccagctactcgggaggctgaggcaggagaattgcttgaacccattatgcagaggttgcagtgagccaagattgcgccgttgcattccagcctgggtgacagagcgagactccgtctcaaaaaaaaaaaagaaaaaaaaatcacactactaggccaggtgctgtggctcacgcctgtaataccaacactttgggaggttggggtgtgaggatcacctgaggtcaggagttcaagaacagcctggccaacatggtgaaaccttgtctctactaaaaatacaaaaaaaaaattagctgggtgtggtggcacacgcctgtaatcccagctacttgggaggctgaggcaggagaatcacatgaacctggggggcagaggttgcagtgagccaagaccgcaccactgcactccagcctgggtggcagagtgagactttatctcaaaaaaaaaacaaacaaaacaaacaaaaattacacagatgcaatgttggtggagctgagattcaaacccaggcagcctggtgtcagcacctctataataaacatgcaataaacatgagcaccctctaatcccttgcaacaactctaagccttccagaattctacagcctgcaggttgggagctcctgctatagacctgacagaggcctttggctacttaatgaaatattctgacaccaggagggttgcatagttatttttctaactttacagcaagaggaagacaggtcaaaaaaaaaaaaaacagatttatgcagttacccagaaacagagatatttggctgacaaggtacgactgttcagaaatagtcattggacagtactttcccccaaaacactgtctcaaggtccctgtcagaggtgttcaaaccagaggactccattttgagtgagggcaaggaaaatgaggctgggacttgctgggctgccttcccagaaaatcaggcattcctagcctctagatgtttacggttaagggagcaaattaacaatgtttactaaaacaaacccagacttgggagtgtgcaggtatctcgatatctggagaatgaaggcattcctaattttgttttaaagataaaatcgattcttgcaaaacacagtaattaagaaaattaattatttatcacaaacccttgtaacagagcacatctcatatatgcaagcatggcacctaaggtggatgcattcctcctcttactttcaggaacatcctgttctatggagtagctgtccttttgccactgtactttcttaataaacttgcttttgctttgcgctgtgcgcttgccctgaattccttcttgcataagatccaagaacactctcttggggtctggattgggacccctttcctgtaacatccccattcgagaattactgtctcggtggccgggcgggcgcagtggctcatgcctgtaatcccagcactttcggaggccgaggcgggcggatcacaaggtcaggagatcgagaccatcctggcaaacacggtgaaaccccgtctctactaaaaatacaaaaaaattagccgggcgtggtggcgggtgcctgtagtcccagctactcgggaggctgaggcaggagaatggtatgaacctggggggcagagcttgcagtgagtggagatcgcgccactgcactccagcctgggcgacagagcaagactctgtctcaaaaaaaaaaaaaaaaaaaaaaaagagaattactgtctcttctactttcctagatgtcacaaaacctcctaaaattctgaagataacaaattgttacaaaaagaaactttttttaaaaaaagaaaaaataaatacataaaaaagaaaaaatcaggacttctctttcataaaaaatgaaaatgggagtaatctgctaaaaaattatttttttttcctggtttagcataaaaggttccaaaaactcccccttgtctctcccgccgagggtaaggtgggaagcaaggtggatcctccatgacccacctccatccccacaagtgaacttttttgtttctaagttctgggccctgcttaggggcaactcaggatctattgtttaagaggagttgtccaaacctttcaaagtgggaatgagaggcccactcccacagtatgggtcctgggacactaagagtcccagccaggacccagcgtggtgcccaggctgatgccccgccggctctcactgcttagagcatgatggagagttcaccagagtgaggagggccacactggagagccagagccatgccccctggcagagaaggtggcatcagatgactgtcccatgggctttaagactcttttccccattttgggagtgaaagagcaggttcacttctcttggattttagaagttctggctgttcttgaatgacccaaattgtcagagtgttgagggaggagaggcactgcccacaaaggatgatcttggactttgtgccagtctcaccagggggtactcaagtcacatttgtttattttattttattttattttattttattttattttatattatttcttattttattttattttattttgttttttgagatggagcttcgctcttgttgtccaggttggagtgcaatggtgcaatcttggctcactgcaacctctgcctcccgggttcaagcaattctcctgcctcagcctcctgagtagctggaattacacaggcatgcaccaccatgcccggctaattttgtatttttttagtagagacagtgtttctccatgttggtgaggctggtctcgaactcctgacctcaggtgatccgcccaccttgtcctggcaaagtgctgggattacaggtgtgagccaccgcgcccagcctttttatttatttttaaattgtattatatttagagacaggtccctcagctgggctcagtggctcatgcctgtaatcccatcccaacactttgggaggccgaggcaggtggatcacctgagtccaggagtttgagaccagcctgggcgacatggtgaaaccctgtctctatttttaaaaaataaataaatgaataaaatagagacaggtctcactctgccacccaggctggagtgcagtggcatgactacagcccactgcagcctcaaccccctgggctcaagtgattctcccaactcagcctcccaagtagctggcactacaggaatgtgccaccagacccgactaatgtttttgctttttgtagagacagatctctctatgttgcccagccaggtcttgaacacctagcctcaagtgatcctcctgccttggccctggaagcactaggattacaggtgtgagccacagtccctgctcaacactttaaattcaatttcaataagaacaattttaggccaggagcagtggctcacacttgtaatcccagcacttttcgaggccaaggtaggaggatcacttgaggccaggagttcaagaccagcctgggcaacatagagagaccttgtctcaattaaaaatatgtatatgaaaacaatttttttggccaggcatggtggctaacacctgtaatcccaacactttgggaggccaaggcgggcgaatcacttgaggtcaggagtttgagaccagcctggctaacatggtgaaaccccgtctctactaaaaataaaaaaatcagccgggtgtggtggcggacacctgtaatcccagctactcaggaggctgaggcagaagaatcacttgaggtggaggttgcagtgagccgagatcgcaccactgcgctccagccttggcaaaaagagcaaaactccatctcaaaaaaaaaaataataataaaagaaagaaagaaatatttttaagtactttgaggccaggcgcagtggcttatgcctgtaatcccaggactttgggaagcaaaggcaggaggatcacttgaagccaggagtttgagaccagcctggccaacatggtgaaaccccatctgtactgaaaacatacaaaaattagccgggcacattagctgggtacatacaaattggtggcgcatacctgtaatcccagctactcaggaggctgaggtatgagaatcacttgaaccagagaggcaggagttgcagtgagccaagatcgtgccactgcactccagcctgaatgacagagaccctgtctcaaaaaaaagaaaagagagagagaaagagagagaaagaaagagagaaagagaaagaaagaaagaaagaaaaaagaaagaaagaaagaaagaaagaaagaaagaaagaaagaaggaaagaaagagtgaaagttactttgagaattctttttcagtgcagaagcatataacaatgactttctgctgtatcaccccaccggggtacagcgacatctggaatggggacttggcaagacttggcacaccaaatcaccaagcttttcttcatccccatcacccattcatgcttaattcacttgggaacccacaaagctcctttgtgtgcggtgagccagagcatccggatatttggaagggcctgggctggtgtggtcctctgagcaagcagagggtacagagagtcacttctgctgatgaggtgggagccaggaaaaacagaactaggaggaaaaataacctgccaccaaaaagctccggtcttatggaaaagcagtatcacttttgaggatccctcatatgacacatggaactttcattattcattgtgtttcgagacaaaagatctttctgtttctgctctatgctgaaacattctaaaattatttggagatggaaaccagttttgaaagccccaggtacatcctctgttggcaaccgacaaccatcctaacagagggcctagcacattatcccacaccccgaca

SEQ ID NO: 808 - DNA, 35389 bp, Homo sapiens
aaccatttcagatcacagattctggaaatgaagatccagaaatctcagcatttctgcatcctaagattgcttctggaaggactttaaggtcatctggtcaagcccctcacacacaaggaaatgacttctcgaggagacccactgctcctagcaaagttgatgtcctcacatgtgcatcccagtctgggaaactcccccattccagcagcctcctgccaatggagatgggctgctcacagccagcctcagggcataaaacaggggcaagaggtgaggcaggaagacactggaaggacgtagaatggaccctaccctggcagacttcctctcctctgtcaccttctccctttctggagggaatgtcaccgcctgggcacagagcgggcaggaattcttttgttaacttcccaaactggaacatagactcaggcccaccccttcccttctgattctcctttctccatattcatggctgccaacaatgagctagaccctgcaagctacaaagataagaggcagaggccctgggaaggagaaactttgctcagacttcatgggggaaggaacagttaattctgcccggggacccagggcaggcctccctgctggaggaggtgtctgaacaaaaggagcagtggggtggggaggctgggggtggggtgggggatgttagtgatgatgagggacagcagctgaagggaaagggcatccaggaagagggtgacagtccaagaaaggggcagtatgagggagctggtctcctattttctcaggggccatggccactgctgctctttctcctcccagaagttgccttgacttcccctataagaaagggaaaggagattccttttttttttttttttttttaaagagacaaggtgtccctttgttgtgcaggctggtgtcaaactcctggcttcaagagattctcctgcctcttcctcccaaattgctgggactacaggcttgagccactgtacctggccagagagtccgtttaagaagaaaatctgtctgcttcacctgagttcctaaaaagaccagcacatggtggatagccaatgaaggcttgttagtgaatagaggagagggcagagagcagatgaagggtctattaggctgagactaggccagctggggcacagagtgcatgataggtggaggggcaagaaggggactggtgtgttctgagcatctggtttgtctccacatcttcagaatcttattcactcccccaatagtgagaggtaggtggtattgctcccattctacagaggaggaaaatgaggttcagtgaccatctgggattacggctcgttctgtctgatttcaaaagcccatctttctaggtgctttctggcatgtcctcacctggttattgccaagaactcagcagtgaccaagttcttggtaggcacccacgcctttgaattcctggtgaagtggagggttcctggaaaggccttcggaaacagaaggccactaccaggcttggtgatcacccagccacattcctctccacccccaggtaaggacaggaggcagttctgagaggtaaagcggcttgctcacatggggagtgggtggctggaggtgggattgaccaccctgcccctgggcactgactcatggcagctgctgtgggaaagccacttccagccttggctttcccagccaggcaatggccaggattgctttgccgaatctgcctgggcctggagccagggaactgggaaaaagctgagcacagcatattgccagggtacctcaccctctccctgctcccagtgacaacagcttgcatggggcatacctccccgtgtgcaggagcctttccagtttccagagggatcaggccaggcccgggccctgatgctcctcaaatccccagtacccagcacaggcagggtgacccaccatcctggtgtgctgaggactgtcttagtttcagcatgtcctgcatcttgggaactcctcagtcctgggcaaacctggatggttggtctccctagccctgcaccaaattcatagttggcactgaagaaatgttctaagtaggccaggtgtggtggctcatgcctgtaatcccgggactttgggaggccgaggtaggaggattgcttgagcccaggagtttgagatcagcctgggcaacatagggagaccccatctctacaaaaaataaaaagattagccaggtacgatagtgcgtggctacagttccagctattcaggagactgagccaggaggatcacttgaacccgggaggtcgaggctgtagaaagctgtgattgcaccactgcactccagcctgggcaacagactgactctgccttaaaaaaaaaaaaaaaaaagagaaagaaaagaaaaaaaaaaaaagaaaggaaaagaaatgttcccagtaaatgaaggaaattagcaaactaaagaacaacaaatgggcaacagtgctgtgagggaaacagaacaaggactgctgagctcattttgtagctgaggaactgaggcctgaagagtttaaaagttcaggctccccatctctatcttatgcctttcctccgcaccagatctcgaaactgttccctgataattttgagctggtccctggggtgagaagcagctgggccaaagagaaggcattcagtggctctgtgcctaagcttaggcagaaaggacactgagagatggggaggagggggggctgctctactttttttttttttttgagacggagtctcgctttgtcgcccaggctggagtgcagtggcacgatctcggctcactgcaacctctgcctcccaggttcacgccattctcccacctcagtctcctgagtagctgggactacaggcgcccaccaccacacccagctaatttttttgtatttttagtagagacggggtttcaccatgttaactaggatggtctagatctcctgacctcgtgatctgcccgtctcggcctcccaaagtgctgggattacaggcgtgagccacagcgcccagctggggggctgctctatttcaactgcatagcgaagagcctgggtggccctgcctggcttggtgggtgcaaacctgacttcagccactgctaactgtgtggccttgagcaagtgacatattctctcagctttagtttcctcatctgtaaaatgggaataccataatgatgcccagctcctgaggtttttgcaagtattaaatgagataatgcatagaaagtaattagcacagtgcctggcacagcataaatactccagaaatatcggctgtttttcttatatatatatatatatatttctttcctattaatgtatttttaattttatttatttgttattattattttgagacagggtcccactctgtcacccaggctggagtgcagtggtgcaatcttggcttactgcagcctcagcctcctgggctcaagcaatcttcctgcctcagcctcccaaagtgctgggattacaggcatgagccactgtgcttggcctttttaatttttttatggtcaattgcaatagtgttctttttcttttttatgttttttcttttttatagtaattatttttattatttggtgcaacaggcattaactgcatactcacttcgtggtgtagtgggagctgcttcagaggacaaaagtctgacactcctgttatttggcaaatcccatggcttctctgcgactcagtctccatgtctgtaatatggggttttacctaattcagggctgctgtgagaagtgtgagctagtgtgtatttggagagaacaagtacttaataaatgagccatctctttcctccccatgcccgtcttaaactttagaatgatcctgtaaagttcatattattattatttttatttatttatgtatgtatgtgtgtatttattttttgagacagagtcttgcactgttgcctgggctggagtgcaatggcactatcccagctcactgcaacctctgcctcctgggttcaagcgattctcctgcctcagcctcctgagtagctgggattacaggcgcctgccaccacacccagctaaatttttgtatttttagtagagacggggtttcactatgttggccaggctggtctcgaactcctgacctggtgatccacccgcctaggcctcccaaagtgctgggattacaggcaagagccaccgcgactggcctacatagtattattattcccaacttacagaaaaggaaacagtcattagaggatacttagaaaacgtctgtgtcgtgaataaatgaacgagtgactgagtgagtggatgcgtggacgaacgaatggatgaatgaatgagcggatgtgcgtggactctgcgggcggggcgcccgtagtctccctccttcgcaccccgggcgcctgggaacctcctcgcgcgtttggccactcgctgctcctggcagtaggggcttcgggccccgccgctgtccccacccaggtatggggatgcggagttgatgggtgcggggcgctgggagggggcagatgaaaggggcagtcgaaagggggccatgcgcgccgagcgcagccgggtcattagccgcgggtgtgagcggcggggcaggcttatcgcccatccaggcctggcgggcgggcgagtccccgacgcggctgccgccgccgcccgcggcagagggcacggcggttcccacgctcgggccctggttcgggggcgttctcgggacggcgtggccgcgctcaccaccaccgcggaggccgggctgtaattaggataattgcgctgctcccagcctggggcagctcaggaccccggctgcaccgcgctggcccgggacgggcgggggcagggggtggcggggcccgagcgatacagcccctggcgcagtccgttcctctagacaggtgagtcagcacacctgggcggccccagccaccaaggggctttgtggggaaatgagggaaggggagagaactagcctggacggagcacctaatgtatgccggcggtgtggattaaactattccattacggctcaacattggggtattgcgggagtaggtgagaacatctgtcctgcccggtggtgcctgacccagagaagatgtgcaagacgaatagcatcttcatctgcacagcagtttagcaggtgggcatcaggaggcccagaggttaagtctcaagactacacagccgggagatgcatgcttcagaaaggaggacgatgaagacctgcctggagtggtggcccacaactgtaatcctagcactttgggaggcctaggcgggggaattgtttgagttcaggagttcgagaccagcctgggcaacatagcaagacccaggtctcccccaccactccatctctacaaaaaatacaaaacaggcctggcacgatggctcacgcctataatcccagaactttgggaggccaaggcggtcagatcacctgaggtcaggagttcaagagcagagctggccaacatagtgaaaccccatctctattaaaaatacaaaaaaattagctgggtgtggtggcaggcgcctgtaatcccagctactcatgaggctgaggcaggagaattgcttgaacccgagaggcggaggttgcagtgagccgagattgcgccattgcactccagcctgggcaacaagagcgaaactccatctcaaaacaaacaaacaaaaatattacctgggtggtgttgtgcgcaggtagtcccagctactcagaaggctgaggcaggtgaattgcctgaacccgggaggtggaggttgcagtgagatgacattgtgccactgcactccagcctgggtgatggtgtgagaccctgtctcaaaaataaaaagaaaagaaaagaaaaaagaaagaaaatgaagacctgaccgtcctggctaacacagtgaaaccccgtctctactaaaaatacaaaaattagccgggcacggtggcgggtgcctgtagtcccagctactcgggaggctgaggcaggagaatggcatgaaccccggaggcggagcttgcagtaagccgagattgtgccactgcactccagcctggacgacagagcgagactccatctcaaaaaaaaagaaaaagaaaaagaaaaagaaaatgaagacctatgcccagcgagctttggctttgctccctcaagtacctcatttttactgcatcttggatcccaaccataaagcccattcctgatccttaggttcttggcaggcctaatcataactgcagatctttatcactgatacaagccacatgaaatccttctggaaaaggcaggttaaaaagaaatgatctgatttcaagatctaatctctaatcctaaacccaacctaaaccttaaccctgctcctccatacctaactcccaaattaatcttcaccttggcccctgcccatgtctccaaacttctccccgcagtgatcctctgccactcctcccacctccccaggtgccctcctttcagtggtggtttcaagtctctgggtctttgcatatgctgcagccgcacgtcaggatatccttttccagggccacctggtaaactcctctcacccttcaaggtcctccacaagcccttggtgttcctttcccggccctgtgctgccttgtttcctgaccaggctctcctcagattcagctcttaggaggtagggtcttaatctgctgggagtaaaaattggaagtagaacaaatgattgattgtgaatgagtgagtgagagaatgaatgaatgaatgacttactgaataaacaagtgaacactggccaggtgcagtggctcatgtgtgtaatcccagcactttgggaggccgaggcaggaggatcactagagcccaggaggttgagacagcctgggcaacatagggagactggatctctacaatttttttttttaaacaaacaagtgaatacctattctgaatctaaatccttaaccttctccctggatccattcccaagaagggaacaattggaagatcaagagaacccccagccaccaggtgccctgagattgttctgtgtgtgtgcgtgtgtgcgtgtgtgggtgtgtgtgttttcctgtgtgcatgcccgtgcatgcacatgcgcttgagtcaggaactttgaatcagacaagcctggagtccgctcctggccacagggttcaccaactgagtgacctgagcaagtacctgcacctctctgggtcttcatgaactcaaacatgctaacaataaaaaacccatcatggagaatcagctcttcttcctttgttcatttaccctcccccagccccttgcctatggcaggctcagtgtttggtgctgcgggaacaggagtggaaggaacacatttttcccctcaaggagcactagtaagggtaggaagcaggtctgcagggaagagggaacagcccctgggtggagagggaagcttcttagaggatgtgagaatcacttgggtttgctgctggacaagtcaaggcagaggcagccacatgttcaaagacaacaagctgtgaacaaagggttccctattactgctggagaatgaggtgggaggtggggggtggtggcagaaattggggctggtgagggtgacagtgtccagatcagggaaggctttaggggcagtctgtgaagtctatgaaatatgcacactttattctctaagcaatagggagccattgcaggtttgggcagggagggatgggcaggtctgtgctgtagaaagctcactctgaccagcagtgtggaggccatcatggaggtggctgtggtgagaagccggtgggggagtgcaagggacatgaaatgatcttggtaatagccgacctttattgaatgcctactatgttctaggtgcttaactcatctaattcccacaacacccatctgaagtagattctctcatgagctccttctagaaatgtcatcaaaacactaaagtctccaatgtttctatctccagcctgaacctcccttctgaattccacacctatatgtgcaatagccggttggcttctctactgaatgtctaataggatcttaaccttaacgagtccgaaaacaatctccccaaacctgcttctctcagtcttctccatctcagtcaatagcagtttcacttttccagttgctcaggctaaaaatgttggagtcatccctgtccaccctccacttcttacttcccatatctgatctatctgcaaatcttgtcggttctaacttcggtacataccttctggtcttctcacccctctcctccagactgctgccaggtgggccaagtccccactgtttcctacctgaattactgcagcggccccattactgatgggctccctgcctctgccccttcgacctattcttcacgcagcagctggtgtgaccttaacatacaaagctagatcaggttcctcctgctcaaaccttttcccagctccctagagtcaaagtcctgataatagcagagagatcccaacatgatccagtccttgtctccccagccccttgtcagacctcttcccacatgcttccccccaactccagccacactgacccccttgccagctttcccattaacctcagaattattgcacttgccattccttctacctggaatgccatcttcccagatatccgtgtcattttctccttcaaatttctgttcaaatgtcatcttactagtgagatcctccttaaccaccccattaaaaataacaacttggctgggtgcaatggctcacacctgtaatgccagcactttgggaggccgaggtgggaggattgcttgaggctaggagtttgagaccagcctgagaaacataaggagacccccccatctatacgaaaaattaaaaaattagctgggcatggtggtgcgtgcctgtagtcccagtgactctggaggctgaggcaggaggatcccttaagcccaggaggttgactctgcagtgatccatgatcctgctgctgcactccagcctagccaacagagcgagagcctgtctcaaaaacaaaacaaaacctcaccttcctcccctacccaggcaccttgtatccccttccctgtttattgtttatactacatgtcaccatctgaaacattttataaattatattttactttctggtttattatctttctcttctcctctccccttccctcccctcccctcaccccactagaatgtcagctccacaaggacagagatttttctttatttgcttcactgccatatccccagtgcctaaagtattgtaggtgcccagtaaattcttctgaatgttgactatggaatctgtgtgctacagaaactaaggcacaaggagattaagtaaacttgcacaaagtcacacactagtaagtggttggatttggataatgaactcagaatataggcagtgacagcagagaatgagaggagggaatgaaagaaaacaaggacctgacagatgggctccaggtccatgggctgatgttgcaccaaggggtgaggttgatgttgtgagacctccgggggttgacatgaagattaaatgagctgagacttgaaaacacattgtatatatagggaaaagagattttaagaaaactattattccatgaattttgaattcccagccatgttcctggccttctccacccttgctgctgaggcatctgttgcttccagtcgggggcagattcagcagcagatgagcagctcatccttagctttgcctttctaaatggattttttgaaagagtagaggagacctaacagtgtcagaatccagaatttcaatgtaaaggcctacacagttgggagagatacccaaaacttccttttaaatgtcaagacctgggctgggcgcagtggctcacgcctgtaattccagcactttgggaggctgaggtaggtggatcacctgaggtcaggagttgagaccagtcttgctaacatggtgaaaccccgtctctactaaaaatacaaaaattagctgggcgtggtggcgtgcgcctgtagtcccaggtactcgggaggctgaggcaggagaatcacttgaacccgggaggcagaggttgcagtgagccgagattgcatcactgcattccagcctgggctacagagtgagactcttgtctctaaaaataaaaataaaatcaatgtcaagatctggagtctggccaaggtggggcctggactttttactatgagccctggagggagggaaggtatgagacaaagcagtgattctccaatttgagtgtgcatcagaatcatctggagggcttgtttcaacagggatggctgcctgggccccacctgcagagtttctgattcagtagctccagggcggggctggagaatttgcatttctaacatcttcctaggtgatatgaaccacatatatatatatatatatatatttaagaggcaaggtctagctctgtcactcagactggagtgcagtagcctgatcacagctcactgcaacctcaaattcccgggctcaagcaagcctcttgcttcagcctctggagtatctaggactacaggcatgtgccacaacacctggctaatttttttttttttttgtagaggcggggtctcgctgtgttgcccaggctagtctcaaactcctaggttcaagtgatccccctgcctcagcctcccaaaatgctgggattgcaggcatgagccaccgagcctagctctaataccaaccacactttgaatagccctgatgtaagggttgttctcagttccaggggcagcctcgcagagcccatgccctccaggatggaggtgtgaagagggaaccccaggaggtggtgggggtaggtgtatggaaatgctcaggaagacggtaggcaagaagaaggttggggtcagaggagagggtgtgaagactgtggccaggaacatagttgtgggcagcagaggccaggggacctgcccagaggacaggtgggacgtgtgcctcagccacactgcagaaggcagacacttgaaagaggaagcagtactgggtcagaggccccttccccaaccatgagactatccaagcccccaactccattccccttcagatgtcaccctgaagaagggacagatggggctgagaagtggtgaaagattgagtattttctcccaaagagcctgaggggacttgggatggcacaatttagaatgtcttgcaacaacatcatgaattaatccctctgctcctaccagggtatgaagaagtggccccaaagttgcagtgcaatggttaagagcaaacatttcctggatgcgcaatcctaggcaggagacaccctctctgaacttcagtcctcaaatctaaatcgaggatgaaattatcatccatctcatcagattgagaggtttaaaagagaccatgcatatagtggagtgttgagctagagcctggcagagggcaaatattcaatcaatggtatttatgatgataggttttaaaggctgggcatggtggctcatgcctgttatcccagcactttgggaggctgaggtgggtggatcacttgaggtcaggagttcaagatcagcccggccaacatggtgaaaccccgtctctcctaaaaatacacacacacacacacacacacacacacacacacacacacacacacatattagcccagcatggtggcgggtgcctgtaatcccaggtacttgagaggctgaggcaggagaatcacttgaacctgggaggctgagattgcagtgagctgagattgtgccactgtactccagcctggacaacagagtgagactctgtctcaaaaaaaaaaaaaaaaaaaaaattcttccctgccttcagtttgttctctcttcctcccttcctcaaatacttatacttactgggacctactggcccctgacatggattttgcctccttggaactcacatcaggaaatcagaccagtcaacaggcacttagtagctgactgtgggctggtgctgtgttggggtaagctcggggcactgggactggggacgctgagaagtctttctggaggatgagatgcattgcttatttagggggctttattgaagctgataataaattaaaagtatatatatatttaaagaataataacacttggggctgggcatggtggctcacacctgtaatcccagcaccttgggaggccaaggcaggaggatggcttgcacccaggtgttcaagaccagcctgggcaacatagtgaggcctcgtctctattttacttaaaaaagaatcactcctgggaaggaaagagtgaaaattataaactttctccctcagtcaaggttcagaaatataattatagtgcgcaacactttataatgggaggcaggagagcatggttgactttggaatcagacgagctggaatccagattctgaggtttaacaaatggtctgaccctggactacttagcttctctgagcctcggttttccttatctgtaaaatgagactaaaggtagctacttgacatgtgggtttgtggtaagatttaaaggacgcagattatgtacagcacctagcatatattatttgctaactaattctgagtccagggctggagagtggatctgggcttttttcctctccaccctgtgtcctgtcactttctgtttctccctggttttctggatcataatgaactgattgatgacccacctgtcttctccaccaacctgggtgctccttgagaacagagtctggttcagggtctgtttagtttatcccccgctttttttttttgctcagagacagtcttgctctgttgcccaggctgaagtgcagtggtatgatcatagcttactgtaaccttgaactcctgggctcatgtgatcctcccacctcagcctcccaaagcactgggattataggtgtaagataacatgccctgtcgctagatatcttctttggtgaagtatctgttcaagtattttgcccctatttgcattacttattttctaattattgcatttggaagttctttttatattctggacacaagacttttatcaaatatattgtattagccgatttttacactgctataaagaactacccgagactgggtaatttataaagaaaagaggttgaccaggcgtggtggctcatgcctgtaatcccagcactttgggaggctgaagcgggcagatcacgaggtcaggagtttgagaccagcctggccaaaatggtgaaaccccatctctactaaaaatacaaaaattagccaggcgtggtggcaggtgcctgtattcccagctactcagggggctgaggcaggagactcacttgaacctgggaggcagaggttgcagtaagccaagaccatgccattgcactccagcctgggtgacagagtgagactccatcaacaacaacaacaacaacaacaaaaaaaaaaaagaataagaagaagaagaaaaagaaaaagaaaagaaaaaaaagaggtttaattgactcacagtttcacatggctggggaggcctcaggaaacttaacaatcatggcagaaagtaaaggagaagcaagggcacatttaacatggtggcaagagagagagtgaggtagggaactgccacactttaaaaccatcagatctcaggggaactaactcactgtcatgaaaacagtaagggagaaacctgcccccatgatccaatcatctcccaccaggccccttctttaacacatgggaattataattccagatgggatttgggtgggcacacagagccaaataagatcatttggcccatggctcctccaaaatctcatgtcctttcacatttcaaaactaattatgccttcccaacagtccccagaagtcttaaatcattgcaacattaactcaaaagtctaagtctaatgtctcatcagagacaaggcaagtcccttctgcctatgagcctgtaaaatcaatggtggtacaggcattggttaaatgttcctgttccaaatgggagaaactgaccaaaacaaaagggccacaggccccatgcaagtccaaaacccaacagggcagccattaaatcttaaagctctaaaataatctcctttgactccatgtgtcacatcaagggcacgctgatgcaagaagtgggtttccaaggccttgggcagctccacccctgtggctctacagggtatagcctccacaactgcttttaaaggctggcattgaggacctgaggctttttcaggtgcatggtgcaagctgtcagtgtatctaccactcttgggtctggaagacaatggccttcttctcacagctccagtaggcagtgccctggtggggactctgtgttggggctccaatcccacatttcccctccatactgccctagcagaggttctccatgagggctttgcccctgcagcagacttctgcctggacatccaaatgtttccacacctcctctgaaatctaggcaaagtctcctaaactcctgccttctgcacacctgcaggcacaacaccacatggaagtcaccaaggcttggaggttgcaccctctgaagccatggtcttagctataccttggccccttttagccacagctggatctccagtggctgggatgcagggtgccatgtcccaaggctgcatagagcagcaggggccctgaacctggctcatgaagccatttttctattctagacctctgggcctgtggtgggagggactgaggaagatctctgaaatgccctggagacattttccctactgtcttggtgagtaacatttggctccttgttacttatgcaaatttatccagccagcttgaatttctccccaggaaatgggtttttcttttctactgcttggtcaggctgcagatttcccaaacttttgctctgcttcccttttaaacataagttccaatttcagaccatctatttgtgactgcatatgactgtatgttgttagaagcacccaagccacctcttgaatgctttgctgcttagaaatttcttccactagatatcctaaatcatttatctcaagttcaaagttccatgtatctctagggcaggggtaaaatgccaccagtgtctttgctaaagcatagcaagagtgacctttgctccagttcccaataagttcctcatctctatgtgagaccacttcagcctggacttcgttgtccatatcactatcagcatttttgtcaaaaccattcaacaagtctctaggaagttccaaactttcccacatcttcctgtcttcttctgagccctccaaactgttccaacctctgcctattacccagttccaaagtcacttccatattttcaggaatttttacagcagtaccccactcctggtaccaattttctgtgttagtccgttttcacattgctatacagaactacctgagactgggtaatttataaagaaaagaggtttaattgactcacaatttcacatgactggggaggcctcatgaaacttacaataatggcagaaggtgaaggagaagcaaggcacatcttacatggtgacaggagagagacagagagagagcaagggaaggaagaaccacactttaaaaccatcagatcttatgagaactgactatcacaagaacaccaaggggaaaattcacccccatgatccaatcacctcccatcaggcccttcctctgacatgtgggaattagaatttgagatgagatttgagtagggacacaaaaccaaaccacaccataaatcatttgcaaatattttctctcagtctgtggattgtatttgcattctcttgtgtcttccaaagggcagacattttaaatttattcatctgtataccaataccacactgtcttgattgcagtggctttctctaactactccaagacaaaggcataagtgaaaaaggaaaaaaaaatagaggaatgttttttgagttctatatgtgcaagcatacttgccaagaaagaaattttatttttcttagaaagttgtgaggtcacaggtcctcttcctagagcccgccccctccccaccactaggtgttgtctgatagggactgaggtggacatgactaacatctcccatcttctagagataaaacttttcttaatatggcctgagatcacattagctttgtgatggtttctgttgactcacataaagcttgtgatcaactaaaactcctttgttttacaagtgatcctgttaagtctggtcaagtcaaaccctctgcactgatcagtaagcactttatattacataatttttgattagtgattatgtgtctagcctcatctaggtactttatataataaatcactattatggctaccacatactgagcacttttactgtgtgccaaagtgctaaacactttgcataccacattcaaaccttgcaacaaccacttaaaacaggctttattaaccccactttattgttgaagacattgagagttttaggagtgatgccgttccccaagagtctggagcatgagtaggtctggggcaagtcatcccaggctggagtgatgacccctatgttagggacttttaaattataaaacaccaatcaaatgtcaggggtgtcattagcatcattaccattatgccgacttgccaagtctaatttgggaaactttgaaggacgggcttcactatatcagtgattgatttgtttacatgaaatagaagcccactccagctagtttaagcaaaaaatgtaattcaatataaggcgttagaactatctcacagatctcaagggcaggcaagtcgcacaaggaccttacactcaggactggtgttgggggaatgcccacctttccgtccacttctctcaaaacaccaatttcctttctgtctttcagacacgtgtcccaagcagccctccttggcaaatctacatttccttacccaaccaggacctgtggcaaacagtctggcctctccttgtcctaattccaaagttcaggaatctgactggcccagcctggcctctagagtggttgcctgtgagtcaggtacctgcttctgccccagttaactggacaaggaggctgggctgcatagaagaaccaaggacccaggagactccctgggcttgtgggctgagcaggtacctactgaagaaacctgaagaaaactgaagaaacctacttcagtttggccggtcctggggactaggagcaggccaggtgggccacgtttctgcccagtcatttcccagtgctgagcttcttcaggggtaaaatggctttctctggcattttagtgtcttagtgcctctagaaactctggaaggttctttttattttttactttattacttttttttttttttttgagacggggtcttgctctgtgcagcggcgccatctcggctcactgcaacctctgcttcccaggttcaagcaattctcccacctcagcctcctgagtagctgggattacagacgcctgccaccatgcctgactaatttttgtatttttagtagaaatgaggtttcgccacgttggccaggctggtctgtaactcctgacctcaggtgatccgcccgcctgggcctcccaaagtgctgagattacaggtgtgagccaccactcctggcctctttttaaattatttatttattttatttttggtagagacaaggtctcgctatgttgcccaggctggtctcgaattcctgggttcaacctatcctcccacctcagcttcccaaagtgctgggatcacaggcgtgagccaccatgcctggccagctctgaaaggttctgacagagtctagtgacatatgtgtagctcatgctttgggggctgtttaaggctcctggggacttatctacctgtttttcttagtccctcgccctggtttacagaccattcccaagggacttcctgtcttgccttcctgagtcactgctgagctttgaaaacacgatacatgtgctgcttttgaccagccacctcttcactgattccgtctagtctctgtgttttcctttgctgggtgtgactctttgaatcagacttccagaatgttagggctgaaagatcattgcatccgaatgccctccactgctcacttgtgggacctgaggtgcagagaggagaggatgagtgaatgcagatacatccaaggtggcacagaagagggttttaggtgatacatggacaaacattttgttattgtaatagctatatttaaacagactgtactgttgcttaggctgaggctaaatttatttaagtaaaatagtccaataaagaaaaacacaaagcaaaaatatcttacagattataaaaaatgatgaaagtagtacaggaatgagtgacatttgggaaatactacattgatgaatgagtgggtgaatggatgaatgaatgaatatatcaatggataaggtacaacactggaatctttaggattcattttcttacagacatggaattttttcccagtccttgcacttcaagtcagagaatcatcatgatcccacgaaacaccagctcagcccccacaggtgctatacttttgacgagatggaacacaaatggattactatgcagttctcttttttccaggtcagcaaagtccaaacgcaggggcaactgagtgtaccttttaaggtgaatgtcttgaactccagttgctccgcctcctttgggttgctatgacctttttcctaatcttaaagagaggaagagctttaagggccagatggggtctctggtttcccacggggctccccaaaggcagcccttcttggcaaaaccctgggcccatgccaggactgagtcatagaagggaaagtaccctgggtggaagttggacagtgaccttgggcaagccccttccctccttcgctgggtcttagtgcttcctctgagaagcaaggaggtttaactccacctcattcgtgccttcattcaataaacaccaaatgcattcctggcatttgcttggtatgtgggcagataaatagagtaattggattcagtgcctggaagaacccacagtcaggttgggtggggagaaggcacctaagggcctgtaattacagatatgtttaagaagggctagatgatgtggacagtccctgcccactccgggatccctagaatgtgtcagtgcaggggaaggaatacataagtaacttggcaaggtcacagggttacacccagaaaaatgttagcccttgaagttagggacagccctgggcctagctcctgatccttctccatcctacagaaaacctgctgaacatggattttggagttgagccaattcagattccaacccctgagcagacaccaactggaactggaagcgtcactctccgggcctcagtttcctcctttatccaagggggataggccctgggatcctaggacatatgagggttccataagataagtataatgtgtatcatgtcaagagctcagcacagggcctggcccattgtacgactccaccatcaaggcaggaggtcgaatggacatctgtccactctggaaacacacccacctcttgcctcccttggctggtcccagggttggctctctttctggggccctcttacccaagaggtcttgccttagtcctctcttgaccctttgaatgctctcaggggcttcctcttctcaggccagagcctccccattgtacacctctgctctactgatctggctgtgaactggtatgtgccagagacagggaggaggctggtagggctgggattccttgggggaaagctggccagagctgcaggttccccgactctcttcccagcattaaattagcactggagctgcctggtcttgcccaataacttgcccaggacaaggtgacatccttcctcccttctttgaggcaggactgagtggcttcctagaagaagacaggcaggacaagccaagacgcacccaaagaatgggggagggaacctgattgggggagaagatgggagagtctggagcttggggcagcagtggatggaacaggtttgcccacattcctggcaggccccaggattccaaagcactttctgtttttgtcactgccccaccaatcacatactctgccagggccacaaggcaccaggcttttcagagcaccaagcccttccaccttcacttctcattcttcacaccaaaagatgggtactactggctctgttttacagatgaagaaattgaggctcacagaggaagaatcacatgccccaactcggaagggctgatacaattaacatttaatggccaggtgtggttgctcatgcctgtaattccagcattttgggaggccgaggtgggtggatcacttgagcccaggagttcaagaccagcctgggcaacatggtgaaacctgactctacaaaaaatacaaaaattagctgggcgtgatggcacgtggctgtagtcccagctacccagtaggctgaggcagaaggatcacctgggctccagtggtcgaggctacagtgcgccatgattgtaccactgcactgcagcctgagagacagaattagatcctatcaaaaaataaagtaaaatagccattcactaagaactactatgaaccaggtggatttcatacaaaaatcatctctgttcccaatatcccagcaaggtgcccattttacagatgagcagaccaaaatgcaacctgatgaaagcacttgcccaagggcccagaactagcaagcacagagcaaagatgtgaacctagatttgttggactccagatcctaccccttctcaatgttaaaggcaaggaagcggaggctcagtaaggttcaaaccatgtccaaggtcataccaccagcaaggcaaagccagttttcaacccaggtctgtctaaccctgcaacttctgtgtttgccgtatgctacattgtctcaataaacctttttttcatggagcaactggctgatgccaaatgactacaactgtatctcaaacagataaagatccaggacagaaagggtcatgaactattattaccattatcatcaacgctattattaattgctaacatagcagggtcagcatttatactgtatgattcagatttgcagaaataaaactttccttccacaactgaacccaacgcgatcacaactcctcttcccctgatttatttctgggttaaaatgtattttttcatgacaactaaatgcagtgggagagcgtgcattttcttttgctttaaaggacatttggggacaattggtaaaatctgaaataagtctacaggttagataatagtcttgtataatgttaattctccaatttttaattttcgtgttaaaaaaaaattttttttgagacggagttttgctcttgttgcccaggctggagtgcaatggtgcaacctcggctcactgcaacctccgtctcccaggttcaggtgattctccggcctcagcctcccaagcagctgggattacaggcgcccaccaccatgcccagctaatttttgtgttttagtagagacagagtttcacctcgttggtcaggctggtctcgaactcctgacctcaggtgatccgcctgcctcagcctcccaaagtgctgggattacaggcgtgagctaccacgcccggcctaaaaaatttttttaagatagggagtctcactatgttggccaggctggtctccagttcctggcctcaagtgatcctcctgcctcagcctcccaaggtgctgggattatagaggtgtgagccaacatgcccggccaattctccaagtttgataactatactgtggatatgtagggttacgtccatgtttttaggaaatacacactaaagtatttaggaacaaaagggcactatgtggacaacttttaaacatttcagaaaaaaatacacatgcacatgtgcacacaaacacagaagaatatagcagatatagtaaaatgttaacatttagggaatttggatgaagggattcagaattctttgccttactcttccaacttttctataaatctgaaattatgtcaataccaaaaaatttagacaaaaatatttagtcttgtttggaaaaatcgtcagctcaggatctgaacttgctgttagggttgctcgtctctcggtggtgccttctccttctgtccaaggatcacatcgggtggcagaggagccttacctaacacctatgggcttgggcctaggcttctgggcttgatggccctatgggctgccttgccctctgtggtgtctggtgccagcttctccccattgcttctctgctggtgtcactggtcctctctggctttgggcctgggcatacgtcactcctgaagcctccagccacggtgtctgttgccagagctgtgtgctctgagccctcctcatcctgaccccaagcctctcacaggttcctcagggcttagatgtgtcctactggaaacttctgatgcttacccatgacccacaaaggcctcaggggagtcagacgtttgtatgagtcagtctcatcaggaacacagaaagcagactggttgctttaagagagggaattgaatagaaagaattgactatttcaacaggagttttgatggagacaaagaaaaacaaaaaattttaaatgtttttaaaagaactgactaaacattaattgacagatggaaaagccggcggcatgagagcggaggtagtaactgcaggaaacagacaccacccctagggaagggagaacaagggaggaagttaggtgtcaggacctagcagctgggacccagacccggaggagggcatggctgtaactggtgctggtgtctccgaggggccacagtggggctggttctgggaaggtggggaaaacctagaaactagaaccgcttgctgctggaaccaatttcctctgccagggtgaatgaagggccatcgctgaggcgatggtgacaggatggaacggtatgctgagacctttcttcctgggaccgccttgcaccctccagggtcccctattggcagagcctatcctggaaacagctgacggaacagaaatagggtgggccccaatgccagccccagcgtcaccagacggcacatacagggataggtttggggacaagggctgatagcttcagaactggtacgtggagggaatggggagccgtggggctgggccagagagaacgttgcttctctctctccctcaataggcctcacagccattccacctcccgtggaaggaggcatacgccccttagttcattggtcttctactccttccactgggcattcaccctaagcagatgagacctgaatcccaggcacttgctctcttttctatgtttctcagtccatccaggaagagtttcttgcctgacctgagaaattacctacttgatgacatcagggaaacttttattccttgggtcatccaagtttcatctcttgattttttttccttttactttttatcctccttgatctgttaataaatctcttgatatttaaagagaagattttgaaaaaaatgtgtctcttctgtatatattgactttgtagttgagtgcctggatctttaaaataattctgctttggacttttataagagtcccatttgacattcaaggctgaacaatgacttctttctctcaggctatactccagtgccccttcagacaattggtgaagggccattaaacagaaaaaaaaaaaagttggtgaggaagaaaaaggctcaattaaaaagctccaaatatgaccctgctctactactgtgaactgagtactatgtgcttggatgtgttaaggacggaggccattgccatgtgaagaaggtaggaaggtctctttgacttcaaagccctaggttttccccactgggctatcccacttttctggggccatttctagccttttaccttttgataaactgaggcccaggaggctactatgcaaatcagtattgaatccaagttcaggagcagtctaacttgggcaagtcacgtaagcttactttatgtaaaacagggatgttgtgaagatttgaggtaatggatgcagagttttgggcacagtgtctagaaaaaagtgggtatttgataaatggtactactactactaataacaataattaatgtttattgccaggcgtggtggctcatgcctgtaatcctagcactttgggaggccaagatggggggatcacctgaggtcaggagttcgagaccagcctggccaacatggcgaaaccccgtctctactaaaaatacaataaattagccgggcgtggtgggacatacctgtagtcccagctacatgggaggctgaggcaggagaattgcttgaacccatgtggtggaggttacagtgagccgagatcgtgccactgcactctagcctgggctacagagcgagactccatctcaaaaataacaataataataataataaacttttattgactggttactatgccaggctcagggctaagcacttttcatgtgtgaattatcttcatttaattatttgatttaattattttaatccactgcctccctccattcctgctggaacacacagaacctaccttccgtcttcccaccctgacccactgagaaacctcaagctttggacttgtccatgctgccctctaaccctagatcacagttctgagtgtgaatactgccagcccagaagagaacattcatgctggatgcagtggctcacacctgtaatcccagcactttgggaggctgaggtgagtggatcacttgagtccaggagtttgagaccagcctgagcaacacggcaaaacctcatttctacaaaaaataccaaaaaaaaaaaaattatccaggcatggtggtgcacacctggagtcccagctatttagaaggctgaggtgggaggctcatttgagcccaggaggcagcagttgcagtgagccgagatcatgccactgcactccagccagggtgacagagtgagaccctgtctcaagagaaaagaaggaggacatccattgcactcaactgcacatgcattgggatggttggaaacatctgcatgacctcctgctttttgttagtattattgttggattctttcatcgagctatttgcatgttgtgtaaactgcagttcccaatatttgtgaaaacattttgtttgcttgtttgtttaattggggaatttgaaggctttgtgattttattattcttgttggtttttttgtttgtttgtttttgagacagggtctcactctgtcacccaagctggagtgcagtggcgcgattttggctcactgcaacctctgcctcctgagctcaagagatactcccacttcagtctcctgagcagctgggacttcaggcgagcaccaccacaccctgctaatttttatattattattattattattattattattgtacagacagagtttcggtatgttgctgaggctggtctcaaactcctgggttcaagcaatccgcctacgtcagcctcccatagtgttgggattacagatgtgagccaccgcaccaggcttcctgttggtatttttaatctattattttgaaatgattttagatttacagaagagttgtaaaagggaacagagagttcccatataactttcacccatcttccctttttgttacatagccatggcaggaaaatcaaaactaagaaattgacattgccagctgggcatagtggcacttgcctgtaatcccagcattttgggaagctgaagtgggaggatcactggagaccaggagtttgagattgcagtgagctatgattgtgtcactgcacttcagcctgggcaacagagtgggactctcttaaaaaaaaattgacattaccacaacactattaactacacaactacaaatgttatttagattttgccagtttttccatgaatgtgctttttctgtgccaggattccagccagtatatcatgttgtatttaaccatcatgtctccttactcgcttccaatctgtgacaatttcttggtcttgttttttcatgaccttggcacttttctttggtgttttttgtttttgttttttcattagagatggggtctcaatttataagccaggctacagtacagtggcacaatcatagctcactgctgcctagaattcttgggcttgagggatgctcccacatagctggggttacaggaacctgccaccgtacctggctaatttaaaaaatttttttttttttttgtggagacagagtttctccatcttatccagactgatctttaactcctgggctcaatccatcctcttgcctgggccttccaaggtgttgggattacaaatgtgagccactgcacctggcttattggcagttttttattttatcttattttatttatttatttatttatttatttatttatttatttatttgagacagagtctcactctgttacccaggctagagtgcagtggcaagatctcggctcattgcaacctctacctcctgggctcaagtgattctcctgcctcagcctcccgagtagctgggattacaggcatgcaccaccacacccagctagtttttgtacttttagtagagagcgggcttcaccatgttggccaggctggtctcgaacacctgacctcaagtgatccaccacctcaacttcccaaaatgctgggattagaggtgtgagccaccgcgcccagccccattggcacttttgaagagtactggttgggaattttgtagaatgtccctgaggctttgtctgatatttctcactagactggagtcatggattttggggaataccacagagggggaagcatccctcaccttaaataatatctggggatatatgagatcagcataacttgttgctggtgatgttaaccttaatcacttggttaaggttatgtctgccaagtttctctgttgtgaagttgccatttttcctctttccatactctagaagcaagtcactaagtccagtccgcaccaaaggggaaaagaattaagtcccacttcccagaggaggtgtatcaaagaatctgtggacatctgttaaaaccaccatggtcattaatattttgaagaaaatgctttaaggctatccaaatgttgtgttgctccttaacatttcattcactcttttagcattcatcagtggatcttgcctttttaacataaataatgtcacattagccattgtttgacaaaatacataatgtcaataagctattgtgaaatcaggtcttgtattgtactaaccacaataaaatctacacggtctagatgaatttaaaaggtattgcattcagggctgattcagagctgggacctgtggccatattagcttaattattgaaatacatctgtccctactctgttctaagtcccatttctgcccaactcttgggaaacctctccacagttaaaaacaactttctagacatttctgttaagtatactgtggtattatgacatatattggtttttgtgcacagttccgggttcataactcccatagcccttgttacagtcttttgttacaatgttgggcgtgttaggcctcaggggcaggcctcaggaaacagaatctctctttcttctgccctcctttcatctgccccaaggcaggcctctaatctacccccacctttctgactatgagtattaagaccctgtacacactgaggaaaggaatgctgatgtcatgaagcttctataaaaacccaaaagggccaggtgtggtggctcacacctgtaaccccagcactttgggaggctgaggtggaaggcttgagcccaggagtttgaaactagcctgggcaacataatggaacctggcctctaccaaaaaaaaaattaaaaaattagccaggcatgatggtaaaagtctttagtcctagctacttgggtggctgaggtaggaggatcacttgagcccaggaggtcaaggctgcagtgagctgttatccatgccactgcactccagcctgggccacagagcaaaaacttgtctacaaaaaaagagaaaacatggccaggcacagtggctcaagcctgtaatcccagcactttgggaggccaagacaggaggatcacctgaggtcaggagttctagaccagcctggtcaacatggcgaaaccccatctctagtaaaaacacaaaaaattagctgggcgtggtggtgggcgcctgtagtcccagctacttgggaggctgaggcaggacaatctcttgaacctgggaggcagaggttgcagtgagccgagatcatgtcactccactccagcttgggcaacagagcaagactctgtcaaaaaaaaagaaagaaagaaggaaagaaggaaggaaggaaagaagggagggagggaaggagaaaggaaggaaggagaagagagagaaagagagagaaagaaaataaaaataaaaaacaaaacaaaaatacccaagaggactgggttgggagagctccgggtagctgaacacgtggaggttcctggagggtgatgtgcccagggaggacatggaagctctgagtcccttctcccatactttgccctccacgtctcttcatctgtatcccttgtaacatcctttataataaagcagttaacatgtttccctgagttctgtgagccgctcctgcaaattaatccaacccaaaaagggggtcatgggaccacaacttgaagccaatccccgcactggcttcaggaagttttggaggcccggacttgcaactatttcccagggactagggaaaaagagaagagaagtgtctagggatgggaggaccgtcctggggactgagctctcaactgtgggatctcacgttatctgcaaagagacagtgttggaattgaattggaggacatccagctgctgtccgctggttggtgtctcaggaaaacttcccctcacatttgatcacagaagtcttctctgttgattgttgtggtgtgtgagagtaggagaaaaacacggtttggatagagtttttttttccaacacaagtacatatcagagttttattacaatcttgcttcaaggggaaaggtctctagtgggccaatccaaagattcactcctggaagggacattttatgagaaaagagaatggccagcataattattattagatgaacaagaaaaagaacatatcaccctatatcattaaggcaaggacatgggctttggtactactttgttattccccatgatccagtaactaaagcagcagtgcctggctcaggaccagaatgctgcccgcctctcacccctagcttggggttgggccagcctccattctgatggtcagccctgtgctggaatggttgttaattacttgactagtgtccaagttttgggtatccacaaaacaagacatattaattattattatcattattgagatggagttttgctcttgttgcccaggatggagtccaatggtgcaatctcggctcactgcaacctccgcttcccgggttcaagtgattctcctgcctcagcttcccgagtagctggaattacaggcatgtgccaccaggcccagctaattttgtatttttagtagagatggggtttctccatgttggtcaggatggtctcgaactcccggcctcaggtgatccacccacctcagcctcccagaatgctgggattaaaggcatgagccaccgtgcccggccctttattattattattttgagacagggtctgtctgtcacccaggctggagtcccatgacgcaatcagaactcaatgcaggcttaacttccctggcttaagcgatcctcctgcttgagtagctgggactacaggcatgcgccaccatgcctggttattttttttttttcagtagatatgggatctcgctatgttgtccaggccagtcttgaactcccaggctcaagcgatcctcctgcctcattctcccaaagtactgggattacaggcatgaaccaccatacctggccaaaacgaggcatattaaataatcagtctacagtttggttcaggcatagtttgatttggttcagagaaagcagtctttagagccagcaagagtaggttttgaaaaccagtatcgaatacaagttctggaacagtctagcattgggcaagtcatgtaagctcattttatataaaatggagatgtcatgaggatttgagatcataaatgtgaagtttctgacacagtccctgggaaataatagctatttgataaacggtagtactattaataataaaaatagtagtaattaataaacatctattggctagttactatgtcaggcacagagctaaacactttgcatatgttaattattttaattctcacattaaatctatgagttagatgcctttagtatcacccccactctataaataatgaacttgaggctcagagaattcaagtaacacattttaagatcacacacagccaggcgcagtgactcacgcctgtaatcccagcactttgggaggccaaggtgggtggatcaccaggtcagagttcaagaccagcctgaccaacatggtgaaacctcgtctctactaaaaaaacaaaaattagcagggcatggtggcgcatgcctgtaatcccagctactcgggaggctgaggcaggagaattgcttgaacccattatgcagaggttgcagtgagccaagattgcgccgttgcattccagcctgggtgacagagcgagactccgtctcaaaaaaaaaaaagaaaaaaaaatcacactactaggccaggtgctgtggctcacgcctgtaataccaacactttgggaggttggggtgtgaggatcacctgaggtcaggagttcaagaacagcctggccaacatggtgaaaccttgtctctactaaaaatacaaaaaaaaaattagctgggtgtggtggcacacgcctgtaatcccagctacttgggaggctgaggcaggagaatcacatgaacctggggggcagaggttgcagtgagccaagaccgcaccactgcactccagcctgggtggcagagtgagactttatctcaaaaaaaaaacaaacaaaacaaacaaaaattacacagatgcaatgttggtggagctgagattcaaacccaggcagcctggtgtcagcacctctataataaacatgcaataaacatgagcaccctctaatcccttgcaacaactctaagccttccagaattctacagcctgcaggttgggagctcctgctatagacctgacagaggcctttggctacttaatgaaatattctgacaccaggagggttgcatagttatttttctaactttacagcaagaggaagacaggtcaaaaaaaaaaaaaacagatttatgcagttacccagaaacagagatatttggctgacaaggtacgactgttcagaaatagtcattggacagtactttcccccaaaacactgtctcaaggtccctgtcagaggtgttcaaaccagaggactccattttgagtgagggcaaggaaaatgaggctgggacttgctgggctgccttcccagaaaatcaggcattcctagcctctagatgtttacggttaagggagcaaattaacaatgtttactaaaacaaacccagacttgggagtgtgcaggtatctcgatatctggagaatgaaggcattcctaattttgttttaaagataaaatcgattcttgcaaaacacagtaattaagaaaattaattatttatcacaaacccttgtaacagagcacatctcatatatgcaagcatggcacctaaggtggatgcattcctcctcttactttcaggaacatcctgttctatggagtagctgtccttttgccactgtactttcttaataaacttgcttttgctttgcgctgtgcgcttgccctgaattccttcttgcataagatccaagaacactctcttggggtctggattgggacccctttcctgtaacatccccattcgagaattactgtctcggtggccgggcgggcgcagtggctcatgcctgtaatcccagcactttcggaggccgaggcgggcggatcacaaggtcaggagatcgagaccatcctggcaaacacggtgaaaccccgtctctactaaaaatacaaaaaaattagccgggcgtggtggcgggtgcctgtagtcccagctactcgggaggctgaggcaggagaatggtatgaacctggggggcagagcttgcagtgagtggagatcgcgccactgcactccagcctgggcgacagagcaagactctgtctcaaaaaaaaaaaaaaaaaaaaaaaagagaattactgtctcttctactttcctagatgtcacaaaacctcctaaaattctgaagataacaaattgttacaaaaagaaactttttttaaaaaaagaaaaaataaatacataaaaaagaaaaaatcaggacttctctttcataaaaaatgaaaatgggagtaatctgctaaaaaattatttttttttcctggtttagcataaaaggttccaaaaactcccccttgtctctcccgccgagggtaaggtgggaagcaaggtggatcctccatgacccacctccatccccacaagtgaacttttttgtttctaagttctgggccctgcttaggggcaactcaggatctattgtttaagaggagttgtccaaacctttcaaagtgggaatgagaggcccactcccacagtatgggtcctgggacactaagagtcccagccaggacccagcgtggtgcccaggctgatgccccgccggctctcactgcttagagcatgatggagagttcaccagagtgaggagggccacactggagagccagagccatgccccctggcagagaaggtggcatcagatgactgtcccatgggctttaagactcttttccccattttgggagtgaaagagcaggttcacttctcttggattttagaagttctggctgttcttgaatgacccaaattgtcagagtgttgagggaggagaggcactgcccacaaaggatgatcttggactttgtgccagtctcaccagggggtactcaagtcacatttgtttattttattttattttattttattttattttattttatattatttcttattttattttattttattttgttttttgagatggagcttcgctcttgttgtccaggttggagtgcaatggtgcaatcttggctcactgcaacctctgcctcccgggttcaagcaattctcctgcctcagcctcctgagtagctggaattacacaggcatgcaccaccatgcccggctaattttgtatttttttagtagagacagtgtttctccatgttggtgaggctggtctcgaactcctgacctcaggtgatccgcccaccttgtcctggcaaagtgctgggattacaggtgtgagccaccgcgcccagcctttttatttatttttaaattgtattatatttagagacaggtccctcagctgggctcagtggctcatgcctgtaatcccatcccaacactttgggaggccgaggcaggtggatcacctgagtccaggagtttgagaccagcctgggcgacatggtgaaaccctgtctctatttttaaaaaataaataaatgaataaaatagagacaggtctcactctgccacccaggctggagtgcagtggcatgactacagcccactgcagcctcaaccccctgggctcaagtgattctcccaactcagcctcccaagtagctggcactacaggaatgtgccaccagacccgactaatgtttttgctttttgtagagacagatctctctatgttgcccagccaggtcttgaacacctagcctcaagtgatcctcctgccttggccctggaagcactaggattacaggtgtgagccacagtccctgctcaacactttaaattcaatttcaataagaacaattttaggccaggagcagtggctcacacttgtaatcccagcacttttcgaggccaaggtaggaggatcacttgaggccaggagttcaagaccagcctgggcaacatagagagaccttgtctcaattaaaaatatgtatatgaaaacaatttttttggccaggcatggtggctaacacctgtaatcccaacactttgggaggccaaggcgggcgaatcacttgaggtcaggagtttgagaccagcctggctaacatggtgaaaccccgtctctactaaaaataaaaaaatcagccgggtgtggtggcggacacctgtaatcccagctactcaggaggctgaggcagaagaatcacttgaggtggaggttgcagtgagccgagatcgcaccactgcgctccagccttggcaaaaagagcaaaactccatctcaaaaaaaaaaataataataaaagaaagaaagaaatatttttaagtactttgaggccaggcgcagtggcttatgcctgtaatcccaggactttgggaagcaaaggcaggaggatcacttgaagccaggagtttgagaccagcctggccaacatggtgaaaccccatctgtactgaaaacatacaaaaattagccgggcacattagctgggtacatacaaattggtggcgcatacctgtaatcccagctactcaggaggctgaggtatgagaatcacttgaaccagagaggcaggagttgcagtgagccaagatcgtgccactgcactccagcctgaatgacagagaccctgtctcaaaaaaaagaaaagagagagagaaagagagagaaagaaagagagaaagagaaagaaagaaagaaagaaaaaagaaagaaagaaagaaagaaagaaagaaagaaagaaagaaggaaagaaagagtgaaagttactttgagaattctttttcagtgcagaagcatataacaatgactttctgctgtatcaccccaccggggtacagcgacatctggaatggggacttggcaagacttggcacaccaaatcaccaagcttttcttcatccccatcacccattcatgcttaattcacttgggaacccacaaagctcctttgtgtgcggtgagccagagcatccggatatttggaagggcctgggctggtgtggtcctctgagcaagcagagggtacagagagtcacttctgctgatgaggtgggagccaggaaaaacagaactaggaggaaaaataacctgccaccaaaaagctccggtcttatggaaaagcagtatcacttttgaggatccctcatatgacacatggaactttcattattcattgtgtttcgagacaaaagatctttctgtttctgctctatgctgaaacattctaaaattatttggagatggaaaccagttttgaaagccccaggtacatcctctgttggcaaccgacaaccatcctaacagagggcctagcacattatcccacaccccgaca

SEQ ID NO: 809 - DNA, 160431 bp, Homo sapiens
agtgcaccagaatatgaatgaatgctggtcatatttacagtgtatgaagcccttttacatacaatttatcatctaatccacacaaaccttggggaagtggatataaataaaaacaatgactcttttgtgtgggtggaaggagtgtaggagctggataaagcttctggcttggaaaaccaccccctgcacatccaagtcttcccctgttgtgcttatcttgtgcttatcatgtgacgtaatcctaacttcttcatgacttatggccacttcctcctgggacccagctggagtgagcaagtgagtaaaatgcaagctcttttaattcttgagacagcaaagcatattaaggaaggaaatacacaagtgagaaaaatcacattgtgaatttcaaagccgagggacaaaactgcagaactgcgggagccagtgataggtttggccattatttaccctcaggatcacccaggactcagcctcttctgtttcctgaacttccatccagtacagccttcagctgtagccactaagctgtaatgcaattgctttacaagacactgtctggcactgtcttttctgacagtggggaagatgccctggcaggatgacggctcagctaaggagtcagggttatgggtattttcttactttttatcttggaatttcagattttaaaaaaaagtttgatagtatagagagttcctgtatacttttcacccagcttcctctgcagttaatcttttttttttttttttttttttttttgagacggagtctcactcagtcgcccaggctgcagtgcagtgctgcgatctcggctcaccgcaagctccgcctcccgggttcacaccattctcctgcctcagcctcccgagtagctgggactacaggtgcccaccaccacgcccagctaattttttttcgtatttttagtagagacagggtttcactgtgttagccaggatggtcttgatctcctgacctcgtgatccgcccatctcggcctcccaaagtgctgggattacaggcatgagccaccgcccccggcctcctctgctgttaatcttatataaacgtggtacatttgtcaatttaccattggtacaatactaaatttcactcgccgtgtgaagagaccaccaaacaggttctgtgtgagcaacaaggctgtttatttcacctgggtgcaggtgggctgagtccaaaaagagtcagtgaatggagataggggtggggccgttttataggatttgggtaggtagtgggaaattacagtcaaaggggattgttctctgttaggcaggagtgggggtcacaaggtgctcagtgggggagcttttgagccaggatgagccaggagaaggaatttcacaaggtaatgtcatcagttaaggcaggcacgcgccattttcacttcttttgtgattcttcagttacttcaggccatctggatgcatacatgcaggtcacaggggatatgatggcttagcttgggctcagagacctgatattcctgtcttcttatattaataagaaaaataaaacaaaatagtggtaaagtgttgggatggtaaaaatttttcggggggtggtatggaaagataatggatgatgtttctcagggttgcttctagcgggattaggggtggcatgggaacctagagtgggagagattaagctgaaggaagattttgtggtaaggggtgatattgtggggttgtgagaagaaacagttgtcatatagaatgattggtgatggcctggatacagttttgttatgaattgagaaactaaacagaagacacaaggtccaaataagagaaggagaaaaacaggtattaaatgactaagaattgggaggacctaggacatccaattagagagtgctcaagggggttcagcatagccctgccagcaaagattatttatttactttaagagttaagagtggcggtttggggatagcaccaggagatatcagctgtgatggcttggagaaacagtgtaaaccggcagtgtaaagaagagcagggcatttatgagtagttgataatggtgaataggagtatgactagacagaagacagtagggatgacaagtttttggggtgcagtccaagttggtctgatgtctggaatgagactggggcctaataaaaggagcatctatacaggagctcaaatgggctgtaccctgtaacattttgaggacaagcccgaattctgagaagggaaagtggtaaaagtatccagtcctttttaagttggtggctgagcttggtgaagtgtgttttaaaaagaccgttagttcactgaacaccaagagcctgagaaactgcttgggtgatttgactaataaaggcctgtccgttatcggactgtatagaggtggaaaagccaaacgaggaattatgtctgacagaagggaagaaatgaccacagtggctttctcataccctgtgggaaaggcctccacccatccagtgaaagtgtctacccagaccaagaggtattttagtttcctgactcggggcatatgagtaaagtcaatttgccagttctggacgggggcccgagcttcatgtgtagggaagggagggggcctgaacaatccctgaggagtagtagaatagcagctggaacactgagaagtgatttccttgaagatagatttccacaatggaaaggaaatgagaggttctaaggggtgggctagtggcttgtaacctacatggaagaggttatgaaatgatgacagaatagaatgggcctgtgaggctggaaggagatatttcccttggtctgagaaccatttgccttgtgtgggaagagattgacaggtggaagttttagtgggggagtaggtgggagtggccagatgagaaggagaaaaactgccctgagggatagaagttggaacactagctgtttttttagctaccttatcagcataagaattgtcctcagtgaggggatctgatgccttttgatggcccttgcagtgaatgactccagcttcctttggaagtagagcagctttgagaagagtttttattaaagaggcattaatgatggaggacccttgtgtagtgaggaaatttctttcaacccatataacagcatggtggtgcagtatatggaaggcatatttagagtcagtataaatattgacgcgtagtccttttgcaagagtgagggctcgagttaaggtaatgagtttggcttgctgagaggtagtggggtgggggcagaaagtatatgcatcaggtgtgaggaagaaaatcgattttggaagttatgagaactgtagagagtgaattgagcatagtttgtgatttttagggcctctaaaagtattaaagcagtggcagccgctgcatgcagacacgatggccagcctaaaacagtaaggtcaagttgtctggacagaaaggctacagggcacggtctggctcttgtgtaagaatttcaaccacacagccctgcacttcggttgtgtgtaatgaaaagggagtgatgagttagggagagctagtgtgggagctgttttttaaggaatggaaaggaaagtagggaaaggatataggatctatggggtcagctaggtttatctagaacagaataatgggttgtagagggaggtattgaggataggagagtatatgggtttggcaccacggggtggataggcaaaacaatttggttttggttgataagactcagatcctgaactaaactgtaaggcttgtccagttttaggacaggtaaaatggggaaattgtaaggagagtttacaggctttaaaaggccgtgctgtaacaggtgagtgataacaggctttaatccttttaacacgtgctgtgggatgggatattggcattgagtggggtaagggtgattaggtttcaatgggatggtaaggggtgcatgatcagttgccaaggagggagtagaggtgtcccatacctgtggattgaggtggggagatacaaggggaggatgtgaaggaggctttgaactggggaaaagggcagcaatgaggtgtggctgtggcctaggaatagtcagggaagcagataatttagttaaaatgtctcgacctaataagggagctgggcaggtgaggataactaaaaaggagtgcataaaagaatattgtccaagttggcaccagagttggggagttttaagaggtttagaaacctggccatcggccgggcacggtggctcatgcctgtaatcccagcactttgggaggccgaggcgggtggatcacgaggtcaggagattgagaccatcctggctaacacggtgaaaccccgtctctactaaaaatataaaaaattagctgggcgtagtggcgggggcctgtagtcccagctactcgggaggctgaggcaggagaatggcgtgaaccccggaggtggagcttgcagcgagccgagattgcaccactgcattccagcctgggcgacagagccagactccatctcaaaaaaaaaaaaaaaaaaaaaaaagaaacctggccatcaatacccacaacagttatggagtcaagggaaacaggcccttgaaagaaggtaatgtggagttgggtagcctctgtattgattaagaagaggacggacttaccctccactgtaagagttatccaaagctgggcatctgtgatggtccagggggcttccaaagtcatctggcagcatcagtcttcagccgctaagctgagaagatctgggaaggagtaagagagccttgagccagagttccaggggctctgagagtggctgccaggtaaattgaacagtccaattttcagtgggatcctgcacagatgggacatggcttaggaggaatcccaggctgcaggaattccttggcccagtggccagatttctagcactcatagcaagctcctggggaaggaggttctggatgaacccctggcagctgcggttcatccagaacctcatccaggtgtttggatttcttgtgtgctggagatgtggctggggtttgtctcacagtggaggcaaagaattgcaactcagaaatacattgctacttggctgcctctactctattattgtacaccttgaaggcaaggttaactaagtcctgttgtggggcttgagggccagaatttaatttttggagctttatttaatgtcgggagcagattgggtgataaaataaaatgcatattgagaataagatggccttctgacttttcagggtctagggctgtaaagcatctcagggttgctgccaaacgggccacgaactaggctgggtttttatatttgatgaaaaagagcctaaacattaactgatttgggagagatcggataaagaaaaaggaggattaaccttcactatgcctttagctacagccacctttttaagaggaaattgctgggcaggttggggagggctagtcacagaacgaaactggaaactgtaagccagaccaggtgtaaggaggggaggtgataaaaggattatagggtgggggaccggaggctgaggaaaaattgggacctagctcggcctggtgaggagcagcctggggaggaggggagaggtcagatgggtctgtagaaaaggaagattggaaagactcagcgatgcttggggttgggactgaggggacaaggcgggagggaaagaagcaagatttgggacaagttgcattgagaacagagactagggagggaccgatatgtaaaagaatgcctggacgtcaggcacctcagaccatttgcccattttacaacaagaattatttagatcttgtaggatggaaaaatcaaaagtgccatttgctggctatttggaaccactgtggagtttgtactggggtcaagtggcatggcagaagaaaataatgcatttaggttttaggtcaggtgtgagttgaagaggttttaagttcttgagaacacaggctaagggagaagaaggaggaatggagggtggaaggttgcctatagtgaaggaggcaagtccagagaaaagacagggtagagacatggagagaaggggtgggggggtgcttgccccccaggaaagtggagagaagagagggtagagacatggcgggaaggggttgggtgagcagccctgggctgcaatgtgggtgagcagccaaagcaggcatccctgcaattgacttgccagcaagggaatgtgggtgaatgaccaaggcaggcgtccctgcggtgatcagacactgatgaaatgtgggtgaataatcaggcaggtatccccacgtgattaaacatcaaaggaagactgtcttcctgagtccgtgactggcaccggagttttgggtccatggataaaacatgtctcctttgtctctaccagaaaaggaaaggaactgaaattaagagaagggagagattgaaagatggcaccaagattgaaaggagaaagaggttgagggatagtgagagaggttggagaagagagtaaagaggggccgcttacccgatttaaaattggtgagatgttccttgggctggttggtctgaggagcagagatcgtaggtggatctttctcatggagcaaagagcaggaggacaggggattgatctcccaagggaggtcccctgatccgagtgatggcaccaaatttcattcgcgttgctgtgaagagaccaccaaacaggttttgtgtgagcaacaaggctgcttatttcacctgggtgcaggtgggctgagtccgaaaggagagtcagcaaagggagataggggtggggccgttttataggatttgggtaggtagtgggaaattacagtcaaaggaggttgttctctggtaggcaggggcgggggtcacaaggtgctcagtgggggagcttttgagccaggatgagctaggagaaggaatttcacaaggtaatgtcatcagttaaggcaggaacaggccattttcacttcttttgtgattcttcagttacttcaggccacctggatgcatacatgcaggtcacaggggatatgatggcttgggctcagaggcctgacactaaaccatggatcagcttttcccctaacatcctttttaagttccagaatcaatcctagaatactgttactgaaagaggtcccaatccagaccccaagagagttcttggatctcctgaaagacagtaagggaggagaccatccctcatattgttttatgcccaatttctgcctccaaagaaagaagtaaaaactaaaaggcagaaatgaaatccacaggcagacagcccggtgccgtgccctaggcctggtagttaaagatcgacccctgacttaaccggttatcttatctacagattccagacattgtatggaaaagcattgtgaaaatccctgtcctgttccattctgattatcggtgctgcacccccagtcacgtacccactgcttgcttgattgatcacaaccctctcatgcagacccccttagatgtgtaagcccttagaagggacaggaattgctctctcaggaagttcaacttttgagaagcaagcctgctgaagttcctggctgaataaagctctttccttctttaacctggtgtctgaggagttttgtctgtggcttgtcctgctacatttcttggttccctgatggggaagcaaggtgattggcagacggtcgaggcagccccttaggtgacttaggcctgtcttgtggagcatccctacggggtactccgaccagcctgagtgacgcagatccaaacagcactcccgggtaggcaattgccccagtgggatgcctcgccagagcagcgtgtggcaggcccctgcagaggatcaacacagtggatgaacaccgggaaggaactggcacttggagtctggacatctgaaacttgctaagactggtctttggaacttgtgcactccatttgagtggaagcgtggcctgatcacccatggcgtgcctctaccagcactttggtttttgttttttacttgacttggattacttgatactttggttttggttttggcctggcttggatttcctgatactctgattttggttttgattctggtttggtgtaaactgtaaaagtgtgtgtgtgccctttttacttgttctttgttttgtggggtgcgagtggtgtgagtgtggtgttttgtctcgaggaagcatggatcaggcacaaactaagcccaccccactaggaactatgctgaacaatttcaagaaaggatttaagggagattacagtgttactatgacaccaggaaaacttagaactttgtgtgaaatagactggccagcattagaggtgggttggccatcagaaggaagcctggacaggtcctttgtttcaaaggtatggcacaaggtaagccagggcacccagaccagttcctgtacatagacacttggttacagctggttttagatgccccccacagtggttgagagaacagcagcataagcagctggcagaggcaaggaaagaccagcagagagagagaaaggaaagagacagagacattaaccactgaaaattcccttaacccagcaggtttcctaacgggatctaaatcttaattaccataccaaggttgaccagacctagtaggaactccctgtaggataggacaatagatggttcctcccaggtaattgaaggaaaaaaaaagaaaaaagccatctataccaattataagttaatttggactaaacaaggtcttattaatagcaaagaataattgaaatcccaaacttacaaggttttcaacaaaagtaaagtttgctaaatgtaaacagtgtaacatgtattatactaacttctaatcttgtgtccttagacagtctagtccacagatataaaggaagcttgctttggaaaagaatggttatcgtcttcaaaaaaaaggggggaaaaaagaaggggcagaatttatctaaaaaaaaaaatgttatatggtaaattcttgtcctaaaataaattaactggttgtttaaagaaagaaatgtttgtaataagtcagaaagttgaggcatgtcgaagaattgtctgcaaaagtcatgaaaaaaagttataaaaaaagaatttatgcaagaaatgttgtacaatttaaaagtaattaggcctcctgaatgtaaaactattggagaaaaagtttatgtgcaaggtgtataagaaaagtaaactatacctctggtaaaaggattaaaaggaagcataaggatgtggatttttacctacattaaaaggtttaaaaaaatttgctttgaaggtttaagcaagttttaaaatgttaattgtaaaggaaattctgtgtgtaaacatattggctaaagttaaaggggtatcattttttttctgtgaactgaacattaaaaaaaaacacaacgggtttttcttaaagtgctaacctgctctttaacaaaaattataaaaggttaaaaagagtctataaaaatcttaccttatggtctgacattaaaaattgaataaatatgtctacaaagaaaacaaagtttaacattaataacacactcaaataaaggtgacatttagcttatctggtataaacatacaggaagcgttgtcaaatataaaatggtgtttagctttctttggtctaaaaacaaataaaaataggtgaaaacaaataaaaataggtgctaaaggaaatttctcagtaaaaaggcaccaaggactataaagtccactgctgatgtccccacatttaaaacaaaaggtcaatttcttaaaaattatatacttggtttagcacatgtaccacccctagaatttccagtaaaacagcaccagcctgaagatcatgttcttaccaaagggtggaaagaaggaaaactcgagtcagcctgggaatgaccctatcttgtgctgttaaccaccaagactactgttcatacagcggaaaggggatggactcatcacacctgagtcaagaaagtgccacccctccagagtcatgggccagagtcccaggggaaaaccctaccaaactaaagctaagaaaaatttaacttcttcatctattctattactctttcttctttcctctctctattgctgaccatctagttattaacataaccaagtcaatttcatctcaaactattgcatttaatgcttgccttgttacaccctgtggggacttgccaagtcaaagacagctctctacttcagaaaagtacctctgtccctcctgactctcctcagactgggcattaataaattgggaccatttaatccagggagatttcgataaagaccccagtgacaaccaggagtcttgccccccaatttagagcttttatgccgtagttggtccaacgttctgtggaccactaaacagcaaggatggactgccccaaccagtttttgtaatttcctaaaaccatacattcattttactagaggatcatagaagttaaagacttaaaatgaactttggcaattaagacaggatatcaagatgcaaatgcctggttggaatggatcaaatattctgtccacacattaaacaaaagtgattgttatgcttgtgcatgtggcaggccagaggccctgattgtccgctttccactaaggtggtcctccagtagaccaggcatgggctgcatggtagctcttttccaggattctacagcctggagtaataagtcatgccaagctctctctgctatatcctgaagtccggcaccctgtgggtcagccaccaagggccatccagcttccctctcccaaaactaagttcgcttcatgtctctcatgacagggaggaaacttagtgttccttggagacctgaagggatgcagtgagcttaagaattttcaagagcttatgtatcaatcagcccttgttcatccccaagcggatgtgtggtggtattgtggtggacctttactaggcactctgccaaataactggagtggcacttatgctttagtccagttggctatccctttcaccctggcatttcatcaaccagagggaggaaaaataagacatcataaagtgagagaagccccttatgggtctttctactctcacatctattaagactcaattggagtcccatggggaataccagaacaatttaaagcccaaaatcaaatagctgcaggatttgagtcaatattttggtgagtgacagttaataaaaatgtagattagataaactacatctattataaccaacagcgacgatattttcatgagttaaaagaaaaacgcatgtcggccccagccctggggctacctgacctgacaaaaccttttacacaatatgtattagagagagaggaaaaaaaatggcggttagagttttgacccagactgtggggccctggccgagaccggtggcctacatctctaaacaactagaaggggtttctaagagttggcccccatgtttgagggccttggcagcaacacccctgctagcacaagaagtggataagctaactcttaggcaaaacctaaacataaagtctcccccatgctttaataaataccaaaagacatcattggctaacgaatgctagactaactagataccaaagcttgctctgtgaaaattcccgcataatcattgaagtttgcaacaccctgaaccccgccaccttgctcccggtatcagagagcccagttgaacataactgtgtaaaaggtgttggactcagtttatttctgcaggcccaacctccgagaccatccttgaacatcagtagactgggagctgtatgtggacaggagcagcttcgccaaccctcgcaaagtgactctgaagaagaccacaagccctgctccagtcacacccagaagctgactggtccacgcatggccgaagcatgaggaaactcatcgcaggactcattttccttaaaatttggacttgtacagtaaggacttcgactggccttcctcagactgagcactgttcccagtatatacatcaagtcactgaggtaggacaaaaggttgctatagtcccattattttatggttattataagtgtacggggactctaaaaggaactgatttatataatgctatacaaggtatgtagcccaggaactgaccagcctgatgtgtgctataatccatctgagctccctatgactaccatttttaaaataagttaaagactggcaacttctgggttctgaaaaacctcaattattagacaatactgtatagcaagggtgaggacggacttcacccttcctatgggaagactcagctgccttgggcaaaaactgtataatagtactacaaaaacagccacttagtggagttcaaaccacactgaaaaaaatctgtttagtaaatttccaaagttgcaaaccatgtggacccacctggcatcccaccgggactggacagcccccactggattataccggatatgtgggcatagagcctatgccaagttacctgaccaatgggcaggtagttgtgttattgacaccattaaaccatcctttttcctactgcccataaaaacaggtgagctcctgggcttccctgtctatgcttcccgagaaaaaaaaaagcatagctataggcaactggaaagatgacaagtggccccctgaaagaatcatacagtatcatggacctgccacttgggcacaggatggcttgtggggataccaaacctccatttatatgctcaaccaaatcatacagttacaaactgccttacaaataatcactaataaaactggcagagctccaactgttttagcctggcaagaaacccagaagagaaatgctattcataaaaatagactagccctagactacttgctagcagctgaaggaggggtctgtggaaagtttaacctgaccaattgctgtctgcacatagatgaccaagggcaagtagttgaagatatagttaaagatataacaaagctggcacatgtgcctgtgcaggtgtggcatgggtttaatcctaggtccatgtttggaaaatggtttccagcactaggaggatttaaaactcctatataggaattataatagtaacaggaacctgcttgttgcttccctgtgtgctgcctttgctccttcaagtaatgaaaagttttgtcactaccttagtccatcaaaatacttcagcacaattgtactatatgaatcactattaatctatcttgcaagaagacatgggtagtgaggatgaaagtgaaaactcccattaatgagtgaggttctcaaagcgggggaataagggaggagaccacacctcacattgtcttatgcccaatttctgcctccaaagaaaggagaagtaaaaactaaaaggcagaaacgaaatccacaggcagacagcccgttgccgcaccctgggcctggttaaagatcgacccctgacctaaccggttatgttatctatagattccagacattgtatggaaaagcattgtgaaaatccctgtcctgttctgttccattctaattatcggtgcatgcaacccccagtcccgtacccactgcttgctcaatcaatcacaaccctctcacatggaccttcccccttaaagttgtaagcccttaaaaaggacaggaattcctcacttggggagctcggcttttgagacacaagtctgccaaagttcccagctgaataaagctccttccttctttaacccagtgtctgaggagttttgtctgcggctcatcctgctacaaaagaatctgggggtagtccacagagtatagtgaaagcaagtttattaagaaagcaaaggaatgaaagaatggctactcaatgggcagagcagggagttcccagaagcaagaggaggaaggtgcccaccttaggtccaatgcttgtttatatatgaaataacaaagcaaataatcatgggggagatgtgctctactacgcaggcttttgacaaaggattgtgtaactactttgtataactactgtcttccacaagaacctatattattatctttatttattaatttttgagacggagtctccctctgttgcccagaccggacagtgcagtgacatgatcttggcccactgcaatctgcaactcccaggttcaagtgattctcctgcctcagcctcccaagaagccaggattacaggcatgtgccaccacgccaggctaatttttgtacttttagtggagacagggtttcaccatgttagccaggctggtttcaaactcctgacctcaggtgatgcacccgcctcggcctcccaaagtgttgggattacaggcatgagccactgtgcctggcctaatatggcatttcttttctttttcttttttgagatggagtcttgctcttgtcgcccagactggagtgcaatggcacgatcttggctcactgcaacctctgcctccgggttcatgcgattttcctgcctcagcctcccgagtagctgggattacaggcacccaccaccacgcccggctaatttttgtatttttaatagagacagggtttcgccatgttggccaggctggtctcgaactcctgagaagctgcaggtgttaggaacttgtttgttcactgttacttctctcctatccagaagtgaggcatatagaacttgttccaaaaaatagtttggatgaatgaatgaataaaaggttaatcctatatctattgcttcaatcagaaaacttatttccttataatttactgttgtgtctttccttactagaaggtaaaatctatgaaatacagacagctgggttttgctccttgctgaatcctcaatgcctagaacagtgcttagcactggcacatgctgtcataatatccactgaatgactatgtggaaaggtaggctttctcttttggccaacatcagcatcttttttgtgacatcaatgtatttcagatgtttagctcagtaagataatggttgagaataaccacaatactgtgagtggctgacagctgaacactctggctccctgaggtaaatactcacttgcagctgaatggtgatcagaagggaaccacaggaatgctgtctccaagagcactgcctgcaagaaggaggcactggtggccggcacaggtggcctgtggatgctacacttcacagctttggtccagcaccagcaaaatagtgaggcaagaccattgtgttcttgagttccgtgttatactcacctctctttcaccagaatgcaactcttggagaagcagaaaaagtaatgtgcttgtaataaccattcacgtctttataggagtcaagtgtctctagctagaacccttttatttcacatctattcacttttcttcttttattattagtgacaaggtaacaatcatattcacatcaaggaaaactagaatatggaaaaaaatcatctcaagtatgtttagaattttgtgtgtatttccatcgccctttatttctgaaagtatattatatatacagaattcacctagtttgtagtttgtgttctgcatttttttttcttttttctttttttttttttttttttcagatggagtctcgctctgccgcccaggctggagagcagtggtgtgatctcgcttcactgcaacctccgcctcccaggttcaatcgattctcctgcctcagcctctcgagtagctgggattacaggcacgtgccaccatgcccagctaattttttgtatttttagtagagacggggtttcaccatgttagccaggatggtctcgatctcctaatatcatgatccacccatctcggcctcccaaagtgctgggattacaggcgtgagccaccgtgcctggcagatgttctgcttttttcatttaacattgttttatgcttacaagtatctttccagctgggcatggtggctcacacctgtaatcccaacactttgggaggccaaggccggcagatcacctgaggtcaggcatttgagaccagcctggccaacatggcaaaactccgtctctattaaaaatacaaaaattagcagggcatggtggtgcacacctgtaatcccagctacttgagaggctgaggcaggagaatcgcttgaacccaggaggtggaggttgcagtgagctgagatcgcaccactcactgcaccccagcctggatgacagggcgagactctgtctcaaaaaaagaaaaaaaaaagtatctttccatgcaattagacttcataaccacttatttaaatgcactgccatgcatttaaggatttgattttttttttttctttttctttgaaacggagtttcgctcttgctgcccaggctggagtgcaatggtgcaatctcagctcaccacaaccttcacctccggagttcaagtgattctcctgccttagcctcccgagtagctggcatgcaccaccacgcccggctaattttgtatttttagtagaggcggggtttctccatgttggtcaggctggtcttgaacccctgacctcaggtaatccacctgcctcgacctcccaagtcctgggattacaggtgtgagccaccgcacctggcctattttttatttttttgagacagggtctcgctctgtcacccaggctggagtgcagtggcacaatcttggctcactgaagcctcgatctcctgggctcaagctatcctcctgccttagcctcccatgtagttgtgcctataggtctgtgccacctcacccgactaatttttgtattttttgtagagatggggttttgccacattgcccaggctggtctcaaactcctgggctcccttggcctccgaaactgctgggattacaggtgtgagccactgcgcctgacctacgattttcaactatattattcatttcactgtcagataagcccgaaaaagtcactcaaagagtttgaaagacaaaaactcaaggtacttaatatctttaagaccttgttaaatatcaggtttgaaaaacgaaagttcacaaaattatacagatgacaagtacatgaaaaaatgatcaacatcattagtcatcagggaaatgtaaattaaaaccacactgccaactgactaaaatgataaagttaaaaagactgacaatatcaggccgggcacagtggctcatgcctgtaatcccaggactttgggaggccgagcgggtggatcacccaaggtccggagttcatgaccagcctgaccaacatggtgaaaccccgtctctactaaaaatacaaaaatcagctgggcatggtggtgcgcgcctgtaatcccagctacttgggaggctgaggcaggagaatcacatgaacccgggaggtggaggttgcagtgagccgagatcacgccattgcactccagcctgggcaacaaacagcgaaactccatctaaaaaaaaaaaaaaaaaaaaaaatgactgacaatataaactgctgacaaggatgcagaatacctagaattctcacacattgctaatggaattacaaaattatagccacttaaagaatagtttggtagtttcatataaagttaaacatgcatttgccatatgaccagcaatcccgatcctagccatttacacaagagaaatgaaaccatatgtctataaaaagatctctatgtgaatgtttatagcagctttattcatgataaacaaaagatgagataactcaaatgttcatcaacaggtgactggatatacaaattacaattcatccatacaaaggaatacaattcagtaataaaaagcaatgaactgctgataaatgcaaccacacagatgaatcctaaaacatgatgctatgtgaaagcagccagacacagagggctactctgaactgtttttactcacaacacttctgacaaccggttctccagctctccaaacaccaagtgggtgtcactacaattcagttcagttctgccactaacgacccagagttcgtgtcagactgcaaagccttaaaggctcagtcccacaagactactttcactgtagatggtattttcaagtaccaggctgccacttgtgcttctaaggtcaactggctataaattgggggttcctgtgaccctgatccagtgattgtgctacttgtcaagttcaataatttgctaaaacagctcataaaactcagaaaaacactttacatttactggtgggtttgttgttgttgttgttgttgttgttgttgttgtttgagacagagtcttgccctgtctcccaagccggagtgcagtggcatgatcacagctcactgtaaccttgaatgcctgggctcaagagatcttgcctcagccccctcagtaggctggctaatttattacaaacatttttttgtagagaagggacatgtactcgtttattatacagcatacaactcaggaacagccagatgaagagatgcatagggcaaggtatggggaaggagcatccgtgctctctctgggcatactaccctcctggtacctcgatgtgttcaccaacccagaagctctccaattcttattgttcaggggttggtttgtttgttcgtttttgagacggagtcttgttctgttgcccagactagaatgcagtggtccccccatcttggctgattgcaacttccacctcctgggttcaagcaattctcctgcctcagtcccctgagcagctgggattacaggcgtgggccaacatgcctggctaatttttgtatttttagtacagatggggtttcaccatgttggccaggctggtctcaaactcctggcgtcaagtgacctgcctgcctcggcctcccaagtgctgggattacaggtgtgagctactgtacccagacttttcaggggtttttgtttgtttgctttttgaggcagagtttcactctattgcccaggctggagtgcagtggcatgatttcaggtcactgcaacctccgcctcccgggttcaagtggttctcctgcctcagtctcccaagcagctgggactacaggcacgcaccacgatgctgggctatttttttatttttagtagaaacagggtttcgtcatgttagccaggctggtctcgaactcctgggctcaggtgatccgcccgcctcgccctcccaaagtgctgggattacaggcactgcgcctggcccctgttcaggggttttaatggaggttttattacatgggcaaaattgattaaaacattggccttggtgattgacctcaacatccagcccctttcccctccccagggttcaggaggtgaagctgaacattcccattccactcctgggtctttctggaaaccagccccctctgcctcctgggttcaagagattctcctgcctcaccctcccaagtagctgggattacaagcgcctgacaccacgtccggctaatttttgtatttttagtagagacggggtttcgccatgttggccaggatgtctcaaattcctgacctgaggtgattcacctgcctcagcctcccaaagtgctgggattacaggcatgagccaccacgcctagccttttttttttttttttttttttttttttttttgttgagatggagtttcactcttgtctcccaggctggagtgcagtggtgcaatctcggctcactgcaccctccgcttcctgggttcaagcgattctcctgcctcagtctcccgagtagctgggattacaggcacccgccactgtgcctggctaactcttgtatttttagtagagatgaggtttcactgtgttggccaggctggtctcaaactccttgacctcaggtgatccacgcacttcagcctcccaaagtgctgggattacaggtgtgagccactgcgcccagccaattttttgtttttttaattggcaaataaaaattgtatatattggccaggcgcagtggctcacatttataatcccagcactttgggaggccgaggcaggcggatcacgaggtcaggagtttgagaccagcctggccaacaaagtgaaccctgtctctactaaaaatacaaaaattagccaggcatggtggcgcgtgcctgtagtcccagctacttgggaggctgcagcaggagaatcgcttgaacctgggagacggaggttgcggtgagccgaaatcataccactgcactccagcctgggtgacagagtgagactccatctcaaaaataaaaacaaaaaaaaactgtacgtatttatggggtatgttttgatatacgtatacatggtggaatggctaaatcaagctaataaacatatgcattacctcacatacttttattactttggggtgagaacatttataatctattctcttggcaattctcaagtatatgtttttattaactatagtcgccatgttatacaacagatcacttaaacttattcttcctagccgaaatgtatcctggctgggcgcggtggctcacgcctgtaatcccagcactttatgaggccgaggcgggtggatcacgaggtcaggagttcaagaccagcctggccaagatggtaaaaccccatctctactaaaactacaaaaattagccaggtgtggtggcaggtgcatgtaatcccagctactcaggaggctgaggcaggagaatcacttgaacccaggtggcagaggttgcagtgagctgagatcacgccactgcactccagagcaacagagtgagaatccaactcaaaaaaaaaaaaaaaatgaaatgtatcctttgaccaacatctccccattctccccttcttcaccctcagtgcttgatcatcactattctctatttctatgagttgtacttttgtagattctacatataagtgagatcatgtagtatttgtgtttctttgcctggcttattttacttcacacaatgtcctccaggttcatccacgttgtcacaaatgacaggatttccttttttttttttttttgaggcacagtctcagtctgtcgcccaggctggagtgcagtggggtgatctcagcttactgcaacctccgcctcccaggttcacgccattctcctacctcagcttcccgagtagctgggattgcaggtgcctgtctatgccaccatacctgtctaatttttgtatttttagtagagatggggtttcatcgtgttagccaggatggtctagatctcctgacctggtgatccacccgccttggcctcccaaagtgcaggatttccattttttaaggcaaaatagtattccactgtgtatacatatcactagatacgatttttgatctgttttgtgctgaatacttccataagcttcttgtgtccttactttaacattccttcatcattcattcagtgttcaaattattgaaaatgcattattgaatgctttctgtccttgacttttttctggattttcttcctgtcatgcaggccaattactcctttctattttgattcagtgactccatttcttctgcctcctctgtcttaacaaaggttggcaagtgaccaaaaacataacttgacctgacttgaataaaaagaaaatgtaggccaggtacagtggctcatacctgtaatcccagcactttaggaggccaaagcaggagaatcatttgagaccaggagttcaagaccagcctgggcaacacagtcagatactgcttctacaaaaaaaaaaaaaaatcaaaaaattagccaggtatggtggcatgcctgcagtgccagctgctcaggaggctgagatgggagggtggcttaagcttaggaagttgaggtgggagggtggcttgagctcaggaagttgaggtgggagggtggcttgagctcaggaagttgtggctgcagtaagctgtgatcatgccacagcattccagcctgggcaacagagtgagaccttgtctcaaaaggaaaaagaaaatgcttttggctcatgtgactgagaaatctaaagtggggttctggttttaggcacagttgaatgcaagaaccaaataatattggttctactttcttctgtgttggttccgctttcagacatgccctcaattcactggtgcaagaattgctagtaacttcaactttacacactctcctataacaattctagcttctttccaggcaacagaattccaagaatgaacatgctgggaatataattagctttgagtaagtacttggttcactcaaggctaatcactgtgtaagctttgattggcgggatctaatttgcatgcttactcctgaagcctggggtctagtggatagaatgtaaagccaacgttttaaagtgctacaaagggtctacataatttgccctgacttcatctcctacatttatccctcctggatcatactattccaactacaatggccttcttactattgttagaggatgtcaagtgtgttctttagggtttctcaaccctaaaggagttaggtgtgcctggagtgtttgtttactcaggtatcacttcaaatcaaatgtttacattatcagggaggcttttcagggccatcctggatcaaatgtcaacctctgacttcgcactccttaccttgctttatctttctccctagcgcctatctaaaagattatctaaataagagtaaacactcatatagtgctttctatgaggcaggaattagattaagcactttagttgattaacgaatttaatactttcaacaaccgtataaaaaaagtactattattttttttaagagtaggggaggctgggcgcggtggctcacgcctgtaatctcagcactttgggaggctgaggcgggcagatcataaggtcaggagtttgagaccagcctggccaacatggtaaaaccctgtctctactaaaactacaaaaattagctgggcgtggtggcaggcgcctgtaatcccagctactcgggaggctgaggcaggagaatcgcttgaacccaggaggcggaggttgcagtgagctgagatcacgccactgcactccagcctgggggagaggacgagacgtcgtctcaaaaaaaaaaaaaaaaggggtaggggaaattgaggaacagaaaggctaagcagcttgctcaggatgtggtggagcagaaattcaaacctaatcagaatgtctcccaagtctgtgctctttagcactaggctatgtttcctcttattctcagtctccctccacaaaaaaaaatatggtgcattaaaggaggaactttttttttttgagatggagtttcgctcttgttgcctaagctggagtacaacggtgcgaactcagctcactgcaacctctgcctcagccccccgagtagctgggattacaggtgtgtgccaccattccaggctaattttttgtatttttagtagaaacgggttttcaccatgttagctaggctggtcttgaactcctgacctcaggtgatccacctgcctcagcctcccaaagtgctgggattacaggcgtgaaccactgtgcctggcctaaagcagaaaccttttttttttgtttgtttgagacggagtctctgttgcccaggctggagtgcagtggcacaatctcggctcactgcaagctctgcctcccggtttcacaccattctcctgcctcagcctcctaggtagctgggactacaggtgcccgccaccacacctggcttattttttatatttttagtagagatggggtttcaccgtgttagccaggatggtctcgatctcctgacctcgtgatctgcccacctcagcttcccaaagtgctgggattacaggcatgagtcaccgtgtccggccctttttttttttccccccagcacttaggaaggctgaggtgggtaaatcacctgaggtcaggagtttgagaccagcctagccaacatggggaaaccccgtctctactaaaaatacaaaaattagccgggcgtggtggcgcatgtctgtagtcccagctactcaggaagctgaggcaggagaatcacttgaacccaggaggtggagattgcagtgagcccagatcgtgccattgcaccccagcctggtgacagagtgagactccgtctcaaaacaaaaacaaaaacatgcatctcacacatgaccttctaaatcaatactctacacccagatcacatctgtttcagtggcatcattaccatttatgtgatgattcgatcaccagctcaaatcactggccaaacaagaagctgggagccatccttctctcatttgccttcatgccccatatctgaccaacatgaatagctcttgaacctatcctcctctccactctcacaaccactacacctgagatcaggtcgccatttcctatagtttaatgtaacagcttcctagttcatttccctgtcttccacctttctgtcttcccctgattattttgattattcatcagaatgagtaagattacgccatgaagttcttagaaatacaattttccacccattgccactcactcattgatggagcagacaaacagaggtaatcaaaagtccttgagagaataagcatcttccatttcccctgcaagagttatgatccgtgtagaagccatttcaaagtttccccaatctggggccgggcgcggtagctcacacctgtaatcctagcactttgggagaccgaggcaggcgagtcacttgaggccaggagttgagacccgtctggccaacatagcaaaaccccgtctctactacaaatacaaaaaagtagctgggtgtggtggcatgcgcctgtaatcctggctacttgggaggctgaagcaggagaatcccttgaacccgggaggcggaggttttagtgagccgagatcatgctgttatacttcaacctgagcaacagagtgagacactgtctcaaaaaaaaaaaccaaaaaaaattaaaaaaaataaaagcatatgaaactgacagtagctgggtacagtggctcacacctgtaattccagcactttgagagaccgagacgggcagattacctgaggtcaggaattggagaccagcctggccaacatggtgaaaccctgtctctactaaaaatacaaaaattagcggggtatggtggcgggcagctgtaatcccagcactttgggaggccgaggcaggtggatcacaaggtcaggagattgagactatcctggctaacacggtgaaacctcgtctttactaaaaatacaaaaaattagccaggcgtggtggcggtcccctgtagtcccagctactccggaggctgaggcaggagaatggcgtgaacccgggagggcggagcttgcagtgagccaagatcgcgccactgcactacagcctgggcaacagagcgagactttgtctccaaaaaaaaataaaagagtgaaactccatcccccgcccaaaaaaaattattacgtaattgttgcgcctcctcactgtgttctagagtgcctgatttattgaaataattttaaaacccgttgctgggcgctgtggctcacgcctgtaatcccagcactttgggaggcccaggtgggtggatcatgaggtgaggagatccagaccattctggctaacacggtgaaaccccatctctactaaaaatacaaaaaattagccgggtgttggtggtgggcgcctgtagtaccagctactcgggaggctgagggctgaggcaggagaatggcgtgaacccgggaggcggagcttgcagtgagccgagatcaggccactgcactccagcctgggtgacaaagcaagaaagactccgtctcaaaaaaaaaaaaaaaaaaaaaaaaactattatagatttaaatctattttattattattattattttttgagaccaagtctcgctctgtcgcccaagctgcagtgcagtggcctgatctccgctcactgcaacctctgcctcccgggttcaagcgattctcctgtctcgccctcccgagtagctgggaccacaggcgcgtgccatcacacctggctgatgttttttatttttagtagagacagggtttcaccatgttagccaggatggtctcgatcgcctgacctcgtgatctgcctgcctcagcctcccaaagtgctgggattacaggcgtgagccaccgcgcccggcagatttaaatctattttaaaaccaaatttataatgtatcctgaatatctagagagacatttataactaaagattaaaaatcaacttatttttcaggaatcaaaaagtggattacataaagtcctaatttatactactcttttttttttttttttttttgagatggagtctgactctgttgcccagctggagtgcagtggtgtgatctcggctcactgcaacctttgcatcccaggttcaagtgattctcctgcctcaggttcccgagtagctgggattgcaggcactggccactatgcccaactaattttttgtatttttagtaaagatggggtttcacgatgttggccaggctggtctcaaactccttacctcaggctatccacccacctcggcctcccaaagtgctgagattacaggtatgagtcaccacacctagccatagtattctattgtcttttaacataacatctcagatttacattcaagagaactaaatgtgtgttaaagtgactcccaagtctgtggtcttaaactgttttgtcccaaaagaactttggaatatatatatatccccttacacattgcttactaaatgtgctgtttaacagttgcaaagatataatttctggcatattgtatgttgtgttataagtgctttaaatatatcttcatcaaaaccttggtgctttgctcacttgatttatggaaaagtgccacttactggccagtcttcaaaaggtctgaactcatttgcattcaaagcagtgagttgataaacatttgttataaccatcactctttcaaattctaagcatgatagaaggcagtcacatacataaaaggcagaagtttgatgcttaggtgaaattagtttgtctccttcaatatttttctctccagagctatctattttctccccaaaggttttgaactggaatgagtgagttagcctttcttttgtaccgagagataagatttgtgtaatagagttgggaaagaagtcctgaagcacccattgtttttttttttttttttttttttttgttgttgttgttgttgtttgagacgagtctcactctgtcaccaggttggagtgcagtgctgcagtctcggctcactgcaacctccgcctcccgggttcaagcaattctcctgcctcagccttctgagtagctgagactacaggcaagtgccaccacggccagctaattttgtatttttagtagagaccaggtttcaccatgttggccaggatggtctcgatctcttgacttcgtgatctgcccacctcggcctcccaaagtgctgggattacaggcgtgagccaccgcgcccggcccggcgctcttatttcaggagagatcattttaaattcaggttacatatgaaactgaggatttgcaaaataacttttgaaaacgatagcaacgtttgaaactaaaagttacttatgctagcatttctaaatgttccatttgaattatagaagcataatatcagtttaaaggaaacaatctgagttctagaattaaatagaaatccccagggcatgcatgttacatttttctctaaattaagagtaaaaaaaaaattaaagtttattcatcttagactatttacatgaatgcttaaatgctgacaatataaaccctagaatatagtcattaaaataaaaatcacttcctttacagtacacttacaataactgcaacgatcaatttctctttccaaagattgtcagtaagttgttaatctacttctctgttctctgttttttgttttgttttgttttgtttttttgagacagagtcttgctctgtcacccaggctggagtgcagtggcgtgatctcagctcactgcagcctctgtctcacgggttccagtgattcttctgcctcagcctcctgggtagctgggactacaggtgcatgccaccatgactcgctaatttttgtatttttagtagagacgtggtttcaccatgttggccaggctggtctcgaactcctgacctcaagtgatccacctgcctcagcctcccaaagtgctgggattacaggcgtgagccaccatgcctggccctgttctctgttttctttcttattttatttattttttgagacggagtcgcccaggctggagtccgtggcgccatcttggctcactgcaacctccaccccgccgggttcaagtaattcacctgcctcagcctcccgagtagctgggatagctgggattaaaggcgtgcaccaccacgccgggctaatttttgtatttttagtagagacggagtttcgccatgttggccaagctggtctcaaactcctgacctgaagtaatccacctgcctcggcctcccaaagtgctgggattacaggcatgagccaccacgccgggcctattgagttttctacaggacaaaccacaagtagcaacacagtgcaatcacaaaagaggaaggtaagcttttaaatttctaatttgcagagcgggtgttccaaatctgaaattcatcgacctctacacgggttgctgaaattgatgcgacaaaagcctgcatcttttttttttttttttttttttttttttttttttttttttttgagagggagtctggctctgtcgcccaggctggaatgcagtggcgtgatctcggctcaccgcaacctccgcctcctgggttcacgccattctcctgcctcagcctcccaagtagctgggactacaggcgcccgccaccacgcctggctatttttttgtatttttagtagagacggggtttcaccgtgttagccaggatgatctctatctcttgacctcgtgatctgcccacctccgcctcccaaagtgctgggattacaggcgtgagccaccgcgcctggccaaaggcctgcatcttttttttttttttttttttttttgagatggagtcttgctctgtggcccaggttggagtgcagtggcatgatctcggctcactgcaagctctgcctcccgggttcacgccattctcctgcctcagcctcctgagtagctgggactacaggcgcccaccaccgcacccagctaatgttttgtatttttagtggagacgggatttcaccatgttagccaggatggtctcgatctcctgacctcgtgatccgcccgcctcagcctccgaaagtgctgggattacagacgtgagctaccgcacccagccaggcctgcatcttgaagtgagttactgaagacaaagtttggcgctaatttaaataatgtgactgatgcgactgattgcgaccacaacggaagggtaccccacaggtcacaataattatcccaaaattaactgaagatgcccactgttacttctgtttaaccatgtgttaaccatgtagttatgggaactacaatgacgttcactaccttagagaaacttacaatcttgggccaggtgccgcacttcacaactataatcctagcactttgggaggccgaggaggctgaatcacctgaggtcaggagctcgagaccagcctggctaacatggtgaaaccccatctctactaaaactacaaaaaattagctgcgtgtggtggcaggcacttgtaatcccagctactcgggagcctgaggcaggagaatcacttgaacccgggaggcggaggttgaggtgagccaagatcgcgccactgcactgcagcctgggcaataagagcgaaactctgtctaaaaaaaaaaaaaaagaaagaaaaacagaaacttacaatctgttacaggagacagcaaacaaaaataatacaaggttcggctgggcgcggtggctcacgcctgtaatcccagcactttgggaggccgaggcgggtggatctgaggtcaggagttcaagaccagcctggccaagatggtgaaaccccgtctctactaaaaatacaaaaaaattagccgggcatggtggtggtcacctgtaatcccagccactcgggaggctgaggcagagaattgcttgaacccgggagatggaggttgcgatgagccgagatcgcgccactgcactccagcctgggcgacagagcgagactcgtctcaataataataataataataataataataataataataataataataataataaggttcacgtactacaaagcagagaacagggaggggaaggaattagaagagaatttctatgggcagagcaaagtcatgggtcacgggaatcacgaactggggaaaattatttgtcaggtttaattaaaggaagaggaacaaatagagtttaaagattagaaggttacaggtggcaccccacaatccccaaaacaaaccccacctcggctcagccccagtcacctcccaagggggtatatcttgcccagagagcctgaaggcaggggcatttgtttttacagcccagtcactattcttccagacaaaaaaagcatttcctgtgaggatgaagtgattaccccaggtcacctggccacattcctctccgggagctggtggccacaccacctggccgcccctccactagcgccgcgctccgaggtcacgcagctgcctgcgaagccctcagtgaggccgcctcccaccccctggagacgtggtctcccctcccgcgagggtccctccgaccccacccgggcaactagggcaccgcgggctgttacccaactaaccattaagcgcggagccgagcgcgtgcgtggcacggagaggcggggcgggtctggtctgcgctctcggcaccatgcggcccccaagacgtagagcttccctgcctcggtttgaagggaccgctgggctgcctgattacgcgcccccggccgagcctgcgcactggggacgcagtcggccctcgcgtcctctgctgcccgaaacaagcgcgtggaaagcttggtcggggcttctcacagccgcgcgcacagactggttctccccccgcgtctcccgggagcgtcgccgccacctgcacgcgtccggcacacaaacgtcggtctcaccccttagtttctggaagagaaaaaggaaaagccaccgagaggcctgaccctgaggggtcggggggagatgcgggcgcgtagtagagggaagcgactgaggagcggggactgggcagcatttgaatggatgcgggtgccgctggcacccgggaagacgcctgggagccggcgctggggagccgggcatgggctgggatgtgtttggattccaatctgggcctgacaccagttcagtgacctcgggaagttccccaaccctgcgggcctgtttcctccctctgaagtggcgacagtaatagaaccgacctcgtaggctcatcgggaggtcctgatgggagaacccatgcaacttgccaccacagagccaggcccgcggcgactggctcctggtgggtattaaagacgagtcgggaaagaagagcaggtaagagggcggggagactggcccagtgggttggggtgtgcacctcggccacgtggaaaagcgagaatgcaggggccggacgcttatggacgatgcatatgtggggccggatagaattgtggcaggcggcgctggggctgatgcgcctcacccagattatcctctgtaatcctcacagccctgtgaagtgggccctgccatgaacattttgtaaataaggcacccgaggctcagagaggtgaagtaattttccagacagcccagctcgtcagcggccagcatttgaagtcacactccagagcctgtttttatcataatagccgctgtgaccgcataaccaacgtgtgtgttgaagtgatcaaataaccatggggtggtctctgatgtccaggacttttgagaaatactgaaaaagtatgaggcaaggcccctgccttcaaagagctttcaagtttatgggagagactgagtcaggcgcaaattaaccaacatctgttgagcacttactgcttgccaggaccctgcccttctctcactgtcttcctcccttccaggactcaccccctcacttacccttcccctcaattctcacaagagattgaagaagggtagagactggaggatgaggctgggcgcggtgtcccatgtctgtaatcccagcactttgggaggccgaggcaggtggatcacctgaggtcaggaattcaagaccagcctggccaacatagcgaaacccccctctactaaaaatacaaaaattagaagggtgtggtggcactcgcctatggtaccagctactcaagagcctgaggagggagaatcacttgaacctgggaggcagaggttgcagggagctgagatcatgccactgcactccagcctgggtgacagagcgagactctgtctcaaaaaataaaaaaataggccgagcgcagtggctcacgcctgtaatcccagtactttaggagtccgaggtgggcggatcatgaggtcaggagttcgagaccagcctggccaacatggtgaaatcccgtctctactaaaaatacaaaaattagcctggcgtggtggtagacacctgtaatctcagctactcaggagactgaggcaggaagaattgcttgaacttgggaggcagacgttgcagtgagccaagatcatgccattgctctccagcctgggcgactctatctcaaaataaataaaataattaaacagataaaaataaaaaatggtggtgggacaattgggtatccatatgcagaagaatgaatttgcatgaaattgacttaaaattcatcaataacaaagagctaaactgtaaaactcttagaagagaatatacagataatctttttttttttttttttttttttttttttgagatggagtctcattccgtcgcccaggctggagtgcagtgtcgcaatctcggctcactgcaagttcagcccccgggttcatgccattctcctgtctcagcttcccgagtagctgggacgacaggcgcccgccaccacgcccggcttttttttttttttagcatgtgggagcaacttacccacatttcggttacactagtatggctacaaaaaaattttttttaaggaaaaaagtattggtgagaatgtggagaaattcaaacttcatactttgctgatggggatgtaaaatagggcagctactgtggaaaacagttttgtggttcctcaaaaagaaagaattaccatatgatgcagcaattctgctactgaagcagcgtcgttttctggggtaaatacctgaggttcctcgtctagtgccaagaagattaaggacatggatacacgcaaggagcgagtttaggagaggagatttcataggcaaaaaagggagaaaaggtctctcatgagagagtggggcgctcgaatgggaattccagcctggggcagagtgcacccgattttataggcaggcttaagaaggcagtgtctgatttacatagggtccaaagattggttggaccaggtgtgacgtttacataacacgccaggtaagctggcttctccaccctaatcttattatgcaaatagaatctttgcctggctggcaccatgttgcctgctccttactacacacgcggctagcaaagagaagggaagatggagccgccattttgaacatgcgtagtcccaggtgtagccttttcctattgccacaactgctggcgttcacccctgcaagcttccagcttgcttgtctatgtttgcagcttgattttacaggatgttctttgttacaaaagaaaattatctgggggctgtttttcattaaaaggaaaaccttaccaaggactcctgtagcttacctgcctaaataatttattcttaatgcctatatcactactaggtatattaccaaaataaaaccggtattcaaacaaacacttgtacagcagcactattcacagtagccaaaagttgcaaacaattcacatgtccatcaatggatgcatagataaacaaatatattatgcagctataaaagggaatgaagtactaataaatcccacaatgtggataaaccttaaaaatatataagtgaaagaagccagaaactaaaggttcaaaattgtatgtgcgataatttcgaggcatttgaaccagagcaactccatcttgaatagggactgggtaaaataaggctgaaacctactaggctacattcctgagatggttaagcattctaagtcataggatgagataggaggtcagcataagatacaggtcataaagaccttcctgataaaatagcttggagtaaagaagccagccaaaacccactaaaaccaagatggcccagagagtgacctctggtcatcactactacactcccaccagtgccatgagagtttacaaatgccatggcaacctcaggaagttaccctatatgatccaaaaaagggaggcatgaataatccacctcttttttagcatataatcaagaaataaccataaaaatgggcaaccagcagccctgagggtgctgtctatagagtagccattcttttattcctttactttttaaataaacttgctttcactttatggacttgccctgaattcttttttgcacgagatccaagaaccctctcttgggctctgggtcaggactcctttccattaacaatttcattgcatgaaatacccaagataggtaaatccatagagacagaaagcagattagtggttgccaggggctagggatagggagaaagggagttgtgtccggatttggtgggttcttggtctcgctgacttcaagaatgaagccgcggaccctcgcggtgttacagctcttaaggtggcgcgtctgaagtttcttccttctggtgggttcgtggtctcgctggctcaggagtgaagctgcagacctttgcgttgagtgttacagctcttaaggcggcgcatctggagttgttcgttcctcccagtggtctcgtggtcccgctggcttcaggagtgaagctgcagattttcgcggtgagtgttacagctcataaaagcagtgtggacccaaacagtgagcagcagcaaggtttattgcaaagagtgaaagaacaaaacttccacagtggaaggggaccggagcaagttgccactgctggctggggcagcctgcttttattctcttacctggccccacccacgtcctgctgattggtagagccaagtggtctgttttgacagggcgctgattggtgcgtttacaatccctgagctagatacaaaggttctccacgtccccatcagattagttagatacagagtatagacacaaaggttctccaaggccccaccagagcagctagatacagagtgtcgattggtgcattcacaaaccctgagctagacacagagtgctgattggtgtgtttacaaaccttgagctagatacagagtgctgattggtgtatttacaatccctgaactaggcataaaggttctccacgtccccaccagactcaggagcccaactggcttcacccagtggatcccgcacggggctgcaggtggagctgcctgccagttccgcgccgtgcgcccgcactcctcagcccttaggtggtcgatgggactgagcaccgtggagcagggggcggcgctcatcggggaggctccggccgcataggagcccatggagtgggtgggaggctcaggcatggcgggctgcaggtcccgagtcctgccccgcgggcaggcagctaaggcccggtgagaaatcaagcgcagcgccggtgggctggcactgctgggggacccagtacaccctccacagccactggcccgggtgctaagcccgtcattgcccggggccggcagggccggccggctgctccgagtgccgggcccgccaagcgcacgcctacccggaactccagctggcccgcaagcgccgcgcgcagccccggttcccgctcgcgcctctccctccacacctccctgcaagctgagggagccggctctggccttggccagcccagaaaaggggctcccactgtgcagcagtgggctgaagggctcctcaagtgccgccaaagtgggagcccaggcagaggaggcgccgagagcgagcgagggctgtgaggactgccctgccagcacgctgtcacctctcagagtgactgcttaatggatatggagttttcttttggggtgatgaaaatgatttggaacttgatataagtggtgactgtgttaccagagaggtgtccgattccagacccctccagagtaaactgaaagccagtttttaggaaagtaaaggaataagagaatagctactccattgacagagcagccccaaaggtgctggttgtccatttttatggttatttctggttcaaacgtctctgacagttgcatgtgctattgtgaaatatatatttggtcttcttctccatttcctggtggcatacaacttctaaaatccttagaacctccaaagagatgtgtctttttatatgttaatgagttgactgatggttggggactcctggatagcttcaggattgagggctggtcacaggaaagaccaaaccttgatgagagagttgggacttgcaggcacacccctcaacctccacgaaggggaggaaggctgaaagttatgctgattaccaatgaccaatgatttaatgactcatgactacataaggaagctttcataaaaacgcaaaaggactgggtccagagagcttcgagttagtggaacacgtggaggcacctggagggtgtcatgccctgccagggcatggaagcttcatgctctttcccacataagcatttctttcatctggtgttcaacagtctcatttgtaatatcctttataataaaccagtaaatgtaagtaaagtgttttcctgagttctgtgagccactttagcaaattagttgaacccaaagagagggtagtgggaatcttgatttacagccagtcagttagaagcacaagtaaaacaacctggggcttatgattggcattggaactaggggcaagcttgtgggactgagccctcacctgtgggatctgacactatcgccaggtggatagtgtgacagttgagttgaatcagaggacacccaactggtgtccactgaagaatggattggttactgttggggagaaattcccacacacattttggttaccaagagtcacagaatggtgaatatactaaaaaccattgaaatgtacactttaggccgggcgcggtggctcctgcctgtaatcccagcactttgggaggtcgaggtgggtggatcacaaggtcaggagttcaagaccagcctggccaatatggtgaaacctcgtctctactaaaaatacaaaaaaattagccgggcatggtggcacatgactgtaatcccagctgcttgggaggctgaggcaggagaattgcttgaatccaggaggcagaggttgcagtgagctgagatcgcgccactgcactccagcctgcataacagggcaatattccgtctcaaaaaaaaaaaaagaaatgtacactttagctgggcatagtggcttacgcctgtaatcccagcactttggaaggccgaggtgggcagatcacctgaggtcaggagttcgagaccagcctgaccaacatggagaaaccccatctctattaaaaatacaaaaattagccaggtgtagtggcacattcctgtaatcccagcaactcgggaggctgtgacaggagaatcgcttgaacccgggaggcggaggttgcggtgagccaagatggcgccattacactccagcctgggcaacaagcgtgaaactccgtctcagaaaaaaaaaaaaaagaaaagaaatgtacactttaagatggttgattttgtgacatgaattcaccggacttaaaaaacaaacaaataaatacaaagaaacacattttccatgaatctcgtgaagcttttgggaggtgctctaacagtatattcataggatcatatctaattttttttttttttaagatggagtcttgccctgtcacccaggcttgagtccagtggcgtgatctcagctcactacaacctccacctccgaggttcaagcaattctcctgcgcctcagcctcctgagtagctgggattacaggtgcacaccaccatgtccggctaatttttgttattattattatttttttaagtagagatggggtttcgccatgttggccaggctggtcttgaactcctggcctcaagtgatctgtccacttcagcctcccaaagttctgggattacaggcatgagccaccgcgcccggctggatcgtatctaattttataattttaactttttattcttttcttgaagagggccgctgtggtggacactataagcaccccctcccaaagatgtccatgttttaatccttgaaacctgtgaatatgttatgtaatatgacaaaggataattaaggtgacagatagaattaatgttgctaatcagctggccttaaaatagggagattatcctggattgtctgggtgaaccgagtataatcaagagtccttaaaatggaagaaggtgacagagaggaggtcagagtgaagcaatctaagaaggacttatctgttgttgctggttttgaagatggaggaagaagccacaactcaaggaatgcagatggtctctaaagctggaaaagacaaggaaactgattttttcccagagcctccagaagggaacacagccctcttgacgcttgagttttatttagcccagtgagtcctgtctggaccttttaactacagagctgtaagagaaatttgtgttgtctaaagctacaaagtttgtggtaatttgttatagcagtgatagaaaactaatacagccaccttagatgtgcatacttcaggccccgcaaaacttttatcttccgctgacagggaatataaagagtacaggctttgaagttggaaaacctggtctcgtaacttacttgctgtgttactgtaggcaaatcgctgaactcttccaggccttagtttcttcacaggtacattggagataatacctacaaacctgatctattgtgcagatcaaaagagaaagtgattaataaaacttggaaagtgctctaaaaatgttcatgtgtcattttaagttgttaataaagagtattagagtgactaagtgactccaagcttattagctggaaaaatagaagtaggagagccgattctctgggacatgcctgtagtcccagttacttgggagactgaggtggggagaattgcttgagtccagcctgggtaacatggggagatctgtccctaaaaaatgaaaaaaggaaaaacagttggagggtaagaaaaggaaaccagttttgatgaactagccaagttgattaaaataaagcagatacaattcctactgtttttccagatatcttcctgattttttttctttttttttttttttgagatggagtttcgcccttgttgcccaggctgaagtgcaatggcatgatcacagctcaccgcaacttctgcctcccaggttcaagcaattctctcaggttcaagtgattctcctgcctcagcctcgcaagtagctgggactacaggcatgtgccaccaggcccggctaattttgtatttttagtagagatgaggtttctccatattggtcaggctggtctcgaactccccacctcaggtgatctgtccgccttggcctcccaaagtgctggattacaggcgtgagccatcacgcggcctgtcttcctgattttaagccagtgcaagataggaattttagagctgaaaggagcttgaaaatcacatagccaggccggccgcagtggctcacgcctgtaatcccagcactctgggaggccgaggtgggcggttcacgaggtcaggagatcaagaccatcccggctcacacagtgaaaccccgtctctactaaaattacaaaaaaattagccgggcgtggtggcaggcccctgtagtcccagctacttgggaggctgaggcaggagaatggcatgaaccctggaggcggaggttgcagtgagccaagatcgtgacactgcactccagcttgggcaacgagtgaaactctgtctcaaaaaaaaaaaaaagaaaagaaaaaagaaagatgttctttttgttgttgttttttttcttttttttttttttttttgagacggagtttcactcttgttgcccaggctggagtgcaatggcgcgatctcggctcactgccacctccgcctcccaggttcaagcgattctcctgtctcagcctcccgagtagctgggattaccggcatgcgccaccatacccagctaatttttttgtatttttaatagagacggggtttcaccatgttggttaggctggcctagcactcccgacctcaggtgatccgtccggctcggcctctcaaagcactgggattacaggcgtgagccaccgcgcctggtgagaaagatgctcttaaccctatttcaccaataataaaacaaaaagtgttctttttgtttttgttttattgagatgtaattcacctaacataaaattcactattctaaagcgcacacttcagtggtttttagaaaattccctatgttgtgtaaccatcaccattactctcaaaacatttccatcaactgcgcccccccaccgaaaaaaaccatactattagcagttagtcccaatttcccccttctcccatcccttagcaactactaatctgtctatggatttgcttattctggatattttatatactgtaaattgaattattagcataatattttcaaagttcattcatattgtagcatgcatcagtacttcattccttttatggctgaataataatccattgtatggatgtattacattttgtttatcctttagttagctgatggacatttggattgttttcactttttggccattatgaataaagctgctatgaacattcatttacaagtttttgtgtaaacatatattctcatttctcttgagtatatgctcaagaagtggaattcctggttcatatgataactctgtgtttatctttttgagaaactgctaaactgttttccatagcagctgtactttccaccagcaatatatgagggttccaatttttccacattcttttcaacacttgttgttttctctttttgaaaatattgttactatagtcaacctaatgggtgtaaagtgatttctcatgtaatttgtttgtttagttttatttttggaatagcatttcccactctttttatttaattttaaatttttttttttttttgagacggagtctcactgtgttgcccaggctggagtgcagtggcgtgatcttggctcactgcaacctcttcctcctgggttcatacagttctcctgcctcagcctcccaagtagctgggattacaagcatgtgccaccatgctcagctaatttttgtatttttagtagagacagggtttcaccatgttggccaggctggtctcgaactcctgacctcatgatctgcccgcctcggcctcccaaagtgctgggattacaagcgtgagccaccgctcctagcccattatggtactttagatgaccacagttataaagttgggtcacataattatcaaccatagtgatatgtgtttatacatttcccctttcgacctatttcttttttcttttttctttttgagacagtttcgctcttcttgcccaggctggagtgcaatggtgtgatcacctgatcgaagtcaggagttcgagacgaacctgagcaacatggagaaaccccatccctactaaaaatacaaaattagctgggtgtggtggtgcatgcctgtaatcccagctactcgggaggctgtggcaggagaatcgcttgaaccccggaggtggaggttgcggtgagctgagatcgcaccattgcactccagcctgggcaacaacagtgaaactccgtctcaaaaaaaaagtcgataaaaataaataagtaaatctaataatctgattttaaaatgggaaaaactccgtctcaaaaaaaatatggttcatctggttgtaactgttatagccatgtaactgtaattagtgtacgtgtttatgcttgcaaaaataggtatgttatactgagtattttgttgtgtaaagtgacctatgaagcgttctgtcatgactttatgtgtctcaaataaatccccttttaaaaatgtaaataaggccgggtggggtggctcatgcctgtaatcccagcactttgggaggctgaggcgggtggatcacgaggtcaggagattgagaccatcctggctaacacagtgaaaccccgcctctactaaaaatacaaaaaattagccgggcgtggtggccggcgcctatagtcccagctactcgggaggctgaagcaggagaatggcgtgaacccgggaggcggagcttgcagtgagccgagattaggccactgcactccagcctgggtgacagagcaagactccctctcaaaaaaaaaaaaaagtaaaaaaatgtaaataaataccttttaaataatttttaaaattagttttccagaatgatagttttggaatgttgagctttcaggatttcaacacttgaggttatgccttttaggattatgatcagcttcctgtctcttaagaatgaaaacaagcaagcacatacactctcagcactttcacccagaattttaatggaggttctcgtgagttcgataaggcaaaaataataataattattattattatttagccggtcgcagtggctcacgcctgtaatcccagcacttcgggaggccaaggcgggcggatcacgtgaggtcaggagttccagaccagcctcaacatggagaaaccccccgtctctactaaaaatacaaaattagccgggtgtggtggtgcatgcctgtaattccagctactcgggaggctgaggcaggagaattgcttgaacccgggaggcggaggttgcagtgagccgagatcgcaccactgcactccagcctgggcaacaagagcgaaactccgtctcaaaaaaaaaaaaaaaaaattaaagacatcgagattggaggccggacacggtagctcacgcctgtaatcccagcactttgggagacctaggtgggtagaaattctgtctcaaaaaaaaaaaaaaaaatagattggaaaggaagaagtaaaattctaatcacaaacaacatggtcatctttacaaaaaatcatttggaatctacaaaaaggctaataaaacttagcaagtttgtaagaaacaataaaaatcaactgtatttttatatagaattagcagacatttttaagtagataataaaatcagtgctattttctttctttctttttttattattattatttttagtagagacggggtttcaccgtgttagccagaatggtctccatctcctgaccttgtgatctgcccacctcggcctcccaaagtgctgggattacaggtgtgagccaccgcacccggcctaaatcagtactattttcaataggagcaaaacagttaaaatttaggaataattacgacaaaagatttgtaaggcctgtacactgaaagctatagaacatttctgagagaaataagagacctaaatagatggagagataatatcatgttcatgaattggaagattcaatattgttaagaactcaattctctccaaattatctatggagttgtgatattatgttatctatacattgattttcatccatggttcctgactcataactcctgtagctcttgttataatgttggggtgctttaggcctcagaagcaggcctcaggaaatagaatctctctctgatcttctactgctgtcctttcacgggctcccttttctcccccaaggcaggactgtcatcttcccctgcctttccataaagaaattccctgacctaccttgtctgattgtaggtcataaaacccctattttagaaagggtcctgctccataccctgaaggaaggaatgctgcacacagaggccaagaagaatctgaacaaacaggccttgctgggtatccccattcagtctattttagatcctaccctttttatctaatcacatttctacatggttgtcaatcatacctatccaatgaagtcttcataaaaggcccaagaatacaacgttatagagagcttccagatagttgaacaaggagagtcttacaggaaagtgagcaagaactcaaccacatgccaggagggcagtgtaccgcaactccaaagggacagaagctcctgtgatcagactcttccagaccttgccctgtgtctctcttcatctggctatctatttatatcctttaaagtatcctggctgaatgcagtggctcacgcctgtaatcccagcactctgggaggctgaggtgggtgaatcacctgaggtcaggagtttgagaccagcctgaccaacatggtgaaccccgtctctactaacaaatacaaaaattaggcgggacacggtggctcacgcctgtaatcccgcactttgggaggccgaggcaggtggatcatgaggtcaggagttcaagaccagcctggccaagatggtgaaaccccatctctactaaaaagtacaaaaattacagcatgcctgtaatcccagctactcgggaggctgatgcaggagaatcgcttgaacctggggggcggagattgcagtgagccgagatggtgccactgcactccagccctggtgacagagcaagactccatctcaaaaaaaaaaaaaaaaaaaaatacaaaaattagctgggtgtgatagcgggtgcctgtaatcccagctacttgagaggctgaggcagaagaatcacttgaacctaggaggaagagtttgcactgagctgagatcgtaccattgcactctagcctgggcaacagagcaagtctccatctcaaaaaaaaaaaaagtatataactacacacacacacacacacacacacacacacacacacatatatatcctttgtaataaaccagtaaatgtaagtaagtgtccccctgagttctgtgagccactctagtaaagaggatcatgggaactccatcttgaagtcagctgatcaaacgtacagaggtgtggtcttgtgactagtgggaaggaagaggtgttcttgtgggactgagccctcaacctgtggtttctgaagctatttccaggtagataatgtcagaattcaattgaattggaggacacgcagcagatatctgctgcagaattgattgcttggtgtatgaggagaaaccaacacacatttggtcccagaagaatcctgggttgattgttgtggtgtgagaacagtggaagaacatggtttgagtttttctactatcccaagagtcagtgtaatcccaatcaaaatcttttttaaaaaatattttacagaaaaaattgacaagctgcttctaaagttcatatgaaagggaaaaataaaaaaaacaacaacccaaacttagagtagacaaaacaacttgaagactatgaagaaagttggagtccatgagtggtggctaacgcctgtaatcccagaactttaggaggctgagacaggcagatcacttgaggtcaggagttcaagactagcctgtccaacatagtaaaaccccgtctctactaaaaatacaaaaaaaaaaaaaaaaaaaattagccaggcatggtggtgagtgcctgtaatcctagccacctgggaggctgaggcaggataatcacttgaacttgggagcggaggctgcaatgagccaacatagtaccactgcactctagccggggcgagacagagtgatactctgcctcaaaaaaaaaaaaatattggagaagtggttcgtttgctgcccatatcctgacagtaggtttgagggcataggccaagggaagcagtaccagaggctcaacatgatgaaaacagctgtccagcaagaaagactggagcttggtttttgttaatttttttttcttttgagatgcagtcctgctctgttgcccaggttggagtgccgtggcacaatcttggctcactccaacctccgcctcccaggttcaagcgatcctcctgcctcagcccccaaggagctgggattataggcatgcaccaccaagcccggctaatttttgtatttttagtagagacagggtttcgccatgttggccaggctggtctcaaactcctgacctcaggtgatccaccctcctcggcctcccaaagtgctgggattacaggtgtaagccaccgtgcctggccagccaccgcgcctggccagccaccgcgcccagccttttttttatttttttattttttttttgagacagagttttgctcttgttgcccaggctggagtgcaatggcgcaatctcggctcactgcaacctccacctcacaggctcaagcaattctcctgcctcagcctcccgagtagctgagattacaggcatgcaccaccacgcccatctaatttagaatctttagtagggacggggtttctccattttggtcaggctggtctcaaactcccgacctcaggtgatccgcccgccttggcctcccaaagtgctgggattacaggcatgagccaccgcactcggccttgttaaacttttttgttaatttttttttttttttttttttttgagagaagtctcgctcttatctcccaggtttgagtgcaatgacttgagctcggctcactgcaacctccacctcccgggttcaaacgattctcctgtatctgccccccaagtagctgggattaagtcaccttccaccacacccagctaatttttgtattttttagtagagacagggtttcaccatgttggccaggctggtcttgaactcctgacctcaggttatcttcccgcctcggcctcccaaagtgctgggattacaggtgtcagccactgcgcccggccattttttttgttaatttttaagacatgattagagccaaagaagagttggtgtagagatcaaggtttggacaagggtgaggcaagtgaggctttcattctcaaggacccatcttgcgcttatatgatcttgagagtgtgtgcctcctaaaattttatgtttcctcacctgaaggtaatcctgccccttatgggactcagaacatgacaccccaaaatatggcaccttggcaattaagaaaactaaagaagcaagatcacgttgacctccccccgctttctcatgcacagtgctttcataaaggaattatttaacctacctcacctgaaagcaggacataagaccctcattccaggctggcccagccccatactcagagaaaaggaatgctactcagcagaaaggaatgctactcagagtggccaagaacaatctgaacaaacagatcttgtcatatttcccctacttcccctaccccagtttattaccattagatcataccctttgtccagtcatgttctccacaatcatctacttctttcagcagacttagcatttaaaaaaacacaattttccctgggtctttgggtcttcatttctgaaggctcttatgtcttataaaaccttgttaaatttgttatgctttcctcttattaatctgcgttttgttatggggtgtcatctgtgaacctagcaatgggtgaggaagacaatacttttttctctcctatgccctgatggggaactctctagacagacaaatgaatagctgaggcttctcatcacccatatacccacattctctctctctttttttttttttttttaaacagagtctccttctgttgcccaggctggagtacagcctgggctcactggatcctctgcctcctgggttcaagtgattctcctgcctcagtctctcaagtaggtgggactacaggtgcatgccaccaggcccgactaatttttgtatttttagtagagacggggtttcaccatgatggccaggttggcctcgaactcctgacctcaagtgatcctcccaccttagcctcccaaagtgctaggattacaggcgtgagccaccatgcccggctgcacactctcttacctttcccacaccttgaaatttccctcactgcccaccctaaatacagtaccatgagacgcaaatcttagattagatttcaaaggaagggcagtgtcacttagttccactaaggcctacctgtatcctctgtggcctagactggaggtggatatggggagactgatttccaagatagacatagctctgttatcttcactccctgagtccaagcccagctgaatacctaagtggcttctcattctttttttttttttttttgagacggagtcttgccctgtcgcccaggctggagtgcagtgtcatgatcttggctcactgcaacctctgcctcccaggttcaagcaattctcctgcctcagcctcttgagtagctgggattacaggtatgtgccaccccacctggctaatttttgtatttttagtagagacagggtttcaccatgttggccgggatggtctcgatctcctgacctcgtgatccacctgtctcggcctcccaaagtgctgggattacagatgtgagccaccacgcccagccgtggcttctcattcttatccttagagattgctggcatccccggcctcttaccactcttcccatccttccatcagcttagaccactcaagtgctttcactgcaagttccctttattgtcatcactaggcagctgcattttgatctcagagctaatagatgaatccactttcttcaatatggccactctctcagctggggtcttcttccctaatctgtgtgtgtgtgtgtgtgtgtgtgtgtgtgtgtgtgtgtgtgtgtgttttgttgggtttttttttgagacaaagtctcactctcttgtccaagctggagtgcagtggcaccatctcagctcactgcaacctccacttcccgggttcaagcaattctcctgcctcagcctcccaagtagctgggactacaggcacgcgccaccacgcccagctaatttttttttgtatttttagtagacacagggtttcactatgttgaccatgctggtcttgaactcctgacctcctgatccgcccacctcagcctcccaaagtgctgggattactggcgtgagccaccctgcccggccctgaaataaaaaaaaataattttttttttttaaaaagagtttgaggccttgtgtaccttgagttaaagaggcctctaaaggagaacctgggggattccaaatctgacagctacaattttgcacaaagccttactcaatgttctccactcatcaccccctttctttttacctgcttcccttgtcttctgctcttctcctctcctggcgagttggtgttggttgttgtcaggaagcctcagctcctcacaatgggaactccccagagggctccttgaatgtcctcatgacatggcgcctaactcccaccagaatgagagatccaggagacagtgagagggaagccaccaagcctttaggtcctaatctctaaagtcactgtaggggagaaaattagcatctttatctagtatcaccctaggtttgtggcagagatccctataacaaaatattaaatacaagagaaaagcatacaaatttatttaataagttttacatcatatgagagacttaataaggaaatgaagacccaaagaaacagaaaaaaaacggtatttttatgcttaggttcgtgtagagtggactatcatacagtatgattggacaaaagtgggtatgatctaatagaatgagaccaccacttctcctgttgtccttcccagcttctccccaacctccccttttccctagtttataagacaggagaaaagggagaaagcaaaaagttggaaagaaacagaaataagataaataactagacgaccttggcgccaccacctggccctggtggttaaaagaataataataataataataatattaacccctgaccaaaactactagtgttatctgtaaattccagacattgtatgtgaaagcactgtaaaactttttgttctgttagctgatgtatgtagcccctagtcacgttcctcacacttacttgatctattacgaccttttcacgtggaccccttagagttgtaagcccttaaaagggctaggaatttcttttttggggagctcagctcttaagacgcgagtctgctgacactcccagcccaataaaaacctcttccttctttaatccggtgtcctaggagttttgtctgcgacttgtcctgctacagtaatggtaacaaactggagagaacttaacaaggcctgtttattcacagcttcttggcatctctgcgtcttcattcttttcttctgggtataggaaggaggccctgcaaatagggtcttatgaccttattttgtaagaaggtcagagaattcttttagggcctgcttcatgggagaaagtcaggggaaggtcagagagaccttccctgttaaaccttccccatagtgttaacaataattacatgccaggctttagataaaagtatagattaagcattagtcaggttgtcctatgactcatttccctatagcctcttatggaccatgtaggccaggacataaaccatgaatttacttattgttcttgtagataggaactttgactttaggagccttacaacttttcatttgagatgtttttcagaactaacgccaatgagtccaaagaccacaccaaggaaccaagtcggtctgagaatgcagtttcttcagctgggcgcggtagctcacgcctgtaatcccaacactttgggaggccaaggcgggcagatcatgaggtcaggagttcgataccagcctggccaacatggtgaaaccccgtctcccctaaaaatacaaaaattagctgggcgtggtggtgtgcacttgtaatcccagctactggggaggctgaggcaggagaacggcttgaacccaggaggcagaggttgcagtgagctaagatcgtgtcactgcactccagcctgggtgacaaacaagaatctgtctcaaaaaaaaaaaaatgcagtttcttcacctccatcctatgacatcacccttcactctttgaacaatcgacaccttggcccactactcgtccaaaccccttaaggtctctagacccaaactctttgaagaggtggttttgaggtttcttctcatctcatttggtggccttacaattaaacctctttctctgctgcaacctggagtcttggtgcattgactttctgcatatcaggcaacacacccagcacaatcacccctgcacatgctgtttgtccattcagttcttcagcttgaattctttttttttgagatggagtttcactcttgttgcccaggctggagtgcaatggtgtgatcttggctcaccgcaacctctgtctaccgagttcaagtgttctcctgcttcagcctcctgcgtagctgggattaccggcatgcgccaccacgctcagctaattttgtatttttagtagagacggtgtttctccatgttggtcaggctggtcttgaactcccgacctcaggtgatccacccgcctcagcctcccaaagtgctgggattataggcgtgagccaccatgcccagccgaattatttcacatgtcaaggcaccatattttagggtagtgcatcctgcactccatctggaacacatgccacatcccttctgctacattctactggtcaaagcatcccttttgctacatgccactagtcaaagcaagttacaaaagcaggccagatccaaaggttgaggaaacagaaccccacctctgagaagcagcaaataatttgtgaccatgtttaatctaccataaagaatttggccaggatcagagatggttgcccacacttttgtcctttctcttactgaactggagttttgaagaggccatcacgcggtctaccccctttagaaggagatctgcaaaagctttaaatgtttgccctgagctctcagtttctctggtttttccttttcccatctctctctctctctctctctctctgagccccaccccactttccctgctgccccatcctctgtaattcagctacagccaagctgtagcttttcctgtctagccctacccaactcagggacccattcttctccccatttcaagccccataggcctcctcaactctccctggaaaggagaaaccggctcaaagtgagttgagtggagaattgggaaagctctttgagacttctggagttcccagtagcaaaaggaaacaggataacaaaacagggtgaaacctgaatgatggcatggaggggctggtgggggtgctcacaagaggtaggatggaaaagaactgaaaacagaaagttgcccttaccttcccggacttgagggacctgtgactctaggcaattgagggtagttgtcttgccaaggtgatagcatgtaatagcccataattacccataatgacttcatgaggctcagcctaggtgggagcccaggcatttcaagataatgtcttttcttccctttgtattctgagtgtgttagctccctgcatggattgaaaggtgcttattaacacaagtgcccttgttaattaggttggttctgacttacgtgctacttattagatactcaagtcaatatggataagtgtcctgcttctgggccagggacagagaaaaagccagaaaacccacttctcctcaaaaggtgtctctggtgtccagaaaggacagaggatgcttcatttttatggtgctgggatgagctgagggaaggggagaagcaggaggcaaaccctggtgggggcgctgctggaaggagacagctcacaggacaccaccaccacaagctgagcctccactttcccatctgtgatgtggggtttagaaccagagtattggcatgagaaaggattagagatgaatgcccacttttgtccttgtaagaaaaaattgtggaactttgaaattaagtaggagtcctggcctaaatagttcatccttctagattatctctttctttatctcttcctagtttgtcttttttttttttttttttttttttttttttgagacggagtctcactcttgtcgcccaggctggagtgcaatggcgtgatctcggctcaccacaacctctgcctcccaagttcaagcgattctcctgcctcagcctcccaagtagctgggattacaggcgcctgccaccatgcccagcaaatttttgtatttttagtagagacggggtttcaccatgttggctaggctggtatcaaactcccgacctcgagtgatctgcccaccttggcctcccaaagtgctgggattacaggcgtgagccaccacacccggcccctagcttttctttgattaggatattttaccactctgtagagataacagttgacttgtaaaaatctggtagtaagacagtttccttctaaagaaatgcaaattgcatcaattgtacagtgaaatgcagttgattctattcctttggtatgatagggttcacgacatactactccaaaatgtggcacctcggcattcgagaaaacaagagaagctgggaggtttctctggccttctcccactgttctcccactgttctcccctgaggcaggccataaaactgaattgaacttctcctgaagtaggtcataaggccctcatttcagaggggttctctctatatctggagaaaaggaataaagacacagagatgccaagaagaatctgaacaaacaggccttgctaagttcccccagttccctcccgctcctgtctctgactcctctgcctttcccagaacacagggagaggctttctctgaagttcccttatctgaccaagggaagtttcttcagaaggaatgcagttgtcttgggccctctccctacaatctcattaaacagagaagattaactcacaggaaaggagactggagttgacaccaaacccagagcccagacgaactttgtgacacgatattgcctgttctttgggcccattcattccccctaagaatcgtttactctttctctaaaattgcctagagcccccacctcccttactgctatgaagagggcatttaagcttcagctatctggccctttgagtttactttgtgtgactctcatttgtgtaactctcttgcacttgcatattaatgaattcatcagccttttctcctgttaatctgcctgttgtccatttatttcagcagatgctattatcaaactttcagaggggaagtgtaaactttcctgcaatacacttttggcttttgatcatacttctgcatgactgcccataaaaatacacagatttttcagttcttttgggtctttgtttctgaaggctcctgtgttaaataaaatttaaactttggttaaataaaactttggttaaataaagatgtatgtttttatcttgctgatctgtcttttgttataggggtcactgccatgaaccttgcaaagattagggaaaagataatactttatcacacataaatattgaccagttttttcagttcttcgagttttgcatccacttgtaaatgcatctcaacattctttatctgactctaaacttgatagttttctttaaaatggactataatattcaaattatattaatgagggtttccttattaattaatgaattaaatgttttgcattttatatctgtgtaacagtatatccttttaaaatattaatcttgtggccgggtgtggtggttcatgcctataatcccaacactttggggggccaaggcaggcagatcgctcgagctcaggagttcgagaccagcctgggcaacatggtgaaaccctgtctctaccaaaaagtacaaaaaaaaaaaaaattagccagacgtggtgtcacaagcctctagtcccagctactcaggaggctgaggtgagaggatcacctgagcccaggacgcggaggttgcagtgagccaagatcatgccactgcactccagtctgggtgacagagcaagacccctctcaaaaaaaaaaaaaattactcatttaacattctacagaagaagaaaagtaggccccaagaggaggtgggacttacctgagatcacacagctcatctgtcccaaagcatgactagaagaagccaggcctcctttggcttctttaagttcagtaatcactaaggtacctcacaggattgtcttcagaaccagaaggtggaagagagaagagaaagtggtgtgaaagtgaatgacgccaagcagaggggagggcttcctctctgggctgtggtggctcatgaggtcctgggctccaggcctcataaggcagtgatgtgagcacggctaggggtgtcagcctcttgagtttccttagctgccctgcttccctcacagggccctggggtgaggggtgaggtgagagaggaggcctgtgaaagtgctgtggtggtttttaaaatatgcccacaaattctttgatattcctcccttcaagaggtggagccttggccgggcacggtggctcatgcctgtaatcccagcactttgggaggccaaggcgggcagatcatctgaggtcgggagttaaagaccagcctgaccaacatggagaaactctgtctctactaaaaatacaaaattatccgggcgtgttggcacatgtctgtaattccagctactcaggaggcggaggcaggagaatcacttaaacccaggaggtggaagttgcagtaagtcgagattgcaccattgcactccagcctgggcaacaagagtgaaactccgtctcaaaaaaacaaagaaaaaaagaggtggaggctcaaaaaggtagagcctaggctgggtgcggtggctcacacctgtaatcctagcacttatgggaggccgaggtgggtggatcacctgagatcaggagtttgagaccagcctgggcaacatggtgaaaccccctctccactaaaaatataaaaattagctgggcatggtggcgggcacccatagtctcagctatgcaagaggctgagccaggagaatagcttgaacccaggaggcagaggttgcagtgagctgagatcatgccactgcactctagcctgggcaacagagcaagaccctgtctccaaaaaaaaaaaaaaaaaaaatttagagcctagagcctagttcccctcaagggttgattggatttagtgactcacttcttacaaatagaataaaatggaagtgatgctctgtgtgtgtgtgtgtgtgtgtgtgagagagagagagagagagaaagagagagagacagtcataaaacagcactgtggcttccatcttggtgatactctcttggatttcttactctgggagaagccaactgctctgagaatactcaggcagccctgtggagaggccctttctgtgaggaattgaggcctccagcaagtagccatgtgtagtgaattccaggagcacgggggctcatgcctgtaatcccagcactttgggaggccaaggtgggcagatcatgaggtcaggagttcgagaccagcctgaccaacatggtgaaaccccgtctctgctaaaaacacaaaaaaattagccaggcatggtggcaggcacctgtagtcccagctactcaggaggctgaggcatgagaatagcttgaacctgggaagtagaggttgcagtgagccgagatagcgccactgcactccagcctgggctacagaacaagaatctgtctcaaaaaaaaaaaaaaaaaaaagaaaagaaagagagaaagaaaaaggaaaaaaagaaagaaaagaaaagctcgatatcactgatcactagagaaatgcaaatcaaaaccacaatgaaataccacctcacaccagtcataatggctattattgaaaagtcaaaaaatggccaggcacggtggctcacacccgtaatcccagcactttgggaggctgagtgggtggatcacgaggtcaagagtttgagattagcctgaccaacatggtgaaacaccgactctactgaaaatacaaaaattagccgggtgtggtggcacacgcctggaatctcagctactcaggaggctgaggcaggagaattgcttaaacctgggaggagaggttgcggtgagccgaaatcacgccattgcactcagcctgggcaacagagggagactctgtctcaaaaaaaaaagaaaagaaaagaaaagaaaaaagtcaaaaaataacacatgctggcgagattgtatggagaatagggaagccttatatgatgttatgatgttggtaggagtgtaaattagttcaaccattgtggaaagcagtgtggcaattcctcaaagagctaaaagcaaaactatcattcgacccagcaatctcattactgggtatataccaagagggagataaagcgttctaccataaagacacatgcatgtgaatgttcattgcagcactactcacaatagcaaagacatggaatcaacctaaatgctcaccagtgacagactggataaagaaaatgtggtacatgtgcaccatggaataccatgcagccataaaaaagaacaagatttttttgccagaatatgaatggagctggaggctatcattcttggcaaaattatgcaggaacagaaaaccaaatactgcatgttctcacctgtaagtgggaactaaatgatgagaacttatgaacacaaggaaacaacagtcactggtgtctattgaggagggaggttgggaaggagaagaacagcagaaaagataactattgagtactgggggttaatacctgggtgatatataataatagtatgtacaacaaacccctgtgacactcgtttatctgtgtaacaaaccttcacgtgtacccccaaacctaaaataaaaattaaaaaaaaagaaaaagatatggctatgaggtggtaataacatacaacaagctttatttgggccgtgttttgacagggttgcctgctgaggaagcttttcacagcatgagaccttccgcaggtaatgactgaggccaccagctagaagagaaggagggtgggggagattctgggggacacggagattggagcggatccttagatgtctagatgatgccctcagtagtagggtgtggagtctcagagtcagagagatccaaagggcagctatggctggtgcttttttttttttttttttttgagacagagtttccctctatggcccaggctggagtgcagtggcgtgatctttgctcactgcaagctccgtctcccaggttcatgccattctcctgcctcagcctcctgagtagctgggactacaggtgcgtgccaccacatccggctaattttttgtatttttagtagagacggggtttcaccgtgttagccaggatggtctcgatctcctaacctcatgatccaccagcctcagcctcccaaagtgctgggattacagttgtgagccaccatgcccggcaactggggccttttatagcaccagagtttattgtatctgtggctagtaaatgtgggattctgttttgtggggtatgcaaaaccggaaggctgtcaatgactaacgatctgtttatttagactatatttaaagcaattgggtgtataaaaaatttgagcttggcactggtaaacttttgaggcaatgataccagtctgctgtgaagcaataaaaaatatagggccaatatagagttaatataactttggcttattatgtaacagcatgtctgtctttgattctttaggctcaatcaaaccttcaatggccccgaaagacatcttgattgaaacctcatgagagactctgagccagaaaacccagcaacttagaacccagatacctgaccatcagccactgtgtgaaataataaatgtttgttgttttaagctgctagtaatatgagtgtcttgagaaacaaagccagtcgggctgcacttaaggctggctttgtgttccctccagcctttgtcttcccccatcatgacaacttgtgctctttctcccaggaggctgaggatgctgctctgaaaccagccaggcaagaacctcagttagcatcagcaacagctgctcctcaatttgctttctgaattatttagcccttctttgcttctatcctaaatccagaccttttaaaatattaatattttaaatatgcctgggccttggcttggaagtctgtatttctctcctgtctctgcccaaggctagacgtcttagagaagagttatctctgccctgaatgattttctctttggctctggctcctggaaattaaatctggctgggttctaaccaaagaaagggaaaccattttcacaatggaatcaaaagagtttcttttctacaaatgcagccttttacttgcccaagctcacagggcttgtgtcacagctggtgatctgagacccagaccctctcaccacctcccagccaccaccacgccagagggagacaaagctcgcactgctgtgagacgttctctgcttcccatgaccgctgcgtcatttacttatctctcagttctcctgccaccccgtgaagtccctgaaacctctggggatgcaggagcccaacacagccgacagaccaggagaggggtcctgagctctgctgtcgtgcagtggctctctgctggccttcatgtccttacctgcaagttgagagggtggcaccatctctcagggctgcagaagttggagtttgtgagtctgaaaccccatttggccgttagaaagccaagtcgcacaggttataatacacctctgactggcccccaggacttgattcctcacccagggttcaatcctacaactgggctgcgcctcactcacctccccagactttatgccaggcatagagggaagtgggacctttattctgagagctaagggagggctccttcctgcttctcagccttctcaggagcccttccctgggcaccttctttgcctggtgaactcagactttccttccttcagtgcagagccaccccctaactcctgcccacccagcctctcagagcagggcaggatggcctatccaatatcccctctccctcacccttgcatcctctcctggtcctttggggcattccccagatgtgtgaatttactattaattctgtctcccctgttagtctgttagttccagacagggcaggaaactataacctctaggaagggctgtatctgtgtttcaacaattcctgattttcatatcctgaagcttcagaacccctggaataattcccaagcaaatcagcagcctctccttccagccaggaggcatcacagctccaacgtagcacaacccagcttgggggcttgggctactggaagggaggccacagggtcaagattaggctggagatgcctcagaaagtatctagaaatgtctggtatgaccaggctgcaatcagaagaggagtgtccaggccactgggtgactgtcctactatgtcccaatggctccatcattcacggagcgctgcagaacttcgaatgtgggacaaacacatgcccctaggactgttgaggttgctcacctcctcaatctagacctgatctgttcagaaggcagggacagggtctgcactaccctgtcttcctcacagcctggcacaggcctggcacccataagcccttgctctgtggctctgcctggcagaagctgacccagtgtcagaagagccttctagcagttggagctgcctgggcaccaaaagggctgcttgagaggatgagtccctgtcactgtcagtgctcaggctgagaccacattagctgggtcaggtgctaagctgggagtgctgtgctgggagggaattgccttctgttagttgttcatttcttagcttgaatcatttcccacagcatttcaatagctaggtaaatcaagtctccctagtggaatcttagatgataggtgaggagggtggttttggggcagcggatccaggctactgtttctgaaatcactgctcatgagcagctccctattcttctagctgaggtcatctcagctgaccatgccctgaggggtcgtagccagagtcctggtgaaagttgtctgctcctccaccccttcttctctgccctcttctgatcaagagcataggctgggggtggcacacagtgggggtgagtaggggagtggaatcctgggtcagaggctctcacttttattataacaagaagttccaagagataccaactcattcccattcgcaccatgcaggggctctaattaaatttttcttttttctaatttccatgtgtcagacaaaattacaacaaatttagttacagattgaattggcttttattagcaattcatgaatcagggaacacctcattctacaaaatagaatgaatgttctgatgagctgagcagaggagattggcttcatagtatgaaaagggctgaggaaagtagaaacaaagaacaaaaagcagattggttgttcctgacttactttccttatgaaggttaaagcaaagggaacttcttcatgatgccagctgaaactgacctgtttggggatctggctattacctctcccgatttcttgcaaggacagataggtaatttagtgttgacttggtggtgtggaacttcaacatgagtaattccattttggtttggtctgttgggcctactgcaggagctcaggccaaaccaatggcctcctataaattttatttaacacgtgaaggtagttcacattccctacccacattgtttacctgtgggcaaacaatgaattaatgctctgttgattattggatctgatggagatcagaactgtaatttgcttgggagcttgggttttctttttttctgttttcttccactttctaaaagaagcagcttcagagtggggagggagacaagaagaaaggaagcccatgtttagtgaacatctgctaagtgcagcaggcttctttgtcagggctctggggaaatccttacaacaatgtgaacaagtcttgttactctcatctttactgagggaggccagttggaagtaatgagagtggagccctgacatgcagggggtgggcagcctggaggagggatgtctggatgcccaaggggagccgggatcctgccaagaggctgcagggccgctctggccacaagagggcaccccacattgccatatctgggctgagggtggtggaatgaagaccacaaagaggccttctagggagtgaccgtcctgtgtacccatacactggtccctctctccaggtttctttctttctttctttctttctttctttctttctttctttctttctttctttctttctttctttctttttctttctctttctttctctctctcttctctcttctctcctctctctgtcctctcttctgtcttctctcctctctctctctctctctctctcctctctcctctcctctctctctctctctctctttctttgagacagtatttcgctcttgttgcccaggctggagggcaatggcgcgatctcggctcactgaaacctccacctcccgggttcaagtgattctcctgccttagcctctcgagtagctgggattacaggcatgcgccaccacgcctggttaattttctgcttttagtagagacggggtttctccatgttggtcaggctggtctcaaactcctgacctcagatgatccaccggcctcggcctcccaaagtgctgggattacagacgtaagccactgcaccccagcctctccaggtttcttgaagaaggtcggcatgagattcctctggcaactagaaacacagctggctttcaggccctgcagaacgcatgtctctgtaactcagggctgtctgtgtcagaggaggaaggatatttgttgtcgattagggcgtgtgcagtctgtgcgtgctgtgttgggagtgactgtatataagcgtgtgggtgtaagtgtgtgagtttctccaggattctagtggagtgtgggagggggtggcggggaagggcctgttcctggttccagagagctggagctgctgctaaaaggagggaacctgaagcaagatccagctcagtgctctttcaggtctggggctgaaacctgtcttgtttccccatcagaggcagtcccaggcccgaaagaggagagatggacctttgccttgctgctggtggtggtgggcaactcctcctaccctggtccagcaggactgcacattgggggcttctcaaagggcctgccaagctccaaggcttccagtgatgcctctttgcctagcaaaggttaggacccacagcagtggccaagccctggagcctgttcagtcttgccaggaggacctggtgtcaccaagatttgcctgggggcacagccgcagtcttgtgacccaagaaataccactggtctcagtttagaccagaactttttttcccctgaaagctttgtgggggcagtggcagggagcccaggcttaggggtgggaggggcagttgccatgagcctagaggcttctccccactctcaccacggtcatcagacagctgcttcacatgaataagctctgcaggctgtaccctggcctggtgtctcagccggggatttggaggcattagggttggtggaaattaaatctagagtgggagcctcaggccagtaggctgacgccctgaacagtgtcccagagcaggaagaggaagtcctgaggcttctcagagccaaattgggagggggaatagcaagccccaggagtctccagattatgaaacatgcgggggacaagagcaggactctgcagtgtgcaggagacccctagctggggacggggaagacaaaaaaagatccactggagccacggtctctcacaaggtcttggttggtttctctgtccctgtccagacttcccctgcaggaccttccccccagcagcctggccttagctctgaactcgctgtccttcccaggagcttccattcctgggcccagccaaacaaccatgagataaacatgagagaaaaacatccttctgggacctgattgtttcagggagtagtggggcctgcagggagccggagattcggggaacaaggcttaatgaccatgtaaccattaagaagaaagcattggccgggcaccgtggctcacgcctgtaatcccagcactttgggaggctgaggcaggcggatcatgaggtcaggagattgattagaccagaaccatgaagaccatccttgctaacacggtgaaaccctgcctctactaaaaaaatacaaaaaattagccaggcgtggtggcaggcgcctgtagtcccagctaggtgggagctgaggcaggagaacggcgtgaacccaggaggcggagcttgcagtgagccaagatctcgccactgcacttcagcctgggtgacacagcgagactctgtctcaaaaaaaaaaaaaaggaagaagaaagcattgctatcaggcctgggttggtcaaaattttggtacagctgcctagtagccatgtgaccttaatgagcaaaaattacttaacttcagtttcatcatccacaaaatggggacaataattacctagcagaagtatgaagatttagaaattaggaaggtaaagcacctgatcaacagtaaacactgttattatattctttattaatacacagacccctccccacccaggatggctccgggcctctcacctttctaaaaagcaggcatcttttctgggctccaagaaaagtagtcctccagcctggccaaaacagtgaaaccctgtctctactaaaaatacaaaaattacccgggcatggtggcacgcacatgtagtcccagccactcaagaggctgaggcaggagaatcgcttgaacccgggaggtggaggttgcagtgagccgagatcgtgacactgtactccagcctgagcgacagagtgagactctgtcaagaaagaggctgggcgccgtggctcaagcctgtaattccagcactctggcaggccgaggcgggcggattgcgaggtgaggagatcgagagcatcctggctaacacggtgaaaccctgtctactaaaaaatacaaaaaattagccaggcgtggtggcgggcgcctgtagtcccagctactcgggaggctgaggcaggagaatggcgtgaacccgggaggcagagcttgcagtgagccgagatcatgacactgtactccagcctgagcgacagagcgagactctgtctcaaaaaaaaaaaaaaaaagaaaagaaaaagaaaagcgggccaggcgtcgtcgctcatgcctgtaatcccagcactttgggaggccaaggcgggcggatcatgaggtcaggagttcaagaccagcctgaccaacatggtgaaaccccatctctactaaaaatacaaaaaaaaaaaaaaaattgcagggcgtggtggcacacgtctgtactcccagctactcaggaggctgaggcaggagaatcgcttgaatccgggaggcagaggttgcagtaagccgagattgtgccactgcactccagcctgagcaacagagcaagactccatatcaaaaaaaaaaaaagaaaaagaaagaaagaaaagcagtcctggccgggcgtggtggctcacacctgtaatcccagcactttaggaggccgaagcaggcggatcatgaggtcaggagatcgagaccatcctggccaacatggtgaaaccccgtctctactaaaatacaaaaaattagccaggcgtggtggtgcacgcctgtagtcccagctacttgggaggctgaggcagtagaatcatttgaacccaggaggcggacgttgcagtgagccgagatcacgccactgtactccagcctggtgacagagcaagactctgtctcaaaaaaaaaaaaaaaaggaaaagaaaagcagtcctataatttgcctgcactagcgtgataatgaaatggtaaaaagttaatgtcacccaggcagtaatggatcaatttctccctgttaacaggagacctctgggaagataccttgattccaaagagtgaatttattggatggcaggcagtgagtcctgtgggtgatgagccaggtgggtctctcctttactcctggatcttacagcagtagaaacacagaacttttcgactttctgagcagaaagaggctgagttggctgcctgtttcagtaggagcccagaggctttgtctaaggccctggtgatgtccctttcctatcatgggtttaagaagtcaggagctggccgggcatggtggctcacgcctgcaatcccagcactttgggaggctgaggtgggtgggtggatcacctgaggtcaggagtttgagaccagcctggccaatatggtgaaaccttgtctctactaaaaatacaaaaattagctgggcgtggtggcgtgtgcttttaatcccagctactcaggagactaaggcaggagaattgcttgaacctggaggtggaggttgcagtgagccgaaatcgcaccactgcactccagcctgggtgacagagcaagactccatctcaaaaaaaaagaagtcaggagtcaagttcctccagcactggcagaggggagaaggcatgaacacgggcttagggtctgtaagattttcccttcttcccagctcaccctcagcctcccatctctgcttcagaacctctcaatcaaccaggtaactcccttaggtgaggctgggagaagcctcattcatggcacacaataggtgcttactattccacataacaggtggattgagttgaatgcaggccataaaggtgttgggagggaagaggctttcagtgaacttagtccaggaacagggagactgtgggtgggcagcgccccagtatcaagtgccaggagccgatgaaggccctgccctattgggtgagcccactgccgaaacctggcagccactcaggttcctccctgcccccacccccacacccgacctgctcagcctcctcctaaactacctggaattggctctgcctatttccagtccttctctagggcattattatttccagcccagaaggctgaattataaatgaaattcttgtctgcagtcctgccctcttacaaactgttgcacaaaccccatcaaagtgatatttctgaaaccaaaatgatgatccttctccctgcttaaataccttctatgggccaggcatggtggctcacgcctataatgccagcactttgggaggccaaggtgggcagatcacttaatgtcaggagttccagaccagcctggccaacattgtgaaactccatctctactaaaaatacaaaaatgtttagtatttttaggtgtggtggcacatgcctgtagtcccagctacgtgggaggctgaggcaggagaatagcttgaacccgggaggcagaggttgcagtgagccgagatggcaccattgcacgccagcctgggtgacagagagagactgtgtctcaacaaacaaacaaacaaaaaaaccttctatggctccctattgcctacacactaaagctcaaattttttcttttgttaaaaaagaccactatgggctgggcgtggtggctcacacctgtaatcccagcactttggtaggttgcagtgagccaagagcccttttttttttttttaagaaggagtctcactctgtcacccaggctggaatgcagtggcatgatcttggctcattgcaacctccacctcctgggttcaagcgattctcctgcctcagcctcccgagtagatggcactacgggcacccgccaccatgctcagccaatttttgtattttcagtagagacgaggtttcaccatgttggccaggctggtctcgaaatcctgaccttgtgatccacccgcctcggcctcccaaagtgctgggattacaagcatgagccaccgagcttggcctaaatcaaattctttaaaatgacacacaatgccccctgagacctctgacccctgtccctgctttcctctccagctgcatctcttacccaccaccctcaccatctctctatgcactggtcagaccaaactgtctactcctggcctggcaaatgccatgctccctccatcattcagggctttgtgtatgtgtatgccccctcaaggtggaatgagcattggtacacataccccttgtttccctctgcttaatttggtcaatttctatttgtccttcaagcatcatactatacttcccttctaccggaaagcctccatccactgacctctccacctttgccatccaagattgggcctgggtgcccacccaccccaggctcccacagctccctatgctctcctggcttttatgaagaagtttttttttttcattcaccaatttactttatgctccctcttgagtctatatatttctacaggataggaacccatcttgtttgccgtgatctctcctagggcctagcacagtgcagccatatagcaggcatgtagcaataatggctataatatcaaccatagcccacatttattcagcaggcactatcatgtggtgggaagcattcaggatgctgtcagtcatagtgtgcttagtactcatgtggctgcatagcacccaggatccattcccaccaatctcctgtcctttggaggcagataggtgaaaaccgcgtttcccagcctgacttctttgaaagcaatgggtacatacggggatccaacatttaggccctcacatgagatttggaaggtggaagaggcagagtccgccttcctgctgctttggctggttctttctggcaagcagggccatacagatgcacgctttttcctgcagcagcatccagtgtccagttaccacctgcggggaatacggggacagttggtggcaacagctgtggaggccccatctgctccctggaccacagccatgccagtgtaacccagaactctgcagtgccaatggaaatctccaggtgccataccttgcttcctgctcaggtagaggtggcagaccctctggactcagccttacttcctctcctctccccatccagacactccaagcaccctgtaatcacccaacctttgtctcaaatcactttctgctcaaagtacctccagtggttcctatgtcctgcactgaactctgctgactcatacaatttttttttttttttttttttttgatacagagtcttactctgtcacccaggctggagtgcagtggcacaatctcggttcactgcagcctccgcctcctgggttcaagtgattctcctgcctcagcctactgagtagctgggactacaggcacacaccaccatgcccggctaatttttgtatttttagtagagacggggtttcaccatgttggccaggatgggctcaatctcctgaccttgtgatccgcccacctcggcctcccaaagtgctgggattacaggcatgagccaccgcgcctggccagactcatacaattattatccttattttacagaggaagaaactaaggcccagaggagttaagtaatcttcccagagcctcacagccagtcagtggtagaaccaggctttgaacccagggctttctgaccccagcacccaccatacttgctgcctctgagaatatgtgttgctgcgtgcccgatgtgggaggaggcacagagagccttctggcagggggctgggctgactcccatgcaagcaggtcctgaggcagggtcccaaggtgtctgccccttcctgagcagcacaaactgctcagcttcctggggaaggttccagaagctaagctgccctagatgggataaggggcagggaggctgcctaggagagccaggctgtctagtcacaatgtcaagcttgtggaagaaatattccttttgtggttcatatccttcttgttgctctaatcactgggagaccatctggtacatcgttgatggctgcaaacgtgcatttaagagcttgagagaatacagcacaacagggaggccaccataatgactgtcaggacaatataccaaaagtttggagtgtttcttagtcaaggtccccatgaaccaaaccaatgaaaataaacaaaagaaaacaaaaagttaatggctagaacaaactattaactcagtctctgagtctacagggcagtaaagaagatttctgtatgttggtctgttccatgataagcaggtctatacaatcctacccacaaataccgagagagctgacaggctggccagttgcagtggctcacacctgtaattccagccctttgagaggccgaggcagaaggatcacttgaacccaggagtttgagaccagcctgggcaacatagcaagacccccatccctatttttaaaaagaaagagagctcagaggctgaaaaaagagggtgacaaatccagtttcttagaaataaacatttaataggaattcacaaacagaagtcatgacttgggcagccacaagatggtggatccctgcactgtcaatattactctccagacccagggcttatacaccatagggaaagggcatatgtgcttcaggaggaatgtgtgggacaattgaagttgattccttagggaaaggcaagcacactatgtgcatcatagcctataaattgcctgagggcaggatttatgttaagtgcatgctaacattacacaaagtagaaatctcaatgacattcccataactggggttaatcagaagtcaaagtggcaaattagcatccaagatggagctgctttaacctccacatgttctcaaagcattttcatttggaaaggggtcaggcactggcagtctgacagattttcctggttcgcagtttgcaccaggtgttccagtgaactttctgagtagttcatacagcaacaggcatgaaggttgttcatatagaagctgttatgataatttctctgaagcctgtatcaagtcttccagctttgacttgcagagctcttaagactagaaatcttttttttttttctgagacagattctcattctcttacccaggctggagtacagtggcacaatctcggctcactgcaacctccacctcctgggttcaagtgattctcctgcctcagccacctgagtagctgggattacaggtgtgcgccatcacacccggctaatttttgtgtttttaggacagacggggtttcgcctcaggtgatccacccaccttggcctcccaaagtgctaggattacaggcatgagccactgcgcccggctgactagaaacctttttaagccaggccagttttgttccaacgggtgctttattggctccgtaatgccagccttagttccttaaagctgcctagttgtatctcaaaatataacattccagttaaagccttggttaatttaaccagtgtttccattatgtttgctacaggaaaacaggttcttactgaacttatgcaaacaattatattgccataaacataaggatactcactaatagtttcataattctggagggatcaggtagggaaaaaaagtaaatgttataatttttgttcacaaaagtatactttaccaaatttctataagctacagatagcttaagaaaaaagaaaaaaaaatcttaaagaaaacaaatttattttattttatttatttatttgaaatgaaaggcctcatatttattactgaacccagtcaaccaacacgttcataacagattcagagaggaaaacatttcgaactgtctagatagtggtgacattttcagcttgatatggtaacgtgattgtgaccttcagacagcatcaatatgtgtgccgtcttatatgcaattccttatagatccagcttggttcttctccaatgtctccttttggagttgtacctgagtttattaccagttttcatctgaatccactggggaatgggacaattttgcttttgtttcttggccaggaatggcttaatcctgaaggtcttgtgagaagacatggcgagaagtggagtcaagcacacaccatgacggcggagaaaggaagagagtattctattttattcacttatttttttttttttttgagacagagtcttgctctgtcacccaggctggagtgcattagcataatctcggctcactgcaacctccacctcccgggttcaagtgattctcctaccacagcctcccaagtagctgggattacaggcgcccaccaccatgctcagctaattgttgtatctttagtagagacggggtttcaccatgttcgtcaggctggtctcagaagtcctgacctcaggtgatacaccccccctctgcctcccaaagtactgggattacaggcacgagttaccgcgcccggcctggaaaacaaatattaaagaaccagaaatgttttaaacaaaaaggcacaaacattatccttgtcagtttattcagtctatgtaattaattcttgtcctgcctagtattgggttagcagtttcatgaacccatcaatttccttagaattgatccatgaatctccttgaagatgaaacattttaggattataattgtttgcaaaagctttcaggaaagtgtcagagtaaaatagttaactgtctgaggataacaagacttaaaatggccatcattaaaaatctgatatgagtttattataatacaattgacatagaaaattcattattggctgggcatggtggctcatgcctgtaatcccagcactttgggaggccaaggtggcagatcacctgacgtcggtaattcaagactagcctgattaacatggagaaaccccgtctctactaaaaatacaaaattagccgggcgtggtggcgggcgcctgtaatctcagctactcaggaggccgaggcaagagaatcacttgaaactgggaggtggaggttgtggtgagccgagatcacaccattgcactccagcctgggcaacaagagtgaaatgctgtctcaaaaaaaaagaaaagaaaagaaaaagaaatttcattatttatgtgacatgcaacattttaacataataatcaaaattatgactgatactattataccaggacatgttagatttttagaaatttcatataatttctggaatactcatatcaattacaaatataaggttttagcagcacttatcatttgacaattctcctcatataatttaacatctaaaataagcctaatcagtttaatatctctctttttatacaaattattttgatacattcaagaaacctgtctggaaaatcccaaagttaaagtgaagaaaaaaacaatttagccaggcacagtggctcatgcctgtaatcccagaactttgggaggcctaggctggctgattgcttgagctcagaagttcaagaccagcctggccaacatggagaaactccattctgtactaaaaatacaaaaattagctgggcatggtgctgtgtgcctgtaatcccagctactcggaaggctgaggcaggagaatcacttgaacccaggagactgaggttacagtgagctgagatcatggcactgcactccaacctgggcaacagagtgagaagccatatcaaaaacaaaagaaaaaaacaatttagaatttgattttgggaagtttgttgaaaatatcaaaggttgaaaacacttgatttaggccaggcacggtggttcacacctgtaatcctagtactttgggaggccaaggtgggcgaactgcctgagctcagcagttcgagaccagactgggcaacatggtgaaaccccatctttactaaaatacaaaaaattagccaagcatgttggtgtgcacctgtagtcccagctgaggtgggagaatcgctagaacctgggaggcagaggttgcaatgagccaagatcatgccactgcactccagcctgggcaacagcgaggttctgtctccaaaaacaaaacaaaacaacacttgatttaacaggatcacagataattatgaagaaatgccaaagtgactaaacatttcaaaggcaagtacagaaaattagttttaaaaaaattagcagttttaatattgagaagactaagttcttaaataatcaaaagacctaacacaggctgggcacggtagctcacgactgtaaccccagcactttgggaggccaaggtgggcagatcacctgaggtccagagttcaagatcagcctgaccaacatggagaaaccccatctctactacaaatagaaaattagtcaggcaaggtggcacatgcctgtaatcccagctactcaggcagctgaggcaggagaattgcttgaacctgggaggcagaggttgcagtgagccgagattgcaccattgcactccatcctgggcaagaagagtgaaactccatctccaattaaaaaaaaaaaaaaaaaaaaaaagacctaatacaagacaacatgaagcacatgaaattttcttgataaaacacagaagcttttttttccccctcacacagatcacttcgaagataatccctttcagtctcttatctactccaaggaaaccctattgttttaaaagaagaggccaaatgtgtctgggtgtggtggtactgtaatcttagcactttggaagaccctggctggcagattgccagagctcaggggttcgagaccagccagccaaacttggcgaaacctcgtctctacaaaaaatacaaaaattaggcaggcattttaatggcctgatgggttcaccttgccggttgcttagatatagctaatttatcaaaacaggggaattgcaatagagaaagggtaattcatgcagaggcagctgtgctagagactggagttttattattattcaaatcagcctcctggagcatttggtgatcagagtttttgaggataatttggtgggtgggggaaggccagtgagttgagagtgttgattggttgagtcacagctgaaatcatgggaagttgaagctatcctcttgtgctaagagtcattttctgggtgggggctgcaagatcagttgagccagtttatctactccgtggtgccagtttatcagtcaagtgcagggtctgcaaaatatctcaagcactgatcttaggagcagtttagggagggtcagaatcttgtagcctccagctgcaagactcctaagccataatttctaatcttgtggctaacttgttagtcctacaagggcggtctagtcccaggcaagaaagaggtttgttttgagaaagggctgttttgttttaaactgtaaactatatgtttcttccaaagttagtttagcctatgcccatgaaggaacaacaacagcttaaagattggaagcaagatgtagtcggttagttagatctctttcaccgtctcagtcgtaatcttgcaaagggcagttttagcatggtggcatgtgcctgtagtctcagctactttgggggctgaggtgggaggatcacatgagcccagaagtccagactgcaatgagccgtgttcacaccactgcactccagcctgggtgacagagtgagacggtctcaaaaaaaagatcaaattctagttttgcatcagtgtaactttgacattaagattcatttttaaaaactcccgagaggtgacagcatgctggcagtccttgctggctcttggcgcctcctcagcctcagcgcccactctggccacgcttgaggagcccttcagcccgctgccgcaccgtgggagcccctctctgagctggccgaggctggagccggctccctctgcttgcggggaggtgtggagggagaggcacgggcaggaaccggggctgcgtgtggcgctcgcgggccagcgcgagttcttcgtgggtgtgggctcggcaggccctgcactcagactggcccgccggccccggcagtgaggggcttagcacccaggcaagcagctgtggaagaggcgccgggtcccccagcactgccagcctgcccgcgccgcctcaaattcttgccgggtctcagccacctccttgtggggcagggctcgggacctgcgccgctgcgctgcggcgccccttcccatcgacagcccaagggctgaggagtgcaggtctgtggtgcaggactggcgggcacctcggcctgcggccctggcggggggatctactaggcaaagccagctggagaacttttatgtccagctggaggattgtatatgcaccaattagcactctgtgtctatctcggggtttgtggatgcaccaatcagcactctgtatctagctaatctggtggggacttggagaaattttgtgtctagctaaaggattgtaaatcctttagacaccagtcagtgctctgtgtctagctcaagatttgtaaatgcaccaatcagcactctgtatctagctaatctggtggggacttggagaacttttatgtctagctaaaggattgtaaatgcaccaatcagcactctatgtctagctcaaggtttgtaaacacactctgcaccctgtgtctagctcaaggtttgtaaacgcaccaatcagtgctctgtgtctagctaatctagtggggacttggagaacttttacgtctagctagaggattgtaaatacaccagtcagcactctgtgtctagctcagggattgtaaactcaccaatcagcaccctgtcaaaacggaccaatcagcaggatgtgggtggggccagataagggaataaaagcaggctgcccaaaccagcagtggcaactcgctcgggtcaccttctgtactgtggaagctttgtacttttgctctttgcaataaatcttgctgctgctcactcttgatctggactgcctttatgagctgtaacactcactgcgaaggtctttaacttcactcctgaagccagcgagaccatgaacccaccggaagaaagaaactccgaacacatctgaacatcagaaggaacaaactccggacacaccatctttaagaactgtaacactcaccgtgagggtccgtggcttcattcttgaagtcagtgagaccaagaacccaccaatttcggacacactcctagaataaattcattcaatttcagctgatttgacacatcagattctcacttttgctctcttgctcttttcaactttctgtctattcagtttttgcctttatcaatttcttcattctaaaacaacctgtgggctaagtgcggtggctcatgcttgtaatcccagcactctgggaggccaaagtgggtgtgttactggtgggtccttgttcttagagctcccaagatggtggcgggctgctcccaagatggcggcaagccttttcttctctgacctggagttcttggcctcccagattccaaggaatggaaccttgggccatgtagtgagtgttacagctctattagaagtcgtgagtcacggaagagaactgtggaacccagcaactagtgttcagctccatcaggacgaacctaggcacttagctgcgcaggaacaatggtgagtctctagccccattgggagcagcaatgggcacctcgctggatcagaagcacagcctgtggtactgcttctcttggcctgtgtcctcaaacctactgtcagtcaggatctgggcaggaaaccacttctacaatttttttttttttgagacagaggagtatcactgtctcacccaagatggagtacagtggtactatgtcggctcattgcagcctccgctcccaagttcaagctaatttttgtatttttagtagagacagggtttcaccacatttgccaggctggtctcaaactcctgacctcaggtgatccacccacctcggcctcccacagtgctgggattacaggcatgagccactgagccaggctgtgctggctattatctgaagttattttatggttgttgacaaatagaaaagtactaaaaatatcacagaagcaaagaaactgaaaaacatgattcttccttgtattttaaaaaaaaattttacttttcatgattgacctgccatcaagccattatttttacagtgcatttcacttataggttgaatttatagtcttatggtcttaaatatctatcagagacaatataaacttgtttgactaggaaatctaggcaaaaacaaacagttcttaaaacagtttcatttttattttatcaaccatttaaaaactagctttacttaccaaagattaccccatatcatatgaattaaaaggcagttgggctatttcctaaatttctgagagttttagggatatttcatttatattagtgctcatttaactcagctcaagtttgaatagaactcctttaggggattttataaattagtttagaaataccatctggagggagaaaaaatatcaaatatacaaatcatacataactaaatatacattaagatggatacgaagatcttatagcttttattttaaaattttagtcacgaatcagtaatacaattggcttatctccacttatatttttattcaaattgtgcttctgacaaaaatcggacaagttaaggctacttgctcacacggctaaagcatattttaaaaataaaatttgtggaaaagacaatattttttggttgccagtttccaaatagtttctcctccttttttaaaaagaaaaaccaagcttctttttttttttttcattctatttcattttattttgtcttttcttttttttttttttttttttttacattttttttttttaatttatttattgataattcttgggtgtttctcacagagggggatttggcagggtcatgggacaatagtggagggaaggtcagcagataaacaagtgaacaaaggtctctggttttcctaggcagaggaccctgcggccttctgcagtgtttgtgtccctgattacttgagattagggattggtgatgactcttaacgagcatgctgccttcaagcatctgtttaacaaagcacatcttgcaccgcccttaatccatttaaccctgagtggacacagcacgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagctgccattgtcatcctggcccgttctcaatgagctgttgggcacacctcccagacggggtggtggccaggcagaggggctcctcacttcccagtaggggcggctgggcagaggcgcccctcacctcccggacggggcggctggccgggcaggggggctgaccccccccacctccctcccggacggggcggctggccgggcggggggctgaccccccaacctccctcctggacggggcggctggccgggcagaggggctcctcacttcccagtaggggcggccgggcagaggcgcccctcacctccctgacggggcggctggccgggcggagggctgacccccccacctccctcccggacggggcggctggccaggcggggggctgacccccccacctccctcccggacggggcggctggccaggcggggggctgacccccccacctccctcccggacggggtggctggccgggctgaggggctcctcacttcccagtaggggcggccgggcagaggcgcccctcacctcccggacggggcggctggccaggcggggggctgacccccccacctccctcccggatggcacggctggccgggcgggggggctgaccccctacctccctcccggatggggcggctggccgggcggggggctgaccccccccacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggccaaaaccaagcttcttaacaaagatcctgaagtgttgagtttactaatttagttaggaactttccaatttagcttttgcttttaaccagattattgagttcagggtggagctcattgacaaataaggcagacaaagcattttctgtgtctgggctcagcatacatagctctgagcttaataatttgactagggcataaaggtggttaaagaagcaaacttgactgacttgagggcttaacttttataaacagtttttctggctttcttttaaaccatcagggtgggatggtcactaagtaaacaggttagcagattcgatttttcttatcagtttgttgcttaaagcttttcatttgcctttttaaaggagacctttagagaagcaattttttgaaacctaaaatctggttagaggcttctgtgtatcgaaaataggcatctcatctgtttgtctaatttgagagcccttactttcaaatgtgcttcttagatggataatcttgtccatctggaatgttctctataatgtcccctgtaattctaaattgtctttgataaaatttcaccactttttggccaggcacagttgttcatgcctataatcccagcactctgggaggctgaggcaggaggattgcttgagcccaggaattcgagaccagcccgagcaatgcagtgggactccatctctacaaaaatgtttttaaattagccaggtgtggtgatgtgcacttgtggtcctagctactcaaaaggctgaggtggaaggaatcacttaagtcttggaagtcaaggctgcagtgagccattatcatgctactgcactccagcttgggtgacagaatgagactctgaaaaaaaaaatcaccatttttgttagaatttacagcttccaagatgaaaatttttgtacataaaaaggcaggcacgggtgtggtggctcaagcctgtaatcccagcactttgggaggctgaggcaggcagatcacctgaggtcgaaagttcaagacaagcctgaccaacatggagaaaccccgtctctactaaaaatacaaaattagctgggcatggtggcgaattcctataatcccagctactcgggaggctgaggcaggagaatcgcttgaacccaggaggcggaggttgccgtgagctgagattgtgccattacactccagcctgagtgacagagcaagactcctctcaaaaaaataaataaataaaaataaaaagtaaaacgcaggcatactggaaggtggagtcctaagttgtttagcatattgggtttctcagatgagatgcctattttctcaatatgagagctgagataaaagcctaagagggaaatgtcaagaggttgggtcgtgtgatgttttcagtgtttctttttgcaaggaaattttcttaaggctcatgggtaacctagcgtcaaactaaaccttatcctttctttttctttctttctttctttctttctttttttttttttgagactgagttttgctcttgttgcccaggacggagtgcaatggcgcgatctcggctcaccacaacgtctgcctcctgggttcaagggattctcctgcctcagcctcccaagtagctgggattacaggcatgcgccaccacacccagctaattttgtatttttagtagggacggggtttctccatgttggtcaggctggtccccaactcctgacctcaggtgattcacccacatcaccctcccgaagtgctgggattacagatgtgagccacaatgcctggccagcttatcctttcagtagttacatatttaggtgataggtgatctaacagcttttgggtgcccttcccatacctgtcaattaagttgtggtttggcaccaagattccttagccaacatagccaatgatctttccctaccttagtgtgcaagaaaaagaaacaaagaggagataacccaaatccctgtgaatttctgaaaaatagtgtctaacaccccctgcagtaactgccatttgctgcaatcactgtcagttatctttaaaagtgtgattctttggtagcgatgcaacaatcaccaaaagtcccaaagatcatttactctgctacaacacaacctttggcacccaaaagccaaaataatcaggagctcaaatacaaagagttggccctggtaggaacttactcatgacattgggagcactgtgaggaagtcaggggactctaaaggagtaaggagcaccttatctgcatccttcagtggcctcagggtcatcagccttcttcaagtcctttcatgttcaccagaactgttagaaaatttcaataaatttagtctaaagatcgagttggtttttattagcaattcataaatcaaacagcatctcatctaaaaataggtaagtgctctgctaggatggcaaaccagtttttgtttttgttttttttttttttttttttgagatggagtcttgctctgtcaccaggctggagtgttagtggtatgatcttggctcactgcaacctccacctcccgggttcaagtgattctcctgcctcagcctcctgagtagctgggactacaggcacgtgccaccatgcccagctaatttttgtatttttagtagagatggggtttcaccatgttggccaggatggtctctcaatctcttgacctcatgatctgcccgcctcggcttcctaaaatgctgggattacaggtgtgagccaccatgcccagcctaacagttggtttttataagatagctagagcaggagtgaggaaacaataataccaaaagcagattgttaacatcaggttacttcaggttactttccttgtaagggttaaaggaggagacttccttaacatgctggttcaggttgactgggcctcttcagactggttgctatgaatcttctgtttttaggaaaaattggtctaatggggaattttcttgcttccttaaagtttcaacttgattgcatgacacttagcataagtgactccattttaatttgttttgttggggcctagtgcaggagctcagtccaaaacaatggcttcccatacattttattttacacctttacaataaatgggtaaatgtaagtaaagcatttcccttaattctgtgagccactctagcaagtgattgaacccaagaaagggtctaatttgtaaaacctctaatttgtagctaagttggacagaagttgtgagtaacatgaaggtctactatttgcagttggagtgtgaacgtgtggaactgagtctttttttttttttttttgagacagggtctcactttgtcacctaggcttgagtggagtggcgcaatcttggctcactgcaacctccacctcctgggttcaagcaactctcctgcctcagcctcccaagtatttgagattacaggcgtgcgccaccatgcccggctaattttttgtatttttagtagagatggggtttcaccatgttgcccaggctggtctggaactcctgagctcagatgatccacccaccttggccttccaaagtgattggattacaggcgtgagccaccacgcctggcctggaactgagtccttaatctgtgtgatctgacactatacctaggtagatagtatcagaattgagtttagttgtaagactctcggtgtctgcagaaaattggagaattgcttgatgtggagaaaaatccctacacatttgatcacaggagtgttctatgttcagtgtgagtatagagaaaaataatttgcttttcctattcagtagcccacaggcccactgggatctcctctgttttctgcccttcatcagacttgggcttgggaaacactctgcctttgttcacttcagtctccgaaatttggcctgtggacttttagggtcctcatcatgctatgttgtaagcactgatttccttttcatgccaccaacagatttaaagcttcttaaaaatacagaccaggctttattcagctttttatcttaacctagcccagggcctggcacacagtctgtgtttaacaatgcttggctgtcagttctaccatggttcctacatagctttctctggatgcttttctccaggagaaatgcagcactatttttctctacctggttgaaatgccacttcctgcagaagcttccccaggccctaaaatcacatggcatactttgtgtgtggttccctctcatctcaagaagttcacagtttcgtagggatttagaagagcaaactaacatgtacaatgcactgcagtgctaggaaaaattgtgaaagacttttaaatgggcaagtaatgactgggtgtctttcaatggaatgatgtgtgttacaattctaccctacaaaagtgctggactgttttataactctgtagaaatgaaggttaatggggaggcctgatgatggtgtagatgttttctgtctagagctggatgcaggatgcaaacaactctgttcatggcaatgcaactaaatacattttgtccagtacagaacaaaccgcccaaggggttcaccttgccctctgcctagacagagcattcatcaagacagaggaattgcaatagagaaagagtaatttacacagagccagctgtgttggagaccagagttttattattactcaaatcagtctccccaagtattcagggagcagaatttttaacgataacttggtgggtgggggaaagccagtgagccaggagtgctgatttgtcagagatgaaatcgtagggagtcggagctgtcttcttgcactgagtcacttcctgggtgggggctacaagatcagttgagccagtttttcaattgggtggtgccagatgatccatcaagtgccgagtctgcaaaatatctcaagcactgatcttaggagcagtttaggaagggtcagaatcttgtagcctccagctgcatgactcctaaaccacaatttctaatcttgtggctaatgttagtcctacaaaggcaatctagtccccaggcaaaaaggaggtctgctttgggaaagagctgtctttgtttaaactataaactaagcttctcccaaagttagttcggcctatacccaggaatgaacaaggacagcttggaggttagaagcaagatggagtctgttaagttagatctctttggctgtctcagtcataatttggcaaaggcagttttataagtaaaattccattttaaacagttataaaatcctactagtttcctccttaattcatgatttaaataaatgtatgttcattctctgtgtgagttatgcttttatcattttgaaaactattctttaatagtggtatctgtgaaagagtaagcaaaattaatacacagtgagcatttattccatgtcaggcactatgctaagggttttatagatttaatcatcatggcgaccctgtaagttaagttctattattagttccattttacagatctggaaaccaaggcctagagattaagtaactttcctaaggacccagagctagtaagtggcctgagatttgagacctgagatttgaaagacttgcattgtaactgcacttcagtcaagagggcaattgaaatgaaattgtgggatcaggtaaggcttccaaatttcggaggataaggtgttggtgcagagggaaaagaagggcggggctttcaggtacaggtcagccctaagaaatgcagttggcctggagagcagggtgtgggctgaggagtggtaagagataaggctgaaggaaacttcaggagtttccttcacagaggaaggaaatcacggagagctctgtgaggccagaagccaaggagtttggactttatcctcaaactacagtattttaagcagaaaaaaaagacatgattagattgagttgtattatttttatctttattgcttttgtttgtagttataaaagaggtataggctttttttaaattgttgttaaaacaaaacaaaacatggagaaatttggcccttctagaaaaattattttggcagcactgttgaggctcgatccgaagtggtgagtgagaaaagagggaagctgttggaaactaagccaatagcaagaaaaacgaagaggaggggatggaaaggagaaacagtaagctagctgaatctacaggatttggcaactgtggcatgtcgggggtaggaaagggtgggaaggaggggctagtgcacagggagagccccatcaaagtacctagctcagaaaacctactgcaggcctggttactcattcttagcatgtaagaactgagatagtacttgaaatttaaagcgaaaagcattgatatcaagtttgtacaacacccattctaaaaagcatatacaaatagagcctgaccaaagtacccaggccttttttttttttcttttttggcctcaaggtggttagaagcgggagacaaaaaagggtgttgagaaaggaaaagaaagataaatcacaaagactataaccatttaaaccttctgttgacaattacgcacatacagattgtcagcacaccaggtgacttttaatcccggtccagttcccctcctggccctcttaatggcttctggccacttcctcttgggatctggccagagtaagctcaggaaatgcaaagttttaattctggaatcagtaaagcatattaggaaaggaaatccacaagtgaaaaaaacatcacattatgcattttgaagccaagggacagaatcagattgtaaatttgtggggacaggaaccattttacacattttggtgcagaactcagggattggtttagccattattccccctcaggttcacccaggatttggtctcttgcattcttgtatgattccaaagcttccatccagcacaaccttcagctctagcagttaagctgtctgcagtcccgctttgtgctccctgacagcaggggaggataacccgccaagatgaaggcccagataaagagtcagtatctttaattatactcacttccctaggattttgcaggatcagatgatagaatatatttgaaaggcctttgtaaaattggatgagctatacaatcactagctgttctttattcattgttgttctggttgatgacctaactgatacttgctacactgcattgcagaatgttcaaggagattcagatttttacaatgactatgcacttaatatattaatgttactatgtgctcaatggtgtgctgtgtactttcacatgtaatcctcaaaataattttatcatgtttatcaaagatcagatagattaacttgctcaaaaacataatttttgattttttatgctctcccaagattggattaggttttgccatgtgttaccacaccacagaagttactacatatcttccccactacactagaagctgtgggtgctaggaactatattttgttcactgcattatgccctctatccagctaatggagccaggcacaaaacatacatgctacaaaaaatagttagggtgaatgaatgaaggctgattttatatccattgctctattctgaaaactactgttttcttaataacttactgttcatcatctatttttccctactagaatgtaagatacttgtgaaaacatatcatttgttttattcactgctggattctcaaagtctggaacaatgcctgggatatactaagtgtccaataaatatctgttggtgaatgaacaaacgatagccacgtggacaagcaaattccacctctttttgtctatcactatattttttctttttcttttctttttttttttttgcgatggagtttcactcttgttgcccaggctggagtggaatggcgtgatctcaccacaacctctgcctcctgggttcaagcgattctcctgcctcagcctccctagtagctgggattataggcatgcgccaccatgcctgactaattttgtatttttagtagagatggggtttctgaatgttggtcaggctggtctcgaactcccgatctcgggtgatccgcccgccttggcctcccaaagtgctgggattacagacaagagccaccatggctggccttgtattttcttttttctgatgctgatctcaataagataacgctcaagaacaacacaacactgtgatgtgggtgagcggctgagagctgaacactctggcttcctgaggtaaatacttgcagctgaatgatgattagaaaggaaccacaggaatgctgtctccaagagcactgcctgcaagaagaaggcacaggtggccagcactggtggcctgtggactctacacttcacagctttggtccagcaccagcaaaatagtgatgcaagactattgtgctcttgagttccatgtcacactcacctctctttcaccagaatgcaactcttggagaagcagaaaaagtaatgtgcttataacaattagcttgattttcttaggaatcaagtgtctcttgctagaactcttctagatcacatgcatagttttttctttctgtaaaccagtagtatatggtatgttgttttcttttagtataaaagtaaccatcgtattaagaaaattctgaatatggaaaaaacatagaaaacagtcacctaattttaccacactaacaaaattatgattggtatatatgtgcattttctttttccctgtgcttgtgtatgtatgtattaggcatatatatctacacatatcatactaggtttttttttttttttgagacagagtttcactcttgttgcccaggctggagtgcaatggcatgatcttggcttaccacaacctccacctcccgggttcaagcgattctcctgccccagccctctgagtagctgggattacaggcatgcaccaccacacccggctaattttgtatttttatagagacagggtttctccatgttggtcaggctggtctggaactcctgacctcaggtgatctgcctgccttggcctcccaaagagctggaattacaggcgtgagccaccacatcaggcctagtttgtgttttttcacttaatattatgccgtttttgtatcaaagggacttcataaccatatccatctaactacttattaaggccaggtgcagtggctcatgtctgcaatcccaacactttgggaggcccaggcaggaggattgcttgaattcaagagttggagaccagcctaagcaacacagtaagatccagtctctataaaagttatagttatgaggtcaggagttcgagatcagcctggccaacatggtgaaatcctttctctactaaaaaaatacaaaattagctgggtgtggtggcatgtgcctgtaatcccaggtactcaggaggctgagaaaggacaattgcttgaacccgggaggcagagagctgagattgcgccactgcactccagcctgggtgacagagcaagacaccatctcacacacacaaaaaagttatagttaatcccagctacttgggaggctgaagtgggtggattgcttgaccctgaaaggttgaggctgcagtgagcagtgactgatagtgccacctcattccagcctgggcaacagagtgagaccctgtctccaaacaaaacaaaacaaaacaaaacaaaacaaaaacaaaaacaaaaaacaaaaaaaaacactgatacccaacgtaagaatttttcaaagaaattgacaatttcaaagacaggcaaaaactttcttagaaaaatttcaaaatctgaaatttttaggaaaaacgagttcctcgtgcttgatacatcttacaatattgccttcccaaaatgttataccaatttactcagccaccaataggtaataatttatcatttaaactgtcatgatgtagtagggaaaatagatatttcatcaacctttccatttgcatttaaatacattgctagggataaaggactttagccaagattatttactagttttatttcttctcttatagaatcattagttattgaggggaaaaaagtttatctgctactagtacggcatcttttccctatggaggggactgtggtattagagtagaaagactaaggactttgatattcaaatccatcttacgtgaaaagccggtatatatgaaccatttggtgaagtgttagtttcatccgttcatttaccaaaaaaagaccaatacattgggaagacaaaaaggagaagctgatcaaaaaggagtatttaattgtttagctaatattcttaagagtcactccaaaaccatccactgcaagtaagagtccacttcaggaattctcatagcctttttacccctaagcatgaactttttaaatagtcaagtgcatacacttattaaccttcttgacaaccctagcggtgggtactaattattattaacaccttttattagaaaaaaaaccctgatgcttagggaggctaagtaatttgtctgatcctcaatttgaacctaggcagcctcccttgttaaccaaccagtaggatgtgattccttttgctatacatctcctctgggcaagtcagagtaaaagcaaaaagtaaatatactgatgctcttcagctgaggagaaagatactcttcgctctacagcttccaactgcttacatttgaatgactttgccacaatgacccagactgaatggaggaaaaaagagtgactgaatctaaaaccctaaagctggaacacatttcaggtaacaatgtatgtaaactgccacccctccccgcccagattcttttaaagtctgaagcatcttggctcaattgctcacatttaggcaagccaggcaaacttgagttgtcatttcccatcatgtactgaaagaatggtcacagttacaaaagtctatcattaacctctttcttcatgtcttctaagcaatgcctgacttgattattaaaacaaaccatgatggcggggcacggtggctcatgcctgtaatcccagcactttgggaggctttactgttaaccttttcctcatctttctaagcaaaagtgtgtgtgaggggatggtggtgaggggcatacctgcactgatgattagacttattatgctgtgaaccatttcctagggagggtaaaacccagacatttagctttttcatacaaacatgcaaccaatatccagtttatcaatctgagatttaatacaataagccatttgttcatacagaaatattaaatggtttttaaccatttttttctttttattttaccatcatcctttccttaatacgatacatagttttgtacaaactatgcattcatgttggctagttaagacagtttatagatttgggtataacatggtaatatgatatgatttatgttaccatgatctgcagttgttcagcctctcagtttcttgaagacttttcctgctttgacttaggagcctatttcagagcgtgacccctgaacagccccgtgccttttcaggcactgcaactacctacgaactgtctatattctctctgtgttatagagaaaaagaaaagataagcaggtgctttatgcgtacatctactttcccaaagcagccactgaaaccatgttaactgaaataaaacttcaaatgcagtcaatcttcaaatggagtaaaggacaacagactagatcagaaagcccagttgcttccagtgttgacctgcatcacagagatgataagctgattgttaataaagagagactcagagtaggcctatgttgagctttagtgtgggctctgttaccaaaattgattctgaataaatcccttaagcctatatattcagcggcaaaatgtcagggttgtacgggtaataaaacatttagttccagctttgagccggttataggcataccttaaagatactataggtgcagttcaagaccatggcaataaagcaagtcacacatctttttttagtttctcattgtatatgagttatgtttacactgtatccggtagtctttttttttttttttttttttttttgagacggagtcttgctctgttgccaggctggagtgcactggcgcgatctcagctcactgaaacctccacctcctgggttcaagcgattctcctgcctcagcctcccgagtagctgggactacaggcgtccactaccacacccggctaatttttatatttttagtagagctgaggtttcaccatgttggtcgggctggtcttgaactcctgatctcaagtgatctgcccacctcagcctcccaaagtgttgggattacaggcctgagccactgtgcccagcatgtggtactaacttttgcttctgaatacagcaacttcagaacccttgtgataagtggtggttaatctgcatcacaaaaccctcactccactaacaagattcaactattgaacagagattaaacggaaagtgctatgtggatatgacttcaacaataaagatgaggaaaaagttatttatacttgctttacttttattttttcagatttcctttacttacattccttattccctcaccaacagtaatcctcatttttatagaaggtaagagagaagaagtacgcagaggttacagacttgggtccaaagaaaattacagagtccaaactgaggccaagcctgccaatactctcagcagcagttttctcctctaacactcttcctctatctgccatgatgcccaggcatacaaagggagtttttcattgtttccttaaggttaactgctctggatgctctcagttcaaataagatggttttaaaattcccctcctccttgccttacagcaaagaagaggaaaggagaaattcaaatgaaaataaatcatatacacaaatatcaaggttcaaaagctggaggatttaattcaatcaatttagcaaggcccaaaatgaaacctggtaatgaaaatgaagacacagcaatattttcctcaagaaaatagacatttgggagaagaaatgttttcttaaaaaatgtttatttggaaaagtcagcctcttacacaaggttttgtatctatacttttactctgtcaattacagtggtattttaaatgcattgaatataattcattgaatgtctgtatctttctgcctcgatttaagtgatattaggttaaaaaaatatttacagttttcattctggtccaccttccctccttatccttatactgaatccatttctctacttttcaggtaagtgaaaggggtcacaaaatttttaggtttgtgtggagggtaaaaatgcatccagcaattctaagcacaacaattttctgtaaggccttctctgaaaaaagagaaggaattacttattaaaactaagcacacttagcaacttctttcccaatcctatctttattcgtttgcctggtgccaaatttttctggccctttttaatttgcaaaccttaaaaaaaaaaaaacaaaaaaacaaaaacaccaaacacacacatatctcacacatagcactaagctagaagcagatataaatgggaccactgtgaatcaaaggggaaaaattccaggaaaaaaaaattccaatagcttcacagtttaactgaggttttggaaaaacttaagtgaattcagctgatgtttgaaatatctgtctacatttaattagatgtgttgtatttaccaaggaggcacaaatatgtagttctgtagattttaatactaacttttccagtaagaaaaataataccaggtgatttcaaaaagggcagtgatctataaacactcaaaatgcatctttgaacaggggagcagaaatagctaatttaatgaaaacaaaccttaagcactttacttggcttctaataagcatcccaagaaaaggtacctgagaggggttgacaagtacactgtgtctagaacagccaagatgttgccaaagttttatgctttgaatttcctaaatatatagctagcagaaacatatgccagaaatctactgatgctaggaaaatatttttgtcagcattttgtaaaatctctaactttcaaccaatatttctgttcataaatcttccagtgaaaatgtctgaaatatattacatgtaacaatgaagcaagattaattttaaattttagatttgcctcaaacaagttagttgttatttttccttttaacacaacactcgaaatagatgaattcagcaaaaatggtttaagaagttaaggctctctagagttctaaagactaaaacttaaggcacatattataatctttatgacactattaaaagctaagattaaaacaaaacaaaacagaacctacttctttcccccatcctttgctaccaatcattccctcctcaaattcaggctattggtaaggagtcaaacaaaaatcccatcaatgaacaactggtatgatttccacacaaatgtctactatttgcattgagcaccactggtagattacaggccagtagaatattttcagatatcctgggtcatgaactgctcaatttacccttcagccccatggattcagactggactttcctcctccttgggccctccatctgtgtctttctggtccggagattctgctgctttggtaacttcatttggcttcccagcaacatctatactggtctcttcctctttactttcctttttctgctcgtttgctttctgttcttttgccaaaagtcgataattgatgcccatgccaatgaagagatagatacctgaaataattaggacgacgccacatgcccagtatgtgtatttgtagtctccatacatgtcattgagccgacctaaatatgtaaaacaacacaaacagttgtttctaagagtaaacagtttttttttcccccaagcaaagcttaaggatccattcagaaagatgtcaatccaatctttaaagagtcccaaaatgatgaattagtataaggaattgctgaaaattagctgatcctctgtttataatgcatcatggattttaagtggcctttgcatattctgttatttttagtaacttgaaaatagttaactcttggcaaactggaaatggaagagacgtagtgatcacctagagtcaattctcttaatacactatagaaataagtgttgctaaaagaggcttgggagtcttgtccaaggccatagtgctgtcccatttacccaggccaatgctctttctctctcagcatttcccaaagagtattcctgtaaacacttgtccagtgctaaaaatttaaaagcaatatcttacacccattctaagtgcttaatctttataacaggcagattctattatcatcctcactggacagatttaaaaactaaattacagagatgttagctaatttgtccatggtcacaaaactaataagtgaaatgacttggctttaaacctagaaagtctgactcggaagtctgcacccttaagcatgtgctacaaggatactgctttaatgtttcaaaagtcaaatgaattgataaatggcatattattttctcataaaggctttgtgaagtctggtagtaaagaaccctatttaatttgatgtttacaaattttattttggtcatgtaactttcattactgtaaaatttattagcatctcattgaactggtatctctgggaaaattctactctatgcttaaacaggacttaatacaaccaatttaaatatgattccatatggctttctaactcagggcatcattcattcaacaatatttattgagcctttatcatataccaggcactggctcagctaagccctgaggataagggtgaacagaggatccacagttcagtggacaagagatgttaatcaagtaactacacaaactgtgacaagtactaccaggagagtttgaaagaagtggggtcaagaaagctttccttaaagtgtcaacttagctgggatttgcaggataggaattatctaggagaaaggagatgggaattagatccaggcagagaactgtagtgcaaaggcgcaatggtaggagagagcatggtgtgtgaggggaaagaagggccaggttgctggggcacagagagcaggaggccagtggtagaaatgaggctggaaggacagctggggccagcccatgcagtgccttgcaagccacattagggaatttgcttttcaccctgaaagtaatgggaagcaactggagagttttaagaaatcttgaagagttctgaactggagacttcaaggagactgaagaacagctagaactgatacaggtagaccagttaggaggttacagttaggagcagcccaaacaggagacaggagctttggataagggtagtagttgtgatggagaaaaatgggcagatgagaacaagatttagagcataaaaactcatagaacttagtaactcactgggtatgagatggaagaagacagtgatctcaaaaggcagctatggatcttctgttatatactcactcactccccaaatcaaagttcctaaagtatgagtcacatccagaagaagggtcaaattattttttcactatgtgttatgtattgagctattaatttgaaagataaagtattcaataaccttcaggaatagttcccaagttgtaattaattttctagctgtatgattttagccaagttatttcaccttttgaagcctctgttcacttacaaaatggggacttaaaacggtcctacctcatatggacttgtgagatacaacaggagatacaaaatgataaggacagtctctggtacactgtgagcttacatggtagctattattatactactgctactgaaataaactttttttttttttttttgctttttgtgtgtttttaaaaaatttatggatcaggcatggtggctcatgcctgtaatcccagcactttgggaggccaaggcgggtggaccacctgaggttaggagttcaagacgagcctggccaacatggtgaaaccgtctctactaaaaatacaaaaattagctgggcatggtggtgggcgcctgtaatcacagctacttgggaggctgaggcaggagaattgcttgaacccaggaggcagaggttgcagtgagccgagatcgcgccattgcactccagcctgggcaacaagaccaagactgtcttaaaaaaaaaaaaaaaaaaaaaaaaaacttatgtgaaatatacttcatttttaaaatgaaataatcactagcgctttaaagattgggttgtttttctacatgcttttctacactaagcacatcagttttgcgatcagaaaaaaacatattttaggccaggcacagtggctcacacctgttacccagcactttgggaggctgagacaagtggatcgtttgaggtcaggagttagagaccagcctggccaacatggcgaaaccctgtctctattaaagatataaaaattggccaggcatggtggcatgcatctgtaatcccagctaccgggaggctgaggcaggggaatcgcttgaacctgggaggcggaggttgcagtgagctgagatggtgccactgcactccagcctgggcaacagagcaagactccatctcaaaaaaaaagaaaaaacactgacatttgtaacaatatttgatcccccttttgccttgatggttccatttaattagattctatatttgagcaattatgctgtgccaagcattgtcccagcatcaagggtacataaatgagaaagatttattcttacccaaatagctcactaatgtttgctttctgtcagcattcccatcttacatgcttgttttgtaatagacccacattagtagggagatatactatacctaaaagtggtggccccaggaggacaggacagcattccacaatggtcaccaatcccacagcgctggagaacctctggggtccaacaaggtccatcaatgtttcaaacaatacggagctgagccacccgaaggcaaatccaaagaatcccgcatagacacagaatccaacataggtagtggataaaggtgctagcatatgacacactccatttgcaacaacggaagccgcaaagaaatactgaattcgaggtcttattggctttgtgttggctacaagtcccatagatggtcgggctaccatgtcaacaaaagccagaatggaaagaaggaaggcagacttctcactagaataatgctgactcttcccataactactaagaaacaccaaaggtgcaaagagtccaaaaaacatgatcacatttccagagaggtatagcaaaaagcctctgtgggtgaatagggttaagtccaggaactgattaattgtttggaagactgatcgtttctcttgtttagggtgtcttccaataagatctgtatttgcatcatgcagatcttttttcacaccagattttccagctttctcaagggatgctttagacttatctttccctgccttggttggcttgggcccgattggtcgcatgagggctccagcaacacagcagtttagtagcaagcccccaagaattagaaagcttcctctccatccaaagataccgaagaaaacctgattgaggggggccagagtacagaggaacacagggctgcctgccatggccagtccgttggccaatggtcgcctcttgtagaaatacttgccaatcatggtcagagctggattcaagttgaaggcaagcccaagacctgtgaagacaataaataaataaataaataaataaataaataaataaataaataaataataagaggtataaataatggaaggaataggatataaatcctcattattagaggacatgttatgtagtggtttaaagtatgacttctaaaacagacatgggttcaaatctcagtatcagtgcttactggttgcataatctcagacatgtataccctcctatgactgcttcctaatatgtaaaacgggcacaggtcactgttgtgaggaagaaaagatttgttaagcacttagtacccagtgcccagtatgtagtaagcacttaatacatgttatttttattattgttgtttttattatttgaaggtgaataactattttgtctaatctaacaaaatcaccggaaggattattataaccatataagatcattaagtcgacagtagagataaaacaaatttacactagaaaatgcataaggccagctgcagtggctcatgtctataatcccagtgctttgggaagccaaggcggcaggattgattaaggccaggcattcaagaccaccttgggcagcatagcaagacctgtctctacaaaaagtaattcgaaaattagtcaggtatggtagtgtgtgcctgcagtcctagctacttgggcggctaaagctggagtatcacttgagcctagaagtttgaggctatggtgagctatgatcacacaactgcactccatcctgggctacagagaaagaacctgtctcaaaaacccaaaaacgaaagaaataacatatagtacaaaatgatcccttccactatagcaccaaaacttaaaaacaggccaattcctaagactccaattgtgaaactttcctgagagatcagagaatttaaaatacacacaaagttttgggaaaataaaacacaacattgctaagatgccaaggctcctgaaatgaatgtactaatttattttatttatttatttatttatttatttatttatttttgagacagagtcttgctctgccgcccaggctggagtgcagtggcgcgatctcggctcactgcaacctccacctcccgggttcacaccattctcctggctcagcctcccgagtagctgggactacaggcgcccgccaccatgcccggctcattttttttttgtatttttagtagagacggggtttcaccgtattagccaggatggtctcgatctcctgacctcgtgatccacctggctcggcctcccaaagtgctgggattacaggcgtaagccaccgcacccagcctgaatgtactaatttaatgcaatccaatgaaaatgtcagtgaattttactttcggattaaggtaaatgattctaaaggatacttacagaacaaatacagagctactaggaaatttttgatggtgcagaggaaaaagtgggaccaaccagaacaaattatttaaatggctttacaaaagctacagtcattagagcagtgtggccctgtttcaggaaccagtaaaaattcgtcagtgaaagtgcagaaacactatagaaagtccaggaacagagttgaaatacatggaaacatttaatgtaagataaagtagcattttaaattaatagagagaaattattcaataaatagtgctagcaaaagtaatattcaaagaacttcctccctgacctcatagcaaaccattcttacatttgttaataagctctacggtctatgatcccttacattttcacaaatctggttccctgttgttatgcaggtctctacttaaagttgattcttcagtgagccctgaccttcattgcttgcccagttcttccctgtcacaacactcagttaaaggctttatatagcatttatcactacctgatatttttcttatttattaatttatttatgagttgtactgtttgtctcctcctattaaagagtgtaactgcctgacttgttgctctatctctacagcacctaaaatggttcctaacacacatacagttgttgctcaataaatatttcataaataaattaataaaagagcaaatgaaccaactgattaaccatgtgggaacaaatagagttatatttcttttttctcatcttatgtcagatgttttcatccatttggaatttttaaatgtagctgggcgtggtcgctcatgcctgtaattccagcatgttgggaggccgaggcaggcggatcacctgaggtcaggagtttgagaccagcctggccaacatggtgaaaccccgtctctattaaaaacacaaaaattggccaggtgcagtggctcacgcctgtaatcccagcactttgggaggcagcggcaggcggaccatgaggtcaggagtttgagaccagcctgcacaacatagtgaaaccccgtctctactaaaaatacaaaaattagctgggtgtggtagcgggcgcctgtaatcccggctacttgggaggctgcggcaggagaatcgcttgaacccaggaggcggagattgcagtgagccgagatcatgccatagcagtctagcctggcagtgagagtgaaactgtgtctcaaaaaaacaaaacaaaacaaaagaacaacaacaaaaccagatttttaaaatataaaaactaaagtgcagtaaacagaagtggacaaatattttcataatcttggagtagaaaacaactttctcaggatgacatacaagatggaaaccataaaatacgttttgaatacataaaaatttatatgtttaataagggaaaaacattggaaaagactgaattttaaaaatactttttaacaaaattcaacatcagaaggccgggcaaggtgattcacgcctgtaatcccagcactttgggaggccgaggcaggcggatcacaaggtcaggagatcgactatactgactaatgcgatgaaaccccgtctctactaaaaaaaaatacaaaaaattagccaggcgtggtggcgggcacctgcagttccaggtactcaggaggctgaggcaggagaatgacgtgaatccaggaggcggagcttgcagtgagctgagatcgcgccactgcactccagcctgggagacagagcgagactccgtctcaaaaaaaaaaaaaaaagaaaagaaaataaggattaaaaccaagagatactgttctcacgtgttaaactggcaattatttttttaaaaaaggcaatatcccattgttgacaaaagggataatcttggaatctctgatatattgtggtgggataataagtgagtataacttttttggaggacaatttagcatacatatattaaaacaaacacacagcagttccctttctacaaatttatacgaagaatatattcatgttcacaaaactttcaacttaatactgacaaaaatctggttataaaatattagacataatttgatccttttttgctcaaaaaaaggtgtatctgtgcatagaaaaacacatggaaggatatacatagaaatgttaatgatattctttggattgtgaggttatgggtaacttttattcattatgctcatcaacagttcattatcttaatttagtgatttttaaaatggggggaggaattatgaagcgtatcctctacccctcagaaatgttatgtggacattctatcaaattgccactctcgcaccaagttgccacacacattgtatctaccactactggctattcttaggacaaggaatgcaatcattctttcaattcattcactcattcgacaaacaataaatatccattatataatggcaatttctttaaaagtttgcttttctagtacttttatctctagttcttcaaaatgataatcaagtcatttctataagaaaagaatttcactccagagatctgaaagatgaatgcaggtaaatacaaaatagccagccataaactaatgcttccaaatgaatcagtagtaactcacctccaatgactccaatacagacgtatagttgctgtacggtgttacagaaagaagctgcaatcaagccacagcctgacaagcagccaccaacaatcatgactatacgacttccatatttattcaccaggatactgctgataggacctaaaagacaaccaaaaatgtagtaatataaaggaaactgctccctcacatctacacaagtatgaatgacaatgaatgacaaatcctccaaaataaacaagcagcaatgataagaatattgttttctataattacttctgagtcacatgtgtactaaaataaagatgttagaaaacataattaattgtgcaggttctaaatctaaaaatactggatggaattttactaaaatacaaaagacctgaagttatccttaatctttctcttttatggcagggcaggctgaaaacaccttggtaatggatgttcacaaggttcttgatgtatctaggatacgattaacatgtatgtagaaagtggctgggcgcagtagctcacgcctgtaatcccagcactttgggaggctggggcaggtggatcacccgaggtcaggagttcaagaccagcctggccaacatggcgaaaccccgtctcgactaaaaatacaaaaattagccaggcgtggttggcgcgtgcctgtaatcccagctactccgaaggctgaggcaggagaatggcttgaacctgggaggtggaggttgcagtgagccaagattgcgccactgcactccagcctgggcaatagagtgagactctgtctcaaaaaacaaacaaacaaaacaaaaacatgttagtagaaagtatgttctgttttaaatttcagacacacgcagtgataggagacgtataaatgcatctagattttagagtacttgtatattatcataaatgtggtttgtggtgttgtgttttttttgagacggagtctcactctgtcacccaagctggagtgcagtggcctgatctcgcttactgtaagctccgcctcccgggttcatgccattctcttgcctcagcctcctgaaagacagggtgggcgtggtggctcatgcctgtaatcccagcactttgggaggtggatggatcacctgaggtcaggagttcaagaccagcctgaccgacatggagaaacctcatcactactaaaaatacaaaattagctgggcgtggtggcgcatgcctgtaatcccagctactcaggaggctgaggcagaagaatcatttgaatccaggaggtggaggttgcggtgagccattgcactccagcctgggcaacaagagtgaaactccgtctcaaaaacaaacaaacagcaatccctaaagccacgcggccgccaactccagggagctgatgcttccaaccactgcacgttgctcccgggctgtcgcagtctcctgttgccgccatcatgtcccggccctccacggtgttgggtgccatggagatggggcgccgtagtcacccgcgccttcctggagcacggccacaccaagatagacacggccttcgtgtacagcgacagccagtccaagaccatcctgggtggcctgaaaattgataccaaggccaatccattgtttgggaactccctgaaacctgacagtctccggttccagctggagacgtcactgaagtggctgcagtgtccccgagtggacctcttctacctgctcaggccagaccacagcaccccggtggaagagacactgagtgcctgccaccagctgcaccaggagggcaagttcctggatcttggcctctccaactatgccacctgggaagtggccaagatctgtaacctctgcaagagcaatggctggaccctgcccactgtgtaccagggcatgtacaacgccaccacccagcaggtgaaaacggagctcttcccctgcctcaggcactctggactgaggttctatgccttcaaccctctggctggggacctgctgactggcaagtacaagtataaggacaaggacaggaaacagcccatgggccgcttctttgggactcaatgggcagagatctacaggaatcgcttctggaagaagcaccacttcgatggcattgccctggtagagaaggccctgcaggccgcgtatggcgccagcgcccccagcatgacctcggctgccctctggtggatgtaccaccactcacagctgcagggtgcccacggggacgcagtcatcctgggcatgtccagcttggagcagttggagcagaacttggcagcggcagaggaagggcccctggagccagatgttgtggaggcctttaatcaagcctggcaattggttgctcacgaatgtcccaactacttccactaggcccatcgtttctcaggttgcccaaggctcttctgtaacctcttttgtttctcacactttctttaatttagaagtgcctcagtaaattcttagggatggaagtatttggacaaaaacctaacagtaaagtcaccaccaaatgaagaatgaaacctcctggggtgctgtgtgttagtctgtttgcattgctataaaagaatacctgagaccgggtcatttataaagaaaacaaacaaacaaaaacaacaacaacaaaaaaaagaaaaaagacaaaaatgcatgatcattttttccaagtttaagtagtgttgcaattaggtaatcttgattaaaaaagaaaaagttcctagttacatccaaattcaggtactaaaccaaatatatctttcaggggccaggtatggtggtggtgcatgcctgtagtcccagctactcgggaggctgaggcgaagaatcacttgaacctgggaggcagaagttgcagtgagatgagatcgtgcctgggcaacagagtgaggttctgtctcaaaaaacaaacaaacaaaaaaaacccacccaaatatatccttcagaattacttggttccatgcctatattattaagtttcatggtagtacaattgtgaaaaaaaatgcttgcaggataagattaaatcagataacagtcaacacaacgtgggtgtaacaactcaagagaataggaaatagtattatccaagaaaaccagacatttcctcagctaactatatgcatataaaaatcagcatttctagtatgtgagaaaaggaaccaaatgaaaagcattataagaaacaagaaaatattttatgcatttcatgtatcagttttttgcgaccagtctccctctgtggctggagtgcagtagcgcaatcacagctcactgcagacccaacctcctaggctcaagtgatactgccaccactgcctccaaaagtgctgggattataggtgtaagccaccatgactgacctatgtatcagtttttgagaagaggaatcaaatgtcaagtggcctttcttttttttttaaatttgagacaaggtgttgttctgtcacccaggctggaatgcagtggtactatcagggttcactgcagcctcgacctcctgggctcattcaatctgcctgcccagcctcccgagtagctgggacttcaggtgcatgccaccgtgccgggctaatttttgtattttttgtagagacagggttttaccatgttgcccaggttggtcttgtaatcccggactcaagtgatccacctacctaggcctcccaaagtgctgggattataggtgtgagccaccgtgcctggccttctcttcttacttgctataaataggtataatctgtaatttgccttttccaaatttcaaaatcttaattacaagaaagtcttatccaaacatagagtctatttctaaaaacacatattgaatgtacatatattcagaatatactaatgatcacatattggcatattctatttccataaatactatgaaaaatacttcagttacttatagtctagttttactattcagagttgcggtacagtatactaacattaaaaggataggctgtagccccagggcaccctgttttaagttttggtttcaccatattcttgtctgtttctcagaggttattattaaactactttataggattgttgaaagaataaaaaattaactaatatatgtgaggtgtttagttggtcctcaataaatactggcagtgatcatgatactggtgcacatgcttatttatgctttcacatgacacagacagaaggtgctctctttccatctccatccatatagatatagatgttatgtatgtatatatacataagataagcatgttaagaaggaattaaagcttttgattattcatgtgtttcataggaccaagtctctctaaggtgctacatcaagaactggccgttgccaggcgcagtggctcacgcctgtaatcccagcactttgggatgctgaggcaggtggattacctgaggtcaggagagttcaagaccaacctggccaacaccatctctactaaaaatacaaaaactagctgggcgtagtggtacacacctgcagtcccagctactcaggaggctgaggcaggagaattgcttgaacccaggaggcagaagtttcagtgagcagagatcatgccactgtagtcataagactttgtacagttagaattacaaagataaataccaggctaggcatggtggctcatgcctgtaatcccagcactttgggaggccaaggtgggcagattgtttgagcctaggagttcaagaccagccttggcaacattgcaacaacccatctctacaaaaaatacaaaaattagccgagtgtggtggtgcaagcctgtagtcctagctacttggcagggtgaagggggaggaccgatcacctgaggccagggaggctgaggctacagttagtggtgattgtgccactgcactccagcctgagtgacagagtgagaaaccctatctcaaaataaataaataaataaataaataataaaaaaacttaaaaaaaaaaggatcagcttgggccatagagtgagaccccatctctacttaacaaaaataaaaaattagctgagcatagtagtagggccacctgctactggggaggctgaggcaggaggatggtttgagcctcggtggctgaggctgcagggagacatgatcatgccactgtactcctggtcaacagtgagaccctgtgtcaaaaaaaaaaaaaaaaaaaatcccacaaaacaaagatcagtatcaccacactgttgactctgaggtagaagttaatactgtagaagttaaagtttttgaaatatttaaaattccaaaccacaagtgttaaggtgacccttgtggaactgataaaatttatactttcatgtttaaaaaaaaaaggaaaaacaaataaacaaaccaaaagtaggcaggtaagatctcttccccgcaaaatatactttaacaaccatcactgtatatctctgacccaaagcactaaaaaagaaaacaaaaccaaccatatctcaagacgtattagtgttcagattgtggtccaaatgaacaagttaaaggattatcacagttgtaaaagtgatgaaaactattaggggatatactatttagaaaccaaaccaaacaaaacaacccatttagtaaaaattctgcaacaaggttcatgataggcattttgtcttttagtgttatttcaggaaggataggcctaattagctatcattaaaaatagaaaggggtacggtttataggcctattataatacaaactcaaaaaaatgtgctagttatctcactaattgagtaaggacaaagaaggaactgtttccccaaaggaaagtgtcatgtgcaactaataaaactgacatcacttacttttgatgcaaaacacaagtggctttctcgctctttggtagcacagaatagcaacatgtaaacttctggtttgtagtcaacttaagaagacactgaacacctggagtacctctgggtaatgtttataccaatttcttcaagccatcatagtcaaaacctgattaaaatcctggcagaatggagttcaaagcctacaaaattattggctctcagaagctaatgcccaaagtccattttgatttctctgaacttattaaaaaaaaacactacaattaagcacttaggttctttaatttgatagacaaaataggcctatgttcaaaatgtaaaaggcacaaaaagataaacagtggaaacataagtcttcctaatcctgttcccagtcacccagtttctctttctccatggcagccagttacctgtttcttctggacgatttaattacaggcttaatgaaattatgatttcaactgcttattcctgtttcacgatcatatattactgtctcaaaaggattataaacttctcaaaggaagggatcagtgttttctgtcactcacaatacctagcccagtgctgaatatattcatagaacttgacagatattggttgactctggcaccaccttagcagcctaaggctaagttatttatagttgaaaccaagaatcattacattggctagaaacagtattttagatgatgttaagtgagcaacttacttccaacatttcctttacaatatgccaaaaaaaacaaaagagaaataaatggtaaaatttaagtttagggtgcagctgaaatgcttttaggactcataacatcgcaagtaatacggaggaggttttttcagttaattctaacatcatataaagattttacctgagaatctgaaccatgccattcaggctagtctgatttattttaatcctcccaacatcaatttttaaaaatctatatttatgtttacatttcaagagtccagcagagatcaacaaaaaaaatacagctgtgaatacatcatttttataacagtcttttaaactcaatgatacatcagttggagcaaatcaaggtccctcacaattttctcatttctgttttgaaatactacagtatactatagcaagagttgctattgttatcaggaatgaaaaatgtgactctaaacaccaaactttaagaaataacatttcaaaacatctcactgaataagacttttttttttttttaaagttacctaatacagacactctggctgcttcatgaaaattaaaagagcaggccttaatgggtacttacctccaccatacatgacagccaacattatggaggatatccatgacacttcgctggtggtggcatggaatataccttcaatctctttgaagaagacagtaattgatttgggaaatgcataagagaagccgatggaaatgaaagctccaattaccactgcccagccccagcctccatctgggggggtgtatccaactggacctccaactgctggtggcattttaagtgtagataaattccaaaatgcaggtcaaatccaaatatctgaaagacataaaattaaaatagtatgtcaatataaggcacacctataaaactcttttgtgaaataagaaatatagccaatcgtggtggatcatgcctattagtaatcccagctacttgggaggttgaggcaggaggatcatttgaggccaggagttcaagacagcccgggcaacacagatcctgtgtctaagaaaatttttaaaaaattagctgggtatggtggagcatgcctatagtcccagctactcaggaggctgaggcaggaggatcacttgtactcaggagtttgagaccaccctgggcaacataagtagaccccaactttacaaaaaaattaaaaaattagccagacatggtggtgtgtgtctgtggtcccagttacttgggaggctgaggtgagaggatcacttgaacctgggaggtagtggctgcagggagctgtgattgcaccactgcactgcagcctgggtgaaagagcaagatcctgtctcagtaaatacataaataaattggtaaacaagagacctgatgagattccaggttggtcattgcatccatgtgcagggaggatagcataccccaattccacgggggaagaggctcctgtacttggggacccttccagactttgccctatgtacttcttcatctggctttcacatgtatcctttaaagtatcctttataataaaccagcaaatattagtaagcgtttccctgagttctgtgagccttcctagcaaattaatcaaacccaaggagaggggtagtggtaacccgatttatagctggtgagtcacaagtacaggtgacaagctactacttatgtatgattggcatgtgaagtaagggccttagtcttgtgcaactgaggccttaacctgcgatctaactccaggtagctgaagtcaaaattgaattgaattacgggacacccagttggtgtctcctacaattgcttggtatatgtgggggaaaaaaacccccacacttctggttacagtagtgttttgtgatgtgctgagtgttgactgtgtaagaggaaaaaaaaaagtgtttttctccttcagaactttacacctagctctcgagtaaatgaattttttttaatgttacttatccaatagacattatcttcttttaaagacattatcagaaaaagctttagagtcatagtattgcccataattttttgtagcttaaaggaaaatagcttctcaccacttaagaaatcataattgaaataaatccctttcaataaatcagttaacatcataattccttaaattacttagataaccaaatgccccatttgacttatctgcttaacctaagataacacataatacataacctacaaacattttaggttttttttttttttttttgagacagagtctcactctgtcgcccgggctggagtgcaatagcaagatcttggctcactacaacctctgcctcccaggcggttctcctgcctcagcctcccgagtagctgggactacaggcacacgccatcacctttgactgatttttgtatttttagtagagacggggtttggccatgttggccaggctggtctcgaactcctgacctcaggtgatccacccaccttggcctcccaaagtgctgggattacaggcatgagccaccactcccagccccaatgctacaggttttaatatagcctttataagttttttaccttttccaaaatatattcttccatactcttttcattctcttatttatggctgacttaacatactaggaagtgggtgcctgactcactagatatgtagcaatttacaaaaaaaaagataattctgaacaccgaaaattttcacttaacaggctggggaattatctcagaaaagtttccttttatcttaatagctttgattcaaggtatttttccgcattatatgacaagaaactcctaaacaacagctagccaatacagttaaaatcataaatatatatatgatgtcaaaagatggtagttttaggccaggcgcagtggctcacacctgtaatcccagcactctgggaggcagaggtaggtagatcacctgagatcaggagttcgagaccaaccttatcaatatggtgaaaccccatttctactaaaaatacaaaaattagccaggcatggtggcatgcgactgtagtcccaactactagggaggctcagataggagaatccttgaacccgggaggcggaggttgcagtgagccgggatcatgccactgcactccagtctgggcgacagagtaatactctgtctcaaaaaaaaaaaaaaaaaaaaaaaagtagttttaaatcaaagataactcctttgtcttgaattcacttagtactaatgaataatgaatagcatggttagaaaatgtaaccttctgttacattttctaataagattttaataaggggcaggtgggagtgagcgtttggtggtaggttacctgttttctcatgaaggtctcctttactttaagccaacttccaccctatattacaacttatcctgtatgttagcaggtccatttcaaagtacttccactcagactatattacagcaatgaacacaggtcagagatgacaagttcactcttgactaccatgttctttagtctataacacaaacgcttcttcataatattagcactcaactccaaaacactgttccttccaacccctatgaacacttcaaatacaatttaggacactggacattgcgggagtatgatgaaaatagctccatacaagaagtttcctgaaaagcaaggatatactcaccacttatacacaacattctactataggttctagccagtgcatgcaggcaagaaaaagaaacaaaaggcataaagaatggaaaagaagaaataaaataggccaggtgcagtggctcacacttataattccaatgctttggaagaccaatgtaggagaatcgtttgaggacaaaaattcaagaacagcctggacaacacagcgagaccctacctctacataaattgtttaaaaattgggtgtggtggtacacatctgtagtcctagctacttgggaagctgaggtgggaggatcacttgagcccaggaatttgaggttacagtgacctatgatcatgctgctgcactccagagcaagaccttgtctcggccaggtgcggtggctcacacctgtaatccccagcactttgggaggctgaggcgggcggatcacaaggtaaggaatccaaaaccagcctggccaacatggtgaaaccccgtctctactaaagatacaaaaaattagccaagcatggtggtatgtgctagctacttgggaggctgaggcaggagaatcgcttgaacccaggaggcagaggttgcagtgagccgagatcgcgccattgcactccagcctgggtgacaaggggagactccgtcgcaaaaaaaaaaaaaaaaaaaggcctgtctctaaaaaataaataataaataaagttgtttttattcagatgacagatatgtataaagaaaaccctaaggaacatcaaataagtgaatttgactaggtcttaggatacaacatcaatacacagaaatcaattgtatttctatatattaacaatgaacaatccaaatatgaaaacatttttaaatgctattgtaaatggtaaactatatagaaataaatctcacaaaagatgtatgagatatgtacactgaaaactataatactgagaagttaaaatagataacctatcctctcggactgaaagactcaatatttaaatcaagcaaagatttctgaaggaacataaagaaacaactataaaaaaagttggccgggcgcagtggctcacgcctgtaatcccagcactttgggaggctgaggcgggaggatcacgaggtcaggagtttgagatcaacctggctgtctctactaaaaatacaaaaattagctgggtgtggtggcgtgtgcctgtagtcccagctactcgggaggctgaggcaagagaatcgctcgcttgaacccgggaggcggaggttgcagtgagctgagatcacgccactgcactccagcatggccgacacagcgagactgcgtctcaaaaaaaaaaaaaaaaaagttttaaaattagacttcaaaatatatgcaaaataatatactcaagaaaagacatacccagaacataaaaagaacttgcacaacgatagcaaaaaggcaaatcacccagcttaaaaaaaaagcaaaagatctaaacaggtgcttcaccaaagatacatgaatgataaacaagcacatgtaaagatgctgaatgtcgttggttatttaaaaatgcaaattaaaatcacaatctaatacatacctactaaaaataagacagataattccatgactttgtggggttataaagccaatggaactctcatattgctgatgttacagtcccttggaacacattttggcagttccttataaagttatagatatatttaacatatgagccagccattacagtgtcaggtatcacccaggatttatataaaaaattctctagcagcttgatgcataatagccaaaaactgaaaacaacccaatgtccatcaacaaatgaatggataaacaatggtacagccatataatagaatactactcagcaataaaaaggaactactgatgcatgcgataacatggatgaattttaaaagcgttctgttaagtaggaaaaaaaagctagacaaaagattgtattctatatggtcacatttatattaaattgtagaaaaggcaaaattctagcacaggtcaagcatttctctaatctgaaaatatgaaacccaaaatctgaaactttctgaacaccagcatgatgctcaaagaaaatactcattggaacatttcgaattttggatttttggattagggatgttcaactgcttaagtaactgcaaatattccaaaatctgaaaaaatctgaaatccagaacacattttatcccaggcattttagataagggatagaaaacagatcagtggctaccaggggttggggagaggagactgactgcaaagcagtatgagataacttttagggtaaatggaaatactttattatcatgatggtgacagttactcatcaaagtatacattcaagttagtaaattttattatgtcaattatacctcaataaagctgatcaaaaccaaaagaaagtccaaggacagtgacaaggggaataaaatttgttctgtggcacagggagacaatacagaagcaaaaggagagggcaggcaaacttctttgtcttagttatctagacggttaaaagaaagaggaagaagacaaagatgaggataaagaaaaggagacaagaggaggacagaagattcttctgagaattcacaactcaggccagtgtgagctcatgcttggcagggaattatctgtagaatatctttgttgttcttccagagatacactatatttgattttgctagcaaagatttcccacaaaggcctgccaaacataagctcacaattgtgaacacatcaagaaccaattaaccgtgagcaaacgcaatgccaatctaacacagttggattagacactcaggaactataggcatagcaatatgaatatttaaatgactaaagacataaaacaaggcatttaaaacattagaaaaaactgtgtatttctctaaaattatgtctttctctaaaaaagatccatagaagaagattaattgatttgaaatagaactagaaatggaaagtaaagttagccaggcatggtggcttgtgcctgtaatcccaacactttgggaggccgaggagagtggatcacctgaggtcaggagttcgagaacagcctggccaacatggtgaaaccccatctctactaaaaatacaaaaattagccaggcatggtggcacatgcctgtaattccagctacttgggaggctgaggcaggagaatcgcttgaacctgggaggttgcagtgagctgagattgcactactgtactacagcctggtgacacggcaagactccgcttcaaaaaaaaaagtaaagtcagtgaaattaataacacattaactggaagactggatgtagctatatacagagtcagtaaaccttaagaataggtttgaagagattagtcagaattcaggggagtgtcattctgaagctatgaaagaaaggctttagaatgggaggatctgacatttatctaatgggactttggaaaaagagaatagagaatggagaagagacaactgtctgggtaaatgactaagggttaatgactaaggatattatagacttgatgaacaatataaatcctcagtttgagaaaacaagataaagagaaaaatcttagaagacaactacttagaaaatacagatgactcagctaacaaatattcatactgacaaaacagtcttcctgacaattttgaaaaattctcacctattatgtcttcaaatattgcttctcccccattctctcttttcacttttctcagactccaactggatatgggttggaccttcccatgctatctactctcttactctcccttctatgttgtcatgttatcattcattcctttgtttctctgaacttcattctggatggtttcttctgtactttagctgtgtttggcactaaagattaaggtgatgtaacttaagattaaggtgatgtaacttacaggaaatagctggccagtcctcattttcaaaccaatcaagtaaaagagatttctgttaaacaaaagcacacttcattttaattcaaataaatgtgttgatacacatctctgtgataactatctcatttttataataataattctaacttagagaaggcagccgggggcagtggctcatgcctgtaatccaaacactttgggaggccgaggcgggtggatcacttgaggtcaggagttcgagacctgcctggtcaaaatggtgaaaccccaactctactaaaaatacaaaaattagctgggcatggcggcaggcacctgtaatcccagctacttgggaggctgaggcaggagaattgcttgactctgggagacagaggttgctcagtctaggtgacacagcatgactctgtctcaaaaaaaaaaaaaaaaaaaaaaaaggagaaggcaggagtttgttgtccagatgaaataatttttcaatattctccaatatttctgacctaatctctttttggatttctatcatgggactctctctaggactatgcattctggaattttcccttcctttgagatttttattgcttaggacagtgaaccaccataagaaatgggatgaataagagatacacctctcttttgtagtgggagtaaaaggcttttggataactcaagttggaaaagaaaaagtagagatcaggcatccattctcaagaggtaatttttagctaaggttatctctcaacctgaggatgtgcagaataattccttcaaaaatataacccagtttaaaaattgaaggtctttgtcctagggcatttcatctacctaggatttgggtgagataaaaatatttacaagttaaggtttcctaaaatttctactggaatgaatatgattaaaagctatttaacaggtcagctctgctaacagcaacagcctgaattctaaaatgatgttaaataaaactgctgcaggcattgattttatgagctttttcttcttctaagtatgaaaaaagagaacacttaaaaaatttcaaagaaccactaaaaagattaattcatctcagaatatttacacacatagaacacccacacacagacagtagggctgtttaacacatcaagctctgactagaacagctaatacgtgctggacgtgattaaactttgagtttagctgccagctatgatttgtcccaattaaggcagttacaatttttagtcactaaagcttgcctcatcaagttaataccttattccacagtgccaaaattagatttaaagcctcaagaaactttagaaaaatttaaaaggaaataagaaagtataagaaataagagcatgcaaaatcattatgaaaaacagaacacttcaaaaaaccacacacagattcaacacaattctgccaccacctgacaaatggctatccctgttaacttaaaaatactgatggtacataactgaaaaaaaaaagtcagttaatattatctaagcatattatttccttttttaactggcaaatctcagctataaacagaagggctcattcaaaaagtaaattatgagagcaggcccccttgcagagtactcagagttcccttgagaaagcagagcacatgcattctttgtatgctaaagcccagaggctaaaagggactaaagtttaagattttaatccttacaatatgcacagtagctttcctatcagcttagctattactgcccaagagtgatggggagactaaaaaacaaagtgatagggtaatgagaaaaattcttcattaattcatcttctaaaggatgatagaaaacaataaccctaacttttcttggcaatgacggtgataagaatcaccttctagattttctgatatttttttctcgtaactctcatgaattgtgctagtaaactaatctggaaagccgaagctgtgctccatacctgccatgtccttgccccactcccaaagagaagagctacaaaagccttgaaaatagtattcatcatgttctgtacactttcctcatcaacatttaaaatgaagccactgtcttttcctaaaatgacaatgaccagtttgtgaacttaaaagaagcagaaagtatctaaaaccaataaccttaaaataatctgttaatgagtgtaaactagttttaggtttcaaacacatggaaacattcaaatccagaaaggctgatttcctgaagctattgctgctaaagtagataacctgttgttctctgtaactagccctaatgcagcttcatggtttacagaaccacctgtcccaagttaactcccaagattcaaagtctaggaaacctcactttcgtttcttttccactttgaaactgaatacattgaggaaaccaaaacaatgaaaaaatcaagcagaaagcgctagtcaaagaaggaatgtaactactggatctggctagccaaacactcagcaattacgaaatgcataattttgatcaaactgcatataaagaatcttaaaaaatataaacctgtctctgcaaacttccaactctctttacctaccctgccattctgggaaaatcctatccacattacaagaagttaaatatattatgcttataagagaaattaacaacttgctaactcgaatgcttaaagaaggattttaggcctatctttcagaattctgtttatgataattgattttagaccttgcttttaattcatatttataatccctaaaaaaatcagtattttagttaataatttacagtttaaaattatttacatagaccactctaccaataaatagaaagcatttcttttttttttttttacctttttttcttttttgagatggagtcttgccctgttgcccaggctggagtacaatggcgcgatctcggctcactgcaacctccgccatccggtttcaaacgattctcctgcctcagcctcctcagtagctgggattgcaggcacacgccaccatgcccagtttttttttttttaacttttagtagagacaggttttaccatgttggccaggctggtctcgaactcctgacctcgtgatccacccgcctcagcctcccaaagtgctgggattacaggcgtgagccaccgtgcccggccaacgtatttctttttaaagacagcagatttccaaagaacaagaattggtaaggatgtggagaaaaggaaacccatgtacactgttggagggaatataaactggtgtagctgttatgcaaaacaatatgaagattcttcaaaaaattaaaaatacaattaccatttgatctagcagtcatacttctgggtatatatccaaaggaactgaaatctggatctcaaagagattacctgcacactcccatgttctctgcagcatttttcacaatagccaagatatggaagcaacctaaatgtccatctacggaggaacagattaagaaaatgtggaaaatacatatagttggtcttgtcgcccaggctggagtgcaatggcatgatctcggctcactgcaacctctgcctcccaggttcaagtgattctcctggttcagtctcctgagtagctgggattacaagcatgtgccaccatgccggcctaatttttgtattattagtaggaaggggtttcaccatgttggccaggctggtcttgaactcctgacctcaggtgatccacccacctcggtctcccaaagtattgggattacaggcgttagccaccgtgccctgcatttgtcagctttttaaaatgagttatgtattatttctttcatcattctaaacaaaaactcagcctcatactccctccactccccgcccctgcccatcccctggcacaaaaagacaacaaatctcaaagtttttgttccaaggcagaaatgtatttggaaaagggagtattttaatagcattttcagataattgaggatattcctctttgatactacaccaaaacctgatgggtgatttttttttttttttttttttttttaaagacagtgtctcgctgtgtcacccaggctggagtagagtggtgcagtgcctcactgtagctcctgggctcaagtgatcctcccaccttagtctcacgagtagctgagattacaggcatgagacaccatgcctggctaatttttgtatgttttgtagagatgaagttttgccgtgtttcacaggctggtcttgaacgcctgggctgggctcaagtgatccgccggcctccgcctcccaaagtgctgggattacaggcatcagtcacggcccggctgatagtttcatgatgattagtttaagtgaaatctaaagacctcaatcgtgagagagtcttgaggtccttgaaggatccaaaaaaaccacactttgagaacggctgtttttttaaatcattaattcaatttgatcacaaacgtgactaaattgatacctaatggtttattcagactgcatatcatcttggtgcattcaactgaatcagaatcaggttagacaatgtttttttcagcactacagtaaattctgatgtataacagggatgtattaattatagaaaaaagctgatatatatgtatactggaaaggatggtcagagatggtgcagaatacactatttttcactgtacatcatttaggctctatttaaataatatatattttatactttgataaaaagtatgcacatacttcttattaaaataattttgatcaaggatgtcaaatttactatttttagtcagttaaaaaagaacatgcaaaaattctattatagaacaaaataataattcactttcctttacgagttctttagacaaaatcatgtcctttgcaacaacatgaagatggtggccattatcctaagcaaactaacacagtaaaccaaatatttttctcacttataagtgtgagctaaactttgggtacacatggacataaagatgggaacaatagacactggggaatacaagatgggggagaagtgaagaggggcaaagggttgaaaaactacctattgggttctatgcttacttcctgggtgatgggttcaattgtactccaaaccttaccatcatgcaatatacctttgtaaaaaacctgcacatgtaccccagaatctaaaataaaagttgaataaataaataaataatgatgtagtataaaaaaagagttctttggcttatcaagtttatcccctatagacctcttcacaccttttttttttttttttttttgagacagagtttcgctcttgctgcccaggctggagtgcgatggtacgatcttggctcaccgcaacctccgcctcctggattcaagcaattctcctgcctcagcctcccaagtagctgggattacaggcatgctgccaccacacctggctaatttttgtatttttagtagagacggggtttctccatgttggtcaggctggtctcaaacccccgacctcaggtcatccgcctgccttggcctcccaaagtgctgggattacaggtgtgagccaccatgcctggcccacatcttcttgtagtcctaaataccatacgtattcttggagagcattctccaaaccagaaatttgtccaaagtttttcctaacaagaaagctcgcaatgcacacttgtcaggagtctacaggaccataaaacatacgaaagctaacatttgtaactgtcctcatctctactgtgatctagaaaagccctgttttgtttcaagtaaatatagcatgtgctaaatttgtgatacgtgatgaaatggagagtgtttgtaagatctcagggccctttcaccacctaaagtaagacagaaggaggttgagaggagggtttctccagcataaacaatatcccttaatttccagcctttctgacacctctctctgtccactgcagttcaagtatgacccccttttttttttgagatggagtttcactcttggttgcccaggctagagtacaatggtgcgatcttggctcactgcaacctccaccttctgggttcaagcaattctcctgcctcagcctcccaagtagctgggattacaggcgcgtgccaccatgcccagctaatttttgtatttttagtacagacagggttttaccatgacggccaggctggtctcaaactcctgacctcaggtgatcagcctacctcagcctcccaaaatgctgggattacaggcgtgagccactgtgccaggccagtatgacacttttctaccttgtgaatgacttttggtgaagaatctttgctaaatattagtccaactgagtcagctgagcaaagcttcaatgctgaaattttttgaaaaggcataaacaaagttcaagtaacatgaaggcatgtggacataaagaaccagccttaagaaatttccagagaatgggatttaactaccaaataacatgtattataaatatttctggcttgttaggtgaaatgggtttaagttttcctagacagctgcctggcaatcaatgtttctgctaaccagcattaagagctacttttgctatatcatgaacaaagccagtcaagctgtttcaatgaaaaataaacaaatggaaaatgttggctttctatttgcaacttcaactaaatttcattaagatacaatatgcctgagtaagaatcaatcttcatttgtatttactgggcatatgttgatatataattccaattaatttgacttgactttaatactctacaataccctatgatgctactattgtgaccccaatcctaatcctcttgtacagtagttgttttagatatgaggaggattaaagtagtatagagaactgatgaagtgaacatatttgtaaatgggcaaactagcatgcaaacttaaaggtaatgaacatagatatacatatatgcacgcacttgtgtgtatatatttacttatttaatcctcttttgtcaatctcagccaacgttatgttaaataatctgaatctagtagcaaacactcttaattctccttgtaagaaaatgacttacatcatttgttcaaccaaataagcatgattttatttagggagaatgaggctattatataagaaaggtgtgggggtataaaatggatcacttacttttgggataagtacccacatcagtacaacttttttcaaaagatagtgacccattcattttaaattgaaaaccggaattttccagtgtctactaaaagcaccacagattagccgggcatggtggcgtgcgcccggagtcccagctactcagaagactctcttgaacctggaaggcggaggctgcagtgagtggaaaggaagaatggggtatactttgttagctaacaaagaaagatttgtagaagggcaatattttaggataatagccaaagaagatcaaatatcaatgtcctaaattatcaaacttcatcgtattgtttttgcaattaaaattgcaaaccggctgggcgcagtggctcacgcctgtaatcccagcactttgggaggtcaaggcgggtggatcacctgaggtcaggagtttgagaccagcctggccaacatggcaaaacctcgtctctactaaaaatacaaaaattagccgggcatggtggtgggcgcctgtaatcccagcttctcaggaggctgaggcaggagaatcacttgaactcaggaggcggaggttgtggtgagccgagatcacaccactgcactctagcctgggtgacagcatgagactccatctcaaaaaaaaaaaaaaaaaaaaagattgcaaactaagatttaaaaaattacacaccatacaactgtatcatcatttttaaaaagtatatcaggatatacaccaaactttttggccattcattcaacaaatctgagtgcctggagtaaaggcagtaaaagagaaaaagagacagacataatccctgccttcatggagcttagattctgggaaagaaagaaagtaaataggtaaacaaattaattaaataaatatgttctaataggcatacttaaaatgccatattgctggaggttgagaaggggagttaatatgctctttccatataactatgttgactgacttgttccaatgaacatgtattacctgatagtaaagaaaatatggccaggtatggtggctcacacctgtaatcccagcactttgggaggcagaggcgggaggatcacctgagtccaggagttcaagaccagccttggccatatggcgaaaccctgtctctacaaaaaatacaaaaaattagacagcagtggtggcacacacttgtggtcccagctacatgggaggctgaggatcacttgagcccaggaggtggaaattgcatgagccaagatcacgccactggaccccagcctgggcaacagagtgaacccgtctcaaaaaacgaaaaacaaagccccacaaagtagtagttttaaaacatgacaagttatacatgtgtgttatagaaaaattaaaagatatgtgtgaatagaaaataaaatttacctgtcattctaccatcctcatttaaagttatttatgttttgatgtaaatcctgacttccttttatgatagtcatgcatatgaataaacataaatatggaatatgtatgtatatgctgcttaatagacattttccattaatatcagaaacttccttttttttgacggagtctcgctctgtcgctgaggttggagtgcagtggtgcagtcttggctcactgcaacccctgcatcccaggttcaagccattctcatacctaagccccacgagtagctgggattacaggtgggcgccaccacatctggctactttttatatttttagtagacatggggtttcaccgtgctggctaggctggtctcaaactcctgacctcaaatgatctgcccgtctcggcctcccaaagtgctgggattacaggcctgagccactgcacccagcctcttttttttttttttttttgtttgagacggagtctctctctgtcacccaggctggagtgcagtggcgtgatctcggctcattgaaacctccacctcccaagttcaagcgaatctcctgccttagcctcctaaatagctcggattacaggtgcctgccaccgtgcctgcctaatttttgtatttttagtaagggtagggtttcgccctgtttgccatggcggtctcaaactcctgacctcaggccacccgcctcagcatcacaaagtgctgggcttataggcataagccactgtgcctggccggaaacattttttgatgtgtctagttccacaatgctgtttttgaagaacagcattctggtctatggatgtattatactttaaaacattacctactgttggccgggcatggtggctcacgcctgtaatcccagcactttgtgaggccgaggcgggtggatcacctgaggtcaggagcttgagaccagcctggccaacgtggtgaaaccccgtctctactaaaaatatgaaaattagctgggcatggtggcgggtgcctgtaatcccagctacttgggaggctgaggcaggagaatcacttgaacccgggagtcggaggttgcagtgagccgagatcgtgccactgcactccagcctgggcgatggagcaagactcggcctcaaaaaaaaaaaagaaaaaaaaaaattacctactgttgtccaggtgcggtggctcacacctgtaatcccagcactttgagaggccgaggcagacagatcacctgaggttgggagttcaggaccagcctgaccaacatggagaaaccccatctctactaaaaatacaaaattagccaggcatggtggcgcacgcctgtaatctcagctactagggaagctgaggcaggagaatcacgtgaacccagaggcggagattgaggtgagccaagatcatgccattggactccagcctgggcaacaagagcacaactctgtctcaaaaacaaaacaaaaaaacctactgttgcacatttaggttgctacattcttttttccttttatagtattttccacactactgtggaaaactagaaatttaggatataattttagacaaagaatttctgcaaattctattttttattcatattgccaacttgctgttaagattctaccaatttcttcttcctaccacagtgtaacaaagggttattttttcactctttcactgcattttgtggcaaaagtatcttcaactaacaaccatggccacagcaatattaaaaaactaagagtaggttgggcacagtggctcacacctgtaatcccagcactttgggaggccaaggcaggcggatccacttgagttaaaaaaaaaaatccctatatctcatccaaatattagcattagatgaacttcaagtaatctaattttcccagtttttgagaagtagagaaaaatatgaaaccagaaaaaaaaacctctcagtgatgtaatgctttctagatctactgctctctacagtgaaagaagcagaaaagtttttgttttgttctgttttgtttgtttgtttttcttgagagggagtctcgctctgtcgcccaggctgtagtgcagtggcactatctcggctcactgcaacctccgcccctcgggctcaagcaattctcctgcctcagcctcccaagtagctgggattacaggcatgcaccaccacgcccagctattttttgtatttttagtagaaaggggtttcgccatgttggtcaggctaattttgaactcctgacctcagatgatccacccaactcagcctcccaaagcgctgggagaaagaacttatcaatcttgttttctgagctattcttggcacaaagaacttatctatcttgttttctgagctattattacaccagcaaattttgccttttttaatgcttcatttttgccttcttctcacagactgaaaaactggctactacctaagttgagagtcctatgtccctttcacatattaatttatttcttggttggccaggagtttccaaatatagacccatttcacattttataaaatgacatgagatgtcatggagaaaagaaagctgggggctatgtccatcaatagtatgttttgcttggcagaattctaaattatattctggaataaataatggtatgtgttctattttctacagcaactcaaaatatattcaacaaatcgatatctaagtgggccatttaaatttattaacacataacctaccctgttccagaatttgaagaaatgtactggctggattaaagttacaaataagtgagttgtcaggattatatcatttatgttactttgaatgtaaatgagtattcgaatatattaataatagatggtatttctattacaatctacttcacttccactatcagatgccaaatagggagaataagtggattataattcattaagaaaaagataaacaacagagaaagcttttccttttcttgcaaagagctaaattgaactattcactcacagaaataattaacattttacttagttttacattaacaaaatctttgaggactagagacaacaaagtaatataacatttcattttaaagttttagtctcattttaaacgtttttaaaccatattttaaatatgtatttacatctctaatctcttctaataactttctaataactgcttgtatataacagtaactgtttaaaaattccttgagtaagtctgaacttcattatgatgctatctttgacttcccccattatctccaataaagatctaagttgttttgttttcttgtttgcttcaccagtaacagacaaatctcacaaaagagtattaaaattgagtactctttggcactgaaacatgattcaccattctctccatggaaatctttagtaaaaggagaaaaatttgctgggtgtggtggctcacgcttgtaatcccagcactttgggaggccaaggtgggcggatcacctgaggtcaggagttcgagaacagcttggccaacatggtgaaaccccatctctactaaaaatacaaaaaattagccaggcgtggtggtatgcgcctataatcccagctacttgggaggctaaggcaagagaatcgcttgaacccaggaggcggaggttgcaagtgagccaacatcacgccactgtattccagtttgggcaatgagagcgaaactccagccgggggcggcgggggagaaaaaaaaaagagaaaagttcatgtgatctgaagagaaaccagggtatactattctcaaatgtttacttgcaaagctttttgggaagatatttgcaggcattaaaaatgtatcaaagtcagcattcttacctcaaaacagcaccattaaatagcctttttaattgctaacgatataaatcttagactatgctgccattaagataattgtcagttattttattagaaatatacaatatatttttttttagatggagtctagcctaaaatatacaatttttttttttttgagacagtcttgctcagttgcccaggctggagtgcaatggtgcgatctgggctcaatgcaacctccgtctcccgggttcaagcagttctcttgcctcagcctccaaagtagctgggattacaggcaaccgccatcatgcccagctgatttttatatttttgtagaggcagggtttcatcatgttggccaggctggtctcgaactcctgacctcaggtgttctgcctgcctgggcctcccaaagtgctgggattatgggcatggcccctgcaccggccaatatacaattttcaaatgagtgttttattttattttattatttttttgagacagagtctcgctctgttgcccaggctggagtgcagtggcgtgatctccgttcactgcaagctccgcctcccgggttcacgcctttctcccgcctcagcctcccgagtagctgggactacaggcgcccaccaccatgcccggttaattttttgtatttttagtagtaaaatatttgcatttttagtagtagagacagggtttcaccgtgttggccaggatggtctcgatctcctgaccttgtgatccgcctgcctcgcactcccaaagtgctgggattacctccacctctcaggttcaagcgattctcctgcctcagcctcccaagtagctgggattacaggcatgcgtcaccatgcccggctaattttgtatttttagtaaagacagggtttctccatgttggtcaagctggtctcgaactctcaacctcaggtgatccactcacctcggcctcccaaagtgctgggattacaggcgtgagccactgtgcccggcctcaaaggaaaattattatgccttaatttgtgacaatcattttattctctgttagcatatacacaaacattttgttccctctcatttgtgaggtcagaatttatgatgattagtaaataaaaccaagtcaataaccaagaaatggcatcatgattctgtagaatcctgtgacatcagcatctgtgtgccgtgttgcttcacaggttctggctaacttcattctaaccttggaacagaagtaaagaagttaggagcaggggtccttagactctggtgccagggattcctttggccatttagtaaaacttatggaacccttgtcagaataatgttttctttttttaatataattttatttttttttcttaaacaaatagagacagggtttcgccatgctgcccagtctgctcttgaactcctgggctcaagtgatccacccacctcagcctcccaagtgctgggattacagacgtgagccacgtgcccagacagaataatgtttttaaatgcataaaataaaatgcaaagatagaactgtcaaaatactttaattgcaattaacaatgtgcttttaaaaaataaaataagatccagcagtgggtctaataatcacactaattttgaggtagtgataagcttaaacaatttcaagatagctataacagctgcattatggtatgaagtacatgatttctactggtgacaaagtcacaggtactgctaatacaactatggtttgttgcctacactcatatttgaatgaaattccaagttttagttataggttaatgaaaagatataatatttttcccccaaacaagttcacagacccctcgaattcaatagaccttaggggatcaatatgcagaccccaggataaaaatttctcatacaggaacagaagagcaggtcaataaagtacaaacataagttttggtttccaaaactcaataagacaaattacaaaggccctgttacctccaaaatagtctaacacaccacagcagtgtatagactttcattcattcaataatcttcaaaaggtttgtgtaggaagagcaaaatcagaaggaagacatatttttcaatcaatgatcaaatatatagcttacgatatcagtagattttgaggaaattctcctatactaaggctaagtcattgtaattaagtcagattcaacaatatcatgagttgtgattagcaacatgatagtgtagataaccaacagagttggatcttactctgcaggacaaatggtcagtgacacccttcaatggctcagcccatgcagctgcctcactggtgtggtggatgtgaacccttcttatcattatgcatactgtgatcccagaagattgttattgctagacaggtgaggtagctcacacctgtaatcccagcactttgggatgccaaggcaggaggatggcttggggccaggagtttgaggccagcctgggtaacatagtgagaccctatcactaaaaaaatgtttaaataaattagctgagcattatggcccatgcctgtagtcctagctactcaagaggctgaggtggctctgcttgagcccaggagttacaggctgcagtgaaccatgatggtttcactgtactccagcctgggcgacagagtgaatttataaatttataaattataatttatagatttataaaattataatttataaatttagaatgtataaattctatacattctatctttaaaaaaaagattgttattgcattttaatctcttctcaggatgacactaggaaccaaacatgccacctaaactagtccttccattcattgtaaaaatctcctataacactcccttcctgcaaagagaaaaatatataaactaggtagcagtattacaaatgaaaagtggggggttggacgagaaataacaaaagggacaagagattggcaccaactgcatgtggtagggcaggggggcctactaggagaaatattaagaagattcagaggttttaagcctggctaccttcaagaatggtagaatcagaagaaaaaaactaggtttggaggatgaaggaaagttgagaacaggcagagataatgagctttaagtgacatattaagttcaaaatgcccaagaagcaactggaaaagcagatcatcaataagagtgttcaacccctgtccttgaggaacttacaatctggaatccttttatagctaaagatttggatttagtagtgattctactaggtattctctaaaagctgtgggaacagcaaagtcctccaagaaagagcatgaaagaccaaaagaaacgccataaatttaaggacaaaaattttaaatattctaaatactaaaagccatttgaaatgttaacatcaagtgctaaaaacacttttacaacttaaaatagtggccttttaagaggatatacctcaatacatttaaatacatttccagaaaacgacagtgtctcaataacatagcatattgtattaaaacataaactttaacttgtccttcctattcaaactgtacctctctttatagaggtattctagttaaattaaaaataaatggtagaattaaaggcataattatttccacttgcaaaccactagtgaaataatgaaaacaggctattagtgtagtacaaagagggataaccaaatatatgcctcctgaaggaagtacacaccaatatctaggaattatacttgtcctctcccccaacactcccactcggaaatcaaacctgaactaaatttgttcagtcttcaatctagctaccaatttacaagaaatacaaaggatagagggacatattaaactaggacatgttaaatctatacctgagggacatattcatcaacatccaggatgagagaaaccggaggaaaaatggcctggttccttcaacaaatattaggttggtgcaaacataattgcggtttttcaattgccattgaaagtaatggcaaaaaccacaatgacatttgcaccaaccttacaaggaaaatacattacgaggaaaataattaagatgagggaacctatagattaaaaagtttaagagacatcccaaacaaatgtaatatgttaccttgtttggaccccaaatcaaaccaaccaattatttaaaaacaactgaggaatatttgaatactgactggatatttggcgatgttaatttttaaaggtagggtaatggcattgtggttatgactttctcgagagttatctttcagatatctatattgaaataaaacaaatgaaatcatttgtagaatttgcttcacagtaatccagtagggtctggggaaagtagataggggaagagagaaatcgtgtcgctcaactctttgtgttttgaaattttccatacttaactgttcaaaagggaaaaaagaaaaacaccattctcaggggttgccaacaaaaactgaaaacaacagtttgaattttgtctccaagccttacaagctgagcagccctggtctagtcacacaactttttagtgtccctattggttaaatggagacaaacaaataccacctaataaactcgtatttgttcaagccagaaacctgggttatatccttaacgtctctgactttcccagtctcccacatctggtctccaccaaatcctccaccaaatcctgtctgtttctctaccaaatcctgtcttgtccatcactgtggtctcacaccactccaacagcctcctttcagcctgttctccatattgcatccaaagtgatgttcctaaaacacaaaatccaatcaggttatccccagccccactgaaaatcctttttttttttttttttttgaaacagagtcttgctctgtcgcctgagctgagctgaagtgcagtggtgtgatctcagttttcattgcagcctccacctcctgggttcaagctgttctcctgtatcagcctcccaagtagctgggattacagaagcatgccaccatgcctggctaattttttgtatttttaatagagacagggtttcaccatgttggccaggctggtcttgaactcctgacctcaagtgatccacccgccttggcctcccaaagtgttgggattacaggcgtgagccaccagcttgaaaatccttcaactgctttcaatcagcttcaagacaagagcgctcctttaaaatttttttaccctcctttatcccttaaaaatccctttaatttttttaccctccttgattccttaaaatggcttacaaggccctccattttctcatactgtctatctcttcaacttctatctcttcccattctctttgacttttttatgctttagctttggtaaaattcagctcttgcattacaccctgtactcttgagtgtagcttcagtgttcatgtctggaatgttctttccacccatcatcactgtcttgcctggctagctctttcatccttcaagtctcaggttaaacagtatttcctcagagaggtctagccaaattgcttctatactaagttgggtgtcttctcacacctacacaatacagtatttgttcctacaggaacctgtacccaccctattataacagtacctacttgtttgtaaagagtatttgctgtggcaattatatatttatctgttttccagctagactataactctaggagggcaagtggtaaaatttgttcactgctgaatcctaagtctctcatggtgcctggtagccaataacaaattgccgaacatataaaattcacaacaatctggactgttttcctcatacccaagttccatcttcctagtcctcaactgcaacaaaaacaagacagctatgtaggcatttacgcagagatcttaatcttgcataggagtgagcattataaagtgaattgaaaacacgatgggaatgcagaacataaggagctgagaaatctattttcaggctgagataatttgtatccaaatttacaatctaaagaaaaatcaggagtgccaatctaacaaaaatgagtccaaagacacacatagttcccaccaaaccataacaagttttcagacctaagatgttagatcacttaatccctccagccccagtttccttatgtgtaaaacaagggatcctgatcagctggtcattaggatcctttccagggctaatatatgccctaatatttaaaggctaaaacatgtaaactagtgaaatactaatcatttgctttcatcctatagtgatatgacttttttcctttttaatctgtttaaggacattacagtctatcccgttaagcttacaactaaaccttcaaatctattcagctataaaaatcttacaaaatgctcctcagatcattaacttgcatatttaacaatggtaactgcaatctgatgaaacaacagcatctacctaagaccaaaatgaattactgaaatatattcaacttctgtgtaaataataaatcttaccacgtgttttaagtgctaaatatcttgaattgttggtcatttctatggcaatctgaaggcaaagtcgtgccccagggtgtaagacttgaatttatgggtactatttaacacctaactaaaaaactgaagatacatagtctttgcatcacctcactgggctggtggttgggataaaaaaattgttgaaaccagagtaatttttgaaaaaaaaattcaaaacaagttatagtaagttacagtaaataaagtagcttagtaagttacagtaaataaagtagcgtgtaaacattttactgttatcagtagcagcccagtttctaatcagccactggaaacccaaagaaagactaaagtagtaacaagtttgtctcctggtttagattaattacaaactagttttggcaactgcttgttccatcaaatatgtcatgacaaagtaataaaatgttaaaacgcatgctggaaaaaaaaaaagacgtacttggaacaaaaaacttgcatcggaccaagtgtaacgctatcctccagatttctctcaacagggccgccttaagtccatgagtagaagggcgctgcggcggacgctggcagccacaggttgaatgacaaagagcccccgtcagcaccactcccaggagtctgcgggctgccccgtcccctccgcaaagtctactcgaaccctgcagtcacgccttggctgtggggaatgcggctctccgcaccactctcgcaagtcaccaggtggggcaaggatcggcgggccaagaaggttggggcggacaatgtcacgaatcataaataacttctgccccgagtcccttcccttggggcagaagcggccaggagagtctggaggtaccacatgcagcagcctcatgttatcccttttccagatcaaagcatctctcgaggagcctattgaagacttaggggggaagggacttccccaccgtcaccgggcaccacgacccaactcctcggccaggcctgggaccggcatcttagcacggggcccgcggctcggctaagagaggcgctgaccccagcgcctcaaggtctccttcaccagcactgcagtccgaggccacgcggctgcctgtgaccacgatgccctctgctgggccgcctccctccgccggagacaaagtctcccaaccccggaggtcccctccgaccccaccagggcagcgagggcaccgtggggtccgcgccgcgtgccgccggctgttacccaactaaccgttatatgcgcggatcgcagcgccgagcgtgtgcgtgacgtggtggcgcaggctggagttccacggggcccagggtccggctcccgtccttcgctcgctgcctcgtttgcttgttccagtacccacgcagctagccagtcacgtcgcagctcaccactttgtctggccgggccagcgaggctgccttataacccgccggggccggagcatgcgcgcagggggcggagtcgtctctcccggccgccgccccctccccgccacacagacatccgaactgcagcccgcgcctccacacgctttcagccgcgcgcgccctctagctcgcccgcgcgcgccggcgccccctccccgccacgtgaccggcgtcccagtccgacccgcgcgctgcgcccctgctgagcggcgcggagctaccacgccctgccagactcgcccttgggtccctgtctgacgagctctaggcaatctgccctcgttcgggacacaaccatcggtctcacccctcagtttctgccagagaaaaaggaaaagtcaccgagaggcctgaccctgacgggtgggggagatgcgcgtgcggagtagcgggaagcgactgaggagcggggaatgggcagcatttgaatggatgcgggtgccgctggcacccgggaagacgctgggggccggcgctgtagagccgggcatgggctgggatgtgtttggattccaatccgggcctgacaccagttcagtgacctcgggaagttccccaaccctccgggcctgtttcctccctctgaagtggcgacagtagtagaaccgacctcgtaggctcatcgggaggtcctgatgggagaacccatgcaacttgccaccatagagccaggcccgcggcggttggcgcctggtgggtattaaagacgagtcgggaaagaagagcaggtaagagggtggggagactggcccagtgggttggggtgtgcacctcggccacgtggaaaagcgagaatgcagaggccggacgcttatggacgatgcatatgtggggccggatagaattgtggcaggcggcgctggggctgatgctcctcacccggattatcctctctaatcctcagccctgtgaagtgggcactgccctgaacattttgtaaataagggacccgaggctcagagaggtgaagtaactttccagacagcccagctcgtcagcggccagcatttgaagtcacactccagagcctgtttttaacataatagccgctgtgaccgcataaccaacgtgtgtgttgaagtgatcaaataaccatggagtgtctttgatgtccaggacttttgagaaataccgaaaaatatgaggcaaggcccctgccttcaaagagcttgcaagtttttgggggagacttaggcacaaattaaccaacatctgttgagcacttgctgcttgccaggaccctgcccttcccctcgtgtcttcctcccttccaggactcaccccctcacttaccctccccctcacttaccctccccctcaattctcacagcaaccctgggaggtaggccttatggtttctgttttgcaaatgaagaacctgagattgaagaagagtagagattggaggatcagatcctgagaggtcccatgtgctttccaataacagttcagtatattagaagacagtgtggcatccacggccaagtactactagtgagtaatacagtaattgctttttacatttgataaacacggagaaagggaaggcatttcgggtcattggggcagctaggacttataagagcagtgctagggtggcagcagcattcaggtagatggtaaggagaattaagttagagagacaggatcctcagtctggttcagaagtaaatatataagggcctgttctatggaatgtagtgagaagtggttaaataagatgaatcccaggaaacctcaaaagaaggcttatagagccccatagggtggtagattcacactatagacctgagagccagatctgttcagttccaaatttgattcttgcacttaccagctctgtgtcctcaggcaagtcattttacctttccaagcctcactcccaactctgtaaaacaaggataatacctacctcagggttattatgataataaaactagtatttatttcaggccggcgtggtggctcaaccctgtaatcccagcactttgggaggccgaggtgggtggatcacttgaggccaggattttgagactagcctggccaacatggtgaaaccctgccgatactaaaaatacaaaaattagccatgcgtaatgcatagtaccagctactcaggaagttgagacaggagaattgtttgaacccgtgaggcagagattgcagtgagccaagatctcatcattgcactccagcctgggcaatagagtgagattccatctcaaaaaaaaaaaaaaaaaaaggtccgggtgcagtggctcatgcctgtaatcccagcactttgggatgccgaggcggatggagcacgaggtcaggagttcaagaccagcctggctaatgtggtgaaaccctgtctctactaaaaatacaaaaagtagccaggtgtggtagcatgtgcctgtagtcccagctacttgggaggctgaggtagaagaatcacttgaacctgggaggtggaggttgcagtgagccgagatggtgccactgcactccagcctgtccagcctaggcaacagagtgagactccgtctcaaaaaaaaaaaaaaattagtatttattttgcagtgtctagcatatagaaaacattacatgagacctaaccctaaagattaaccctagatgcccttcccttgaatagaccctaaggaggctctgagaggggccctaacagtatgttcaacaggatcatactttctgttgtattgcagttttgtactcctatccttgaagatagacagtcatcaaaattatagacacctcaggccctacaaaacctggatctgctttaatagattttagtgttgtgaagactttggaatcagaagacctggccccggccgggcacggtggttcacgcctgtaatctcagcactctgggaggctgaggtgggtggatcacctgaggtcaggagttcaagatcagcctggccaacatggccaaaccctgtctctactaaaaaatgcaaaaaaaaaaaaaaaaaaaaaaataggcctaggccgggcacggtggctcacgcctgtaatcccagaactttggtaggctaaggcaggtggaacacctgaggtcaggagtttgagaccagcctgagcaacatggagaaaccctgtctctactgaaaatacaaaattagccgggcgtggtggcgcatgcctgtaatcctgggaggtggaggttgtggtgagctgaaatcacgccattgcactccagcctggtcaacaagagcaaaactccatctaaataagtaaataaataaataaataaataggccaggggcagtggctcatgcctgtaatcccagcactttgggaggctgtggcgggcggatcacggggtcaggagttcgagaccagcctgaccaacatggtgaaaccccgtctctactaaaaatacaaaaattagcctggcgtggtggcatgcacctgtaatcccagctactcaggaggctgaggttggagaatcgcttgaacccaggaggcagaggttgcagtaagccgagatggtggcactgcactccagcctgggtgacagagcgcaaaaagaaaaaaaaaaaaaaaaagatctggtcccataactgctatctgtgttattctgggcaattaattcactgaacttccctgggctttagtttcctcgccagataaattaaaaataatacctactagcctgaactgttgtgttaatcaaatgagatagtatctgcagaagtaattggtaaaacttggaaagtgttctgtattcatgaattaatgtcataatttgtctaaagtagataaaagggaaaaattaaaagcaactaccaggctcttacctggaaaaatagaaacacggtgggtgggtgagctggtgaaaataataaaataatacaggtaaaatccttgctcttctgccaggtttttttcctgatttgaggcacacgacattgaagaaatgaactagggagcataggatgagaaatcagagtggagaggaaattggagatcatctaaggcactcctgactttttacagaaatggaaattaaggcccagggatgctaaaagacttgtctgaggcctcccatctaatgattggcatgatcagaaactccagtttctttaagtataaagaacaagtacaacctttaagataaaatattttgtcatgggggtctttcagaatcattacatcagaaccagagaaggcctggtactctctactggcttttagctttatcacaaaattcttaggattcacctttctgttttaaaggttgatagactggatgctgctatggtaatctgcctcaggaaaatgccggactgttgtttgcaagctggttaagtgagcaaatcttgggaagatttcaaggtaagagttgtaacttcggaagttagtgatgcaataagaaatgcaaatgcaaacttcaaaaattatgatataggtactctttaagctgagtaagttgctctattgcgttatctgaaaaaagaaagatgaaattacagtgtgttctctggaattcacctacttaacttacattctttcagttacttcaccatttctgtgatgtagtagataggaaggtgctattttgcccattttagtaacaataaacaatacaggaaaggattcttcttttaattgacacattgtaattgtacatattctaggttacagttttggtgtttccatacatacaaatgttgtatactgatcaaatcagggtacttagcatatctctcacctcatgctattttgtaatatacaataccttattgttaacagcaaccctactgtgcaataaaacaccagaacttattcttccaatctaattgtcactttgtacctgttgaccaacctctccctatcctcctttcctctctcccctttctagtctcagataaccactgttctctctgcttctaagatataaactctttctttaaaaaaaattagattccacagatcatacagtatttatctttctgtgtctggcttatttcacttaacataatgtcctccaggtttaaccgtattttcacaaatggcaagatttcatgcttttttacagctgtataatattctgtaatccatatgtaccacattttctctttttttcctttttctttttcttttttttttttttttgagactgagtctcgctgtgttccccaggctggagtgcggtggtgcaatctcagcttactgcaacctccgcctcccaaattcaagcaattcttctgcctcagcctcccaagtagctgggattacaggcgcctgccaccacgcctggctaatttttgtatttttagtagagacggggtttcaccatattactcaggctggtctggaactcctgacctcaagtgacccacccacctcggtctcccaaagtgctgggattacaggcatgagccaccgtgcccggcctcacattttctttattcattcattcactgttagatgtttgggttgattccatatcttggttattgtaaatagtgctgcagtaaacataggagggcagataccacttcaatgtaactgatttcatttcctttgaatatatagccactagtgggactcctggctcacacagtagttctatttttaattttttgaggaaaaaattttcaacaaaggtgccaagaacacacactggggaaaagatagtctcttaaataaacgttgctgggaaaattggaaagtcacatgcagaagaataagactagaccctgtctccaccatatacacaaatcaactcaaaatggattaaagactgtcttctatagctgctgtactaatttgtaattccaccaaaaatgtgcaagtgttgtcttttctccacatccttgccaacagttgttttttttgttttgttttgttttttaagacagagacagagtctcactgtgtcactcaggctggagtgcagtggtgcaatctcggctcattgcaacctctgcttcgtgggttcaagcaattctcctgcctcagcctccgagtagctgggactataggcatgtgccaccatacctggctaatttttgtatttttagtagagtcggggtttcactatgttggccaggctggccttgaattcctgacctcaagttatccacctgcctcagcctcccaaagtgctgggattacaggcatgagccaccacgcagcctgtctgtttgttaatagccattctaactagagtgagatgatatctcattgtgattttgatttgcatttgcctgatgattagggatgttgaggattttttcatgtaactgttggccaggctggccttgaattcctgacctcaagtgatccacctgcctcagcctcccaaagtgctgggattacaggcatgagccaccacgcagcctgtctgtttgttaatagccattctaactagagtgagatgatatctcattgtgattttgatttgcatttgcctgatgattagggatgttgagcattttttcatgtacctgttggccatttgtatgtcttcttttgagaaatgcctattaaggtcttttgcccacttttaaattaagataatttgtttttcattgttgaattaagttattatatattcttcagatattaactccttgtgagatgtatagtttgcttatattttcttccattctgtagattttctcttcattttgttgtttcctttttaagtacaaaagcttttcagtttgatgtaatcccattggtctattttttgcttttgttgtctgtgctttgagatctctttttaaaaacccttgcccaacccggtgttgcaaagcatttcccttatgttttcttttagtaatttcatagtttcaagttttatatataagtctttaatccattttgagttgatttgtgtatatagtggagacagggtctagtcttagtcttctgcatgtgactttccaattttcccagcaccatttattgaagaaactgtctttttcccagtgcatgttcttggcacctttgttgaaaaacagttggccatagatgcatgaatttatttctgggttctttattctctttcattggtctctgtgtttgtgtttatgccaataccatgctgttttggttactatagccttgtagtacattttgcaatcaagtactgtgatgcctcagctttgttatttttgctcaggattgatttgcctatttgagtcttttgtggctccatgtgaatttaatgattgtctttttttttttttttttttttttgagacggagttttgctcttgttgccctggctggagtgcaatggcacaatctcggctcaccgcagcctctgcctcccaggttcaagtgattctcctgcctcaccctccctagtagctgggattacaggcatgcgccatcatgcctggctaattttgtatttttagtagagacagggtttctccatgttggtcaggctggtctcgaactcccgatctcaggtgatccgccctcctctgcctcccaaagtgctggaattacagagtgagccaccgcgcctggctgtcttttttatttctgtgaaatatattataggtatttgatagagattatatttagtttgtagatcactttgggtagtatgagtgttttaacaatactaattctcccatgaacatgaaacgtctttccattcatttgtgtcttcttcaatttctttcatcaaggttttatagtttttcagtttagagatctttaacctccttggttaagtttattcttttttttttttttttttttttgcagcacaccaacatggcacatgtatacatatgtaacaaacctgcacattgtgcacatgtaccctaaaacttaaagtgtaacaataataaaatttttttaaaaaagtttattcttaagtatcttatttttgtgtagttattgtaaatggaattatcttcctgatttcttttaggaaaggattctttttaaacaatattttgtcattaagaacactgcccccccctcataatatataataatttaatagggaatatggaaaatgtgatttgcttttgaaccatgtttgaaaaaaggtttgctaaacaaatacctggagtaaagaagataatgccaatcctaaagacattctttctttaaagttgagagccctctcattcagaatatcatcatctaatttcaggttatatgtcaggtgtagtcctactgctttcaaaggcctatgtctggatctaggatgaattttgccattctttaaagaaagactaactcggtattcgtgagatgcactctaagctcctccctgacctcccccgtttctcttcagctctctttgctctgttttgacctatcacttatcttaccagcttgcaccagtttagtatcctaatcagttacttctctggcactctactgacatggcatggcgcagtcaaaatagtttgctagaaaacaaaatgtttgcaataaaaatgtcttcaacatgacaaataagtcaaaaattattgtttccaactgctggttttttgtatgtttagttattctggtggccagggatttgctttattgcttctttgggcctttgagaatttttttgtgcacacacagacacacacacacacacacatatatatatgtttcttaaggaatcatattgtacatactgtttctttccactaacacggaatctcactctgtctgccaggctggagtgcagtggcgagatctcagctcactgcaacctcggcctcccgggttcaagcgattctcctgcctcagcctcccaagtagctaggcttacaggggcgtgccaccatgcccgactgatttttgtatttttagtagagacagggtttcaccatgttggccaggctagtcttgaacccctgacctcagatccacccgcctcggcctcccaaattgctgggattacaggcgtgagccaccacgcctggccgctgtttactactttttaaatatttgcaggctgggcgtggcagctcacgcctgtaatcccagcactttggaaggctgaggcaggtggatcacgaggtcgggagtttcagaccagcctggccaaagtggtgaaaccccgtctctactaaaaatacaaaaattggtggcgggtgcctgtaatcccagctactcgggaggctgaggcagagaattgcttgaacccgggaggcagaggttgtagtgagctgagatggcgccactgcattccagcctgggcgacagcgagcctttgtctcaaaaaatatatatatatatatatttgcaatggcttgataatatgaaacatttacgttgcttcttaataattatctaagaattaatttagattaaaaagcacaaaagtttgaaacatacctaaaatattatgataatctgacagtactgctttaaaactttaaaggtggcaaaacaatccatatggaaaacaagcagctgagaatattcctttttgacccatttatcttcaaattcaatttgttttcctttttttttttttttttgagatggagtcttgctctgtcgcccaggctggagtgcagtggcgcgattttggcgcactgcaagctcggcctcccaggttcacgccactctcctgcctcagcctcctgagtagctgggactacaggcacccaccaccacgtagagatggagtttcaccatgttagctaggatggtctcgatctcctgacctcgtgatccttccaccttggcctcccaaagtgctgggattacaggcgtgagccactgcacccggccaaattaaatttgtttttaaccagattacctgaggctcaatctatgtcatcctaattcccactctggtctgatatggcttgactcctgttccttgtttttgctagcccagggggatagttttgacctgtgctctttgtaatgtacatcatcgctatttaggatcttttctaggaagcattctttctagagatggtcctatgtatttgccagacctgttttcttccttgacccctagctactaaaagtcctaaccctgagtagcttccccacctccctcttttcctccctcccttccctcctttcttccttccatctctagtaaagtattttaggcaaatgggatggggagttcaataataacaataataaattgatgatagccaagatttctgggatacttaccatatgccaagcattgctctaagcactttagatgtagtaacactcattaattcctcacaaaaatgctataaactaggaactgttacaatccccattttacagacatatacagatacagagaggttaagtagcttccccaaggtcacataatcagtattgtctcgagtcatcagaaagtagtcatcatggccgggcaagttgtctcacgcctgtaatcccagcactttgggaggccaaggcagatggatcacgaggtcaggagtttgagaccagcctggccaacatagtgaaaccctgtctctactaaaaatacaaaaattagccagatgtggtggcaggcacctgtagtcccagatacttgggaggctgaggcaggagaatggcttgaacctgggagggaaggtttacagtgagctgagaccgcaccatcacactccagccttggcaacagagcaagactctgcctgaaaaaaaaaaaaaaaagaaagtagtcatcatttagttttcaccaaaaatacacaagtagaaattgtcatttttagctattaataccataggagactaatccatagaatttaaggccatcttgacttagaaaaaccctgttttgggttccttttatgttagtagagcaaaacaaccattatgaaagcatgtgccatgaaaggtgcctttgaaaccagagattcaccacagagaactaccccttgcttatctgaatttggggtagttatcagtctctagtcagctaagttggggacaaagatgatgggacatggttttgttagcagcttatctatttatttatttatttattttttgagatggagtttcactctttcacccaggctggagtgaagtggtgcaatctcggctcactgcaacgtccgccccctcggtgggttcaagcaattctcctgtgtcagcctccaaagcagctgggattacaggcgcatgccaccacaccaggctgatttttgtatgtttagtagagatgggatttcaccatgttggccaggctagtcttgaacttctgacctcaggtgatccacccacctcagcctcccaaagtgctgcaattacaggtgtgagtcaccacgcccagccaactaacagcttaattttaaggtcacctatttctaggaagttctgggtgtcctggtccccatattccatgctataagatcattcagtgtgagaacctggactttatagccctcacccaaagcagcagcagatagttggaattattggacagctgcacatcaagcctactgtgattcagctgaggggtgcatgcagcgaaggaggcctctaacatcacagtgactggctttgtgtatccatctgcctggggatccagacctgggtgttctacctggaccttcatactgctgcactggtgagcaagatgaggcttaaataaagcatactattcaatttgtggtgacctctgagaaccccaaatctgccatgaatccctgcaccacacaatacctgtgacacctgtgccaaggtgaggtccagtagctaccaaacctacttctgagctgcatattagagtgaagccttcctccctaccctccctctgtcttaccttttgcacaaatcatgggttcagatgttatacctattattgcactctgataagttttttttttttttttttttgcagtcatggaataaggccataccctgtgggtagggtataaaggtttccctctatatagtaggtgttcttattatcagtcattcaaagaaaaagagaatcctcaccagaaaatcttggaacatagaacagatggaaggtggcacttctggatatgcctttttacatctgaacttggaagagttaagaattgttgaaggcccttctcactgatcaggggaaatagcttctgtcacagagctgcctactccaggagaaccaaaaatgaaagtaaacactcatattttgtaagtctgttcctcaacttccatcaatcaagtttaatctaaatcaaggattcaaactgagaagcatttaaggaccaagaaaaagttaattagcccagtataagtcaacaagaaatggtaagcagtatggaggaaaagaagtgccacacccttctaggcatccaaattcaagcatttacaatgtacttcatgaagcagtaccctatacagcactaataacagcccaaacttgcttgacatttctacataacacattattcattaattcagaagaaaaatagaattcttaaaactcctaactttatttttaattaatataaaggaggaaccaacaacaacaaaaaattgtgtgggagttagaaaataaggactaggcgcctgggcgcggtggctcacgcctgtaatcccagcactttgggaggccgcggtgggcagaacacgaggtcaggagattgaggccatcctggctaacacggtgaaaccccgtctttactaaaaaatagaaaaaattagctgggcgtggtggcgggcgcctgtagtcgcagctactctggaggcttgaggcaggagaatggcgtgaacctgggaggcggagcttgcagtgagccaagatcgcgccactacactccagcctgggcgacagagcgacactctgtctcaaaaaaaaaaaaaggaaaaaaaggactaggcaggcagatgtggggtggggcaaacaaaacatggcagccagcagaccagtctatttcagcatagtctctgctgcagtatttaagaaataggtagagccagccaggcgcggtggttcacgcctgtaatcccagtactttgggaggccgaggcgggcggatcacctgaggtctggagttcgagaccagcctgaccaacatggagaaaccgcgtctctactaaaaatacaaaattagccaggcgtggtggcacaggcctgtaatcccagctacttgggaggctgaggcaggagaatcacttgaacccagaaggcggaggttgtggtgagcccagatcgtgccattgcactccatcctgggcaacaagagtgaaattccccatctcaaaaacaaagagataggtagagctggccgtggtggctcacgcctgtaatcccagaaggctgagttcggtggatcacttgagatcaagagtttgagactagcctggccaacatggtgaaaccccatctctgctaaaaaaaaaaaaaaaaatacaaaaattagtcgggcatggtggcaggcatctgtaatcgcagctacttgggaggctgaggcaggagaatcgcttgaaccccagaggcagaggttgcagtgagttgagatcgcgtcactgcagtccaacgacagagtaagactctgtcgcaaaaaaaaaaaaaaaaaaaaagtagaaagcagaacgcttcttcccggtgccaagggggatttatgaaagatccccaaggaagagttgaatatcagaatgagggtcattttggcagtcccatccctgtatggagacagtcctttcgttgttacttttggcagatgaggatttgagtttaagagacctggttgggggggaggggggagggatagctttgggagatatacctaatgctaaatgacgagttaatgggtgcagcacaccagcatggcacatgtatacatatgtaaccaacctgcacattgtgcacatgtaccctaaaacttaaagtataataataataaaataaaaaaaaaagagagacctggtggatttccgtacaacttcataatttccccctatccaagacccatggttccatttttgtcaccgtggccacagtggctgaaatggctcacttcatcttttgcactaaacagccttcagccccacactgcaccgctaaatggacaagttcttttttccctagtgtcttaaattcatggcctcagtctgaggcctttagttttatactgctttgggagagtcctctttacagtcttagagatatacatatacctcttactgtttaccaccactaatttaatagcaagaaagaaactggaaatcttgtaggaatactctgttcctttttttgttttttgagacgaagtctcactcttgtcaccaggctggagtgcaatggcgcaatcttgggatcttggttcactgcaacctctgcctcccaggttcaagtaattctcctgcctcagcctccccagtaactgggattataggtgcctgccaacacgcctggctaatttttatatttttagtagagacgaggtttcaccatgttggccaggctggtctcgaacacctgaactcaggttatctgcctgcctcggcctcccagtgtgctgggattacaagtgtgagccactgcgcctggccaaggaacactctttgttctatgctacctactaggacagctagtctactcagttaccccaaaaccaaaaggatagtaactcaacaagctcagaatacaccattctgcttgcagccattgttttcaccactaccccatttccccctgcacacatagctcattaccttgtcacatgtacacttactatagtcacagcaggagctagaatctggagatgttacatgccacacaagaggtcagtgagaagcacaaaaccatacattgcaaatgggtaacatatcagtgtagccatccaagcagaggattaggtatggccttcatctcatgttcccattaggctcagatgggctagataatggggttttgctcctgtttccaattcaaagatagtcaacctgggagctttctaactctatcatatgtatttcatttgtttcaccagttactcatttgatcaacccagggaagaccatatcatgaatgaaacacagcccaagtatgctttaaccataacgtgggagtgcataattcaggctaccaagaccatttaacagaatccagtggaatgagggaagtctggactacaggagttagtgggggaattctcagtcactgcaaccatgcttctaaacaaaggccttcaccaagaacctagggcaatcttattccatctgccagaacttatagggatatcactaaattatgcttagtcaaaattgggtaatttgtagtttataaatactataaaactgatatttaaatctaggtctacttaattcctagcttctgttcttaagtgctagattattttgattcatttattttgttcaaaatcttgacgttataggaaaggatggggatgaggaggatgatgaggcaggaaaatgcagaactgtttcatagtcccagcgctgaacctttgtacaggctgtttcttcttcatataaagcacttcttggccaggcgtggtggctcacacctataatcccagctctttgagaggctgaggtgggcgggtcacttgaggtcaggagttcgagacaagcatggccaacatggtgaaacgcaatctctactaaaaatacaaaaaaattagcccgatgtggtagtgtgcctgtagtcccagctacttggggggctgaggcaggagaatcgtttgaaccagggaggcagaggttgcagtgagccgagatcgtgccactgcactctagcctgggtgacagagcgagactccatctcaaaaaaataaacaaattaaaaaaataaaaagcacttcttccttccacttgataaactgtgtgcagaataacatggagatggaggagaggcaggtagattaagggggagcagttttagtaattctatgattcagacctctttttaattcagctttcctgctaattaatgtaaattagtaaggtttctgctgggcgcagtggctcatgcctgtaatcccaacactttgggaggccaaggcgggtggatcacgaggtcaagagatcgagaccatgctggctaacatggtgaaacctcgtctctactaaaaatacaaaaaaaaattcgccaggcgtggtggcaggcgcctgtagtcccagctactcaggaggctgaggcaggagaatggcgtgaacctgggaaccagagcttgcagtgagccgagatcacacctctgcactccagcctgagcgacatagtgagaccccgtctcaaaaaaaaaaaaaattaataaggtttcataattattatatttaccaaccaggttctttctacataattattgtttaccttctaataaattacttacaaaggccacctacaaatccaaattatatacaaaacgtttcatttcctatttccttcccagggatgcataattattttggaaaaatcagtggcagctgggcacggtggctcatgcctgtaatcccagcactctgggaggccaaggcaggcggatccatctgaggtcaggagttcaaaaccagcctggccaacatagtaaaaccccatccttactaaaaatacaaaaattagctgggcgttctggtgcacgcctatagtcccagctactcaggaggctaaggcaggagaatcgcttgaacccaggaggcagagatcgcagtgagctgagatggtgccactgcactccagcctgggtgacagagcgagactgtctcttaggaaaaaaaaaaaaaaaatcattggcttgtaagttaaaatctttatcttgctctaccttctctggaatacctacatctctgatgtttttttaacattacatattcacaagctttaccaattcatggaaaggattcctctaggattttggtggatctcttgaagcactaagaacctcaagcaaaaatgtatgcaatctttgtactttaaaattaaagcatttcaaccaggagcagtggctcatgcctgtagtcccagcgctttgggaggccaaggcaggatgattgcttgagccttggagtttgagactagtctggccaacatagccagaccccgtttctttaaaagaaaaaaaaaaacaattagctgcatgtggtggcacacatgtagtatcagctttgggaggcccagatgggaagattgcttgatctcaggaggttgaggctgcaatgagctatgatcatgccactgcactccagcctgggtgatagagcaagaccctgtctcaaaaaaaaatttttttaatagataaacattcaggcattccaaactcctaatgtattgtctactattaagaatgcatgctggctgaggcaggagttcaagaccagcctggccaacgtgatgaaaccccatatctactaaaatacaaaaattagctgggccaggtggtgggtacctgtaatcccagctactcaggaggctgaggcaggagaatgtcttgaacccgggaggcagagattgcagtgagccgagatctcgccactgcattccagcctgggcaacagagtaagactccatctccaaaaaaaaaaaaaaaaaaaaaaaaaagaatctctggaatttaacattcctttaaacttaaaaaataagaaaaaataaattaaaaaaaattagaagaatgcatgctggggtctgctcagtgattcacaaggcaggaaatctcttgagccaaggagtttgagaccaacctgggcaaagtggcaagaccctgtctctacaaaaaaattaaaaattagcagggcatggtggcacacttctgttgtcctagctacttgggaggctgaggcaggagagtcatttgggctcatgtgtttgaggttacactgagctttgatcacaccactgcgctccagactgggcaacagagcaagaccttatctcaagaaaacaaacaaaaagagaattcagggctgggggcagtagctcacacctgtaatcccagcaccttgggaggccaaggcaggcagatgacttgaggttaggagtttaagaccagcctggccaacatagtgaaaccctgtctgtactaaaaatacaaaaattagctgggtgtggtggcaggcgcctttaatcccagctacttcggtggctgaggaaggagaatcgcttgagcccaggaggtagaggttgcagtgagccaagatcgtgacactactccagcctggacgacagagcgaaactctgtctgaaaaaagttcaggtgggaggatcccttgaggacaggagtttaagaccagcctgggcaatgtagcaagaccttgtctcttaaaaaaaaaaaaaaaaagaatgcaaaagccatagaaccttttcctaggagagaatgctaggaggaaggagggaaacagtatattttaaggtaaataagaaaggcctaatgccccgtggttagatttttctatctacatattggagataagtttaaattttgtgttagtgtttgggtattacttcctgccaacgtgaaaagttaacctttctaagacaatctctactaagaatttggactttttcaagatttttgcctacttctttcaaagagattgcaaaacgattttaactcactaaagaacatttttcacctcttgattgtccagtacaagtgtagtacagttctttttttatgtatcctccctttgtttttatagactggaaggtatccagaaataaggcattcagaaatggaggcacacatagatgaaggcaaaggccattcctatgaaggcaggtctgtaggcagctggttatttgtttttctcagcctctcttggcattctaccttcatctggaaaaaaatttaaaaaggaggatactttataggtcctgtctcaagtatctgacttccctgggaagcttgattctcacattcaaaatacatggggagtttggttcagttaaattttatcacaccagaattgttgaaaagcaataaattattactgtataattggtgcctgtttgttatcttaggtattgttatttctgtttttaacttgtttggaaaaccatagaccataaacttttctgaacgttcgatgcagagctccaaccgaactagcaaagaacatttcctcaaagaaacggagtatttttttctgtaacaatgtaactttctgtctttcattcttcaaaatgtatcactataaatttcctacaaaaagagctatttcttctctcagtatcatacagattgatttgtatagatgtatatgtatggctgttaaattgtttgttggtataaaatggtgagtgtcagtataataatgatgataataaatagcggctaacatttaaagcgcatactctgttccaggcaccgttgtaagcattttacatcgagttgctcaatctaaaaccacttttatctggttgtctttatttatctagcaaaacttttaagaatctatgctgcaataaattccacaactcagccttcatcttcccaacaaaaataactagaattccagtgttttctctttatcagtttgtcttcaggaaaccgtcaacattttagaaccatgctagtccccaggacttgatctgaatatacaataggtagctgcattgcctatcttaggacatagaccagtaaacaaaatcaaaggtaactttgcacttagtataagcccttgatgttagcttcactgaagtaggagaggcaataaaaatgttgacttgaagtctgctctacctttcaccatctttcagaaaaatgttgatcaggactagcctcctcagcaaatgtaggcatatataaaaatatatttcttcatcctttatgatgtaataaagactaatggcttagacttagaaatctaacaaagtgacaatagtttttttctcccaattcagacctatttctgttcttaaaaagacatttaagccaggcacagtggctcacgcctgtaatcccagcactttaggaggccgaggtgggcgaatcacaaggtcaggagttcgagaccagcctgggcaacatggtgaaaccccatctacagtgagccgagattgcaccactgtactccaacctggatgacagagtgagactccagctcaaagaaaaaaaaagacattaagtctcatacagttatgaaatttcacaattccagaaagctttagtaatcaaaatatagatttaagacacttattcagtcatttcacttaattcatccatctattcatttattcattcattccatctttattgaatacctactatgtgcagtgcagttactccaatcttatccaacattggactactaattagtaagatttttgtaattctgtttttaaattattcctttacatgggacaaaattcaaaaggtatatatatacaatgaaaaggaaatcttgcacccagttccccagccattcacctcacctcctcaaacaacaagaaaaagaacagtgaggccaggcgtggtggctcacacctgtagtcccagtactttgggaggtcaagtgggcagatcacaaggtcaggagtttgaggccagcctgaccaacatggtaaaaccccgtctctactaaaaatacaaaaattagctgggcgtggtggcgtgcacctgtaatcccagctactcaggaggctgaggcagaagaatcgcttgaacccgggaggcagaggttgcaatgagccgagattggatcactgcactccagcccgtgcaacagagtaagactctgtctcaaaaaaaaaaaaaaaaattaaaagagttataataaatacaggcttagaaaagaataaagtctcagaacaaggtaaaggggcaataaattatgtgaagatgtgcattgttatttaacacatggctaacatgttacaagttgttcttttgaatggtcaactatcaacaataacctgcttagccagtaagtcagagcccagcaagggggttctgtaggtttccagtttttctggattggtttttcttctaagggctaaaaagttctaatgaaggtagccacttccaaagtatttaccttttacttacctagctagtaagccaatgttatctaatgagtccaattctagggatatgcaagtgaatgtaaatgcttttttctgccaccacagttttgatattcgaatcctagtagttttacatttaaaaatataatattggccaggcgcagttgctcatgcctgtaaacccagcactttatgagaccgaggtaggcgaatcacttgaggtcaggagttcaagaccagcctggccaacatggtgaaacaccgtctctactaaaaatacacacagaaaaattagccacacgtggtggcaggcacctgtaatagctatttgggaggctgaggcagaagaattgcttgaacccgggaggtggaggttgccttgagctgcgattgtgccactgcactccagcctgggcaacagagtgagactccatctcaaaaaaaaggaatactgtcaatgtgctaatattcttccaatttgtccaatattaacctaccaatgtttaaggtttgttaatgtttcaatgaataaattaaccaagtattaatcttttattaaaaatattttattggctgggcgtggtggctcatgcctgtaattccagcactttgagaggctgaggcgggcagatcacctgaggtcagcagttcaagaccagcctgaccaacatggaaaaaccccatctctactaaaaatacaaaattagaaggcgtggcgtggcggcgcacgcctgtaatcccagctactcaggaagctgaggcaggggaatcgcttgaacccaggaggcagaggttgtggtgagccgagatcacgcccttgcactccagcctggacaacaagagcgagacttcgtctcaaaaaaaaaaaaaaagccaggcctgatggctcacgcctgtaatccaagcactttgggaggcctaggtgggcggatcacgaggtccagagatagagacgatcctggccaacatggtgaaaccttgtctctactaaaaatacaaaaattgggccaggcatggtggctcacgcctgtaatcccagcactttgggaggctgaggcaggcagattgcttgatcccaggaattcaagaccagtctgggcaacatggtgaaaccttctctacaaaaatgcaaaaattagccaggcatgctggtgcatgcctgtattcccagctactcgggatacagggagtcacctgagcttggggaggtcaaggctgcagtgtgccatgattgcaccactgcactccagcataggcaacagagtaagaccctgtctcaaaacaaaaagaaaaacagatttcaaaacactaaatagaaagtgatcacaatttttttaaaagaaatatgcataaaatgaacacaaaggcaatattagattataacaaaatcctttggtgataggattatagggggttatttatttccttctttgtctcttcatttggatctttaaaatgtcaacatggtgccatgactatctggagaaaaaaaggcagacattctatacagagagagagctattttattttaagcatctgtgatgagtgatggagcatttcacacacaacaaggatgaaaagagggagggtttgtcagatgaaatcatagaatattcaactggagggtgggttagaaataatttaattcaacttcctttgttttatatatgaaaagattcaagtttatccaaggccacacaggtaatgtttagaatccagaataacaattggattttctactttccaggatctttagctcatctttcttcctttctatttatgtataatgcaggagctggcaagtagagctcttttaagtctgaaaaaagagatagaaaatgtttaggataaagagaaagagaaaagctatatcttaaatagcatggtgacatggcttttcttttcttttttttttttggagacagggtctcgctctgtcgctcacgctggagtgcagtggcatgatcataccccactgtaacctcaaactcctaggctcaagcagttctcccacttcaaccttctgcggggctaggactacaggaagacaccaccatgcccagctaatttttaaaattttttgtagataaggggactcactatgtttcccaggcttgtcttgaactcataacctcaatgaatcttcttgcctcggcctcctgaaacattggaattgcaggcgggagccactctgcccacagcctcttcctatttttgaattggcatttgccaaaaaaaataaaataaaataaaatgaaaaaaccccaccatgcacacactttgtagttgtcttcagaatagcatgttttaaataaaacctctaaataaaacttcatagtgttgatt

SEQ ID NO: 810 - DNA, 3799 bp, Homo sapiens
atacctttctgaaaacctcctggatatctcaagtccctgaacatctccagatgcctgaatcacagttctcttgcctccttgcctagtcgaaataggttttctcatccattttccaaccttggaataaaccagctgctccccagggccagcagctcccagagctccatcctgcggagatgtgccagagaggccttcctatcagtgaagcttctgttcacagactcttctccagcttggctcaagtccaagaaacatctttgttctccagcatcaaaggcatgcacagattggagtccaagatcagacacccaggcattaaaggaagcacgaggctaatgaacagggagagtccagacttatcagagagaggggaaatctgctgattacaggggaggcctctacggttaggaaggggacaagtctgcagattgcagataggagagcaaacgccaagcagccagcaggccttcatctagctctgtcataggaacctccacacctcctcatcctcacagaggtctgccccagccactgcctgggccactgctgctgcagcctggtctcttaagacacagaccaggtccacagccacagaggccacagggacagctaggacacagcattcagacttccccagctgccgcttctgtgctgagcctttcaggaagtagggaggggccttaccaaggaaagccctggatgttaggggttctagctaacagttaactcaacatgagacaatagtggatctgtgggccccatatgccaagaggaaaaaatacaaacagacaggaattcacaggaggagctgtggattcactcaatcactcaaaatatttatggagaaactactatgccaagccagactctggaaacctgcgacagtgccaggaggtgggcaagcagagcagtggcctgaaagactttcacatcaggaagagttgaaaaatatttagtctacaaaagaaaatacccaagggagtgggacagctgaactcaaatattttaagtgcttttatgagggaggagtgagatttttgtgaagtgccaaagaacaaagttaggacccatgggcagaaatcatgaaattgggctcagtttaagaactttcttataatgagatctattggactgcgacaggagctgcctttagatgcactgtgtcccatgaactggaggtttgcaagccagtagatgacaaccagctcctcccaatccatcaaatactgtgactcctctaactgtaacttgtacgtggaaatgggacccaggggcagggagcctcccacgaagggagattcagaagacctgaccgcaagctcaggagacaggaagtttccctggcttccagaacactgctgggaggctcttcggggggcccaaacttctggggaccagcagaatgtgtgaccatggcttgaaactaaaagaaaggaggaagacaggtaagtcatgggaagaggctcccccagatttggggttttcttaatgtttttggacccacaaatgcttcagccctgagaagcaccctacagtaattcctcactgctttctaatctcgttcttcccagctgggtttagtgtgctcgctcccttttacatctcatttatttaccatccagataccctttctcttctgtaccaaagtgatccgcctgttcttccacctgacaacccatcgcagattcctttctgccttcaccttcctctctcccacccaggactctcccctgtttgtctcagccaaaccaggggtttcaacctgacctccaggaagccctccatggtttcagcctagctcctaagtactgcagcttgggctctgtgctgcagtggccgcaggggtctgcagccctctaccagctgcctgtatttgaatgacacatgtctcctgtcagcatgagagcccagatgacagctcctggggctggctgtgttcttgcctgacttcacagggcccatcacagtgaggtctgagacacctgtacggctggccaccagcatgccccctgagcagagacaaagcggggtgctggcttctagaccacctggacaatctcttttattgatagggtaaccagctcatcttgatttgcctggaactgtcccaattttagcactgaaagttctgaatcctgggaactccctcagtccccgacaaactgggatggttggttgccctaagcacctgtgtgtataagacatgatgctttgttccaggtgggggagcacagagggaaagcagatgaggccctccatgctggaggaacttatagcccaagggatttttctggaaaactgtaaacccaggaggcctagttcccactgcctgccccctccatagccacattctccatgagcaggggtgggggcagcaggggctggtgaggggtgatcaaatactagatcaatgagcaggttcccagcctaggcctgtttcagcatgaactggcaggtcttgaccaggagaagtggtatcgtgggggccaccacccctattcgacagcagatctggacttgtccactcctgctctccttctctcctacggacacctgcctcacatctgaaaatggttgaaagaaaataagtggccagctggcagggccttctcaactcaacctccctcatcacccggttcccaagccagcctcataacctgtctttcctcctttagaagccgctggggaccgtttctcttctcttcccaacagcaccacctgctggccatagaggcacttggccttctactaatcacacccagtctggcctgagttggagatggccgcacacactccggccgtcagtgctccatgtggagaagacaagagtacagagatgcagcatctaacagagtcagaggaaggctatatgtgcaagacagagttacactatttatagggtgggagcaacacgaataatggttcaggacataggctcaggaatcagacttctggaattcaaatctagactccaccacttctattgttcccttaaaacaaatttctcctatgtgagagtaagtgacacagaatctcctatgagccaagcactggagttacagcagcgaaccagatacacagaatccctgcctcccagagctcacatgagaaggaagacagacaaaaagcaactcagcaaatgcataaataagaaagtgaaaatgaagaaaatgaaacaaagtggtgaggagagaccagagaagaggggtgctctttagctcgggtagcgtggaaaggccgatctgagatggggatgtcggagtagcgacatgaacaataggaggagccatccatgtgggatcggggtaagtatcagcgcaaagagaacagcaggtacagggagtactgcaggtcagactgcccctggagccttaactcggatgctgcatttgaaggtagaccctggccaacttttagttcatccaaattaatgtgagaaaaagagcgaggtctctgggcaccttgtcacatgagctgtggctgaaggaagggggcgtttcatccagagatgaggagacttagagacacacagtggctgtcttcaggcctgtcaaatgtcaaagagagaggcagtggatatattctttgtgatcccaaggagaatagcatggatcagtgagttctgggcacagaaaagcagattctgctcatatcaggaataaaatggcccagcaaatgaaatgagctgctcatgaagtagtgatcccaccatccatgaaatatgcaagcagagaccaaataagtagctgagattataggaagtgtggatgcaatgcttttaatctttaattatcaccta

SEQ ID NO: 811 - DNA, 119437 bp, Homo sapiens; identical to SEQ ID NO: 174

SEQ ID NO: 812 - DNA, 6416 bp, Homo sapiens
actgagactatttctgcacattccagttaatggattaatgtaatgaatgttggtaggtcaaataatgcagctgtgtaaacatttgtttaagctgctgccaacaaagaagtttaatctccctgaaggaaacttcatttttagtcccttcggaaacatctatttacaaataatcaaattgatatacacagtatttctcaatgtacatcccagggcacttgtttatcacagcatgttgtattttgctataggcatttataaataataaaattgctttttaaaaaaataatagaaatcccttcacattctccatagttattcaaagcaaagatagtttttttatatagaaataattgcatgtgatttttcaatttaaagaatgaaattatgtcctttttggtgtcacatcagttaaagggtaggtgatatgactgtctttttgtgtgctgcaaggaggaggaatcagttaagctttgaagactgggaaaaaaggaagagttgaggatggatgaagtatatcactggagagtacttactagaattcatcgactcagacttcattcaataagaaaatatttattgattacctactatgtgttagccgctgtttcagaagcttactgctgaatgatgatgcaagaagattttcacgaaagagattgtggtgaggtagaaagagctctgaacaaaaaataactgattttagttctataaatgccttgggtaacttcttgtcctcgctggtctctatcctgtatgtatgtaaaaagagggtggtgggattgaaccgcatgatctccaattcctatatgtctctgccaccaaagtaccaccagatgactaaaaaaggaaactttgcataggcaatttcaatgtgggaagagtacaatatgttaaggtttaatagacgaacaggccgagaaagctgtgtggctggcataatagagaaggagtgttcatgattctttttgaagggagcgtggtaaactgggtggcagataagtggaagagttctgaggaaattgcagctgagaactggatctatttttccatgtctccatactctcatagatatgggctctagtaaaattgaagccaggctcaatgttagcagcatggtgtaccagaaaaaaaatgttttatgatagtcctgggttggatatttttctgtccaactcgattattagctccctgtggtctccctttcttatttcctatctggatggtgttggaaagtgtctaatccttttagattaaggttgatgcatacattatatgagttaatatatatgacacttaatatatgatactgagtaaattcttgaacgtcaatttgttttcttgctagtataaaagtacaatgatctgggatcttctattagccaaattgtgaatatttgcttaactaaagaattattctctcataaagataatgatgactcttatgtttgccaccttggactggagtatatgttttctttgacaagtatttcacaagtataggcttctaagtgtcatttccctatgccccattaccccttttgccaatgcattatccacctgctgttggagttttctttctaaagcacagttctgatcatgctactcctctgctcaaaattctacattggctccctgttgcttacacaacaaaattccacccctgtgcttgcattctaagctcaccatgattcagattcaccatgtctttccagcctcatctcacatcatatcactgcatgcacattaccctctatttcaggggttctcaaatctaagtgtgcttcagagtcacctggatgtcttgttgaaacacatgtttctgggcgttatgcccagcatttctgattctgtgagtctaagagggagccttgaaattttgcatttctaataagttcccagttgacactgatgttgcttatctagggactacacttttaagaaccactgttggccaggcgcagtggctcacacctgtaatcccagcactttgggaggtcgaggccggggggatcacctgaggtcagaagttcgagaccagcctggccaacatggtgaaaaactgtctctactaaaaatacaaaaaattagctgaatgttgtggcgctcgcctgtaatcccagctactcgggaggctgagtcaggagaattgcttgaactggggaggtggaggctgaagtgagccgagatcatgccactgcactccagactgagcaacacagtgagactccatcaaaaaaaaaaaaaaaaagggagagagattgagaaccattgctctaacaacaccaaatgctggttcttttggaatatatctagtgtctactttttcatcttagcatttttctgatgctctttcctccttccttgggctccttctattggtagaattcctctcatttttaaaactaattttactttcttaggaagctcgtactaatcactcagtcagtattaaagagggagcactgactcttgtttcccttcacaacatgctgcttgtactctgctttagtatttataccattctgcattgtactagagctaattgtgtttgtcctcttgctcacattcagttgtcaagcccatgaaagaagggaccatatttcattaatcttcgatcttcaaacgaactgaatttcatcatggtgcctaaaagccagccccagtaattacacatctgttttctttaaaatgtatctgattattgcagcctgcagaagacaacaatcttatgggtggcagccaccctgccttttgaggtagaaggatatgcaccatttaagtgcctgaacaaatggattccatcagcaacctgatagagaaatttaccaaggttagaaagaaaccagcctgaaatgttggggtggtaggtttcagagctgcctgtataataaagatgctgaaccccattgcagtaagtcaagctgtcacagggaacactatctaaagccaactccaatctaatgaggtgtttgaattattgttaaaaggaagaatgccagaagctatttcttctctgtggattgtgctttcctataccaaatgtacaggaaagaaccaggggaattagtaatgaagccagagtaaatgcacagtctggagaaagttttgttcaatctaaatttcagagaatgtaacataatcaatttccttaaatactctgtcagtttccaaagagcacagagtgaacccaattctcccatatgacaccccgctctctgttagtgggaaaggtgcttgttagcctccctcctactccagtttctctgcccctgctttcctcttgaataccaggtcctcttcccttcttatgcctcatactatacttgggcattccatctgacctgacttcctctgtcatctttttgctgatgaccacgtctttccttgggctccttctattggaggaggatccaatagaaggttccagcctagatcctcctcctgagcctcagatccctggagccaataattttctcttaattctccttggctgttccacagtcatctcagattcagtatctccccaaattaactcatcattttcctggtactttggttatttgtagggtgtctacctcaaagaacaaggagttggtacaaccattttagaaagctgttcaatcatttctactaaagctgaatgaatgcacaggacatgaccccaaaatagccaacagaattgcttacatatattcaccagaagagatgtacaagaatgtttataccacactatttgttatacctcccaactggaaatgatccaaggtgtctctagactgtagaatgggtacatcattgtggcttattcatacaataaaatgccattcatcattaataatgaacaaaccatgtggaacaccatgagtgaaccctacaaacataaggttaaaaaaaagccagaagccagatacagaatatagactgaatacttccgcttgtataaagttcaaaagcaggcagaatgaagctgtgttgtgaaaagtcaggagagagaatacccttggggaagtgtgatgggaaggaaccctgagagcttcggggatactggtaatgttctttttctcaatctggatgctgatttacgtgatggtgttcagtttgggaaaattccttgtatggcacactagagagctgtggacttttctcaatatatatgtcaataaaagttacaaagataagtaaagaacatggatcactgctctccgtctctttcagctgctgagagttcagccttcagtcctggttctgtcattttcttatgctgggtaactttcctatgtggctatgagggcccttggtggccctcatccccagtagaatgagaagacatatgtgtgagggcacagtatgtaaggtttagtcagagtgatgtttctaaccatctggttagctgttcaggcctccatggctttctacgcccaaggtgggtccccatgaacactggcctcagtctaaaactcagcctgagaagagactgcatgttgaaactctgtagtatgagtcacttgtggacatagattccctatgtaggaagctaaacaggtgtttggtgtgtgaatcaattttatagtctccaaataaatggaatttaagagctgctgttggctagaaacccagatttgtatcgcaagtgggatagagtccattatcagctgagttgcagcattcgtcttttagttagcagataaactctggaatctctgtggctaaaagataaaacctgaaatctcagagtattaactcagtagaagtttatttctagcttttgttaagtctaacagcagcagtgttggggagatggggctggggagagaagaatccacaccatgcagccgttcaggctttcagaagctttggtgtcttcaacatgtggcttccaaggacactttggacactgacatccagctggcacagaggaaaataagagtggaggactgtgcagtaagttttcacagtcaggcctggcaacagcatctctcatgtctttccagtttttattggctagaatctggtcatatcactgcatctaacagcaagggagtctaggaagtatggcccagctgtgggcatggaagaaaggaaaacaaatttgatgactagctagccagtgtctgccacatttagatttacctacaagcagagaaaaactacatagtattgaaggtggatgtcgaaagcaaatgtgatcctctgttgggtggaatatatcacagatgtggcactaggaagtaagatttcctgcctgatgagctgaggggagacatccaaaataaaactgtgcccttattgcaattcagagataattttttgttcttttggtgctacaagctgaaaatggaacactgagaaaatgtgtgagcattccatggtgagtaaacagaagaggaagactgactttcctaattagtgtcctcccactgcaacttttttcttctacattgtctcacattcacacagtcacctaagcctcacattgagagaagttcttccatcttcatatttatccatatatttactatgacctgccaagttcgtgccctacattgtattcactccattgcatcagtgcatttctactgatgctcttccaattctggaaatctagttctcaagtgggctactgccatatgtctatcagatcttcccacttaccatctctttcctttgatctagtctccacgcattgtcaaaatcatcttaaagtaacgttgttcaagcattccagtgactccccattgcctgtaaaattaaatataaactcctttgtttgacgtatacagcattactcaatctagactcaaaatgcactgttcacctttatctctggaaattgaacaaccctaccaattctgtattccagcctaccctaactccttgtcatactctgtacaatctcaagtccatttcacaggcttccaagcatgccttttctgggcttcacctggtgagtccctaatcattaataaaacctaactcaaatgtcacctctttcttgagacttccaaagctccttcagggagagttaattccagtaagacttatcttggttatagcactcatcacattgcattgtattttcttgttatccacctctcctgctatattgtcctggaaggcaatgtagtgtgggggaaaaaagacagaatttagaagtcagattagacctagatttgatttctaccatttcacatgactacctatgtagctttaagttacctaagctctctaaactacaggatcctcttctgtgaaatggggatggtaatatttcatatgatatgtatacaatgtcttatacaggacaagaaaccacatgcctaatttatttattattccccagtattctcctcctctttcttgtattttgtcttatataaaaggctatctttcagtaaaggcatacaataaaggttttc

SEQ ID NO: 813 - DNA, 30722 bp, Homo sapiens
cctcagcacttctatagcatttatctgtggttctcatccatacaacacattttgttgctaattttgtgtttgtgtatatgtgtatagctgtgtgtctatatccctaccaaaccatgagcttcggtggccagcaactactttattcattctgtagcttccttaggacccagtcctatttcttctcctagtagatgtctaacacatatttgctggcagtgaataatggaaaagtagagtagagcagaaggtgcccggggttggtgatgtatcaggaaatatacagatctcccattcagaagctcccaccaggacctgcctgggggtgatgagaataaatgagttctcttttagttccatttaacagatacatatggatcacctcaaggttggatattaaaatatactatgaagactgggcacagtggcttatgcctgtaatcccagcactttgggaggcgaaggtgggggggaatcacttgaggtcaggagttcgaaaccagcctggccaacatggtgaaaccctgtctctactaaaaatacaaaaattagccggcagtggtggtgggcacctgtagtcccagctacttgggaggctgagacaggagaatctcttaagcctggaaggtggaggttgcagtgagccaagatggcactgctgcactccagcctaggtgacagagcaagactttatctcaaatatatatatatatatatacatgtactattaaacactgatccccaaggaagaaatgcaaattcatactcaactaatctctactggtgaaatattaagcttgggccagtttcccatgatttaatgaataagctgtaaaagaggacaccacactcttccatctgctgccccatgcttgtggtcacaaccaggagatagcccgatttcatcagtggctaaatgaagatgggtgtatgcccagtcagaagaggaaagatcactgaaggtcagggacagaatgaaagggaagagcatcagtttcagcccaatgaagagattttcagctgacaggcattcctgagtgaaactgcctgtattataagggctttttactgctttctacacgtctgctctatgctgcatggcgtatgaaaggcatgaggcacacaggtgaattagacacaaggagccacaagaaaagagatggtcacttaaaaaagttcctaacatttatatacaactttatagttttcctttaagcaagatagcttttatctttataaaattatatgaaaaatgctaataacaagaaataattgtatccatatttctatacaaaaagataattgttaaaattgtgttaaaatttttccccttcatctgtgcctttatacatttcagtagttgggaacatactatatgttttcccccacttgcctttgtatcacaagcattatatgttaatatatagttgctttacagtttttattacacttttaaattaagatgtaatttacatacagtaaaattcactccttttcagtatacaaaaggttgtgagattcatgaatatgagtttgacgaatgtatacagtcaagtaacctctgccacggtcaagatatagaacaatttcatcatcctctcaaactcccctgcggccctctgtattcaaccatcctcaaatcccagattctggaaactgctgatctgttggctgttcctaaagttttgtttttgcaagaatttcatataaatggaattatacagtgatgtggtttggatctgtgtccccacccaatctcatgttcactcctaatccccaatgttgcatgtgggacttggtaggaggtgattgttttcatgggggaggatttctcatgaatggtttagcaccatcccccttggtgctgtcctcatgatactgagtgagttctcctgagatctgttttgtttttttctttttaattatactttaagttttagggtacgtgtgcacaacgtgtgggtttgttacatatgtatacatgtgccatgttgatgtgctgcacccattaactcgtcatttaacattaggtatatctcctaatgctatccctcccccctcccccaaccccacaacaggccctggcgtgtgatgttccccttcctgtgtccacgtgttctcattgttcaattcccacctatgagtgagaacatgtgttgtttggttttttgtccttgcgatagtttgctgagaatgatggtttccagcttcatccatgtccctacaaaggacatgaactcatcactttttatggctgcatagtattccatggtgtatatgtgccacattttcttaatccagtctatcattgttggacatttgggttgtttccaagtctttgctattgtgaatagtgccgcaataaacatacatgtgcatgtgtctttatagcagcatgacttctagtcctttgggtatatacccagtaataggatggctgggtcaaatggtatttctagatctagatccctgaggaatcaccacactgacttccacaatggttgaactagtttacagtcccaccaacagtgtaaaagtgttcctatttctccacattgtctccagcacctatggtttcctgaactttttaatgattgccattgtaactggtgtgagatggtatctcattgtggttttgatttgtatttctctgatggccagggatgatgagcattttttcatgtgtcttttggctgcataaatgtcttcttttgagaagtgtctgttcatatccttcacccacttgttgatggggttgtttgtttttttcttgtaaatctgtttgagttcattgtagattctagatattagccctttgtcagatgagtaggttgcaaaaatgttctcccattctgtaggttgcctgttcactctgatggtagtttcttttgctgtgcagaagctctttagtttaattagatcccatttgtcaattttggcttttgttgccattgcttttggtgttttagacaggaagtccttgcccatgcctatgtcctgaatggtaatgcctaggttttcttctagggtttttatggttttaggtctaacatttaagtctttaatccatcttgaattaatttttgtataaggtgtaaggaagggatcctgatgcagatcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccctatagtatagtttgaagtcaggtagcgtgatgcctccagctttgttcttcgggcttagaattgacttggcaatgtgggctcttttttgattccatatgaactttaaagtagttttttccaattctgtgaagaaagtcattggtagcttgatggggatggcattgaatctataaattaccttgggcagtatggcattttcacgatattgattcttcctacccatgagcatggaatgttcttccatttgtttgtatcctcttttatttccttgagcagtggtttgtagttctccttgaagaggtccttcacatcccttgtaagttgggttcctaggtattttattctctttgaagcaattgtgaatgggagttcactcatgatttggctctctgtttgtctgttattgttgtataagaatgcttgtgatttttgcacattgattttgtatcctgagactttgctgaagttgcttatcagcttaaggagattttgggctgagatgatggggttttctaaatatgcaatcatgtcatctgcaaacagggacaatttgacttcctcttttcctaattgaataccctttatttccttctcctgcctgattgccctggccagaacttccaacactatgttgaataggagtggtgagaaagggcatccctgtcttgtgccagttttcaaagggaatgcttccagtttttgcccattcagtatgatattggctgtgggtttgtcatagatatgtcccatcaatacctaatttattgagagtttttagcatgaaggttgttgaattttgtcaaaggccttttctgtatctattgagataatcatgtggtttttgtctttggttctgtttatatgctggattgcgtttattgatttgcgtatgttgaaccagccttgcatcccagggatgaagcccacttgatcatggtggataagctttttgatgtgctgctggattcggtttgccagtattttattgaggattttttcattgatgttcattagggatattggtctaaaattctcttttagaccaatttttgttgtgtctctgccaggctttggtgtcaggatgattctggcttcataaaatgagttagggaggattccctctttttctattgattggaatagtttcagaaggaacggtaccagctcctctttgtacctctggtagaattcggctgtgaatccatctggtcctggactttttttggttggtaggctattaattattgcctcaatttcagagcctgttattggtctattcagggattcagcttcttcttggtttagtcctgggagggtgtatgtgtccgggaatttatgcatttcttctagattttctagtttatttgcgtagaggtgtttatagtattctctgatggtagtttgtatttctgtgggatgggtggtgatatcccctttgtcattttttattgtgtctatttgattcttctctcttttcttctttattagtcttgctagctttctatcaattttgttgatcttttcaaaaaaccagctcctggattcattgattttttgaagggttttttttgtgtctctatctccttcagttcttctctgatcttagttatttcttgccttctgctagcttttgaatgtgtttgcttttgcttctctagttcttttaattgtgatgttaggatgtcagttttagatgtttcctgctttctcttgtgggcatttagtgctgtaaatttccctctacacactgctttaaatgtgtcccagagattccggtatgttttgtctttgttctcattggtttcaaagaacatctttatttctgccttcatttcgttatgtacccagtagtcattcaggagcaggttgttcagtttcatgtagttgagtggttttgagtgaatttcttaatcctgagttctagtttgattgcactgtggtctgagagacagtttgttataatttctgttcttttacatttgctgaggagtgcttttcttccaactatgtggtcaattttgtaagaggtgtggtgctgagaagaatgtatattctgttgatttggggtggcgagttctgtagatgtctattaggtccgcttggtgcagatctgagttcaattcctggatatccttgttaactttctgtgtcgttgatctgtctaatgttgacagtggggtgttaaagtctcccattattattgtgtgggagtctaagtctctttgtaggtctccaaggacttgctttatgaatatgggtgctcctgtattgggtgcatatatatttaagatagttagctcttcttgttgaattgatccctttaccatgatttaatggccttctttgtctcttttgatctttgttgttttaaagtctgttttatcagagactaggattgcaacccctgtgtttttttgttttccattttcttggtagatcttcctccatccctttattttgagcctatgtgtgtctctgcacatgaggtgggtttcctgaatacagcacactgatgggtcttgactctttatccgatttgccggtctgtgtcttttaattggagcatttagcccatttatatttaaggttaatattgttatatgtgaatttgatcctgtcattatgatgttagctggttattttgctcattagttgatgcagtttcttcctagaattgatggtctttacaatttggcatgtttttgcagtggctggtactagttgttcctttccatgtttagtgcttccttcaggagctcttgtagggcaggcctggtggtgacaaaatctctcagcatttgcttgtctgtaaaggatttttttctctccttcacttatgaagcttagtttggctggatacgaaattctgggttgaaaattcttttgtttaagaatgttgaatattggcccccattctcttctggcttgtagagtttctgccgagagatcagctgttagtctgatgggcttccctttgtaggtaactcaacctttctctctggctgcccttaacattttttccttcatttaaattttggtgaatctgacaattatgtgtcttggagttgctcttcttgaggagtatctttgtggcattgtctgtatttcctgaatttgaatgttggcctgccttgctagattggggaagttctcctggataatatcccgcagagtggtttccaagttggttccattctccccgtcactttcaggtacaccaatcagatgtagatttggtcttttcacatagtcccatatttcttggaggctttgttcatttcttttcattcttttttctctaaacttctcttctcacttcattcatttgatcttccatcacttataccctttcttcccgttgatgaaattggctactgaggcttgtgcattcattacgtagatctcatgccatggttttcagctccatcaggtcctttgaggacttctctgcattggttattctagttagccattcgtctaatcttttttcaaggtttcttacttcttcgccatgggttcaaacttcctcctttagcttggagaagtttggttgtttgaagccttcttctctcaagtcatcaaagtcattctctgtcctgctttgttctgttgctggtgaggagctgcgttcctttggaggaggagaggcgctctgatttttagaattttcagtttttctgctctgttttttccccatctttgtggttttatctacctttggtctttgatgatggtgacgtacagatggggttttggtgtggatgtcctttctgtttgttagttttccatctaacagtcaggaccctcagctgcaggtctgttggagtttgccagaggtccactccagaccctgtttgcctgggtatcagcagcgaaggctgcagaacagtgaatgttggtgaacagcaaatgtggctgcctgatcattcctctggaagttttgtctcagaggagtacccggccgtgtgaggtgtcagtctgcccctactggcgggtgcctcccagttgggctactcagggatcagagacccacctgaggaggcagtctgtccgttgtcagaccttaagctgcgtgctgggagaaccactactctcttcaaagctgtcagacagggacatttaagtctgcagaggtttctactgccttttgtttggttatgccctgcccccagaggtggagtctacagaggcaggcaggcctccttgagctgtggtgggctccacccagttcgagcttcccggttgctttgtttacctactcaagcctcagcaatggcccgatttttccaggtgccgtccgtcacccttttctttggctaggaaggggaattccctgaccccttgttcttcccaggtgaggcgatgcctcaccctgcttcggctcatgctcagtgcactgcacccactgtcctgcatccactatctggcactcccccatgagaataacccggtacctcagttggaaatgcagaaatcattcatcttctgcgtggctcatgctgagagctgtagactggaaatgttcctaatcggccatcttgagatctggttgtttaagagtgtgtggcacctccctctgtctctctcttactcctgctctggccatgtgatttgcctgctctcccttcactttctgtcataattgtaagtttcctgaggcctccctagaagctgagcagatggcagcattgtgattcctgcacagcctgcagaactgtgaaccaattaaacctcttttctttgatatttacccagtctcatgtatttctttatagcagtgtgagaatggattaatacatacagtacgcagacttttggttctggcttcttacactattgcatttatgattgatacatgttgttctgtgtataaccagtttattcattgttattgctaagtagtatcccattgtataaatgaactatatttattccctagatgaggtacatttgatttgggttttgtataaatctgatcatatttggacaattacaaaaaaagctgctgtaaacatttacgtacacgttttcatatgaacatttgattcatttcactcgggtaaatgcccaagagtggattgctgtgttgtatggtaaatgtgtatttaactttatacaaaaccttactacctagtgctcaaatcttagtttctaatacctcattctccaataaaaggaaacagggatttttggagaaatggctgattctaggactagggcaggaaatatataaaatgaacttggagcatcttgcagtatcaaaaattaaataaaaacaaaaaagcccattgatggggacatatcaaagggccacaagggccactgaaagacttcctaatggccaaagcaggaacaatttgagaaacaaagaaaagaaagcggtattggattgtaacccgaattacaaaagagctatccatgtgtccatactgacataaatacatgattgaataaattaacgaatggtgaagaagagatgaatctcccatgcataggaattccaaataaattatttaagtatttcaccacaaaaaagggggagcgtaattccccactccttcagtataggtttaacatagtgacttccttctaaagtgtacagtatggaaaggggtgggaagtggacagaagattaactttaaaggtgagaaatctgacaaacactaccataggcaggtgatcaaggtcaacatcaacagccaaaaatcatgttgattatatgtactcttgatatgatgtgatgaaaatggcacttttacctctttgatcttccctgcaaaaacccataaccaaatcatctccaacaaagaggcaaactgcaatagagagatatcctacaaaatatctaatctgtactcatcaaagctgtcaagcatcagaaacaagggaagcctgagaaactgacctagccaagacgagcttaaggagacatgatggctttacattacgtggtatcctagatgggatcttgagacagaaaagatcagtaggtacaaaataagcaaatctgaataagctatagactttagttgataataacctgtcagtgttggttgattaattgtagcaactgtaccttactaatgtaatatattaataataggggaaattaactgcagggatagatagaactctctactatctgctcggtttccctgtaaacctaaaaccattctaaaaaataaaatttatcagttaaaaaatcctgaaaaactgctttccaaaatggttatatcattttgcatcccctccaacaatgtatgaatgttttgtttgctctatatcctcagtagcacttgatatggtaagtttattttattttatttttattagtaattgtatataattaatactatatcttctcagtaaagtttctgctcatcttttgctcattactggttttctaattgggttgctggttttcttgaagttcgacagaatttggaaaatatattttgaatatatatttgttttatatacagcttgaaactttttctcacaatcggtggtttactttttcattctcttaacagtcttttgaagagtataaattcttaatttttatgaagtctaatttatcaatttttcttttatggattgtgctttcgatggtgtatctaaggactctttacctaatccaaagtcaaaaagattttctcctagaagttttataatttaggttttacatttaggtatatgattcatattgagttaatttttgtataggttttgtaaggtagaaagagaggatacacacacacacacacatatacatatatatgagacacttaatgccagcctgtgaaagcagccagggtgcagggggtggaggctgggggctgtactctgcaaagccacagaggcatagctgcccaaaactgtgggagcccatctcttgtatcagtgtgacccagatgtgagacatggagtcaaaggagatcattttggagttttaagatttaatgactgcccttactggatacatatacacatatatgtatgtcctctatccctacctcatatatatgtgtatatatatatgtgcatatatatatgtcctttattcctacctcaaaaaacctatacaaaaattataatatatgaatatataattacttatatataatatataaatatatatatcctctattactacctgtcaaagtcatcagaaactatatatatatatatatatatatatatatatatatatatatatatatatatttgcaagtgggtatctaattgttccagtggtgtttggtgaaaatacaatcctttctccattgaataaccttttacgcctttgtcaaaaatcagttgatcatatatgtgcaggtttatgcgggactgactattctgttctgtttacctatatgtccatctttgtgcaggtacctcactattttgattactgtgctttatagtaattctggaaaccaggtatggtgagaactccaacttagttctttattgttttttaaagtgttttgattattttagttgcctcatctttccatacaaattttagaatcagcatgtccatgaaatcctgctgggattttgattgacattccactgaatctagagattgattttggggagttgacatcttaataatattgactctttcaatgtatgtgcatggtatatcactctatttaattagattcacttggtttcattcatgctttgtagttttcagcctgtatatcttgcaatattctgttagatttgtaactaaacattttatgcttttagtagtaatgtaaatgaaactttcaaaaacaacacaatttctaattttcattgcagtgtgtagggatacaactgattttatatattactttatatcccatggccttactaattgtagtagctttctttgtgtgtgggtttgtaggggtttctttgttgtctgtgattaaaacagttttatttgttcttgtccaaacatttttttttctgctattgccttgttatactactacaaccttgaagatggtgatgaataggattcatgagagcatatatcctggtcttgttcccaatcttagcagcaagattcagtttttcaaaattaagtgtgatgttagcgtatgttttatgtggatgcctgatacggtttggctgtgtatccccacccaaatctcatcctgaattgtaattcccacctgttgaggaagggacctgtaatagccacatgtcaagggaaggaggtgattggatcatgggggtggttcccccatgctgttcccatgatagtgactgaattatcacaagatctgatggttttataagtgttcacatgctttctcatgcctgcttccccttcctccatgattgcatgtttcctaaggcctccccagccatgtggaactcctgaccatgtggtagaaaagagaaaaaccattttctggggagaaattcaagctggctgcataaatttgcataagtaataaggagccgaatgttaatagccaagacaatggggaaatgtcttcagggcatgtcagagatcttcatagcagccactcccattacaggcccaggggcctaggaggaaaaatggtttcctgggccaggctcagggctcccctgctctgttcagccttgggacttggtgccgtgtcctagctgctctagctccagccatggctaaaaggggccaaggtacagcatgggccattgcttcagagagtggaagccccaagccttggcagcttccatgtggtgttgggcctgtgggtgcacagaagtcaagaattgaggtgtgggaacctttctctagatttcagaggatgtatggaaatgcctagctgtccaggcagatgtctactgcaggggtgaaaccctcatggagaaactctgctagggcagtgcaaaggggaaatgtggggttgaagctcccatacagagtccccactggggcactgcctagtaaatcagtgagacaagggccacaatcctccagtgcccagaatggcagatccaccaacagcttgcacaatgtgcctggaaaagctgcagacacttaatgccagcccatgaaagcagccagggagagggtgttaggggggctgtaccctgcaaagccacaggagtggagctgcctgagatcatgggagcccacctcttgcataagcatgacacagatatgagacatagagtcaaaagagatcatttcagaactttaagatttaatgactgccaccactggatcttgaacttgcatagcacctgtagctcctttgttttggctaatgtctcccatttggaatgggaacatatatccaatgcctgtacccccattgtgtcttggaagtaactaacttccttttgattttacaggctttagacagaaaggacttgccttgactcagatgagactttggagttggacttttgactttgggggactgttggaaaggcatgatttgttttgaaatgtaaaaaagacatgagatttgggaggggccaggggcagaatgatatgatttagctctgtgtccccacccaaatctcatcttgaattgtaattctcatgggttgaggcagggacctgtaatccccacctgtctagggaggaaggtgattggatcatgggagtagtttccctcatgctgttctcatgatagtgagtgagttctcacaagatctgatggttttaaaaagtggcaatgttttcctgtgctctcacttcactctctcctgccgccctgtgaagaaggttcctgcttccccttctgccatgattggaagtattctgaggcctccccagccatgcataactgagtcaattaaacctcttttgtttataaattaccaagtctcaggtagtatcttcataacagtatgaaaatggactaatacaatgccttttatcagattgaagttcctttctattcctaatttcctgagaatttttattatgaatgaatattgaatttagtcaaaggctttttctgcatctattgagatgatgatatgcttttccctctttaatctattcctatggtgaattatattgattggtttttgaaagttgagtcagttgaatacctggcatgtatcctacttgattatgacatattatcctttttgtatatattagtttcaatttgctaaagtttgtggaggatatttgtgtctatgtttctgtgggatatttttctgtagtcctgttttcttgtaatgtctttgtatggttttggtatcaggttaatgcttgcctcatagtgatagaggcaggaggcagagaactctcctagacagataggggagggtccctggagaatctccaatctacctcacaagtgcttacaccagatgattttgtgtagaacttgcacagggggcttacctgaatgtgcctgcagcagactaagggcccacatgtgcactgtggggagggagtggagccaccaggaatttgtgccttatacaaatagggaacccagccccatcaacctttatataacagcccttgaatttagctgtgaagggggcaactgggaacctgctttcaggaccctgctctttgctgagagctttccttttgcttaataaattctactccactcacccttcaatgtctgcatgcttaatttttgctggttgtgagacaagaacctgatctagctgagctaaggagtaaaaaaatcctgcatcattttggtggcccatatgggcacctgaagaagggtgagtaaaatgcagacccccaaaacctcttttactttcatttcacagccttcttgtcctcagactttttctgaaggtagaggaaaaactgaacctctgattagccaattaagaatgaatggtggcacagctacagaggaggctcctctccacacctattgctctcaggagttgggaatgtcgactttgttccagtctagtcttttctgtggcatatttcttcttcttttgggatggtcatggcacctatctcctcttttacaatgttaggaaggctgatgcaaactgttactgggtagaatgagcccttgccccagccatcagatgtgcaatttagaataatgtaatttccatctgttgttagaagcatgtcccctactcccacttcagtggccacaggttggttcaggggatggacgggtgagcagcagctgcctgcctctatcccctcccggctagggtgcatggccatatgtctgccacatgtgtgtgctacatgcaatggccacgtggggtgggaatgagccatgaccactgcccaggcccaggcctcagggcagtctcagggaccaagggccccacatggccagctagccagcatttcccgctcactgtcccctcctgtcacgtgcccattggagtgtttcctccctcctggcttggccaagccaggagggaggaaacagcaattaaaaggttctctcccagttggaggaacccatttgcataagaagttttttccctaggcatcttccccacccacgcgcttaagctggttttttttttttttttcctagtctctatcctgtcaagtgttaacttctatgagagactttttttttttttcacttttgaaaggcattaggccaggaccccaattcacaagacatcttttcactcccttgttcaaggaggacccagctccacagcttcaccttagcatgactaattcctgtggattcgtccatttcctgtttcatggatagaggtcatgctagcatccatgggatagacaaggtctggggaactcaaagtttactaacaacagggggacaagctacgcaagggtaagggtgggtaattcccatccctgaggccccctgttaacatgggtgaaagttgcattgacacccagaggtggcaccctgtcaaggttgccagaacttaggcatgtaaggatggaagaaggagagagggatgcctcttctttctctcccttacataccccaggtatttactaggaaggaaaaggaactacagatgcctgttcccctctttctagatgggtaaacaatcatgttcaatctctgcttctcttgaatgcctcctgaatcactgggacgcctttgaaaaaaatgccctctttttcctttttcctcctctgtcctcacaccacagaatatgtggtggtgttctcataccacaggatactcccctcggatgcattccccaaactggagcaagttgacttccccaaaccttaaactgctaggcttaaaattgagcttcgtggaagggaacccagaagcctgacatgcaagccaaagggtaaaagtttttaccagtcagacttctggcctccctctccctgtgcaaactggttgaatgaatgataaaatcactgtttatatcctctgtaaggtgttcattaatggaaaaaggacttgtgaggctagtcttaaggtgtacccaatctggtgtgctttgggtctttgtgtatgattttgtcataaagcatacattaggatagaatgcagacctaggactctataagcccagtgttcaaagccagcccagcaaactggtcagtaacaaactttgttgcaggtctccatcttgttttatgtctttgggagtgtgacctgtaaccacgtggcaacctataaccaccacttggttttggtctctgctatttaacaatggtggcctggtttcaatcttggcatagagaacgagtactttctggttaatatctgtgtgacttttaccatttgctgattctctttcactccatgaacaacttctagcttcctttattaaatattcctttctctgaaccacctttaaagattctagattttgtaaaaactgcttaccacctctttgaaaatacctcgtatacttgcagttaagccgtaactttagttgaggcttcttgtgaggttactttggtaaagttcaaaggccagaaatattggccacttggcatggctaaagtcaagtaataagggatttgaaaagattttcttaaagagcacttagcttaattaaaagtggatagctaagctataggtattttaaaaaggcctttacgtttttctctccttggatcttgtttttctggaaaaagaaagaacttttcgtgtttttttctcagccaactgaattatttttctccgttttgtcttgccactcttagtgcatgcatgagaggccctaagataacttctgatagcctgagacttctgggaaaaagcagagaaggagccacaaaccccattttggtaaaaaaccctctgttttcctcaaggaaccccaggaattaaaagtggatagatccctctcagaatctgtttctgtcttccagctgtttctgcttattaggctctgttagaccacatactttcctagccctgtttcttggaaggctccaccctgatgccaataatccaattaggagattggcaaatgaaaaatcttacaactatggggtcttcttctgtctgtctgtgtaatcatcatatatgtattatgtgtggatggttgtataaaaaagagctctaattgattggcctgaagaaaaataagtgcttagatcaaatttttttgaaggaaaaataaaaggttccaccctaatccaattaggagattggcaaatgaaaagtctcacaactacggggtcttctctgtttgtctgtgtaatcatcatgtatgtattatgtgcagatggttataaaaaataactctaattgattggcctgaagaaaaataagtgcttagataaaaatttttttgaatgaaaaataaaagctgtaatgccttttagttaaatgtgactttaaggaataaaaacagttttgaagatagttggtaaaatacaaatgtcttcaaaatgtaaatatgtggtctaaattatgtgggtcagatactaggtttgctaaatgttttaaggttataaactacttctttggcttttgagaactgtttgacttgcctgcttcacaactggtaaagcctggggacatatggaattaaccacacccttaactatgctcgaaagagtcacaccttatctgtgcatagtacataattaaaatataacttaccaggttttacactaaaattaaaaattgctaagagttgccattatacatgtaattgagactactggaaatagattttatatgcaaaatgtgtaaggaaagtaaaatgcatttttagtaaaagattattagaaagcatgggaatgtaaatttctcccaatgattaaaggattgttttgaattagatacgataaagctagaggtttaaacaaatggtggaaggtttgtaaaaataatcttgtaaaagaaactctgtgtgtgaacatattaaccgaaatttataaagggttataaaaggtttaataaaaatcttacctcatggtcaaatgattaagattggatagaattatctataatgtttcattaaaaaaattggggttgaccccatcaaaaagtgggcaaaagatatgaacagacacttctcaaaagaagacatttacatggccaatgaacatatgaaaaaaagctcaatgtcactgatcattagagaaatgcaaatcaaaagtacaatgagacaccatctgatgccagtcagaatagcaattattaaaaagtaaagaaacagtagatgttggtgaggttgtggaaaaataggaatgcttttacactgttggtgggaatgtaaattagttcaaccattgtggaaaatggtatggtgattcctcaaggatctagaagcagaaataccatgtgacccagcaatctcattactgggtatatactcaaagaaatataaatcattttactataaagatacatacacacatatgtttactgcagcgctgtttccaatagcaaagacatggccaacccaaatgcccatcaacaacagactggatacagaaaatgtggcacatatacaccatggaatactatgcagccataaaaaggaatgagatcatgtcctttgcagggacatggatgaagctggaagctgtcatccttagcaaactaacacagcaacagaaaaccaaataccacatgttctcactaataagtgggagttgaacaatgagaacacatggacacagggaggagaacatcacacactggggcctgttggggggtggaggtgaggggagggaacttagaggacaggtcaataggtgtagcagaccaccatggcacatgtatatctatgtaacaaacctgaacattctacacatatatcttggaacttaaagtaaaattttaaaaaataaaaataaaaataaataaaaaaattattgatccataaaaaaattgaggttgacattaatagactaatacaagcataaaatctggctttttctccctggaacaatattttcatgtaatagtaaacaataatgaaaggtttttgccttttaaaaaatttttgagtcactattttggctaaaataaattatggtaatttggaattttatttcataatatcaagtgctttgaacctctaacatatttaataggcttccccaaatcaaacttcagcttcaaaaattgtcttttctgaccctcaccttgtggatgctacagagggcccctggaatattcaaaaagagaggtaaacagaattatttgatgtgtttagttatgtgggattgtcaaagtgacattcaatctctttaggttatattttagtaaataatattatgtcccaaaattctatgggatgtctaaaattctaatgtctgagtatatgctatcaatcataattaaggttattatgttaaactattgtaaaccacagaaataagcaaatttcattgtcaattgtgttttgactgtaactaccctggatattttgtccttcacagacaattgttgtcttgctttgaccctttttcaaaagatggtttataatcagctataggactttgacatgtgctctcaatgcaggtttctgataactttggagattttgacactggaataaaggaaaaacatataagactcatgaagaactgaaatgttcatgaatattaagcagaacaacagttaacagaatggactgaactgacagaaaactgaagtaatctttttaacctttttgcctaaagtgttgctgatccttgttttgtttttcagagtcaaggaaaacagtctttaacaattgattaagatatactcctgtgaataaaatttggaacgtatttgtttttctctgcctggcttctccagaatttggaaatcatttgcttgtgaatattcttaacttatggcaatagagttattttcatcagtgcaataagaatccattttctgttgcaacaggacacaattggagaaactgattatttcactcgggctttgaatggaaggttgtgcttccctttaaggaatcaagcttgacctgcagagccaataagagccctttgggaaaactggcctcataccttgtctacacagtccctgcacagggttcctaacctgtcatgaataaaaaatgtcactaacaggcccaggagccccatattcttgggacctcaagaagagaggaatttacacaactcataggtatttgagggtacaaacccctggctgggctcagctttaacaggtcttatctgggattccttgtggaacagagttccatcaaagccaactgaaaagccaatgtgaaaaataattcttgctgcactttatgcaaataatcaaaccaagagactaaagtttattttgcaaacaactcagtcctatcataatttgtttttgacaaaaatgaggactggagagagaaaaattatgtttcaaaacttatcatacatttgtcattaaattctaatctcattcattgtttttaagtttttgcctacattttagactaaccctgcttattcctgtgaacttaccagtgatctctggctgcatctcagaagaaacaaaagggttgagtattgtaaaaatctggatcaatattttaatgctgagtaattatcctgcaaatcctgctgggtgatgggagtaaatagggtgcccataacctggaggtttctttgtttgggaaaataagaccaagggagctaatcaaagccaagccccaggcacccaaatcttagcaggcataactatagccaccagttatctgggtatgttggcagccttgggatttttgatctgtccttagccccacttgttttgttttgatgcatgtcttctaataacccagtttttcttttctcaccttcaggctgtcaaactccaaacagttatgtaactggagcctcaaatgatggctcctttttaccagggacccttagataggcctctgagggagtcctaattgccgttttcccaaaacagcgccccctgtcagcaggaagtagttaagactggccttcctctctattctaatggctgttaaaggcacctcgggaaatgatagaggcaggaggcagagaactctcccaggcagataagggcgggtccccagagaatctcctgaccagtcccacaagtgcttacaccagatgtcttttgcagaaaaggcaacttgcacattggtcttgcctgaatgtgcccacagcagactaagggcccatgtgcgccctggggggagggggtggagccaacaggaatttgcaccttatacaaatagggaacccagccccatcagcttttatataaaagcctttgtattcaactgtgaagggggcaaccaggaacctgctttcaggaccctgctctttgctgagaactttcctttcgcttcataaattctactccactcacccttttatgtctgtgtgcctaatttttcctggttgtgagacaagaatccagatctagctgagctaaggagtacaaaatcctgcatcaattaaatgtgttcagaagtattgtctcttattgtaattctaggagaggttgtatagaattggaagtatttcttatttaaatacttggcagaatttacaagtaaagccccctgagccaggaggcttttgtttatttgttttgtttttttaaattataatttattttctttaagaataaatgctacagcaaaaaaagctatcattagagtgaacaggcaacctacagaatgggagaaattttttgcaatctatccatctgacaaagggctaatatccagaatctacaaggaacttaaacaaatttacaagaaaaaaacaaccccatcaaaaattgggcaaaggatatgaacagacacttcctaaaagaagacatttatgtggccaacaaacatattaaaaaaagctcatcatcactggtcattagataaatgcaaataaaaaaccacaatgagataccatctcacaccagttagaacagcaatcattaaaaagtcaggaaacaacagatgctggagaggatgtggaaaaataggaacgcttttacactgttgttaggagtgtaaattagttcaaccattgtggaagacagtgtggcaattcctcaaggatctagaactagaaataccatttgacccagcaatcccattactgggtatacactcacaggattataaatcattctactataaagacacgtgcaggcatatgtttattgcagcactgttcacaatagcaaagacatggaaccaacccaaatgcccttcaatgatagaatagatgaagacaacgtggcacatatacacgtggtatactatgcagcgataaaaaaggatgagttcatgtcatttgcagggacatggatgaagctggaaaccatcattctcagcacactaatacaggaacagaaaaccaaacactgcaggttctctctcataagtgggagttgaacaatgagaacacttggacacagggaggtgaacatcacacactggggcctgttgggggatggggggctaggggagagatggcattaggagaaatacctaatgtaggtgacaagttgatgggtgcagcaaaccaccatggcacatgtatatgtatgtaacaaatctacccgttctgcacatgtaccccagaacttaaagtataatttaaaaaaagaataagtactaaatagaccctctccctctttctttcctttctctcatgaatttttggcaatttgcgtcttttaagggatttgtctatatcatcaaaaattttgagattaaggtatagaattgtttgtagtattcttttatattttaatggtttgtacagtctgtaatgatgttttctctttcattcctaaaatttgaaatttttcttttttttctctttcccttgggcagtctggctataggtctatcaattttgctggctggctttgccaaaccaccatttattggtttcactatttttgtctgttgtctctattttctgcttcatttctcctatttattatttcccttcatctgcttgtttcggatttgtcttgcttactttcctagttttttaagataaaattttagattactaatttgaaacgctttttcatttttagtataagcgtttattgtcaaaactttcctccaaagctctgcttttagtaagttccacacattttgatgtgtggtatctccgatgttactctcaaatggtcatcagagcacctttagccaaacattagaattacctgtggtgcttgaaaaaaaatgccaatgttcacccctaaccaagaccacatgtggtagaaaatctgggattgggccctgggaattcctttgttttagaagctccccaggttattctaatgttcatctaaggttgagaattcctgctttaatctcattaaaagtgattcccaatgctcatgtgccagtgcttatctggatgcgtgtagaaaatttaaactattgtaccccctcctagagctttgactgagcaggtgtacagtggcccgtggaaaccactatttaaagtttttaaaccttaaagccactttaaaagttggaaatcactttttaaagtttttaaaaagtagcctatgagattctggtgcatgtgggtctcaaactacactttgagaaaatctgcattaaaattcataaaataaaaagcgagttcctattgtagtcccagctgtatgcttttcaaaaggcaaaaaatagcctgagtactgttgacaccctgggagagggtgccctcctccctttctgctgtgctggcatagaccaattctaggatggcaaggaggtcttccgtactgggaacacctgagatgccttcattcttgctgctgctccccttaacatcatttttgcaaggccaaggagaattactttaatagatttcaggtctttgtgcagtttgctttgtctgaatgcatcctttcccctttgcgcctagctaactcactcctccctgccatatcatccaggaagctttctctgaccttctcccagactggaagtctgcagacttctctgatctagattaggtgcacctccttgggacctaatatcttctctgcctatcactctcagggttaatcatctacttactcatctgtatccctcactaaaccccttgaggacaagtctagtattctgtgtcttcagggtttagccttgggtctagaacctaacagatcttcagtaaatgtgaaccaagctgatctaaaatgagtgcttttcaaatagaggacaccccaacaagtccagcttcctactggtttttgtttagggtgtggtcagagtagcaacctcccatttgctctatattgaaaatcctgaccatcaggaacctaatcaatgcatgggtgtaggaggtggaggaagcacagctggctctccagtctccagcccagggtctggcacatagcactggctcaggaatattgtttgattgaacgaccagaaggaaacaaagttggaaaacgccaagatatattcaaaattaagatgtggtggtcccacaaagtcctgaatcatcgaagaaaaactcatttaacttattgtttattagatgctaatcacactgaaatatccaaactcatttccaggctttctaagtagaagagacttagagaagaactcactttttttccccagaaaagagaataactgagactatttctgcacattccagttaatggattaatgtaatgaatgttggtaggtcaaataatgcagctgtgtaaacatttgtttaagctgctgccaacaaagaagtttaatctccctgaaggaaacttcatttttagtcccttcggaaacatctatttacaaataatcaaattgatatacacagtatttctcaatgtacatcccagggcacttgtttatcacagcatgttgtattttgctataggcatttataaataataaaattgctttttaaaaaaataatagaaatcccttcacattctccatagttattcaaagcaaagatagtttttttatatagaaataattgcatgtgatttttcaatttaaagaatgaaattatgtcctttttggtgtcacatcagttaaagggtaggtgatatgactgtctttttgtgtgctgcaaggaggaggaatcagttaagctttgaagactgggaaaaaaggaagagttgaggatggatgaagtatatcactggagagtacttactagaattcatcgactcagacttcattcaataagaaaatatttattgattacctactatgtgttagccgctgtttcagaagcttactgctgaatgatgatgcaagaagattttcacgaaagagattgtggtgaggtagaaagagctctgaacaaaaaataactgattttagttctataaatgccttgggtaacttcttgtcctcgctggtctctatcctgtatgtatgtaaaaagagggtggtgggattgaaccgcatgatctccaattcctatatgtctctgccaccaaagtaccaccagatgactaaaaaaggaaactttgcataggcaatttcaatgtgggaagagtacaatatgttaaggtttaatagacgaacaggccgagaaagctgtgtggctggcataatagagaaggagtgttcatgattctttttgaagggagcgtggtaaactgggtggcagataagtggaagagttctgaggaaattgcagctgagaactggatctatttttccatgtctccatactctcatagatatgggctctagtaaaattgaagccaggctcaatgttagcagcatggtgtaccagaaaaaaaatgttttatgatagtcctgggttggatatttttctgtccaactcgattattagctccctgtggtctccctttcttatttcctatctggatggtgttggaaagtgtctaatccttttagattaaggttgatgcatacattatatgagttaatatatatgacacttaatatatgatactgagtaaattcttgaacgtcaatttgttttcttgctagtataaaagtacaatgatctgggatcttctattagccaaattgtgaatatttgcttaactaaagaattattctctcataaagataatgatgactcttatgtttgccaccttggactggagtatatgttttctttgacaagtatttcacaagtataggcttctaagtgtcatttccctatgccccattaccccttttgccaatgcattatccacctgctgttggagttttctttctaaagcacagttctgatcatgctactcctctgctcaaaattctacattggctccctgttgcttacacaacaaaattccacccctgtgcttgcattctaagctcaccatgattcagattcaccatgtctttccagcctcatctcacatcatatcactgcatgcacattaccctctatttcaggggttctcaaatctaagtgtgcttcagagtcacctggatgtcttgttgaaacacatgtttctgggcgttatgcccagcatttctgattctgtgagtctaagagggagccttgaaattttgcatttctaataagttcccagttgacactgatgttgcttatctagggactacacttttaagaaccactgttggccaggcgcagtggctcacacctgtaatcccagcactttgggaggtcgaggccggggggatcacctgaggtcagaagttcgagaccagcctggccaacatggtgaaaaactgtctctactaaaaatacaaaaaattagctgaatgttgtggcgctcgcctgtaatcccagctactcgggaggctgagtcaggagaattgcttgaactggggaggtggaggctgaagtgagccgagatcatgccactgcactccagactgagcaacacagtgagactccatcaaaaaaaaaaaaaaaaagggagagagattgagaaccattgctctaacaacaccaaatgctggttcttttggaatatatctagtgtctactttttcatcttagcatttttctgatgctctttcctccttccttgggctccttctattggtagaattcctctcatttttaaaactaattttactttcttaggaagctcgtactaatcactcagtcagtattaaagagggagcactgactcttgtttcccttcacaacatgctgcttgtactctgctttagtatttataccattctgcattgtactagagctaattgtgtttgtcctcttgctcacattcagttgtcaagcccatgaaagaagggaccatatttcattaatcttcgatcttcaaacgaactgaatttcatcatggtgcctaaaagccagccccagtaattacacatctgttttctttaaaatgtatctgattattgcagcctgcagaagacaacaatcttatgggtggcagccaccctgccttttgaggtagaaggatatgcaccatttaagtgcctgaacaaatggattccatcagcaacctgatagagaaatttaccaaggttagaaagaaaccagcctgaaatgttggggtggtaggtttcagagctgcctgtataataaagatgctgaaccccattgcagtaagtcaagctgtcacagggaacactatctaaagccaactccaatctaatgaggtgtttgaattattgttaaaaggaagaatgccagaagctatttcttctctgtggattgtgctttcctataccaaatgtacaggaaagaaccaggggaattagtaatgaagccagagtaaatgcacagtctggagaaagttttgttcaatctaaatttcagagaatgtaacataatcaatttccttaaatactctgtcagtttccaaagagcacagagtgaacccaattctcccatatgacaccccgctctctgttagtgggaaaggtgcttgttagcctccctcctactccagtttctctgcccctgctttcctcttgaataccaggtcctcttcccttcttatgcctcatactatacttgggcattccatctgacctgacttcctctgtcatctttttgctgatgaccacgtctttccttgggctccttctattggaggaggatccaatagaaggttccagcctagatcctcctcctgagcctcagatccctggagccaataattttctcttaattctccttggctgttccacagtcatctcagattcagtatctccccaaattaactcatcattttcctggtactttggttatttgtagggtgtctacctcaaagaacaaggagttggtacaaccattttagaaagctgttcaatcatttctactaaagctgaatgaatgcacaggacatgaccccaaaatagccaacagaattgcttacatatattcaccagaagagatgtacaagaatgtttataccacactatttgttatacctcccaactggaaatgatccaaggtgtctctagactgtagaatgggtacatcattgtggcttattcatacaataaaatgccattcatcattaataatgaacaaaccatgtggaacaccatgagtgaaccctacaaacataaggttaaaaaaaagccagaagccagatacagaatatagactgaatacttccgcttgtataaagttcaaaagcaggcagaatgaagctgtgttgtgaaaagtcaggagagagaatacccttggggaagtgtgatgggaaggaaccctgagagcttcggggatactggtaatgttctttttctcaatctggatgctgatttacgtgatggtgttcagtttgggaaaattccttgtatggcacactagagagctgtggacttttctcaatatatatgtcaataaaagttacaaagataagtaaagaacatggatcactgctctccgtctctttcagctgctgagagttcagccttcagtcctggttctgtcattttcttatgctgggtaactttcctatgtggctatgagggcccttggtggccctcatccccagtagaatgagaagacatatgtgtgagggcacagtatgtaaggtttagtcagagtgatgtttctaaccatctggttagctgttcaggcctccatggctttctacgcccaaggtgggtccccatgaacactggcctcagtctaaaactcagcctgagaagagactgcatgttgaaactctgtagtatgagtcacttgtggacatagattccctatgtaggaagctaaacaggtgtttggtgtgtgaatcaattttatagtctccaaataaatggaatttaagagctgctgttggctagaaacccagatttgtatcgcaagtgggatagagtccattatcagctgagttgcagcattcgtcttttagttagcagataaactctggaatctctgtggctaaaagataaaacctgaaatctcagagtattaactcagtagaagtttatttctagcttttgttaagtctaacagcagcagtgttggggagatggggctggggagagaagaatccacaccatgcagccgttcaggctttcagaagctttggtgtcttcaacatgtggcttccaaggacactttggacactgacatccagctggcacagaggaaaataagagtggaggactgtgcagtaagttttcacagtcaggcctggcaacagcatctctcatgtctttccagtttttattggctagaatctggtcatatcactgcatctaacagcaagggagtctaggaagtatggcccagctgtgggcatggaagaaaggaaaacaaatttgatgactagctagccagtgtctgccacatttagatttacctacaagcagagaaaaactacatagtattgaaggtggatgtcgaaagcaaatgtgatcctctgttgggtggaatatatcacagatgtggcactaggaagtaagatttcctgcctgatgagctgaggggagacatccaaaataaaactgtgcccttattgcaattcagagataattttttgttcttttggtgctacaagctgaaaatggaacactgagaaaatgtgtgagcattccatggtgagtaaacagaagaggaagactgactttcctaattagtgtcctcccactgcaacttttttcttctacattgtctcacattcacacagtcacctaagcctcacattgagagaagttcttccatcttcatatttatccatatatttactatgacctgccaagttcgtgccctacattgtattcactccattgcatcagtgcatttctactgatgctcttccaattctggaaatctagttctcaagtgggctactgccatatgtctatcagatcttcccacttaccatctctttcctttgatctagtctccacgcattgtcaaaatcatcttaaagtaacgttgttcaagcattccagtgactccccattgcctgtaaaattaaatataaactcctttgtttgacgtatacagcattactcaatctagactcaaaatgcactgttcacctttatctctggaaattgaacaaccctaccaattctgtattccagcctaccctaactccttgtcatactctgtacaatctcaagtccatttcacaggcttccaagcatgccttttctgggcttcacctggtgagtccctaatcattaataaaacctaactcaaatgtcacctctttcttgagacttccaaagctccttcagggagagttaattccagtaagacttatcttggttatagcactcatcacattgcattgtattttcttgttatccacctctcctgctatattgtcctggaaggcaatgtagtgtgggggaaaaaagacagaatttagaagtcagattagacctagatttgatttctaccatttcacatgactacctatgtagctttaagttacctaagctctctaaactacaggatcctcttctgtgaaatggggatggtaatatttcatatgatatgtatacaatgtcttatacaggacaagaaaccacatgcctaatttatttattattccccagtattctcctcctctttcttgtattttgtcttatataaaaggctatctttcagtaaaggcatacaataaaggttttc
